United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 16

SEQ ID NO: 63608 - DNA, 1056 bp, Glycine max
  Peptide Sequence Number=SeqID_180386
atggaaagaccagtgattcatgttgatcctctcactgtgaaagccgatggtccccaaagaatgaaattaagaacatgtttggggattgtcacttgcgataaggtggatgtcacatgtaataattggaaacaattccctgtcactcaaaaggatatgatttgggaggatattcagtcagatttgacctccaaatgggctctagcgcacgataaggaaggtgaggatgacaaagtctgtgagaagtatggaataagcaaagagaagttgaaccaattttgtcagagccataaagacccttcatgggaggatgttcgaaacaaggcacataccattcagaaacaaaacacttaccctcacatgttgtctcgtgagggctatgattttctagaaaaaaaattgatggaggagaagcaaaagaaacgattggaggaagcagctcaatccgggagcattgacacactcgttgatcatccatctcccattagatggcacatgaagtggaatatggcacgcacgaagaaaactggtcaaataacgtatgaggcaacaaaggaaattgtagacaggattgattccttggagaagcaggcctcacagggaagctttgtcgcccatggacgtcaggatgtactgactactgccattgggcaaccagagcaccctggttgtgttcgtgctgttagagctggtgtcatgattaaaaactactttggaccggcttcaagggactcctgcatctctttgtccatggctgttgaagacctaggtcccaaatgtagttgcatatgcaatcacagggactcgcactgcctcctaaggttgagagtttatgaagggtccacaactgtccacaatgttcctttgggcaatgatgaagtaaaggtcggtgttgaggaagtcagagatgctgattctcgtgttcttgtaccatctcaagaggtagctgcgggaccagcaaaacctatagatatgtcggatcctgatatcgatcccctctacctaataacattgaccatcccgcagcttttcctcaaagtcgttgcatgtgccgtgtga

SEQ ID NO: 63609 - DNA, 453 bp, Glycine max
  Peptide Sequence Number=SeqID_180387
atgtgggatgtagctggagatgatattggatcacttgatgattgtgttcatccgttgcatctaggatcggattatttgtttattatagaggtagggataatgagtcgtgcacgtgaatggcttttctattctgaaggacagtggatggtggtcagaagctctaaagcagctcgtctcataatgcttccaagcaaatctgtgactttaggtttacttggatgccggccattacattcggataccagcatggaggagattcagaaggatttgtctccattggttacgcagttggcacctacagaaaatgacaatggagctaaaataccgtctgtatcttgtaccagttgcatttttgtgattttttatttatttcaagcaattttcatgatggcaagtgaggggatcaaggagcgaaacatcattcacaaggtcacatcttcattaactggatga

SEQ ID NO: 63610 - DNA, 210 bp, Glycine max
  Peptide Sequence Number=SeqID_180388
atggaggccatgaaagagcaaatggccacaatgatggaatccataatgagtatgaaaagagtgatagaggtcaacacggctacagccattgccgcaagtactgccactaaggtgtgtcgcaacctaccttttggcgggaaggcgaggcgaaacgtaaaaatgtgtcttctcatgaagaaaatgtgtggagtctccaccaacgtttattag

SEQ ID NO: 63611 - DNA, 495 bp, Glycine max
  Peptide Sequence Number=SeqID_180389
atgtacaagtgggaactggcaaggaaaaaattgagaaagtgttctcaacagctcgctctaaggcataggtgtatcactgaaatcatgctaggcatcaagactcagcaaactgaactgcaacaaactaaaaagagctgcaaaatttctcaaaatggggtcaaagaagaaaaaagaccttcccatgaacttctcacatccaaacgagagtcaaaggagctacatttggcatttggggaagggaaatcaaacagaggcatgcaacgtaaggtggctctaggatatagtggtttaatgaaaatggagatttcttggaggatcatatggcaacatcattttttatggtgtaaaaggagctacaaaaatccccaaaaatggaaatgtagctcacaaacccttaccatgaagacaagagctatgtttaaacctgttgttgagatcaatgctgagaaagagagttggagaatcatggttagattttttgtggatggcatctaa

SEQ ID NO: 63612 - DNA, 132 bp, Glycine max
  Peptide Sequence Number=SeqID_180390
atgaagacaaaggaaataatgaagggtcctgtgagattgagaaaggaagaaggacttcaaatgacaatgcgagaaggagaacaaatagtgcaatttagcgaggaatcagcaacgaagtatgtccctcactaa

SEQ ID NO: 63613 - DNA, 372 bp, Glycine max
  Peptide Sequence Number=SeqID_180391
atgttacaactgtggaagaaccttcttccgggccatctcacggaagaaggttcttccttagttgtaaattacaacaacggaagaactttcttccgtgaattcttgggaagaacttcttccgtgagatcgcacagaagaaggttattccacagttgtaacattaaatgcggaaaaacctttttccgcgccatctcgcggaataaattctttcgcaggaagtcacagaagaaggttcttccacagttgaaaataacaacagcagaagaaccttcctccgtggattcctgcggaagacgttctttcgcgagatcacatggcggaaggttctttcgctgttgttattttcaactgcaaaagaaccttcttccgtga

SEQ ID NO: 63614 - DNA, 384 bp, Glycine max
  Peptide Sequence Number=SeqID_180392
atgccctcctttcgcgatttggagcagaaatgggcaccaaaggttgaagctttgttgggcaacaatggtggaggaagaaaagaagaagaaggctgcctatgccacatgtccccatttgagtggagcaaaaaagggcccactttctcttttgattgtgacccatactcagccacaaaaagtgagaaaaacctgacctttgaaacgctaaaatcctgcctcggtttgcgtgccgtttctctggttccagttcctcgcgtttctctgcgtccgtcggggccagttttcgaaagcaagcaatatatatgtcaaaacgctcagaataaaaccccgagggtggctcagaggttggttttgttaaattttaagttgcacgcaaaacgatga

SEQ ID NO: 63615 - DNA, 921 bp, Glycine max
  Peptide Sequence Number=SeqID_180393
atggagaacaggatgagttttgatggccgactattatccggcatgagcgtgctggcagccgtggttgaagccggcagcttcagccgcgccggtgaggtgctggggttatccgcctcgggcgtcagccgggcgatttcacgactggaacagcgtcttggcgtgcgcctgctggatcgcaccacccgcaccctgcatctcaccagcgaaggtgccagcctgtatgagcgggcagcgccgcatctggaagggattgaagaagcagcaaactacgtctccggcgccgccgtgacggtgcgcggtacgctgcgcgtgagcctcaatccgctgttttcccgctatgtgctggcggcaaagctgccgctgctgcgtgcccgttatccgcatctggaactgacgattttgcagcagcccgatgtgggcgatctggtggcagaaggtattgatgttgcggtgcgtttcgggccgcagccgccgtccaccatgacctcacgcttgctgttacaaacgcgcgtcctgacggtggccgctccggactatctggcacgctgtggccgcccgacgcagccgcagcagctgactgagcacaattgtctgcaatacatcgatccgcgcagcaataagccctttagctgggagtttcatcgcggcacgcagcggctgacggtcgccacccacggccatctgaccaccaccgatccggatttaatggtacaggcgtgcgtcggcggtgccggcgtagcccaggtgctggcgctgagcgtgcaacatctgatcgccagcggtgaactggtcgaacttttccccgactggcctgacgaaacctatccgctgtttatcacccggccttcgcgccgtctggccccggcggcggtggaggcatttctcggtttttgcctggagatttgtgcggaacagagctga

SEQ ID NO: 63616 - DNA, 541 bp, Glycine max
  Peptide Sequence Number=SeqID_180394
cctggtccgtgctgcgcgccgccgggcgcattgccacgctggtggagttcggcatcacgcctgccagcggccatcacggcgagtttgtcttcttcgccagcgcgacgccgtatcttgcccgggcgagcggcctgttccaggccgggcagttacagaggcttcaggaggaaacgtgctgtttaatttcagagccgcgggcaagcgcgcaccacctggcaaacgctcgctgacatccatcatcattctctatcttgcgatgctgtgcggtacggcttttctcgcgtttctgccgctgatctgcgcgatgggcgccggatatgtcgccagtctggcaggctgccagctggacgaaggcaacgtgcatccctgttacatcctgggagaagatcgcggccagttgctgtatgaattaggcgtcatgggctggttcctgctcggcaccattcccctgggtgggatactgttgttactcgcgacgctcaccttcatcgttcagctggtgggctattaccggcaaacacgcgctgagggtaaccggtaa

SEQ ID NO: 63617 - DNA, 272 bp, Glycine max
  Peptide Sequence Number=SeqID_180395
tgggacagcttgcaaagcaattagcagatagatcatcaagcagttttacagctaatacagagaaaaatcccaaggaggagtgtaaagctgtgatgactagatgcagaagggcaatccatgtggatgagagtgaagctgagaaaaagatggaggaacataaacaacagctggcacctaaggcagcacttgaacctgtttatgattttgtagaacttgaagagattaatgaggatgctaaagataataaggaagaagagacaccaataaaatag

SEQ ID NO: 63618 - DNA, 264 bp, Glycine max
  Peptide Sequence Number=SeqID_180396
atgcgatggatatacgtgagatgggaaggggaagagagccgcacaaaggcactatcgttgtggtggcccatcctgacaaagggacaatacgagagtaatggaggaagaccgtgttgtcatagcacgacaacaacggatcaccattgtggaaactttccacggtggcatttagagcatgatggagtgagagagagaacaagaggaaaaaaaggaaaagaaggaaactgcaaccatcaaatggtttctgattggagttattgttag

SEQ ID NO: 63619 - DNA, 318 bp, Glycine max
  Peptide Sequence Number=SeqID_180397
atgtgtgtatgttcacaaatatggaaatctgagttgctgaacctaatgcaacacccaatgagatgtcttgtgttcaagcatgagggagagatcgttgtttcgggtgctagcttggaaaccctagctttggttcggaggggttggtggtgttgcgatagcataagcggccggacgaccggtggtggggtctctgagggtttggaggaaaggagtgggatgcggcaaggggtggagtggttgagagatgagcgagaacaaaaagggttagtaaggaaccaatacgaaggcggttcctccttcaaacccgtcgtagtttaa

SEQ ID NO: 63620 - DNA, 315 bp, Glycine max
  Peptide Sequence Number=SeqID_180398
atggagtttctcaataatcaagtataccaatggagcgttgcacctttcaacattataaggaacactcgacacatgattgcattgtcattcatggacagattaattcatttgtgtgatgaatgtgttgacatgttattctgggtccgagagtctatcataatgatggatggtcaacatcttccatccaggtgggagttaagcctccataatcttgtcagtgaaaggatgaagctaagtgtcaatatttgttgctctttggactggttgtgtgacaaaggggttccttcacatcacattgcatcagtcgcgtcttag

SEQ ID NO: 63621 - DNA, 273 bp, Glycine max
  Peptide Sequence Number=SeqID_180399
atgaaagacataacatgtgatcgggaccatgaaatagaacaagatagaagtcgagaacacagtaggactcatgaggcaacagaagcacaacgttgggatgagaataccccacttgaaacttggcttcaaggtgtaatcaacacgatgactggaggattcgcagaggaaagaagttcaaactcgtttttaagtgaagatataatggcaagggaatgttacactacaagcctcaatattgccaagggaaagaaagtgatagagcttaaggagtaa

SEQ ID NO: 63622 - DNA, 330 bp, Glycine max
  Peptide Sequence Number=SeqID_180400
atgtcacccacggtgagtgacatatgcccacaagcaccctaccaagactccaaaacatatcactacgtcttcagtgcataccacccatggcgagtgatatgtatgcaatgtatgcaagagtacggtgctcaaaacccaagtcggaaaattccctggtcaatcctccaaagggctcgcgaaacccaaggtcctcctttggtgagtcccactgatagacaccaccgtgtctccagtacctgccactttgtaagaggcgtgtatgtaagagcacaatacttgcactgcacgcaagactcagcaaacccaaccttcgcgcttgctgatccataa

SEQ ID NO: 63623 - DNA, 366 bp, Glycine max
  Peptide Sequence Number=SeqID_180401
atggtggtgagcttcttcttgacgcatcttttccttgaagtggcgtctccaatcatctttcttccttctccatttcgctaccatgatcttcaagaagcaaaggacttcattgataaggaagatacaaggcctacaagctccaatggagctacatcagtcttgcttagcgagtattttttttccagtgatcaagatgattatgaggttgtacaaaaagtgggcagggggaaatatagtgaagtttttgaaagcataaatatcaatagaaatgagcgctgtataatcaagattctgaaacctgtcaagaaaaaaaagttttactcagtacctgcagactgtgaattaagccaagcaatgatgctttag

SEQ ID NO: 63624 - DNA, 350 bp, Glycine max
  Peptide Sequence Number=SeqID_180402
atgaacccttccacactcaccccttcccacacccaccgtcctctcctcctaccctctcccttctacagcagacggcatcgtttcagagtctccctccctcgctgttcctccgacgccgccgctccctctcctccgccaccgacgccgccgcagcgaccgcccaaggacctcaagggaatcgagctcctcgtcgacaagctctctccgccggccaggctcgccacctccgccgtcatcgtcgccggcgccgcggccgcaggctatggccttggctcccgcttcggaggcagccgctacgccgcgctcggggggagctgttgccctcggcgctgccggcggtggctgcggcg

SEQ ID NO: 63625 - DNA, 1033 bp, Glycine max
  Peptide Sequence Number=SeqID_180403
tctgcgcggtcatggccagcgcatagcggtcgatctcgaacagctcgccgtagggcacggactgcgacacggcgtcgaagtcggccaggttggccagcaggaagcgcagcgtgttgcggatgcggcggtagccctcgaccacgcgcttgaggatctcgtcggagatcgacaattcgcccgaatagtcggtggaggcgacccacaggcgcaggatctcggcgcccagcgaatcggacaccttctgcggcgcgatcacgttgccgaccgacttgctcatcttgcggccctggccgtccaccacgaagccgtgcgtgagcagcgccttgtagggcggctggccatacagcatgcagccggtcagcagcgacgaatggaaccagccgcggtgctggtcggagccttccaggtagaggtcggcgggccagcccagttcggcgccgtgcgagccggcgaaatcgccgtccttgccgcccaacacggtggcgtgggtgctgcccgagtcgaaccacacgtccagcgtgtcgcggttcttttcgtattgatcggcttcgtcgcccagcagctcgcgcgggtccagcgtctgccaggcctcgatgccgccttgctcgacgcgttgcgcgacctgttccagcagctcggaagtgcgcgggtgcagcgcgccggtttccctgtgcacgaagaaagccatcggcgtgccccactggcgctggcgcgacagggtccagtccggacggttggcgatcatggcgtgcaggcgggcgcggccccaggccgggtagaaggcggtggcgtcgatgccggccagcgccgattcgcgcagggtcgggccgccgtccttgggcttgatgtccatgccggcgaaccattggctggtggcgcggtagatgatgggcgtcttgtggcgccagcagtgcatgtagctgtgcttgtgcttttccacgtgcatcagcgcgccggcttcctgcagggcctcgacgatcttggggttggcgtcccagatcgacaggccgccgaacagcgccaggctgtcgac

SEQ ID NO: 63626 - DNA, 333 bp, Glycine max
  Peptide Sequence Number=SeqID_180404
atgactttacaattagctgaccgctccattaccaggccatatagagtaattgaagatgttttggtcagagtaaaatattttatcttcccagcagactttgtggtaatggatatctctgaagatactgacatccctgtaatattgggaaggccattcatgttgaccgcaagctgcatagttgatatggggaagaggaagctagagctaggttttgaagatcagaaaattgattttgatttgtttgttgaagacaagcctgctctagaacacaatgtttgcttacaggtaatggaaggaggtcaagaggttctgaaagtaggaaccaaaacataa

SEQ ID NO: 63627 - DNA, 228 bp, Glycine max
  Peptide Sequence Number=SeqID_180405
atgcccacttgggccttccaggatgtccaacagaaggcggtgccttctggtggaagcaacccagctcacttgggcgagctgggcggcaaccacctccctcttttccctataaataggggaaagagggcagagcaaattcgttcaaccctcctggtatctgagattcacttaaaattagtgagaaacattgtttccgtgaagaaaatccaagccgaggcgcttctgtaa

SEQ ID NO: 63628 - DNA, 1237 bp, Glycine max
  Peptide Sequence Number=SeqID_180406
ccggcgtatcgaagcgcacccacgtacgggggctcttcagatagtggaggttcgggagcgggtggaagaaatcaccctgcgcgcactgccaccggcacagcccgatcttcctttcgttgtttcaccgccgctgccggacgcaagtgcgccattgttcgcaacgttgtcctcggaggaggccctgtccatcggtgtaccagcggactgggtgaacgacgtactccaagcaagtgaaaatcgctttttcacgttggcaaaccaccttcctcaagaagctgccgaagcgcttctcgagtacgcggcgactggggttcttaacaggcccaaggctgtcgatacgacgccggttactcaccccgacgcgcagcgccgattctgcatcttggaagggcacgaggagctcgcggcggcactcgaccaacccttcgagaagtgggcggtattcctgcatccctcacagcgggcgttggttgaacgtgatttcgccggccctgtgcgggtggtcgggtccgcgggtactggaaagaccgtcgtggcagtgcatcgggttgtccggatactgcgcgccgaccccaccgctcgcgttttgctcaccacattctccgagccgttggctttggcactcaagcgaaagctcaacgttcttgtcgccgacgatctgcggctgacggaacgcgttgttgtctcctcgttcgaacaggctgctggagaactgtatgccttgatgacgggacggaaggcctatctggtcaatcgtgataacctgcggggcattctgagtgacacggccgcaattgccggctccggacgttacccgatccgtttcctgctgtcggaatgggaacacgtgattgatgcctggcagatcgatagtgcggaggcctatgcactggttccgcggatgggtcgaaagaaccggttgggtgccaaacagcgcgaggagctctggtccatctttgctgaagttcgccgccaggttcgtgcaaaagctttgatgacgagcgccgatctcttcagcgcggtgatgcggcacttcgataatcgcgacgataagccttacagccacgtggtggtggacgaagcacaggacctgggcgttgcagaactgcgatttctgaaggcaatcgtgccggatcgtgccgatgcgatgttcttcgcaggtgacattggccaacgcatcttccagcaacccttttcctggaaagggatcaggatcgacgtgcgggggcgtcctcac

SEQ ID NO: 63629 - DNA, 486 bp, Glycine max
  Peptide Sequence Number=SeqID_180407
gggttgcatcaactacaatctcgttcttgctataagacaacttggctaccctatgagaggggcgccactagaggatgagctcgtgcttgtcatttcacgaggcttcgataagaccaacgtggagacacttcagaaggtccgcaaggcatgggaggcccttagggcggaactcgagcaagcccaaacagttaaagaaaggttcaacaacaacgagcttaaactccgaagagaggaaagggaccaatcacgagtagacagtttgatcttgaaagatgaattgaaggcttgctcgaggtccaaaagtagtttgtctcagcggttatgcgagacagagaccaacatgttagctattatcaccaagtaccaagaagaactaaatctagctgcggcccacgagcatagagtggcggacgagtatgcccaagtgtacgcaaaaaagaaggctataggaagggtgatcgactcgctacatcaagaggcaacgat

SEQ ID NO: 63630 - DNA, 873 bp, Glycine max
  Peptide Sequence Number=SeqID_180408
atgcatgatatatttggtgcatttgttcagtctttgaactggaatgggagggttccttcccttctctcctcaattcttcaacacctagtggcttgtttccctattgcttcggatgaacaaaacatactcaattttctgaatgaggtgaaagatagactgggttgtcctataatctaccagcaggatatacgtgctgtaaaaacagagcgccaatcgagaaaagagatgcattactttcgggactttcattcaggctgcagtaaggaacctctgtattttacttttgatgacgtcttaaagtgtggccaagcatataaagagggttatactgttgccctgcgtggtctggagttttgctatcaaagcattgcagctattgcagatacattagcacttatgtttggccaaccttcagtgggtgccaatttgtacttaacaccccctaattctcagggtttgattttcggttcaaaacagtggactatattttctccacccagtcagctgttacctcacttatatgataatttacttggttctgatattaactgtacaaaagctggtagaagagagttctttctcagggaaggtgatctattatatattcccagaggttttcctcatgaagcttatacaagctctgctgttagtgatggttctcctgggttctcattccaccttacccttagtattgaggttgaacctcctttcgagtggcctccatctaggtattcaagcaattgtgtacattccccagaggaagggggcctatgcccggaattgctggttggactaagtagtaaccaatgtgtatcttccattggctgtgaatggcaaacaaacatgtggtcagtggctgacagtaagaattag

SEQ ID NO: 63631 - DNA, 1323 bp, Glycine max
  Peptide Sequence Number=SeqID_180409
atggggaattgttggagtcatcaatcaggttctccaggcgatcaccgcaactccaatactgcccccaaccccaacaatcaatcagggagtattcagttttctgctggtctcagcaacacaagattaatacagaatggcaattctacttctcttgggcgtagcagccactctggaggaatcagcaggttctttgggccaagtagtagtaataactactcaacaggaaataatactagcacatccctttggggctctgagactagccaagcctctcgagtgagagatgaagaggagtttcctcatgggcagatcttggatgttgcagacttgagagcatttacactggccgaattgaaggcagccaccaaaaatttcagagctgagactgtgctaggaaaggggggctttggtacagtattcaagggcttgattgaggatagagcagcaaagaaaagaggagaggggttgactattgccatcaagaaattgaattctggaagcagccaaggaattgcagaatggcagtcagaggtgaatttcttaggaaggctttctcaccccaatcttgttaagttgttgggatttgggcgagagaatagtgaacttttcctggtgtatgaatttatgcatcgtggcagcttggataaccacctatttggaagaggagcaaatgttcggccactttcttgggacacaaggctaaaggttatgattggagcagcaaggggactgaatttcctacactccttggaggaaaaaattatatatagagattttaaaccctcaaatatattacttgacacgacatatacggctaagttatcagactttggcttagccagatctgtcaattctcctgatcaaactcacgttacgacacaggttgtgggaacgcatggctatgctgctcccgagtacatttttactggtcatttgtacgtaaaaagtgacgtgtatggatttggaattgttttgttggaggtgctgactggcaagaggatcagtggtataatgttcctgtgtgagcaaacgtccttgagtgattggctcaaatcaaatcttctaaatagagggaaaataagaagcactatggatgcaaagttggaaggtaagtatccatccaacttagctttacagttagctcaacttgctcttaaatgcatccaagcagagcccaaagtcaggccatcaatgaaagaagttgttgaaacattggaacatattgaagcagctaatgagaaaccagctgataacactcataacagaaaacgggttaatctttcccgggtagttcaacaacatggccggccagaaggtggttaa

SEQ ID NO: 63632 - DNA, 894 bp, Glycine max
  Peptide Sequence Number=SeqID_180410
atggatgactatatgacttatgtgaatggtcctgaagagttcctaaggtttacattcggtatgggaatcagtaaaacagaagtaaacttgaagaggttgcttgcagctgctcctcagcagcaaaaccaggcaaaacttgtgcattatgttgctactttgcgtgaacaattggaacaattggctgaggaaagggcaccggaaggcttaccaaggatttcaaaggctgtgttgaatgattattcagagaagattgaagccattgcttccaaattggttaatcatgtgagtgacccaccagtacccaagaaggacttcgaaaggaattctgttgaagaaaactcttctgaaatagaggaaacaaagcagatactcctttcttctggactgagaagaaggcctgtgctgttttactgttgctcatctgattcagtggacagacctgcctcaagtacggaagaaagagcacacaagcctgctgagactgatcatatatcacctgttaaactggatgctgcagcacatgcacacattgaaaagcacagaatgcttcaagataatttgactgatgagatggtagtgttggcaaaacaactcaaagagagtagtctcatgatgagccagtccctgcaaaacactgaaaaggtctcgaaactcatattttcattcaatcctgcttgtctaactgctaaacggttgtatgagatggtgatgctaaatatacttgattctaccgaaaaggctattgagcatagcttggcaagcaccggtcgtgccaatgtgcgagcaacggcaatatactcggagagttcaaagacttcttgcttaacatggcttgtgatgtttgtgatgacatgtgtgtttgtcatggttattcttctaatccgtgtcacatag

SEQ ID NO: 63633 - DNA, 474 bp, Glycine max
  Peptide Sequence Number=SeqID_180411
atgactgaagcacgtcaaaagggggtacggaaagtaaatgaaaacgagaataaaagtacacaaaacaaatggggacctccacgggttaaatatgcttatttaggattatgggaattttacggaagcattacggggtgtcccggaagccccggaatcccatttttcaacaaaacgggggctttccaagaagttacgaaaactcacggattgcgaaaaacacctcctttcgatttccgtcacattacggaattttcacggatcgcaaccttttggagacatgttgagttagtcaacaagaagactatagcatccaaggttttgggtgtcaaggtggtgttgtctagtgacactattgtcaaggcaataggatgtctgcatgaaggtagtacttatcaaggaaaatgggagaagaactatgactctcgtgttacaagagcactttactgggagaattctgacaaggttaatgattag

SEQ ID NO: 63634 - DNA, 228 bp, Glycine max
  Peptide Sequence Number=SeqID_180412
atggatgcaaatttggaaggcaagtatccaaccaacttagctttacaattagctcaactcgctctcaaatgcatccaagcagaccccaaagtcaggccatcaatgaaagaagttcttgaaacattggaacagattgaagcagccaatgagaaaccagctgataacataaaatgggttacttgttcccgggtagttcaacaacatggctggccagaggtggttaattga

SEQ ID NO: 63635 - DNA, 574 bp, Glycine max
  Peptide Sequence Number=SeqID_180413
gacaccaccacctttagtatatctcctcccgtgtccaccaccacctcctcattcatgtcctccatcaccgccgacggaagtgtctccgacggaaagatcggccccgccatcatcgctgccggcaagcctcctctctcctcatcccaccggaaaaggtgtcacgacgccaccctctctgccggaaaagcctcttcctccgctcactgccattgctccaagagaagtggacgagtactcatggcgaaagtatggtcaaaaaccaatcaaaggttcaccttacccgcgagggtattacaagtgcagtagcgtgagagggtgtccggcgaggaagcacgttgagcgagcccaggatgaccccaacatgctcatcgttacctacgagggagagcaccgtcatccgcaaccgcgtctgccggaaactgctgccggcgccggcgggacttttgccgctcatcctgggagatctgatccaagtataggattccatgggcacaacagcaacacaagggttgaaaagaaaggatggggtgaaggaaaagtcaaaggtgaagttcaaaatggagaatctgagtag

SEQ ID NO: 63636 - DNA, 261 bp, Glycine max
  Peptide Sequence Number=SeqID_180414
atgttgttgttagggtggaaggtttggcgcgaagcagaaagacagaagcaagatcgtgtgggacttgaaagaaggcttgagaatgagaaggaaaagttgtccttgtggttctggacactcgtggtttctttggaggtggtggacaaaccaacaacgtttgagcagctcctccttctctacctccgcgcgttggctgcagcttctaacaaccgtaggaacaggaactgttcggatggacataattggccgaaattcgtctag

SEQ ID NO: 63637 - DNA, 678 bp, Glycine max
  Peptide Sequence Number=SeqID_180415
atggctattgccggggcaatcgtgggagcagcattgggtggttggattaatgatgcctatggtcgaaagaaggccaccctctttgccgatgttatctttaccgccggagcaataatcatggcttctgctccagatccttatgttctcattttgggacgccttctggttggtttgggtgtgggcatagcttctgtcactgctcccgtttatattgcagaagcatcaccttccgaaataaggggttcattagtcagcacaaatgtcctcatgataaccggtggacagtttctttcctatcttgttaacctcgcttttactggtgttcctggtacttggcgatggatgcttggtgtttctggtgtgcctgctgttgttcagtttgttctcatgctcttcctccctgaatccccaagatggctttttgtcaagaataggaaaaatgaagccgttgatgtgctttctaagatctttgacgttgctcgcttagaagacgaagtcgatttcctcactgctcaatccgagcaagagcgccaaagaaggtcaaatatcaaattctgggatgtttttagatccaaagaaatcagactggcattcctcgtcggtgccggacttctgaaatgctttgaatgtggatttgggtcttactccatcccccccccccccccccccccccaataa

SEQ ID NO: 63638 - DNA, 1773 bp, Glycine max
  Peptide Sequence Number=SeqID_180416
atggaaccaggaattgaaaattctgtcaactccgtaaatattgaagcaatcgaggtgacaggaggaaatgggcactacacagagcagtcaggcacaagccatgagaagattaaaggaggttggaaaactgcaaatatcttgctagcgaatcaagcactggctacactagctttctttggagttggagtgaacttggttctgtttctgacccgagtccttcaccaagaaagtgctgaggctgctaacaacgtgagcaagtggaccggaaccgtttacatattctcactcataggagccttcctcagtgattcttactggggacgatatttaacatgcacaatctttcagctcatttttgttgtgggcttggggatgttatctttcacgtcttggcgatttttgatcaaaccggctggttgtggaaatgaagaaactacatgcttggaaccatcatcattgggtgttggcattttctacttgtccatatatctagtggcatttggatatggagggcaccaacccaccttagcaacctttggtgcagatcaatttgatgagaagaatgaaaaacatagggatgccagagaaaccttcttctgttacttttactttgctctcaatgttgggtctctgttctccaacactgtattagtatactacgagaattcaggaatgtggacaaggggtttcttggtgtccttggcctcagctgttattgccttagtttcatacttagcaggatatcaaaaatataaatatgtaaaggctcatgggaatccggtgataagggtagttcaggtgtttgtggctactgctagaaagtggaaggttggttcagccaaggaagaccaactttatgaggttgatggtccagaatcagccataaaagggagtagaaagattctgcacagcaatgattttagattcatggacaaggcagcaacgataacggagaaagatgcagttcatctcaagaatcactggcggctatgtactgtgactcaagttgaggaagccaaatgcgtactgagaatgctaccagtttggttatgtactattatttattcggttgtgtttacgcaaatggcttctctttttgtcgagcaagggaatgtgatgaacaacgagataggaaaatttcacttgccagcagccagcatgtcagtgcttgatatctgcagtgtccttttatgcactggaatttatcgccaaatccttgttcctctggcaggaagattaagtggcaatcctaggggactaactgagcttcaaagaatgggagttggtctagttattggaatgttagcaatgcttgcagctggtgtcacagagtttgaaaggctcaaacacgttacacccagggaaaaggctagttctttgagtatattttggcaaatcccacagtatgttctagttggtgcttcagaagttttcatgtatgtgggtcaattggagttctttaatgggcaagccccagatggcataaaaagctttgggagctcactttgcatggcttcaatgtctcttggaaactatgtgagtagcatgctggtttacatggtgatgcgaatcactgcaagaggcgagaatccgggatggattcccaataacttgaatgtggggcacatggataggtttttcttcctcgttgcagtgctaaatgctcttgactttgtactctacttattatgtgctcgctggtacaagagcatcaaccttggagatggtgacatggaaagccaagaggacaaggaaatgattggtaaagtttga

SEQ ID NO: 63639 - DNA, 2346 bp, Glycine max
  Peptide Sequence Number=SeqID_180417
atggcttcatctttggaggagcttcttgcagaggaggggttcaaaggaatcagaagagtgacaaggtctagatcctccttccaccatggtgcttcaagtgagcctctttactctttggatgggagattttctgtatcaagtgaaagagttcgaactcagagaacaaagtctgatgcctcacaatatcaaattacaagtagacagttaaaaaccgacactcatactgctacgaaccggatgtcaagggataatcttttttcgagagacaaaatggatcaacggttaaagaactcttctaccgatacagattcaggcaaaggaattgatatgccaaggaatgagattactgaggtgactgagcaagaagctaacatagttaaagataattattcaaaccaagtttctctaaaaagaggcaaagagaagaatttcaatgaacttgtggaggaggaagatcctgtcaaggatgcaaagatgcacagcagaagttccagtatacatatgcttggacactctagtgaaactagaaagaatataaaaccccagaaggactcatacactagatcaaatagcagcaggaataaagatagcaatcatgctatgcaagctgcttctagtcttgctcttgatcaagttgctgtccaagcagtagtttccattctaaatggctatataaagcgtttctccaaagatgtgaattttcggtcaacattgcgcggcaaatgcttctcctccttgaatttgattgaaatggaagaagagaacattacggagaccaaagtcataagaagtcttgagcaagcaatcgaggccattgatcaaactgctgaggaacctatatctaccatgtatctgaaaagaaccacgatgcaacttagcattattacaggtttgagtttaaatgattttaagtacgagtgtacgtgtgggattccaaattataagttgtcagcctgtgctcatctttacctcagtgtggcacggactgtattgttgcctgaactatgggagcacctattttctccacaattttctcatttgaaggcatggtacatcaaggaagcagaatttctagaagatgcaccaagcaaaacaagaaagctaaaacttcttcaaaaagtgtataatgaacatttggattctggaactcatgtatttgccatatactacaaagattggctcactgaaggagtagaatctccgcctattccttcaattggcattccatcagcttctgtaacgggaagtcaagagggaaattcacttggttattcatttgagtctgctagctccattgacccactctcaccacagccaatggtcagcaagaaactgtatgattctatgtttggtgactctagcaaatccagagtttaccaagtcaaagatattaatgatgatgataacctagacaactgcatgaaaggctcttgtggttcaactattgttagacagacactaacatatgagtctgaaactgttaaatttacagatcaagatattgaagatttctctataggtgtagcaattgatacaatcaagcctcacaatggaaattcaatgacagcttcagaagaatggcagaaaaggaatctagtcgatgacattaataactctttctctatgaaaactaatttaagcagccacagtattgatgctctatcacatgaaaaagctagtgaacttgttcttaaaaagccaaataagacaagttctactcttgaagggtcatattttccaagtattccacatgaatttatttgtcctcttactggagatctctttgaggaaccagtcaccctagagactggtcaaacatttgaaagagaagccatcaaagcatggtttgaaaagggaaatagaacatgcccagtaacaggaaataatttggaatgtgtgaccatgccatttaccaaccttattttgaagcgtttgattgataattggaagtcagaacgtttggattaccttattgatttttcttttcaaacagtggagaatttggaggagcttaagttgaaaaagagggatgaggctgctgttttcaagttagagagtcatttctcctctttgaaagaagaggacaaatcaacttatgctaagcatctcatctctttaggagttcttccatttctttttaggaggtttgaacagggaaatgtgaaagaaaaatcacatgtggtgtcacttttgctaaactgtattcaagtggactctggctgcatatatcagatagcaaggagtgttaacagaaaatgtcttgttgagcttcttcacagtaaggaggctactccgacaacaaatgcaataatattccttactgaacttttatcaatgaagaggtga

SEQ ID NO: 63640 - DNA, 804 bp, Glycine max
  Peptide Sequence Number=SeqID_180418
atgaaattcagtttctgccttgcacacttaaagactagaacaagtttttcacttcaggttgagcctcaaaagtttggcatatacagagaggtggctgtgaatgccattgcagaggcacttgatgccagcttaaatgatgagaagggcagagagaagtgttgcagagcactattaatcttgtgtagccatttttcttcaactggaaagataccaaccatgactagcatcttaaaacaagcaggttataataatgatagcctagaagtgaaacctcctggccatgaagaagagggtcagcagttatatgtaaccatttcagtttcatcggaagatgaagaaaaaaggggtgaagagttgctaaagaagttgttagagtcgttgattggtgatggagaaagcccttttttgaagagcatatctagatgtttagatactaatcacctagatttggtgagaacgtgtctaataactgtgacatggttgagctcctcactatcttcgctatttagtgctggattgcatcttcccgccttcttatccatcatctctcagttgaaaggaatcttggaaaatggagaacttgagctcaagactcttgcttctttgtctttgcttaatttcagtaaaatatcaggttcaccatcttctgcacttctttttcctttcctttttttggttgctaaaaatctttccatttttgatatgaacttgtgcgaaaacgaaggtgtgaaatatattcaaaaaggtgatagatatgagcattcaagtgcactaagcatgcacaacttatatgattctgtttaa

SEQ ID NO: 63641 - DNA, 189 bp, Glycine max
  Peptide Sequence Number=SeqID_180419
atggatgataacttctgttacaagttgtacgaacatgcacatctttttcttttaaacatctcagaaataatgaactgttctggaattgtgtcaaattctggtgagggggaagagcaagaagcagcaattacaaaggccaatgttccccaagaatctgcccggttcaaacctctattcatttatggttga

SEQ ID NO: 63642 - DNA, 258 bp, Glycine max
  Peptide Sequence Number=SeqID_180420
atgaaccaggataactacatggaagaagctttgaaaatgagaaatttgttgcaagaatttcttaagaagcatgatggtgttcggttccctagtattcttggacttagggagcatatatttactggaagtgtttcttcccttgcatggttcatgtcaaatcaggagacaagtttcgtgacaattggtcagagattgttggctaatcctttgaacataatatggacagaattttggaataaatgtgcttctagtttttaa

SEQ ID NO: 63643 - DNA, 321 bp, Glycine max
  Peptide Sequence Number=SeqID_180421
gtgaatttgactgaacctcctcctccgcccaaggctccgccacctgaagaatcctcttttcatgctgctgaagacattcagaaacctgcgtcgtctggggaaaaaccttcggaaactaatgacaccaacaccaacgttgctagccccaaaagtttgtcgtgggatcatgggttggtgcttaaagtgaggtgggtttttttaggaggggggggggggggggatgattggaaagtgctacctccagaagcactatggatttctatcaattccaaacaaccagttggcgcatgggaagcaaatatctgctgtttccaaatctag

SEQ ID NO: 63644 - DNA, 264 bp, Glycine max
  Peptide Sequence Number=SeqID_180422
atggtggtggtagcaacgttagtggtggtggtggtgatgacagtagtgataagtgacgatggtagcaatggtggtatcgataacaatagtaataacaacgataatgatgatgataacagtcaaacggtggtgacagaggaaacattgatagtggtggtgatagtagtaatgtgggtggtgacaatggtagtgtcggcagccagtgatgattgtggtggtgataacaaaggtgatattagtagtaatagtacaatgacatggtga

SEQ ID NO: 63645 - DNA, 252 bp, Glycine max
  Peptide Sequence Number=SeqID_180423
atggtccctcagaaagtgaagtactggtggaaaatcatatcccatggtgatatgaaaagatgtgctgctggagttggtgcttgttgtgaaggtgaagagagtaaagatggctatgttcctgcatccagagacgacatcgagtcacaaagctctacgaatgttgcaagtaaaagagtaaggcaatcaacaccagattcaggagaaattctcaaagctagaaacggtgaagagatgaatgatgctaatgtttga

SEQ ID NO: 63646 - DNA, 372 bp, Glycine max
  Peptide Sequence Number=SeqID_180424
atgatggaatatcctctgcaatatagagagaaaggtagcatagctcgtgatgctgatgtagagggtcaggcaagcagaaaagtgtcattgcagcgatatcttgaaaagcgtaaggacagggggagattgaaaggcaagaaattgactgggataacttcatctaacttcgagatgtatttgaaccttccagtgaaggtccatgcctcaaatgggaattcaagccgtagcagtactagctctccaccacagcctagactgcctctagtatctagtggttcagctgacaaccagctaaaggttgcccttcccattgatctcaatgacaaagtgtcattgcagatgttcaagaatgctaaaactctaactagatag

SEQ ID NO: 63647 - DNA, 753 bp, Glycine max
  Peptide Sequence Number=SeqID_180425
atggtttcttccgacaaggatccacgagaggatgtccttcaagcctggtacatggatgatagtgatgaagatcaaagactcccccaccacaaagaacccaaggagtttgtctcgttggaccaacttgctgaacttggagtccttagctggaaactagatgctgataaccatgaaaatgatccagagctgaagaagattcgtgaagagcgtggttacacctacatggatgtttgtgaggtctgcccagaaaagttgccaaattatgaacagaaaatcaaaagcttctttgaagagcatcttcacactgatgaggagatccgcttttgtgctgctggaagtggctattttgatgttagggatcgcaatgaagcttggattcgtgtgtgggtcaagaaaggaggaatgatcatcttacctgccggaatttatcatcgctttacgctagatgagagcaactacattaagagcaaaaggttccaatctagtagggtttggagagcgaatatgtacatgcctttaccccagggaagtggagaggttgaatccatgccctctggttcacaagcggttttggagtgggtcgctctgtgttgctatctaggattgatgaatatagctttgcgtttttttgttggtgagccagtttggactccatacaatcgtccaaatgaccatctccctgcaagacaacaatatgtcaaggattttgtggaaaaggatgttagcaaccatgctgttgatgccgccgcgtaa

SEQ ID NO: 63648 - DNA, 327 bp, Glycine max
  Peptide Sequence Number=SeqID_180426
atgagatatccgtctctccgagttgcctatattgatgaggtagaagaacctgtccaagacagtaagaaaaagatcaacaaggtttactactcttgcttggtgaaggctatgccaaaatccaatagtccttcagagcctgagcagaatctggaccagacagtcaggaaatttcaactagatggacaacagaaattccttcagaatgaggaaatttacatacaaaaaggaactgtgaaaactaggaatgtagcaagtttgctatgctcaggtgctctgtattgtcaaagattgaagctccattcaagtagcctttggtgttctgcttga

SEQ ID NO: 63649 - DNA, 1101 bp, Glycine max
  Peptide Sequence Number=SeqID_180427
atggatcctcatggtcaagtgaaggaagagtttcttggagaaagttcttccttttgtggtggctatgatccgcagccaatactggttgttcctcaaccaattgaggggcttcatgaaactggccctccaccattcctcacaaaaacatacgacatcgttgatgacccttccacaaaccatatagtctcctggagcacggggaacaacagcttcgttgtgtgggatccacaggccttttccataacccttctccccaaattcttcaagcacaacaatttctccagttttgtcaggcaactcaacacctatgggtttagaaaggttgatccagataagtgggagtttgctaatgagttgtttcttagagggcaaaagattcttctgaagaacattagaaggaggaaagcaaatcatcaatctcacgcaatgcagcagcaaggtgtagtagagccttgtgttgaggtggggccgtttggattagatggagaagttgatcggttgaggcgagacaggcaagttcttatggtggagttggtgaagctcagacaacagcagcaaagtaccaaatctcaccttcaagaaatggaaggaaggcttaaaaagactgaacagaaacagcaacaaatgatgaattttttggccagggcaatgcagaatccaaacttcgtccaacaattagctcagcaaaaggagtactggagaaaggagcttgaggaagctttttccaagaagaggaggaggcctattgatcaagggcctagtaatgttgttgaagtaggtggtgatgatgagttattaggttgtgctgaagagtgttcaaatttcgttaaacttgaaccgcaggaatacactgccaaggtattagagtttgaggtacctgatctaccccttgttttgaatcttgatgaggagaatattgaaagccaaaagagaatattggaggaagataatattcgactagaaagtagagataaagatattgatgaagtgttttggcaagatttgcttaatgagggtattgaagatcatggtgtactaggtgttgaagatgtagatgtattggccaatcaacttggttatttggcctctagtcctaaatag

SEQ ID NO: 63650 - DNA, 264 bp, Glycine max
  Peptide Sequence Number=SeqID_180428
atggaactgatgaccgatgaccatgaaacacaggttacctttcttaaaaggaagaaagacaaccataaatacccaacggtaaatccaaatccttcgttaaagatgtcctggacagtggtccttctgtttggaaattgtcaagaactttcctctgttgtacgagctgctggtgatggactcatgcctcgtggagtgtcctatatatacgacagtacttggtccttaaaaactcaagcatccaacatgcatgagatgaagaactga

SEQ ID NO: 63651 - DNA, 2061 bp, Glycine max
  Peptide Sequence Number=SeqID_180429
atggggtcggtgccgtcaacgccgcgcaggggtggcgcatactctccggagacggcggagtatctgatcggaactttcgtcggcgacacgcccttccccctctcatcggagttctggcagaaattgctggagcttcctctcaatgttcaatggtccactcagcgtgttcaacaagcttgcgagctattagccaaaaacaattgtcacaccaggcatcttgcgaagattttgttccatctagcgtgctgcttgcaagagtacatgtcttcttctggtgcgttgcccttggtctatgaaaaggcttttaatgcagtgtacatcagttcgatatttttaaagcacttgattgagagcgtccaaggtgagaatatccagttatacctgtctcttgaagataatgaggatgtacagaaggatgttttgagagaccaaaccatcgaaaatcttgttatgcgtaatgtgctgagctttatagcatcagtagaagtgagtcccgacacatttctcctacatctagagctgcttaatttcatgattattggaatgtcaactcaacttctctgtgggccatctcctggaccaaatgatgtgaacccctttcttgatgcagcaatggctcaggacagctctctggttggtgcagttgtttgcagattgcttctaaatttcatggcccgttctaatgttccatctaatagggcaacttattccatcttgtatgatggaaatcagagtagtgtgctacagagagttggttctgcagctgcaaatattgttttatttccatttagttatctggtcagttcgagtggtgaagaatcaaaaagtcctattgcagatatcagtattcatgtgcttcttgttctcgttcattatcataaatgtcttgtgagcgaggattacgcgaatcacaaatcttccacatcagattctttactcaaagaaaatcctcacttttctgacaatccttactgcaaggccttagaacatgcaattgattgtgaattggatcgtgtagatattgagggcaatgcacatagtgctcgacacataaagcttccctttgcttcattgtttgatacacttggcatatgcttagctgatgaggcagctgttctattgctttactcattgttgcaagggaattctgcctttctggagtatgtattagtgcggacagatctggatgcattgttaatgccaattctggaagctctatacaatgctccaagtaggactgctaatcaaatttacatgttgctaattatacttctcatactcagtcaagattcttcttttaatgcaagcattcataagctgatattaactggtgttccttggtacaaagaacgcctgttccatcagacttctcttggttcgctcatggtcataattcttagcagaactgtacagtataatttgtcaaaactacgggatgtctatctccaaacaacatgcctggcaaccttggcaaacatggcacctcatgttcatcgtttgagtgcatatgcatctcagagattagtcagcctttttgatatgctttcacgcaagtataacaaattagctgaacgcagagataataagctccatattgcaaaaggaaactcagttgaaggaaaccaaccttgtagaagatatgaaataataaatgcaatcctgacttatgcactacctcggaatcctgaggtagtgtatgcaataatgcacaggcaggaagtctttcagccattcaagaatcatccacgtttcaatgaactgattgataacatttatactgtattagattttttcaatagtcgaatggatgctcaaagagaggatggtgactggtcagtccatgaagtgctccaagtcataattgtcaattgtcgttcttggaggggtgatggaatgaagatgtttactcaactgcgcttcacatatgaacaagagagtcatccagaggagttttttatcccatatgtctggcagctagttctatcccattgtggattctcattcaacacaggagccataaatttgtttccagttgatctacaaacagaagtatgtatctga

SEQ ID NO: 63652 - DNA, 336 bp, Glycine max
  Peptide Sequence Number=SeqID_180430
atgttcattcaaaccccctttcatgaagagttgcaaattgcattggttccattcaattatatgctacaccattcagtaagaggtatgatgtattatagaaaagctttggaactccaggcttttcttgatatggccaaagatgaagatttgatggaaggttataaagccatggaaaactcagatgacaattcaaggggggaaaggtcattgtggacacagtgtcaagcagtagctgatatgaaattcacatatgtggtatcatgccaacaatatggcattgataagcgatctggttctcttcgtgcacaggacatattaaggcttatgacaaggtaa

SEQ ID NO: 63653 - DNA, 348 bp, Glycine max
  Peptide Sequence Number=SeqID_180431
atggcttttgaattgtatggtatgcttgcgggtaatgtcagtccgatgacgggagagaatgtgaagccagcatatggaggtgaagatgaggcttttttaaggaaagttgtcactcctatctataacgtgattgctaaggaagctgcacgtagcaaaaagggaaggtcaaaacattcacaatggagaaactatgacgatttaaatgaatatttctggtccgctgattgttttcgattaggttggccaatgcgtgctgatgctgatttcttttgcctgccagctgaaaagctggtttttgataaatcaaatagactatcgatgcattacaagattcagaatcatccatga

SEQ ID NO: 63654 - DNA, 1650 bp, Glycine max
  Peptide Sequence Number=SeqID_180432
atgtatattatagaaataggaatactttgtcatttcataaagcggtgtgctactgatgttaatcttttctctcccacttggacagctgttctagatgtgatcttgagttggaaagcacaatggagtatgtcactgtatgttaagttaagatacattctcaaagttgtttcagctgcagcatgggtgattgttctgtcagttacttatgcgtatacttgggataatcctcctgggtttgctcaaaccattaaaagttggtttggaagtggtggttcaagtgctccttcattgtttattttggctgttgttgtttacctgtcaccaaatatgcttgctgcaatattctttctgatcccttttattcgtcgtcatctcgaaaggtcgaactataggattgtgatgctaatgatgtggtggtcacagataaaacctctggtgggacctacaaaagctataatgagtgtaaaaatcacaactttccagtggcatgaattctttcctcatgctaggaataatattggcgttgtaattgcactttgggctccaattattctggtatgggtatactttatggatacccaaatttggtatgccatattctcaacattatttggtggtatttatggtgcctttcgtcggcttggggagatacggacactgggaatgctgaggtctcgttttcaatcattgcctggtgccttcaatgccagtttgattccggaagaaacaaatgagccaaagaaaaaaggattaaaagccactttatcccgcagatttcctgagatctcatcaaacaaagggaaggaggctgcaaggtttgcacaattgtggaaccaaataattactagtttcagggatgaagatcttattaatgatagggaaatgaaccttttgctggtaccttattgggctgatactcagttggaccttatacaatggcccccctttctacttgctagcaagattccaattgcactggatatggccaaagatagcaatggaaaggaccgagagctgaagaaaagaattgcggctgacaactacatgtcttgtgctgtccgtgagtgctatgcttcatttaagagcattattaagcacttggttcaaggggaacgagagataccggttatagagtacatgtttgatgaagtggataaaaatatagaaacagataaactgattagtgaattcagaatgagtgcacttcctagcctctatgcacagtttgtcgagctaacccaatatttattgaataatgatccgaaagatagggacaacgttgttattctattccaggacatgctggaggtcgtgacaagagatataatgatggaggatcaggatcaaatattcagtttggtagattcaagccatggtggtaccggacatgaggggatgcttcaccttgagcctgagccacatcaccaactgtttgcatctgaaggagctatcaagtttccaattgaaccacttacagcagcttggacagagaagattaaacgacttcacttgctgcttacgacaaaagaatctgccatggatgtaccatctaacttggaagctagaaggcgtatttctttcttctcaaattctttgtttatggacatgcctatggcgccaaaagttcgcaacatgctttcattctcgtaa

SEQ ID NO: 63655 - DNA, 267 bp, Glycine max
  Peptide Sequence Number=SeqID_180433
atgcctgcaactccacccagtaacaaaggaagaatctctaccctcttcgctttcactcctcgccaagttttgttaagcaaccaaacaatgaagcacaccactgacaatggaacccccatctcggaacacaaagttcttcttcaccaatccattgcccgttacttggaacgcagtggcttctccaaaactctgaaaaaatttctctccgaagcgcatatcgaggtcggtaatatagctgagttgaagcttgattatgtaaaaccttaa

SEQ ID NO: 63656 - DNA, 1011 bp, Glycine max
  Peptide Sequence Number=SeqID_180434
atgtcgtcgtccagaggaggcgcggggccgtcctcggaggcgccgccgccgaggcggatcatgcggacgcagactgcggggaacttgggagagtcggtgattgacagtgaggtggtgccttcctctctggtcgagattgcgcccattcttcgtgtcgctaacgaagttgaaaagactcatccaagggttgcttatctctgccgtttttatgcctttgagaaagctcataggttggatcccaactcaagtggtcgtggtgttcgccaattcaaaactgcacttcttcaacgccttgaaagagaaaacgatccaactttgaaaggaagggtaaagaaaagtgatgctcgcgagatgcagagtttttatcagcattactacaaaaaatatatccaagctttacaaaatgctgctgataaagctgaccgtttgccgttgtctcctttcagtgcacagcttaccaaggcatataacacagctaatgttctttttgaggttttgaaggctgttaacatgacacaatctatggaagttgatcgcgagatccaagctgctgtatatgctcttcgtaacactaggggtcttccttggccgaaggacttcaagaaaaaaaaggatgaagacatcctggattggcttgggtcgatgtttggatttcagaaacacaatgttgcaaatcagagagagcatttgatcttactgcttgctaatgttcacataagacaatttccaaagccggatcagcaaccaaagttggatgagcgtgctctgacagaagtgatgaagaaactgtttaagaattacaaaaagtggtgcaagtatctgggtcggaaaagtagcctttggttacctaccattcagcaagaagtacagcagcgcaaactactatatatgggtctgtatcttctaatatggggtgaagctgccaacttaagattcatgccagaatgcctttgttatatatatcaccatggatgttttgatgcattttcagcatttgcaatgaaaagctaa

SEQ ID NO: 63657 - DNA, 237 bp, Glycine max
  Peptide Sequence Number=SeqID_180435
atgagaagctcgaagatgtggatggttttcatgtgtctgacggtgagcttcttcgctcgcattgaatcgctatccgtgacggtgaacgacgtcgagtgcgtctacgagtacgtactttacgagggcgacaccgtttcggggaactttgttgtcgtcgaccatgacattttctggagctctgatcaccccggcattgatttcacggtcagtgcaatctctatcacttttctcatctaa

SEQ ID NO: 63658 - DNA, 457 bp, Glycine max
  Peptide Sequence Number=SeqID_180436
taatttgtcagatgacctgcccaaatttgtgacaactgctgcagggaatactgtccacagtatcaagggaacctctggtgacaagttcagttttaaagccccatcacatggaatgtataaattttgttttcataacccttactcaacacctgagactgtttctttctacattcatgttggtcacatcccctctgagcatgatcttgccaaagatgagcatttggacccaattaatgttaagatcgctgagctcagagaggcactagaatctgttacagctgaacagaagtacttgaaagcccgtgatgcaaggcatcgtcatactaatgagagcacacggaagcgtgttgtattctacactgtgggagagtaccttctcttggctgctgttagtgcactgcaagtcatatacattaggcgccttttcagcaagtcagtggcctacaatcgtgtttga

SEQ ID NO: 63659 - DNA, 3858 bp, Glycine max
  Peptide Sequence Number=SeqID_180437
atgaaatgtcccgtgttaaggatttttattcttaaactggaaaagagagtgttgcttgctggtcggagaagaatcagactccagagcgagcatgagaaatcgatttctggtacagctgatggcgaatcttcgggtgctcaatttatattgcagtacatgccgactcgtgataagaattgttttatcaattatgtaaatgaatatattttggatagtggtgaaatcactactaggagtagtgatcctggtattggaagcagtgaagataataatgctgttaatgttagaattacttcatcagatgattctgagagtggaaaagctttttctggaagcacgagttgtagtcattctggaagattttcttgcttgaggacaatcacttcacttgcgccgattgctcgtgtgggaatgtcttcctattccacatttcaagaggtctccactgatttcttgtgtgagttaatcgaagatcacgtgttagagtcgcttgatctcttcattgaagggaaagcgtctggacgggacagtgtaaatttccttagtttaattgggttgccatcatttgaagaggatccttttccaggctctttgaggcatccaaacatagctcctgtccttgcaatttttaaaacatccgatcacgttaatgttgtgcttccaaagactccatacaacttggaaagtattcttcattttaaccccaacgcattaaagtctaattggaatataatatttcttatgtatcagctactctcagccttatcgtacatacatggtttagggctttctcatggtaatatatgcccgtccaatatcatgttgactgactcattatggtcttggctgagattatggaatgaacccgtattggaatctaatttaactttgcaagagagtgaaagagataactccaaacctgcaagaattggttgttgtaatgtggcttgtcgttcttatgacctttatgctgatctaaagctttctccaacaatagattggcaatcttgttttcataaatggtggagaggagaattaagtaattttgaatatttactcatcttaaacagattagcaggaagaaggtggggggaccatacatttcatccagtaatgccttgggtaattgattttagctcaaaacctgatgacagttgtgacgcagggtggcgagacttgagcaagagcaaatggcgcttggcaaaaggtgatgaacaattggatttcacctattcaacgtctgaaatccctcatcatgtttcagatgaatgtttgtctgaattggctgtctgtagttataaagcaagaagactccctttgagtgttctccgaatggctgttcgttcagtgtatgagcctaatgaatatccttccacaatgcagaggctctatcaatggacccctgatgagtgcattccagagttctactgtcatgcccaaatttttaagtcaatacatgatggaatggctgatttggctgtaccctcttgggcagagagtcctgaggatttcattaaattacatcgtgatgcattagaaagtaatagggtgtcatttcaactccatcattggatagatataacctttggttacaaaatgtctggccaggcagctattgctgctaagaatgttatgcttcctatatcagaacccatgatgccaagatcaacaggacgtcgtcagctctttacacaaccacaccccatccgtcatgccactaccagaacaaaacgtcatggttccaataaatatgccaaagtttggattcaagcaaatgaaatgcaccaagagacatctcttctatctgaaactgcttatctacaagaactagagcaagcatctacattttctgaacaggctaggcatttgaatgcctattaccattatcccttaaatcaaacaacagggaaaaacatctcatctttgggagatccaacaacagagacatttagtgaaagtataagcaaactatctttgattgacagaaattaccaggtgccgtatagaatgaacctaatatcttttcttcaacatatgaaagaggaagatgaaagctccttaggatatccagacttgctactttggaagcagaaattatcttcttcaagactttgctctgaagatgttgctagggacatattttctattggttgtctcttggctgaacttcatctttgcaggccgctctttgatccaatctcattggcaatatacttggaagatggaaccttaccaggatttctgcaggatctacctcctgatattagattacttgttgaagcatgcatccaaaaggattggacgaggaggccatctgccaaaattcttctggaatctccttattttccaaagactgtcaagtcctcctacttgtttcttgctccacttcagcttgtagctaaagatgaaactcgtcttcattatgctgcaaatcttgcaaagcatggagctctgagggaaatgggtgcatttgcgactgaaatgtgcactacttattgcttaccacttatagtgaatgctaccacaggttatttacgtttaaaggtttctcttctgcaagattcatttgtacgggaaatatggaatcgagttggtaaacaagcatacctggaaactattcatccattggtcttgtcaaacttgtacaattctccagataaaagttcagctgcctctgcttcagttcttctaatcagttctagtgaagaacttggtgtacctattaccatccatcagactatcttgcctcttgttcactgctttgggaagggactatgtgcggatggcattgatgtgctgatggtacctttactgaaaaatgttgtccgttccttcattgatgtgtcatgcatgaataaggccgatcctgtccagagttggagtgctttagcacttattgattgcatgatgactttagatggccttgtatatttcttgacagaagaggtcattgtaaaggagctgcttgaagacctatgttgcatacacattggagttcttatgcagaaacatatggaaattgcagtgcttcaggtggctgcttctactctttttggaatttgtcagcggattggagcagatttgacagcattgcatattcttccaaaactgaaagaactatttgatgagcttgctttctcccaggaaatttctaaaggttcaactactgtgggcagaaacttgaaggttggcaaaataaaaattggaggagacttgcatattgaaagtcgtatggatctagtgttggttctctatccttcctttgcatctcttcttgggatagagaaacttcgtcaatgttgtgctacatggttgattcttgaacaacatcttctacgccatcataattggaagtcttatgtacatctttcttgtatgcttatttctaaacctcctgtgcttcagtgggaatatgctggagaatcatcaaaaaacagctcagaaaattttcttgctagaagacctgtaatagcccagggatttacatctgaatacaatcctgcaaagctgttgcttaatggggttggatggtcaattccacaatcccaaggaagaagtgccaaaaatttgatccctcaaagacgaccatttaaagttcatcaaagtccagtagcagtgcatgaaggaatgtcataccaaatgaaccatgaaccctggttttggttccctagtccagccaccatctgggatgggcctgaatttcttgggagggtgggggttcagaaagacgaacttccatggaagatcagagcatctgttatatactctatacgaattggccaaggatataaaggaactgttcagaaatgggaattgagccgaactaactgtctgtccggctaccatggccatgaggag

SEQ ID NO: 63660 - DNA, 120 bp, Glycine max
  Peptide Sequence Number=SeqID_180438
atgggtgggaatattcgtgagggtgaggatatggaatgtatggagaatacacgaccggtggaggaggagagttgtagtaataaggtgaacgaggctttggagatggtggagagattatga

SEQ ID NO: 63661 - DNA, 2841 bp, Glycine max
  Peptide Sequence Number=SeqID_180439
atggggtcactaaagagaaagtccccagaggagccttcaagttcaactttgcaaccactccatgattgtgtgcaccatgtctcatatccagatggttacaacaacgtccacgcttcttcttcttctccaactcacactactacttcagaacccgccaagaacttccccttccctctcgacccttttcagtccaaatccatttcttgcctcgaaaacggcgagtccgtcatggtctctgcacacacctctgctgggaaaaccgtggtggcattgtatgctattgccatgtccctccgtaatggccagcgcgtggtctacacttcccctatcaaggctctcagcaaccagaagtacagagaattcaaggaagaattctccgacgttggtttgatgaccggagacgtcacaattgatcccaatgcttcttgcttggtcatgactaccgaaatctggcgtagcatgcaatacaaaggctctgagctcactagggaggtagcttggattgtttttgatgaggtccattacatgcgtgatcgtgagaggggtgtggtttgggaagagagcattgttttgtcccccaagaattcacgtttcgtcttcctctctgccactgtccccaatgccaaagagtttgctgattgggtggcgaaggtgcaccaacagccttgtcatgtcgtttatacagattaccgaccaactcccctccagcattatcttttcccttctggaggtgatggtctgtatttggttgtcgacgaaaagggaaagtttcgtgaagacagttttcagaaatctttgaatgctctcattcctgccactgagggtgacaagaagaaagaaaatggcaagtggcaaaaaggtttggtgcttggtagaagtggtgaagaaagtgacatattcaagatggtgaaaatgatcattcagcgtcaatatgaccctgtcatactcttcagctttagcaaaagggagtgtgagtttcttgcaatgcagatggcaaaaatggatcttaatggggataatgagaaggataatattgaacaaatattttgtagtgctatggacatgctttcagatgatgataagaaacttccccaggcaagatacttccttaactttggtgcccccctccccctctttggggcacattaccactgcttatgcagattactgagttttagcgtttcaaacatgctgcccttgctgaaacgtggaataggagtacatcactctggtttactcccaattctaaaggaagtgattgagatcttatttcaagagggactaatcaagtgtttgtttgccaccgagacatttagcattggtttgaacatgcctgcaaaaactgttgttttcacaaatgtccggaagtttgacggggacaagtttaggtggatatccagtggagaatatattcaaatgagtggtcgtgctggtcgacgaggcattgatgaacgtggaatatgtatcctcatggttgatgagaagatggagccttctactgctaaaaatatggttaaaggggcagctgatagtctaaacagtgcctttcatttaagctacaacatgattttgaaccaaatgcggtgtgaagatggtgatcctgaaaatttgctacgtaattccttttttcagttccaagcagatcgtgccattcctgatcttgagaaacaaataaagagtcttgaagaagagagggaatcaattgttattgaagaagaaagcagtctgaaggattatttcaatctgcttgagcagcatagagctttgaataaggagattcgtgacattgtgctgtctccaaggcattgtttaccttttttacagcctggtaggcttgtctctctcgaatgcacatcaagtgatgaagatctacccctcatttttattgaggatcagttgacttgggggttggtcattaattttgaaagggtcaagagtgtatctgaagatgatgcaagcataaaacctgaagatgcatcttacattgttgatgttcttacgagatgtgttgtgaggaaagataaaattggaaaaaaatctatcaagattgttcctctgaaagaagttggagaacctctagtggtttcggttcctatctctcagatcaatacaataagtagtttgcgtctatatataccgaaggatcttttgccattggaagctcgagaaaacacactgaaaaaagtgttggaaactcttactagatttggtgagaaaggattgccacttctagatcctgaagaagacatgaagattcaaagcagttcatataaaaaagcatctcgtagaatagaggctttggagagcctatttgaaaagcatgaaattgcaaagtcaccacttataaaacagaaattgaaagtttttcagaggaagcaagaactgactgcaaagataaagtccattaagaaagcattaagatcttcttctgctttagccttcaaggatgaacttaaggcaagaaagagagttcttcgtaggctcggaagacagcagtatggcttgtcttgtcaagctgtccctttcttccttgatgtatatatatatgttattttgaatgaaataaacttcaacttggtatcagagctaagttcgtccgccgccgtcgtccgccgccgcgccgccgccgtcgtcgccatttttttccggcgacaagcagggtttggtgcacctcgaaaagcgcaacccaaccccacaagtcgcgtgaccatcaggtcactcacgcgccgtcacgcgccctcgccgttcgttgccctcaccggcgcgtggccgccacgcgccgtcttcccggcgccggaatccggccagaccagtgccaaacgtctcgtcggcgcgtcctga

SEQ ID NO: 63662 - DNA, 1719 bp, Glycine max
  Peptide Sequence Number=SeqID_180440
atgaagaacacccctgcttgtctcaaaatcttctccgcccttcttctcttgacctctctcttgtacattctcattgctccctcttcacctagtatccatgaaaacttgcaaccccaacaactccactttgactttgagttctgcccagataactacaccaaccactgtccatgccaagaccccatgaggcagagacgcttccccaaagctaaaatgttccgcaaagagcgtcattgccctcaaagcaatcaaaggttgaggtgcctcattccaaccccaacagggtaccaaaccccgtttccttggcctaagagtaaggacactgcatggttcagtaacgtgccttttcccaagcttgtggagtataagaagtcacagaattgggttaggttggaaggtaaccgttttgtgttccctggaggtggcacttcgtttcccgaaggagtcgatgcttatgttaatgctctaaaacgtcttcttcccgtgcctttagaatctggggatgtcagaacagtgcttgatgttggttgtggggttgcaagctttggagcttctctgatggactatgatatcttgacaatgtcacttgcaccaagtgatgaacatcaatctcaagtacagtttgccctagaaaggggactcccagcattgcttggtgtactaagcattcacaggctaacattcccttcaagatcatttgatatggtccattgctctagatgccttgtcccatggactgattatgatgggctatacctaagagagattgaccggattttgcgtcctggaggattttgggtactgtctgggccacccataaattggagggtaaactacaaagcgtgggaaacagagcctaaggtgttaaaaaaggagcaaaacattttagaagaccttgcaatgcgactgtgctgggaaaaagttgctgagagagaccagattgctgtctggcaaaaacacagagatcatatcagctgcatgcaaaagttgaagactaggagatcccccaagttctgcaactcatctgagtctgaccctgatgctggttggtataccaaaatgactgcatgcatttttcctcttccagacgtgaaagatgtacatgaagtatccggtggtgttcttgagaaatggcctgagaggttggaaactgttccaccaagggtcagaaatgaaaatgatgatggcttccttctcaaaacatatattgaagacaatcagacatggaaaaggagagtgtccaattatggggtccttcttaaatccctcacttctggcaaatatcgaaatgttatggatatgaatgctggctttggtggatttgcagctgcaatagtgaaatatcctgtttgggttatgaatgttgttccctttgatgcaaaaagcaacaatcttggcattatctacgaacgaggccttataggaacttacatggattggtgtgagcccttttcgacatacccacgaacatatgacttgatacatgctagtggtgtattcagtatgtatatggacaagtgtgatattactgatattcttctggagatgcatcgcattcttcgtcccaaaggagctgttattgtcagggatcacggaaatgtaattcttaaagtaaaagaaataagtgatagaataagatggaaaggaatagtagtggctggtgaacaggatggagcttttcatccagaaatgattatggttataaacaatgacgactaa

SEQ ID NO: 63663 - DNA, 516 bp, Glycine max
  Peptide Sequence Number=SeqID_180441
atggtgggagaggactcttgtaataataaggaggtggtggagaaggtgacttgtagtagtaggatggtggcggtgatagagatggtggtagggatgacttgtagtagtaggaaggtggaggtgatggattttggtggtgaagaagtagctagggaggtaacttgtagtagtaggaagaaagtgatgatggagatggtgggggttgtgatttataatagtgaaggagaggagaaggtgaaggtggagggggactcttgtagtagtaaagtggatgaaatggttcttttaggagaggaggtggaggtggaggtggaggagatatatagtaacatggaggagatgatggtgatggtggaggagagctcttgcagtaataagaaggtggagcaagggatttgtaataatatgatggtggtggtggaagtggtgacttataatagtaaggagggtatgggtgtggtgagagtgaagggggtggtggagaattgtaataatatggtttgtgataaggagtag

SEQ ID NO: 63664 - DNA, 2769 bp, Glycine max
  Peptide Sequence Number=SeqID_180442
atgaagaaggttattggtcaaactgttagggaccttaaaagagaagtaaataagaaagtgctgaaagttcctgggattgaacagaaggttcttgatgctaccagcaatgaaccatggggtcctcatggatcacttcttgcagatattgctcaggcaaccagaaaccctcatgaataccagatgatcatgtcagtaatctggaagcgaattaatgacactggcaagaattggcgacatgtctacaaggctttgacagtactagagtacttggtggctcatgggtcagagcgagtcatagatgagatcagagaacatgcttaccaaatatcaacattgtccgattttcaatatattgattccagtggaagagatcaaggaaacaatgtcaggaagaaatctcaaagtctggttgtccttgtgaatgataaagaaagaatcatagaagttaggcagaaggctgctgctaacagggacaagtttcgcaacagtacagcaggtggaatgtatagacctggttcatattcaagcagtggagcctatggtgacagatatgatgatgatcgttatggaagcagggaagaagatagaaatggctatggttatggaaaggaaagagaatggggcaatagagatgatgatcgacatagtcgtgatggagatcgttatggcagagattatgaggatcgttatggcagggatggatacagagatgacgactacaggggaagaagtcgaagtgttgattaccaatatgacacaagaagcaggagctctgatagagatcgttatgatgatgatggacaacactcatctcgtggaagcaatgctaaagctgaagaccaatctctggaagcaaggcttgagcggaaactttctgagcaaaatatgggtgctcctcctagctatgaagaagctgtcagtgaatctcgcagccctgtacacagtgaaagagatgtggaaacttcagcagcacctgctcctagagactcctctcctcatgtaaatgataatcctagtcaaacctctgctcctacgggatcttttcctgtaaacaataatccaaccgaagcaactactgctgccagtactgctgtatctggagctcaggaaactgaggcgactgatgatttttttgacccacgtggtcctgcatcagctgccccagccaccactagtaacgttgaaatggacttgctcggctccctctcagactcgtcctcttcaaatgcattatctcttgtaccagctgcatcagcaactgcagcccctgatgcaaatgctggatcaacagcttcctttgcagcaccaccatctgggtccaataattttgatcagtcttttgaagatccatttggtgactcgccattcaaggcttttacttctactgaaactgctccatctcaaccccagacatatcagagtattgagccatcccaatcaaatggccttaatgcagaaacaaactctaactttgggtttggggactcattttctgttgtaccatactctgcacctgtttcctctgacgctcaacctttctctacaaactctcagtttccgtctcaagatatgtcatcttcacagccagaaacagatattcttgcagacattcttcctcaagcaccattatctgagatgcattcacagcagaacattccagttcctacagatcaattttctcaacaacccttttctgctcctaatggccaaccaggacaagtacaatcatccttttcatctccctccagtcaatatgcacaaccacccttttcatctcatgctggtcaacctagcttgcatgcattttcatctcctactggccaacatttgcagtcgccttttgcttctcaaggtggccaacctgcacaatcaggtggtatgtatggtggattgcactcccagggtggatatccaaccatgtctcctcaatcccaaaatggatataatgggcatatgaatagtgggaactttggatcgacagcagcttttccatcacacatggctccccaagctccaacaggacagctgtcacagggcaccaacttcccccatcatggaggatctactgctcacactgctccgcatttgtcttcttattctccaactcatcaagcatcacagtttaacagccagagctttattggacaacaagggaatgcagccccctatagctcaccaattaccaatcaatcatttgcttctaatgcttcacaatccaattctttagtttctcaaccatccaaggacaagtttgagactaaatcaacagtttgggcagatacactaagcaggggattggttaatttgaatatatctggacctaaaacaaatccattagcagatattggggttgactttgaagccattaataggaaggaaaagagaatggagaagcccactaccacagctgtaacatcaactgtaactatgggtaaagctatgggatcgggttcaggtatgggtcggtctggtgctggttctctaaggcctcctcaaaacccaatgatgggttctggcatgggcaatggtcctggtgttggtatgggtatgggaggctatggaggaggcatgaatgcatcaatgggtatgggaatgggggggatggggggaatgggtatgggacaaggataccagatgcaacccccaactggattgcctcccggctccaacatgccaggtaattataataactccatgatgggttcaggtagttatggtcagcagccatatggtagttatggtcagcaaccatatggcggctaccgatga

SEQ ID NO: 63665 - DNA, 786 bp, Glycine max
  Peptide Sequence Number=SeqID_180443
atggacccatccgaaaattccatcacttcagagcaagagcgccggagagcagatttttggaatgaggcaatcaagcttgctgacttgcatcatccgaatatggtagcattctacagtgttgtgcttgatggccccagaggttctgtggcgacagtaactgagtatatggttaatggttctctaagaaatgccttgcagaagaatgggaggaatcttgacaagcgcaagcgtcttttgattgcaatggatgtggcctttggtatggagtacctgcatggaaaaaatatagttcactttgacttgaaaagtgacaacttgcttgtgaatctccgggatccgcaccgcccaatatgcaaggttggtgacttgggtctgtccaaagtgaagtgccagactttaatatctggtggtgttagaggaactctaccttggatggccccagaactgctaaacgggagcagtagccttgtttcagagaaggttgacgtgctttcatttggtattgtcatgtgggaactcctcacgggagaagagccatatgctgatttgcactatggggccatcataggtggtattgtaaacaacacattacgacctccagttccagaatcttgtgatccagaatggagattgctgatggagaggtgctggtcatcagaaccatcagaaagaccttccttctctgagattgctaatggattacgttccatggcaaccaagatctctcccaaaggacaaaatcaacagcagcaacctgctgcactgcaaagtcaagttcagaaatga

SEQ ID NO: 63666 - DNA, 911 bp, Glycine max
  Peptide Sequence Number=SeqID_180444
tactataaattcccgccaccacctctccatcacctccacctccttactactacaagtccccaccaccaccttcaccatcaccaccaccaccatactactacaagtctcctcccccacctgagaagtcacccagctccaacaccatactactacaaatctcctcctcctccatctccctcaccccctcctccatattactacaagtctccgcctcctccttcaccatctcctccaccaccttactactacaaatctcctcctccaccatctccttcacctcctccaccttactattataagtctccacctcctccttcaccgtatcctcctcatgtgccttactactataaatctctgcctccaccatctcctaagcctcctccatacactccatatcctcaccctcacccatatcatcacccattgattgttaagattgtgggtaaagtctattgttatagatgttatgactggaaatacccccaaaagtcgcacaacaagaaacacctcaaaggtgccacggtcgaagtgacttgtgaagttgggagcaagaccataaaagcttatggtaaaactaagagcaatggaaagtacagcatcactgttgaaggctttgactatgtgaaatatggagccacagtctgcaaggctaaactccatgctcctcctaaggattcacgctgtaacatacccaccaagcttaatgagggaaccaaattgaaggtgaagtccaaggataagtatgaagttgtgctcaaggctaagccatttgcttatgctcctgaaaagtcatatgattgcgaaaagcccaagcccaagccttcccctactccttatcacaaaccatattattacaactctcccccacccccttcaccctcaccgcacccacaccctccttactactataa

SEQ ID NO: 63667 - DNA, 150 bp, Glycine max
  Peptide Sequence Number=SeqID_180445
atgtttgaccaagttagaaggaatggtggtagctgccgcaagaggtcgcgaacaaagattatttggtcggataagcatgtcaaatttgggagaagaggtggcttaatatatccctttggcaatcgtcatcaacaacaatgccaagattag

SEQ ID NO: 63668 - DNA, 153 bp, Glycine max
  Peptide Sequence Number=SeqID_180446
atggagcacattgttcaaatgaagggaagattgaagttgaatgttaccgcaaccaataacggggtagcaccagagtctataatccagatattttcaatatcagaagcattaaaggataggaagctagaactcttaccaaccagtcatggttag

SEQ ID NO: 63669 - DNA, 273 bp, Glycine max
  Peptide Sequence Number=SeqID_180447
atgattttgtattttcgtaaagtgtttgataccagtgatgacgtgttgcattgggctcactctattgcgtatgatattggttttgtggtagtgattatgaggtcagatacaaatattggaaataaaggaaggatttcatatgttttaattggttgtgaaaagagtggaaaatacagggcatacaataaaaatttagtacgaacagttattgacagtagaaaatgtgggtgtccctttaagctgctagcgaaaccagtgttgggagatggatga

SEQ ID NO: 63670 - DNA, 480 bp, Glycine max
  Peptide Sequence Number=SeqID_180448
atggctccgaggaagctttcctcgaagagatctaggaaggacgccgcggccgcagggactagtgccgctcccgagttcgatagccatcgtttcaggagcgctgagcaccagcagcgttttgaagccatcaagggatggtccttccaccgagagagacgcgtccatctcagggacgacgagtacacagatttccaggaggagatagctcgccggcgttggacgtcgctagtcactcccatggccaagtttgatccagatatagtcctcgagttttacaccaatgcatggcctacagaggagggcgtacgggacctccggtcatgggtgaggggccagtggattcctttcgatgcagacgccctcagattttgcccggaccactgccgggagacgggtgcggatcatgtgcaccaacatgactaccttgacccagacatggatgacgttgctgctcagcaacatcctgcccagcgatcataa

SEQ ID NO: 63671 - DNA, 528 bp, Glycine max
  Peptide Sequence Number=SeqID_180449
atgtatgacagtttgaatgatgcgtcaaagaatacgacaaaacatcttacaggatatatcatcctattacagtgttggatctatgagcattccctacaattgcctccattgttgccgatgaggattatcatgagaggaaatcacgtgcttgtccatggaagtatgacattacagtgtctacgtatcataagcgcctggatagattgccaccagatttttcctactagattccttatgaccattctttcacaccctgttattccatccttatctataaagaagaatgacaatagatggcttcagttttcagaataccttacaccggccatccacacaacaactacgccagaaacacatgcagttgcagctgctaatgcagttatgcctcgacatgtagtggacgtttgccaaaggatatcagaaagtttggaacacatgattagtatgaggatgattattgttggaattgaagcatatactttgaccaagcactgcctaaaattagccaggggtgtcactgagcaatga

SEQ ID NO: 63672 - DNA, 441 bp, Glycine max
  Peptide Sequence Number=SeqID_180450
atgacaaaaatttcgtatcagattatgattagaaccagaggattgcgtcgaactttaggcaaagttttaggaagagacatagggagacaggtgagtggtgatgtggaagaattccctcaacgtcgaaggccaacaacatctggacgtagacaacaaacaactgcagttgttgctggggatgttgatcatgccgatcataatgctgatgaggttcatgaggagcctcaagagctagttactgatgatgtaggtgctaatacaaagggtttttcaggcaggccccaagatacatcagtgttgacgaattatgtttatcatgtggcagttagagtttggacaagagaggaacatattgggttaaagtttgcctcttatgggaggaaagtagagaaatttggaaggcttgcacatgagattgaaggtatagtggctgctacatga

SEQ ID NO: 63673 - DNA, 435 bp, Glycine max
  Peptide Sequence Number=SeqID_180451
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaattcctgaaccgggacgtggcggctgacggcaacgttagggagtccggagacgtcggcggggccccgaaaga

SEQ ID NO: 63674 - DNA, 1557 bp, Glycine max
  Peptide Sequence Number=SeqID_180452
atgactaagggtacctcggaaccggggggtagtggaagcggtggcttccacgcggttcacgcggagcgtgacctagaatcgaattgggaagttaacctcgccaagaaacttgaggagtatttgctgaaaatctgttccggcgagatcactggcgaagaagaaggacatagtcccgtgaattttgccgaagctgctctgctgcttcagggttccatgcaggtgtatagtcggaaggtggaatatctctacaccttggtcttgcgtgctttggagtttctttctcagaaaaggatgaacaccgcacaatcgcacacaacatctcaaccctcctccgccgatgtccttatgccctgggcaatgcacgtgctacagtcatcacaagatcaaacctgcttgggaaattgggaatggaaggaggccaaactagatccaaccacacgacgtctttggggtgcttgtgattcggtgaaggatcatatagatggggcatcagtccaacctgaagaaagtggtccccgtgcagttaccgatgaagaaaatgatcaattctggggcttggatgacatcccagttgaagaaaagaattccttggatgctacaacaggcaaagtgaatttagatcactttattaaacctcctgcaaatctagttgttcttgaaggtgactgcttggatgctggtggtgatggaggggaattggagtcttttctgttgtccaccacagacctgtaccaggactttattttattggacacatctgatgctattgcagttcatgagtttttgaagagcagcaaagctgccacaactcaaaatgatgctaatagaggaacctcagctcgtaaaagctttctttctccaggacatactggtggaagtgctcgtagattatcagctgctaagagtcagggtgctaataactgctcccctaaacttaattgtggctttaatgatgaaaatgtccggtccagttctcctgcttctgctggtcttgatgacttcaattatggatttgatatggatcatggatgtgatgcatctagggattcagacaattcagacgaagataatgatgatccatggaaacctttaaatcctcatgaaccaggcaacttaagggtgaagccattcagaaaagtgaacactttaaaaaagaatagcatcaatgtcagactaccagtttctatgaacaccttgtttccgcttgcaaaattgcgtggtcctatcagtccagagctcatggaaatgtgggagatgcggcatcttgtccatgaacgacaaagggattctcaagctccattatatgagaagctgaggcaatctcttgttaatgaggggaatgaaactggtggaacattttttaactctgaagctgacaatgatgacaatgaatatgatggtggaaatcctgattttgatatgccggacaatgcttacatggaagaagatctaccatctttcagtaatgagcatgaatttgatgatgctcatgtcaaccctgatgaagctgtggatctttctcagactagtttggaagatctttgccgctctcacctg

SEQ ID NO: 63675 - DNA, 769 bp, Glycine max
  Peptide Sequence Number=SeqID_180453
agggctacacatcctcgccttcaaaggactacacgccctcgcctttagaggactacgcctcttcgctttcagagggctacacgccctcaccttcggaggactacacgttctcacctttagaggacaacacgccctcgccttcagaagactacacgtcctcgccttcagaggactacacgtcctcacctttagagcactacacgtcctcaccttcagagggctacacaccctcgccttcagaggactacatgtcctcgctttcagagggctacactccctcgcctttagagggctacacgcccttgccgtcagagggatacacaccctcaccttcggaggactgcacatcctcaccttcagaggacaacacatcctcgccttcagaggaatacacgtcctcgccttcagagcactacacgtcctcaccttcagagggctacacaccctcgccatcagagggctacacactctcaccttcggaggattacacgtcctcgcctttagaggactacacgtcctcgactttagagggctacatgccctcgcctttagagggctacatgtccttgcttttagagggctacacgcccttgcctttagaggactgcatgttcttggcatcaaagggatttacgtccttaccatcagagggctgcacctcctcgcctgtagagggctgcacctcctcgcctgcagagggctacacctcctcgccttcagagggctcgatatccgtgcctacagagaactcaaagtcccctgccattaa

SEQ ID NO: 63676 - DNA, 141 bp, Glycine max
  Peptide Sequence Number=SeqID_180454
atgatgcatgcacctaactcaacactcagacgcaatgtgggaattgtgctgagttcgtcgggaccacccggttgtgcacgtaacagcccccctcccataggtgatcagcctgggagcccaaaggtgtttcctaccaggtga

SEQ ID NO: 63677 - DNA, 359 bp, Glycine max
  Peptide Sequence Number=SeqID_180455
atggcgatttgggtagatgcggacgcgtgtccgaatgtcattaaagaaattttgttccgcgccgccgaacgcacgcagacgccgctgacgctggtcgccaaccagtcgctgcgggttccgccgtcgcgctacgtccgcgcgctacgggtggcgcagggttttgatgttgccgataacgagattgtccgtctctgtgaaccgggcgatttgaaaggaggtgcggcgctgaatccgcgcggcgagcgctacagtggggcgaccattcgcgagcgcctgacgatgcgtgattttatggagacgatgcgggccagcggcgtacagaccggcggcccggatagtttgtcgcagcgcgatcggca

SEQ ID NO: 63678 - DNA, 165 bp, Glycine max
  Peptide Sequence Number=SeqID_180456
atgacggcgacagcgacgaacctctggcgacggtggcattggaaagcacggaccaaaggtgacgcggaggtagctgaaggcgccgccagcgacgggcatgtcgatgacaaactcggtgtagcagaaggcggagaggagggcgcagaagccgacaatgacaattaa

SEQ ID NO: 63679 - DNA, 1512 bp, Glycine max
  Peptide Sequence Number=SeqID_180457
atggcttctgtcacacacccaatacccagcagcagaaccaacaataatcacatcacattctcgcaaacaaagtctctcccctttgggcaggtttcacttcccatgaaaaagaaacatgacttgtctccccttagccactcaattgctgctacgagttccatactaggaatcaccagcacctccaattccagccatgcacacactagtactctttccaaaacaataactacaaagcccacacacactagtactctttccaatttctggagagaggttcaagggtgcaacaactgggaaaaccttttggagcctttgcaccctcttctccgccaagagatcattcgctatggcgagtttgtaaccgcctcatacaaggcctttgatctcgaccccaactccaaacgatacttgaactgcaagtacgggaagaagaggatgctgagtgaggtgggaatgtcaaactctggctacaacatcactaagtacatctatgccacacctgacataaacataaacctccccaacatcactaactcttcttcttctggtcggtggattggttacgtggctgtgtcatcagatgaagctgtcaagagacttggcaggagagacatattggtaactttccgcggaacagttaccaatcaagaatggatttcgaacctgatgagttcattgacaccggccatgcttgatccctataatccacaacctcaagtgaaggtggagtcagggtttctctctctttacacctcagatgaaagctcagcttccaagtttggactcgagagttgcagggaacagcttctctctgaggtgtcaaggttgatgaacaggtacaaaggggagaacgacaaccttagcatatctttggctggtcacagcatgggaagtgctttggccatcttgcttgcctatgacatagccgagcttggattgaacaaaaagagtggcagcactgaggtgcccgttactgtgttctcatttgggggaccaagagttggtaactccgaattcaagcaccgctgtgaggagttgggtgtcaaagtgctacgaatagcgaatgttaatgaccccatcacgaaactacccggtgttgtgttcaacgagaattttagggttttgttgggtggtaggtacgagttcccttggagttgctcgtgttatgctcatgtgggggttgaactaatgcttgatttcttcaacgtgcaaaacccttcttgcgttcatgacttggatacctatatttcccttctcaggcgtccaaataagcgcaaaagggatggagatggagtaaattctttgttggagaaagcaacagagttgctcttcaactcgcaaaccatgaaaactttgcccggattcttaactgcatacaactaccatgatttgctgaattcagtctcaagggacatattgtgttcttggagcgatgaattgctttttggcttggtttttttgttgttggaacgagtagtgcagtggaaagcggatactatatgtaaagcttaa

SEQ ID NO: 63680 - DNA, 216 bp, Glycine max
  Peptide Sequence Number=SeqID_180458
atgtgggtgtcgagggagcggtttccggcagatttcaggcgggaggagaaagagaagagctattttaggcaggaggatgacaaagagaagagggagggcaagagttgttggtgggaggaatgtaagggtggaaagcaaggcaaagaatttggatcgggagagacaagcttgctgctgtgtgagagttttaatttgagaattgaaaaaggagtctaa

SEQ ID NO: 63681 - DNA, 369 bp, Glycine max
  Peptide Sequence Number=SeqID_180459
atgggtaataccgaagttactgctgctgtttatggccctagagaggttcggtgtgagtacagcctggctaattttagcactggagatcgcatgaggaaatctaaggagaagctctcaaaagagcttataacttgtatccaaacatgtccatatgtagaagacagtgctggaggggctgatgtaactctaggaattctgccgaagctggataaagtgacccttcttcagatggattctaaactacctattgacattttggaaaatgttatgcaactggcaattgaaggctgcaaagcaatagcaatagcactaatcacttttgtgattatactaagagaagtgaaaacatggtttacattcatttcatag

SEQ ID NO: 63682 - DNA, 807 bp, Glycine max
  Peptide Sequence Number=SeqID_180460
atggaagaacccaagccaattctacagaaaccccccggttaccgggacccggactccaaaccaccgccacctcccccgcgaaagcccatgctgccaccctcgttccagcccaaacccaagcggcgaagctgctgccgcatatgctgctgcaccttctgcctcaccatcctgatcttgatcctggtggtcgtgatcgccgccgccctcttctacctcatctacgacccctccctcccggagttccacctcgactccttccgcgtccccaaactcaacgtcaccgaagccgccgacggggcctacctggacgcggacacgtccgcgcgcgtcgaggtgaagaaccgcagcggcaggatgacgtggcacttctcacagagccaattcacggtttcagcggagaacggagacctgaatctggggtcgacgaaggtggcggggttcacggtgaaggagaagggcgtgacggggctgaaggcggagacgagcgtgaaggagctggcgttgaacgagaggcagaggagaaggattaagagcgccgtggagagcaaggcgttggtccccagcgtggaggttcgaaccaaaaccggtttgggcttggggggttggaactcaccctccatctctgtcactatcgtctgcggagacgtcaccatgagacaactccaaaaaggagaccctcccctttgctccatcactctcctcaaatgtcgaaaagcgttgaggcttagagaagaagaccagcaagggacttcaagaaagccgaatattaagatacaacaaatcttgattagttttgagcaatggtga

SEQ ID NO: 63683 - DNA, 450 bp, Glycine max
  Peptide Sequence Number=SeqID_180461
atggggcattctgcagctgtgtgggactatagagcagcaactgaaattacaaaggactggaatgggattcatcaaattgtgcttcggactccaaggggtgcttcagcacaggtatgcttacatggggcgcaggtcacttcatggcggaatgagcatggggaagaacttctattcacaagcagcaaggcaattttcaaggctccaaaagccatacgaggaggaattcctatatgttttccacagttcggaaactgtggatcgctggagctgcatggttttgcgagaaatagaatgtgggcaattgatgataatcctcctcctctgcctgcaaatgattctagtgggaaatccttcattgacctggtactaaaatcatctgaagaagatatgaagggctggccacataggtatgaacttgaatgccacaatactgcagctcatggattatga

SEQ ID NO: 63684 - DNA, 1317 bp, Glycine max
  Peptide Sequence Number=SeqID_180462
atgggaaacagtgaggaagagaaatctactaagactgaaaagccttcttcacctgtaacaatggatcaggcgaatcagaccaaccagaccaatattcatgtctatcctgattgggcagccatgcaggcatattatgggccaagagtcaccatgccaccatactacaactcagctgttgcttctggtcacgctcctcacccgtacatgtgggggccaccacagatgacagggatgagtaacttgctaacttactatttcttccagcctatgatgccaccttatgggcctccttatgcagcaatttatccacatggaggggtttatactcaccctgcagttcctattgggccacttacacatagtcaaggagttccgtcttcacctgctgctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagtgtggatactgagggttccagtgatggaagtgatggcaacacttcaggggctaatcaatcaagaaggaaaagaagccgtgagggaacaccaaccactgatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagcaggctgaaactgaagaactggcacgaaaagttgaatccttgaatgctgagaatgcaacactgaaatcagaaattaatcgactgactgaaagttctgaaaaaatgagggtggaaaatgctacattaaggggaaaacttaaaaatgctcaactgggacaaacccaagagataactttgaagataattgacagccagagggctacacctgtaagtacagaaaacttattatcaagagttaataattccggttctaatgatagaactgtggaggatgagaatggtttttgcgaaaataaaccaaactctggtgcaaagctgcatcaactgctggacacaagtcctagagctgatgctgtggcagctggttga

SEQ ID NO: 63685 - DNA, 219 bp, Glycine max
  Peptide Sequence Number=SeqID_180463
atggggtatggtggtggtggtgaagaagaaaaaggagcgcgaaggcgaagaagcccacgtcaccacacacgtgtcgtatgtgcgggtgggcgtatacgtagagcgtatgtatatggtatatacggtgtggtggtggttgaggtggcgatttgtttattcgaacgtgagcagaggcgtacacgtgctggtcagggaatcgatctacgcgtcttgtgttag

SEQ ID NO: 63686 - DNA, 303 bp, Glycine max
  Peptide Sequence Number=SeqID_180464
atgtatcacccaactgcatatgtttgtgtttactataatggccaaatctgcaacactaatgaggacatcactttcgttagtaacaacacaaaaactttcatgatcaacaagttatttgtcgtaatctttgacaataataacccaccaagtaaccaacatggctcaacctccaatcttgaggacttatcagatgggtacgagacttgttgggtcaaaaatcatgatagtgatactgactcctcttccgggcccgaagaaagtaacatgtttccatcccacgaaacaatattcaaacgagattag

SEQ ID NO: 63687 - DNA, 501 bp, Glycine max
  Peptide Sequence Number=SeqID_180465
atggcctccaagcggattctgaaggagcttaaggacctccagaaagaccctccaacctcttgcagcgccggtcctgtagcggaagatatgtttcattggcaagcgactataatgggtccccctgatagcccttatgctgggggtgtttttctagttactattcattttcctccggattatccattcaagccacccaagtttctaacagttacctgtagaggtggagccacctctttaaaaccaaatctgacggttgcatttaggactaaagttttccacccaaatatcaacagcaatggtagtatttgtcttgatatcttaaaggagcagtggagccccgccttgacaatatctaaggttttgctctccatttgctccctattgacggatccaaacccagatgatcccttggtgcctgaaattgctcatatgtacaagacagacaggtccaagtatgagacaactgctaggagctggactcagaagtatgcaatgggctag

SEQ ID NO: 63688 - DNA, 321 bp, Glycine max
  Peptide Sequence Number=SeqID_180466
atgcgaacatgctttagtaaagagataaacttccaactgatcagagcaacatatgctttttggatgaaagacaatgtgtctatcggggaaggagaaggaaacactgggtccaacaaagataggagaaaatcactcaaagtgtatcaatctcacacagggcaaggattgacattctcaccctgggtcaaggtttatgataagttgggattttggctcaaggcttgtagaacggctggtcatgatatatgtcagggtttggctagcggttcggggataaagggggtgtcctacattatttccatgatacacatgcaacaatga

SEQ ID NO: 63689 - DNA, 1280 bp, Glycine max
  Peptide Sequence Number=SeqID_180467
aacgatttgcctgaagggcggcaaaaagacagtgctgccctcatacacaatgcaggccagcacttgttgaagctgattaatgaagtgctggatatttcgcgcattgaaagtggcgacatcagcatgtccatggaagtgattgtcctgaatcacttgctcgaagaagcttaccattacttaaaaacgctggagaaggtgcgcgacatcaccatagaaacgcactttgaaccggcattaagcgtgcgtgccgacaggcaaagactgttacaagtcatcttaaacctgctggcgaatgccttgaaatatggcccggaaaataccagtgtggctttcagtgcttaccgccagcacggccacatccgtgtcgatgtgaaagatcagggaccaggcatcccggcagccttacgctcacgcttatttaccccgtttgaccggctgggcgctgaacgcacagtgactgaaggcacaggcttaggcttggtgctgagcaaacaattgatggatgccatgggtggtcagattggcgtcgctgaagatcagagcctattctggatcagcttgccagaagtagtccaaacgatccagccccccgccaacccgtcagtggccgctgaagcccccctgacccgcgcagtagcgacaacgccagccgcaaaacgtcatgtgctgtatgtcgaagataatcatagcaaccaggcgctgatagaggccatcatgagcaaacaccggcacctcaaactgcacctggccgccagcgtgcaggaaagcatggtctggctacgcgacatgcagccagacttgctgctgctggacctcaacctgccagatggctcgggcgagtcgcttatccagcacattcagaccagccgtgcggatttgcaacatattccgatagtgattttaagcgcagatgccttacccgaaaccatacaacggctcaacagtcttggtatcacgcactactttaccaagccattgaatgtcgcagcgttcaaccacaccacggacccgaccaaaaccatggatctggtcaatgcgtttcagccagacctgattttgctggatttaatgatgccggtactggatggttttgccgtactggatcagctctcccaccatgtgggtgcccatgaatacctgccggtgctggtgctcacagcagacgccaccatcgcgacgcggcgcaaagcgctggccttgggtgcaaaagactttttaaccaaaccttttgacccgatggaagccatgctacgtgtctggatactgctggaaactcgctg

SEQ ID NO: 63690 - DNA, 381 bp, Glycine max
  Peptide Sequence Number=SeqID_180468
atggtagccataaccctaaccaaggttcatcaacctctatttctccgagaatacgactcgaacgcaacgtgtgcttgtcatggagaagccccggggcattccattgagcattctaggggcctgaagcgtaaggtgcaaggtctaattgatgagggctggctgaaatttgaggagaatcttacaatgttaaatgaaatggataaagttgatatctttgtccctcgtcctctcacaaacgcatctttgcttattcaactttcactggaatgtgggtgcaagccattggtctgtttgctcaagcgacctgtgctcctgagtttggacttccaagaccgttcaatcagagattactcgtcttgcacgttggtggggctgccgtaa

SEQ ID NO: 63691 - DNA, 108 bp, Glycine max
  Peptide Sequence Number=SeqID_180469
atggtcagaagtcgagacgagttgacggcagaagtcaccaaggtacttagggatgaaggcgaatggaggacagggtcacggccgaccgttgtcccttcccgacgctag

SEQ ID NO: 63692 - DNA, 252 bp, Glycine max
  Peptide Sequence Number=SeqID_180470
atggccatttttgccatctcgagggtcaaattgagcttggaagctagaacctctgcacttgaagaattaggttgcgagtttgggcttctatgttgtgtaattagtttaattagtcgttatcacagtggccaatgcggtgagtgcgtggcggcaccattcatagtagtgtacactatagagggtggcaccgagcagaggtaccacggtggtggcatggaatttgtggatgcaaccgagatcgcggtggggtga

SEQ ID NO: 63693 - DNA, 279 bp, Glycine max
  Peptide Sequence Number=SeqID_180471
atgagcaagaggctccaagaggattgggctacagctattgaagaaggcccgagggttctcatgaaccttaggggaaaatacttgtacttgggggcatgtcactcggtttggaactcccttgtgactcgggcttatcaccattgggggtggggtggagttgcctgtgcacaacaggatgaccttgacacttgctacccagctttcttgggtgtgagtgtcgtgtgggaatgctcaggctatttcatgacgaatggtactacattgcatttgagagttaag

SEQ ID NO: 63694 - DNA, 261 bp, Glycine max
  Peptide Sequence Number=SeqID_180472
atgcctctacttatgcatagtcttcatcaactctccctccatcaacaagttatgatgccagagaccttcctagagcgcgttgcttggcctggggacatgccatcctttgttggggggtgtcgcaacctacccttcaacgggaaggcgatgcgtgactcgcgggggcgtgtttcaagaaaggaatacccgcggagtcgccaccaacgtttatttgaggaaaacgtcagaaaaaccggaaaagacgtgatctacgaaccctaa

SEQ ID NO: 63695 - DNA, 501 bp, Glycine max
  Peptide Sequence Number=SeqID_180473
atggagagacctggcagctcaagtggcacgaatctttcaaagaatacgcccaaagatggagagacctggcagctcaagtggcacgaatctttcaaagaatacgcccaaagatggagagacctggcagctcaagtggcacctccaatgacggggaaagagatgatcacaataatagtagacacattaccagtgtttttctatgaaaaaaggtgggttttcgccgatgaaaggatcgaagtgggtctgaaaagaggcaaatttaatcatcctgcttggatgaatgggaaaattggggaaaatgaagagggtgagaatgagggagaaacccatgctgtgactgccattcctatgcgaccaagtttcccaccaatccaacaatgtcattactcagccaataacaacccttctccttacctaccacccagttatccacaaaggccattcctaaatcaaaccacaaagcctgtctaccacacttccaatcacggacaccacctttag

SEQ ID NO: 63696 - DNA, 372 bp, Glycine max
  Peptide Sequence Number=SeqID_180474
atgcatgagaacgaatggcacggagcgtgtttgctctttgcccctatttgggaacctataggacaatatctaggggtctctaataactactccccaacaattcataactcacacggctgttttctagaggtatcatcactcaagataataatattgtggcggcctaactcacaaaaagtccccagtggagtcgccaactgtcgcaacgtgcccttttgcgggcgagcgaaggcgaggctcacggatgcgctttccaaaggaggaaaggtgcgcggagtcgccaccaacgtttatttgtggaaaacgtcgggaaaaccgaaggaaaccggtcaaaatgagaattctaagttcgggagttgtatttacgcttga

SEQ ID NO: 63697 - DNA, 192 bp, Glycine max
  Peptide Sequence Number=SeqID_180475
atggggcaattaaggatgtcgctgcatgttctttatctttatgcgttttctggatttcccccagggatttcccatctgctgggcaggatcatcttgagctaccttctggggtggggacaaaacgtggacagcagaaaccaatcaaggtacttaggaacggatgcaagtggggatggggtcacgaccgactga

SEQ ID NO: 63698 - DNA, 189 bp, Glycine max
  Peptide Sequence Number=SeqID_180476
atggagttgtgggagagttatacaagtgttgtgaaatacaaattgtgggagagttatacaagtgtcgtgctgttaagcgaaacagcaaagcatgttgcacctttactggcaagtgtccagtacggagttgtgaagagttatacaagtgtcgtgctactaggtgaaggagcagacaatgttgcaccctag

SEQ ID NO: 63699 - DNA, 570 bp, Glycine max
  Peptide Sequence Number=SeqID_180477
atgggtatctatattcatgaaaaatcagaggctttggacatgttcaaaatatttaaagctaaagtagaaaatcaacataacaaaagaattaagaatgttcaatctgatcatggtggtgaatactacgatagatataatggttcaggtgaacaatgtcaaggtccatttgctaaattcctagaggaatcaggaatcgtccctcaatacacaatgtcagggtcacctagcatgaatgttagaaacattacttttgaggaagaattggttccaattcctattgttgcttttgaaaatgcaaagcatgatggagataatggtatggtggaggatgatccaatcaacttccatcaagccatgaaaaacactaactctcaaaaatggattgaagcaatgaatgaaaagtacaaatccatgcaagacaataatagatataagactcgtcttgtggcaaagggttatactcaaagggaaatgattgactttaaagagactttctctccagtttctatgaaagacacttttaggacactcatgacactagtgacacagtttgatcttgagtttcattag

SEQ ID NO: 63700 - DNA, 654 bp, Glycine max
  Peptide Sequence Number=SeqID_180478
atggaaagacaacattcagcttgtttgggttgcatggatctagaccttgcattacggactgagcaacctatttatcttaatgatacaagttcctctgaagaatggaggcactttgagaagtgggatcgctcacatcacatgagtctaatgatcattaagcgtggcattctagaagcctttaagggtacagtgtccaaagggatcaccaatgctaaggatttccttgatgaactagagaaacagtttgcaaaaagcgataaggtggaaacaagtacgttgctacaatacttgatttccatgaagtataacagaaaaggaaacattagagagtacatcatgaaaatgtctcatatagtttctaagcttaaagtactcaagcttcaactatctgaagacctcctagtacatttggttttgatctctcttcccgtgcaatacattcaattcaaggaagaaagactgaagcatgatatcactaaaagtgttaatttgggaagcacctctatgagaaagggcaaaaagagaaagagatttgaggttggtttcctgaactatcgaaagccaacggatgttgaaagatacatttatgtgggagatggaaagtcagtagaagtagaagtaattggtcattttaggttgttattaggaatttga

SEQ ID NO: 63701 - DNA, 444 bp, Glycine max
  Peptide Sequence Number=SeqID_180479
atggctttgaaaatattgggcaagtttaccaagtattggcataagtattgtgagattcttgctattggagccattcttgacccactattaaagtttggagcgattcaatttgcttatactaagattaatccttctacttgtgaagagaagattacttacttaagggaaaatattgaaaaattatttgacgaatatgtcaaagaaaaatcaagtgattcaaaagcttcaatttctcaacaattttctcctccatcacaacaagtttcatatatggatgatgaacaagtgattgatgcatttggtggatcacttgatgtaagctccattggagcttgtaggcctaggatcttcttcatcaatggattcctttgcttcttggaagatgaatggcagcggaatggagaaggaagagagagaggagacgtcacttcaaggagaatatga

SEQ ID NO: 63702 - DNA, 198 bp, Glycine max
  Peptide Sequence Number=SeqID_180480
atgagggttgcatggatgcaacagaaacaaaggtgtggtatatggggtgcacaaacgaagaagggaaacagaaaattgaagggcaaaagtgaaaaagggagagacaagtggctcactaatgtttatagcagggtgatggaatggagggtcataaaaaatagaaaaatgctgaacaccgatattattattgacacttaa

SEQ ID NO: 63703 - DNA, 162 bp, Glycine max
  Peptide Sequence Number=SeqID_180481
atggaatacgaaactactaatactaaaaaacaggttgtttcctctgattcagaagccactctcttatcctgggcaccacatacaccagttagcccttcgtccattaagcatgaacgcaagttaggctcagaggcaattaatcgaacacgaagcgtgcactga

SEQ ID NO: 63704 - DNA, 1198 bp, Glycine max
  Peptide Sequence Number=SeqID_180482
atggggtcggaccaagcgccatcttttaaaaagagattctatcatgtcaaagtcaagaatctagagctagccagcttgcaaaaactggggcaacggatgggtcaagttcaacgtcaagccttcagcaagttagcaccaaccatagaggagttcaaagggatcttaggatgcccgctagggggaaggaaggataccaaggaagcgcttggaggagaaggcggaagctctggccagccgaggagagtaggcagcatcgacttattagctctgctagtgattgggacggtactattcccgaatatagacgggttggtggatctagcggcaattaacgcctttattgcttatcaccacagcaaggaaaacccgttcatcgcaattttggcggatgcatatgatacattcaacttgagatgcgagaagagcagtgcaagaattatctattgctaccctatgagaggtgcgccatcggaggaaatcattgtgcgaggtttcagtgaaactaatgcgaagatacttcagagagtccgtaaagcgtggaataaagtggaaagaaaagataaggagcttaggggaggcttgagtggggaagaggctgaaattcctgagaagagtgaagaagtgcgagctttgaaagctgagctcgaaagaacgagaatagtaatagagaagctaaaggtggcggtcactagggtcaggaaagaatgtgatgagctgaaagatatcaacatgaccacggctgaagcgctagagcgaaaaacaaaaaaggcccaaaaggaagagtggagtaggaacaagttccgatgggctttgtggggcagcagtaatgagctcaaacttagaaaggccgagagggacaaatcaaggatggaaagcatggtgttagaggataaattgaagagttgtcagaggtcgaagagaagtttgacagagcagttgagcaaaatagaagagaatatgttgataatcatttatcaatataaggagaaggtgaacctagctgctagtcacgggcaaatactggaggatgaacaggcaaaggaagcgagagaaggggtgatagagctattgcacaaggaagccatgaaatggatgaatagatttgctctcactctaaatgaaagtcaagagcttccaaggttgttagccagagccaaggcagtggctgacacgtactctgctcccgatgaacttcacg

SEQ ID NO: 63705 - DNA, 558 bp, Glycine max
  Peptide Sequence Number=SeqID_180483
atggtgtctgagtcagagaataacaagtgtagtgatgatcatgtgctgacaaagctctctttcttaatctcacgcccgaccatgccgccggaaactctcatgtcgccgccgcagaacacgatctcggttcccttcaagtgggaggaagcaccggggaagcctaggcattgccacaccgaatcggatcccgaggacagtactactgccgttaaaaaaaccttggagctgcctcccaggttgttgtttctgttggacagtaccaacaaggtttccgacgtggacgggccttctcctacgaccgtgcttgatgggccttacgtgggccgggccatgtccttcaccacctcctataggactcccagggctaactggaattccaattttggctcctccaggtggagcggttacaagaagtttaccaccgaggatgctgagggcagttttgacttttcaccccactcctgctcttctatgcctaacgtgaagatcacaagggttccaagacgaggaagcttctgggttctgtctaagcaaaggtcacatatgtggaatatatga

SEQ ID NO: 63706 - DNA, 150 bp, Glycine max
  Peptide Sequence Number=SeqID_180484
atgtataactacatttgcattcttgcagagctcgcgaaagccctaacacatgcaactgccaagaaaagctttctagatgtttctgaaaaagctaagcggtgcccattttggcttcttcctttaaaacttaaatctgtgtttgaagtttga

SEQ ID NO: 63707 - DNA, 576 bp, Glycine max
  Peptide Sequence Number=SeqID_180485
atgaaaaaatggggactaacataccatctagacgcttggaaagatgatgagttacttgatttgcttgtcgacaaatcaaactcaaagatgagtcgctatttacaatacttgacaatacacccatactcagaattctcatggtgctggtgggatgataccattgctttaagaagttcgagcaacaatgaattctccgctggagttactgatacaagcacccagactaaactctcgagcctcagaagaaatggacgcatctatgtttaccgaataagcatcattcctactagtgttccaaatcaactcgtcttcactcgtggaaaaatggatcggcactccactaataatctcatagcctctatcattaaaaatgtcctttataatgccctgcttccattaactggtcgagggatctatgaattcacaggccctcaaatcttccaagctttcaatgggttccctttggacgtaaaggttatcattagaacgcagccagagatcattccaaacgttgatcttctcgcatcacccattcgccatccaagaccttgtttaaccaccacccatgaagaatag

SEQ ID NO: 63708 - DNA, 225 bp, Glycine max
  Peptide Sequence Number=SeqID_180486
atggggggtgaaagtgaccccaagttgccatttgggtatatcaagctggatgatgagatggcaagctgtgcaaaaatcaattctccacctttgaaggccttgatgagggccatgcaccaggctaggtttgaggtacacaatgtgggtgaggttcagggtttgaggtacaccatgtgggtgagcttcaaggggcaaggtaaaaagtttgacggagatcgacaatga

SEQ ID NO: 63709 - DNA, 243 bp, Glycine max
  Peptide Sequence Number=SeqID_180487
atggactgggaaacaccaacacaggtgtgggacaagatccaagatgaatttgaagggagtaatagggtcaaatttgttaggcttctcacattgaagaaagaatttgaattgatgaagatgaaggacaatgaatctgtcaaagatgattttggcatattagtggatgttgtgaatcaaatgtggcttcttgttaactatcaagcttcatgcgcaagaggaaagagtttcaaatctctctactaa

SEQ ID NO: 63710 - DNA, 210 bp, Glycine max
  Peptide Sequence Number=SeqID_180488
atgagggcttctggtaatcgattaccaagggggtgtaatcgattaccaggcttagaaaggggactggaacattgtggaggcctctgtttagcctttggtaatcgattaccagccttggtaactggtaatcgattaccagagatgaaaagccttaagatactccttttaattgcatgtagtggttatgaaacgtattgtgcggcggcatag

SEQ ID NO: 63711 - DNA, 225 bp, Glycine max
  Peptide Sequence Number=SeqID_180489
atgaagcgctgctgcccgaaatcgcctccggctgaggctgacagagcatatccgggaaggagcttgaatctggtgggagaggatttgcttttaggttcggacaggtgctccaatgccagcaggacgaggtgcttgaccactaaccaggctgaccgggcctttgtgcatcatcctggcaaagagacaaatgcatcaaacaagaacaggtgttacattaattcatga

SEQ ID NO: 63712 - DNA, 189 bp, Glycine max
  Peptide Sequence Number=SeqID_180490
atggatgaactgaaggatttgatcaagaaagttgcgcctgctgggattcccccttatggtattcatgaaacacaaatggtgttacttgagtctaactactggaaaaagactgggcctatagaaattttagttgttttcagtaaacctgtaatggaaatggaagacgagttatccttgtcgcaaaattag

SEQ ID NO: 63713 - DNA, 672 bp, Glycine max
  Peptide Sequence Number=SeqID_180491
atgctgggcaacgggcgcgctgacagcagtgtgctatccgagctgaccggctacagcgccaaggggcgtgtgcgtggcactgcgttgggcgtgtacggcacctggctgcaggatgcagaaggaaccggcggtgcctacgtggacgcagccatgcagttcggccgcttcgacaaccgtgtgcagggtatcggcctggagccggagcactatgatgcgcgcgtggccactgcgtcactggaaatgggccataccttcaatgtgtggcagggtgctggcagttcgctctacgtgcagccgcagctgcagctgacgtatgcggactaccgtgcggatcgccacgtggagagcaatggcacggtgatcgaccacgccgatgccggtggcctgagtgggcgcctgggcatgcgtgtgttcggtcatggcactgcggccggcaacaccgtgcagccgtacctgggcgtgaactggctgcgtggcagcggcaccagcacgttgcagttcaacgatgacacgctgggcgcggatgtgccgcgcaatcgttatgaagtgcaggccggtgccgagttgaagctgggccagcgttggggcgcttggggcggcctgagcgtgcagcgcggcgaccatggctaccgcaacgtgggtggccaggtgggtgtgcgcatggcctggtaa

SEQ ID NO: 63714 - DNA, 243 bp, Glycine max
  Peptide Sequence Number=SeqID_180492
atgaatcgaaagcacaagagtgaagaggttagcacgtctgagcagaaatcatggtatgccactgagccaaatagccaacctgttactagaataaattccttgcaccttgttgagcctaatgtgaataaattgtttttgaaacctaagccaaatgaaattaataactaccttatattaggttgtaggagagcacgagttaagacaaatttacccctaatttgggggaggaggattcttgggtga

SEQ ID NO: 63715 - DNA, 687 bp, Glycine max
  Peptide Sequence Number=SeqID_180493
atgggaaggtctgctctgttagtgcacccggctgagccggttaccgctcagcccgcgcgcgtcgcggctgataacgttaatccactattgtgttatctgctgcagccggatgccgcgcacagccagtttaccgctgtgccacagccagcggcggagagcgtcagcgacgacgcgttcttactgtttgccgccgacggctttgcgccctctgctgcactgttgcaggaagtggcaacgctcagccatcagcgcccggagctcaactgcatgctggtttcactggcaccacgcgcattgagcagcggcctgcagtcgtcgctgcagctgttccagcagctgcaggcgcagcgcctgtggcagcagaataactatgcggtcatcctgcgcgccgcgctgatgaaaaatgccgctccgctggtacgcattcaggatgtgatgctggccggcctgttaaatacgcaaacggtatggctgctggatgctcgcgctgagcatgaggtcaccacggttaatccgccacccagctatcagcaatttatgacggagtatgaaaaggtcacccgtttgtcacactttattccggagcgaaaccgttatcgccagagttatttacgcagcgggttattacagctggtacagcaggaattaaacgctgaaacgcagttctctaataatgtgcggcacgcg

SEQ ID NO: 63716 - DNA, 993 bp, Glycine max
  Peptide Sequence Number=SeqID_180494
atgacattctccactgcttttgcttacttggaaggagaatatcttaataatattgtttgggctctacaatggttttggggtcttctcatgaaagttgatgcactccctaaggttattgttaccgacaaaaatttgtctttgatgcgtgcagtgaaaactgtattcccggatgttacgaacttgttgcgtcagtttcacattgacaagaatatgaaggcaaagtgcaaaaccctggttgctaaacaatatgcatggcattatgtgatggaggcttgggggagtttggttgactgtccatgtgagagttattttgatgagtaccttaaaaactttgaaaaggattgctctccgtggcctatgtttgtggactatgtgtgccaaacatgggtgatttcgcacaaagaaaaatttgtgaaagcatggactaacaaagtgatgcatctaggaaacacaactactaacacggttgagagtgttcattggtcattaaagagatttctacaaaataaccttggtgacatatgcagtgtttgggaagcaacgaacaacaagatgacacttcaacacacccaaattaaagcatcttttgagacaagtacgaacgtggttggtcatgtgtttaaagttaccttgtacaaaaaactacttggcatggtatcaagacaaaaacccttcacgttgtggatgagtcatgaggactacccacggtcttccatgtatcaagggttatgtgaggctgaggtgaccataactgaggaaatggaaaccatgtctgtcgcaacctacccttttgcgggcgagcgaggcgaggctcacgggtgcgtcttccaaaggaggaaaatgcgcagagtcgccaccaacgttatttgtgaaaaacgttggaaaaatcgaagggaaccgatcatgaagaatattccagattcgggagttgtatttacgtttgaggaaggtattagcacctctcacgtttgtcccaaaggacaactgccttaa

SEQ ID NO: 63717 - DNA, 449 bp, Glycine max
  Peptide Sequence Number=SeqID_180495
cccttcgtccaagttctcaccacaaagaggcttaagacagggagatccactagcaccattcctattcaatattgtagcggaggcactgactggactagtgagagaggcatgtagaaaaaacttattccggggattcaaagtgggctcaaacagtgttgacataagcatactccaatacgcggatgatacaatattttttggagaggcatcaatggagaatgtgaaggcacttaaagcaattctgaggatccccaagaagacaagcactttcaacttggctatgcttggagaatggagatggaacttatttcatgatgagggacagctttgggcgaagatactggtgtctaagtacagagggtggaggggtttagaagagaacggtggtgatagctttgagtcattgtggtggagagacctaaagtcgatcttccaaacaacacaacaag

SEQ ID NO: 63718 - DNA, 984 bp, Glycine max
  Peptide Sequence Number=SeqID_180496
atgaagggttctggattggttgctgatacggtgatttataccattcttattgacgggtattgcaggaatggcaatgtggctgaggcattggccatgcggaacgagatggttgaaaagggttgctttatggatgtggttacgtataatactctgctgaatgggttgtgtagggggaagatgcttggtgatgccgatgagttgtttaaggagatggtggagaggggagtttttccggattactatacccttaccactctcattcatgggtattgtaaggatgggaacatgagtagggcacttggtttgtttgagacgatgactcaaaggagccttaagccggatgttgtgacatataatacattgatggatggcttttgcaagattggtgaaatggagaaagctaaggagttgtggcgtgatatggtgagcagggggatattgcccaactatgtatcgtttagcattttgataaatgggttttgcagtttaggacttatgggtgaggcattcagggtgtgggatgaaatgatagaaaaaggtgttaagcccactttggttacttgcaacactgttataaagggccatttgcgggctggcaatgtgttaaaggcaaatgacttcttcgaaaagatgattttggaaggagtttctcctgattgcatcacgtataatactcttataaatggttttgtaaaggaagagaatttcgacagggcttttgtcttggttaataacatggaagaaaaagggctactgccagatgtcatcacttataatgcaattctcggtggatattgtaggcaaggcagaatgcgggaggctgagatggtgttacgcaagatgattgactgtggcatcaatcctgataaatcaacatacacatcattgataaatgggcatgtatctctagacaacttgaaagaagcattccgtttccacgatgaaatgctgcaaaggggatttgtgccagacgacaaattctga

SEQ ID NO: 63719 - DNA, 486 bp, Glycine max
  Peptide Sequence Number=SeqID_180497
atgaatgcaaaaaccaagtctccagcgccggaaacatcgtcggttgtcatccacccagcactggcaccaatcttctaccttctcagcacatggagagcccaaggagaaggttgcttccccactatcgattccttctcctatggcgaagagcttcacttctcacattcccccaacaagagcttcacttctcacgttcccagaggtcgaagcagtggaggaaggtggaaaattgcaacgaatgtgggggaaggagagtcgatgcaaagagaagaagaggacgaagccaccatgtcagatcaggaaaaacaaaccatggaaaaaggaggaaggagagtggatctcaaatctggaaaaagaaatcatttcgagggtgaagttgtatctcgcggcggcggcatcgacgtggcgaagatgaagtgcttgtcctcggagtcgcaatcgctagagaacaagtcgatggctggagatgggaggccatggagttga

SEQ ID NO: 63720 - DNA, 201 bp, Glycine max
  Peptide Sequence Number=SeqID_180498
atggacttgattgttctcatcaattgtatcagagccttacactatgtctcccagctgcaaacaagtggtgctggttgcgatgatggcattgcagtgtttgactggagctatacatgggagcaggggctgtggcctgtggagtgtggtggaatgttggggtccaatttcaaggtatggaacttgaatcctatgggattctaa

SEQ ID NO: 63721 - DNA, 402 bp, Glycine max
  Peptide Sequence Number=SeqID_180499
atggaagagacatcacagatttttgcggtatctttatgcaccagtgaatccagttcatctgattttaaaaatattgcctataaatttattaatgagtggagagcacaagaaccactttttcacagtattgctttacagcaatatattctcttatgtgcacaggagcaagagggtggactgagagacaaaccgggtaaacgtagagatcattatcacacatgttactgtttaagtggactctcattgtgccagtatagttggtcaaagcacccagattctccaccactgcctaatctagtattaggcccctactctaatctcttagaaccaatccaccccctctttaatgttgtcttgggacgatatcgtgaagctcatgaattcttctttactgagtcgtga

SEQ ID NO: 63722 - DNA, 6066 bp, Glycine max
  Peptide Sequence Number=SeqID_180500
cacgctctgggtgataattcttttgctgccaatccatttggtgccctagtgacgaattcaaacttcaacaatgggaatgctaatggcttcgaaaaggcatctgaagttgtgacacatgctgttagagtcggttttgaggatatattgaaccatactcagtcaattactagaagctttgaggaggctcttagagattttgtatctgaacggcgtggtgtactagaggaaggttggcgagtggaatttagacaatcagtgagcaactctgaactgtatgcagtttactgtgcaccagatggaaagatatttgattctgtgtatgaagtggcttgttatttggggctaacgtctggctacaactctattgaatctgaactaaggagtgagaggtctctcccttctttaggtgggcctccatccagaaaaagaaagtcaacaaggactacagtagccaacggttctatggaaaatcggggaacctcgacgaatagtaattgtaaggatcctccttgtgatggtttaaatgtggaatgtgctagtgctaggggaaatatcccaaaaccctctgaaattggaagaaaagaggattgccactcctgctctcaacaatctgctgatggacttcctctacagttcaaggacttctttgttctttctttggggaaagttgatgggagaccttcatattatgatgttaatcttatctatcctgtaggttataaatcttgttggcatgacaagatcactggctctctttttacatgtgaagttttggaaggtggtgattctggacctatatttaggatccgaaggtgttcctgttctgaatttcctgttccagttgggtcaaccatactctcaatgtcaaaactttgtcaagttgtgagtcaaaccaatgaaggtgagagaaaaactaatgctaatatggatttagattatgatgaaggtctccaaatgatgcttttagactcttgtttgccaacggaaaatgatatcctaagttgcttcccaagctgctcgattgagtcacgtgatatgtcagatgtattacaccctattactagttcagttcaagataatgctagcaattcattagctgataacttggggtttaatggccttggcgaaattttggtggaagagcggtcgtcattctctgcgtggagagttatttctcaaaagctagttaatgcttgcaaggatatcttaaaactgaaaggaactctcaagttctattgtaaccatgttgataagtgggatttaaggaatggaaaaagtgatacatactgtacttcgttggataaattttgtggttctcttggttcagttggcatcccagatgtaatttattcagacaatgatctggaaggtatctacgtggcattgggaaaatggttggagcaggatagatttggattagatgttgaatttgtgcaagaagtattggaacagcttcctagtgtccaagactctttgcagtatgaacttttaaataatagaaataatagctcgtcattgccaacagttgaaaatggtttcttagtggttgaatggagagatggatcaaaatatcaggaagaagcagttcaagctttatatggaaggtccaagaaggtgactgaaaaaagtattaaggaaagttgtcatccaccacttgggaagccattatgctctagggctcctggtgagctcattggtgacatttttcaggcttgggagcttttaaagcgatttcatgaaattctggacctgaaagaaccattgacattagatgaacttgagaaagaactcattaacccctggtttgatggatcaaattttcttgagaaatctgagagggacatggatgaaagtcaagtttttatttccctaggagctgatggtaatggtagaccattattatccccaagatgtgaagttgatccatcagtttccatagaaagttctcatgcatttattcatgtggaaacagaagcaatgaaagagacagctcaagttaagcttgcctctttcacatatgccagatgcttcggtgtagctttgaccaaggctcataaatcgttgctaagagttctaataggtgaattgctgtcaaaggtggctgccctggtagatccaaattctgaacctggagaatcacgaacaagacggggaagaaggaaagatatggatagtgcagttcctgctaaacgaaccaagctcaatatgcttcctattaatgaattgacttggccagaattagctcgtaggtatatgttggcttttttgtcaatggatggtaaccttgagtctgcagaaattactgctcgcgagagtgctaaagtatttcgttgcttacgtggtgatggtggtttgctgtgtggttctcttactggtgtggctgggatggaagcagatgcacagctgcttgcagaggctacaaagacaatttttggttctttaagcagagaaaatgacatactaaccatggaagaagaagagtctaatgcaaagggtgctcctgaaatttttttggcaaatgatggtaatgttcctgaatgggcacagatgctagaacctgtcagaaagctaccaacaaatgtaggcacccgaatcagaaagtgtgtttatgaggctctggaaaagaatccaccagaatgggcaagggaaatactggagcattcaatcagtaaggaagtgtacaagggcaatgcttctggaccaacaaagaaagcagttctttcagtgttggttaaagttggtggtgaaggattgcaatcgaatcccaataaaagccagaaaaagaaaattgttatatcaatttctgacattatcatgaaacaatgtcgcattgtattacgtcgtgccgctgctgcagatgattcaaaggttttttgcaatttgttgggaagaaaattaataaattcttcagataatgatgatgaggggcttcttggatctccagccatggtagcccgtcctcttgacttccgcactattgacctaagattagctactggagcttatggtggatctcatgaagcttttctggaggatgtccgcgagctgtggaacaatgtccgtgttgcttttggggatcaacctgatttagttgagctggctgaaaaactgacccaaaactttgaatcattatataatgaggaggttgtcacctatgtccaaagatttgtggaatatgctaaactggaatgcttaagtgcagaaatgagaaaggaagttggtgattttattgagtcaacaaatgagattccgaaggccccttgggatgagggagtatgtaaagtatgtggcattgatagggatgatgatagtgttctactatgtgatacttgtgatgctgagtatcatacatattgcttgaatcctccacttgcgaggatccctgagggaaactggtactgtccttcttgtgttgttggtaaacatgcaactcaaaatgttacagaacgtacacaggttattggcaaacggcaaagtaaaaaattccagggagaagtcaattctctttacttagaatctctagctcatttatctgctgcaattgaagaaaaagaatactgggagtacagtgtgggcgagagaactttccttctcaagtttttatgcgatgagttgcttaattcttccctgatacaccagcaccttgagcaatgtgcagagttgtctgcagagttacatcagaaattgcgtgcacactctgcagagtggaaaagtctgaaaactagagaggatattttatccacaaaagctgccaaaattgatactttctcactaaatactgctggagaagttggtcttaaggaagggtttgcttctttgttatcaaatactggtaaatgtctggtccagccacatactgcagttgacaatcctagtaattttggggtatttgttgatagtctgccttcagaagaggttaccaaagataagtataggtttgatagtgttgataaaagcatatctgtgacaaattcagattctgatagccaaaatatgaattccatagatgtagaggggcaatttagaaatgtctctggcgctgtggagtctcaatgtacagacaaatcccccaagtcttttccattgccaaatcatatgcctcaagaaacaaatggtgctggtggagcatctcttgttcagggtaaaaaccagaaatgtgagggaaaggacatacctactcctgtgtcttaccagcaaggaatgcctgttgatgttcctcagatttctgtgaatgagtccgaaccctaccaccttgagctcattgccatcaaacgtgatatttcgctattgcaggactccataactagtgtagcatcacagctgctgaagctctctgttcgccgggaatgtttgggtattgattccattggtcgattgtactgggcttcggctttgcccggaggacgttcacgtatagttgttgatgcaagtgctgctttgctgcatggaagaggaatgacatttagcagagactatgtggagaagttttctgttctgcagcattgtgcactatctgacaaggattcctctttaatgtctcagcctagtaatcctttgggcaatagttctccgtggattgcttatgaaactgatgttgaaattgaagagctcttaggttggctggatgatagtgaccctaaagaaagagaactgaaagattccattatgctggggccaaaatcaagattccaacagtttattaatgcacagactgaagatcgggccaaggaccaaggaaatgtttctatgccaagaaacagagagaaaacagtatctaattctcttgttaccaaggcaacttccttgctggaaaagaaatttggtccctttgttgagtgggataatagtgaagtgttaaagaagcaaaatagaaagaccagaacaactaatgatgaaaagttgtataggtgtgagtgcctagaacccatattgccttctaggaaacactgcacacattgtcacaaaactgttgcgagtgacattgaatttgatgggcacaatgatggcaagtgtaatgcaggtcttctggccatagagaagaataaggataaaaatggatcttctaaaggaagagggaacttaaaatgtgataccttacatgaaaaattcagagctgatgcggaaacagctttgacctcggttagtggatcttctaagcttagctcaagattgattaaattttcaaatgaagaatccacatgcccatttaattttgaagatatatgttccaagtttgtgacaaatgattctaacaaggaacttgtcagcgaaataggtcttattggttcagatggtatcccatcctttgttccttctgtatctccttttgttagtgaatatacactctcagctcaaaaggatgaaagcattgttggtggtgtgtccatagtgtcagaaagccgggtttctcagggaaacactgatggagctggcacatgccttgaccataaatctggcatttctactggaaaattggctgcaaatgaaagcaataaatccaacaaatcatccttgagagaacaaagagatggaaaattctctttttgtagtcctgcttcagttatgggagccgatgggtgctgtgtggttccttcgccttcattgagaccactagttggaaaagcttctcacattttgaggcagctgaagataaatctacttgacatggatgctgcactcctggcaattgctcttagaccatcaaaggctgtgccagacagaagacaggcttggcgtacatttgtaaaatctgcaaagactatatatgagatgattcaggcaacatttacactggaggatatgattaagacagagtacttgaggaatgactggtggtactggtcatcattctcagcagctgccaaatcttctactttgccttcccttgcccttcgcatatactcccttgatttagccattatatatgagaagatgcccaattcaagctttactgacagctctgaaccttctgtcatagcggaaccaaaaccactgatgaatgtggacacagaaaaatccaaagcaagccggaagtcaaccaggaaaaggaaggaatcagatagttga

SEQ ID NO: 63723 - DNA, 348 bp, Glycine max
  Peptide Sequence Number=SeqID_180501
atgacctcgaaaagcaagttcagtgttgccgaggaagagcatgttgttcccgcgagaagcagaggcatcaaagaaaatccgtccagactccatggcactccgcttatgacggaagaagcttgtggtccaaagcaacctcgccggagtctccaacgggcatatgcaagatcccatcatacaccgccagatcctacccactaccaaagtttatactttgaggccctcagtttcgggacgaaggaggagcaccgccgcgaccaccttcgtcggaatctccggagcaagattttccggcgagcttttgttgtgtgtgtgtgtcgtcaacgaacactctgtgtgtctttgtga

SEQ ID NO: 63724 - DNA, 1035 bp, Glycine max
  Peptide Sequence Number=SeqID_180502
atgaaagcagggagatcgatgatgagcatggaggaagcctcaaagaggcgacctttcttcacctcaccggacgaactgtatgatgaggagtattatgacaagcagtcgccggagaagaagaagcaccgcctcagttccgaacaggtccatctgttggagaagaacttcgaggaagagaacaaattggagcctgagaggaagacccagttggctaagaagctgggattgcagcccaggcaggtggctgtgtggtttcagaaccgcagggctcgatggaagaccaagcaacttgaaagggattatgatgttctcaagtcttcatacgacaccctactttcatcctacgattcaattatgaaggagaatgagaaactcaaatctgaggtggtatccttaaatgagaagcttcaagttcaagctaaagaggtgcctgaggaaacattatgtgacaagaaagtcgatccacttccagtagatgaagatatggctccgattttcagcacaagagtggaggaccacctgagtagtgggagtgttggaagtgcggtggtggatgagggtagtccacaggtggttgttgacagtgttgattcatactttccagctgacaactatggtggatgcatgggcccggtcgaaagggttcagtctgaacaggaggatgggagtgatgatgggaggagttacttggatgtgtttgtggcatctgaaactgagaatcaaaaccatgaggaaggagaggcattgggttggtggactaatatgtattatgttggatgtatcatgtgggcgagaggaggaaaaagtgaaagcccgatttggctggcttggacccctagcagttggagtgtccttaagccaagatataatctaacaccaataacagagatattcggacctaaagatcatcatcaagcaagcaatgagaaagcttacagatatcattcaacctacctcccaaacacaccctatataatggacgcagcaaacacttatgcaagggctaactcgacacgtgcaatgcacatgaactaa

SEQ ID NO: 63725 - DNA, 910 bp, Glycine max
  Peptide Sequence Number=SeqID_180503
aaattcaagattagcaggatggaaagcgagacttcttaatagggcaagtagagccactctagccaacaacccatggcttcatgggaaaccctcatctaattgggtgaactggcaaactgttagacaatctaagaaggatggagctttaggggtccgaacaacaagggaggccaatgcatgtggccatgttgggaaagcatacttgggctttgatgacctccaaggaacttgtggaggggtttcgtttcgtgttggcaagggggacacgtctatttggtttgatggatggtccgtgaatggccacttgtgcaacagagttgattacgtgcacattcaagatgtctgcatgactcttagagatattcatgcggaagtgacatggcactggaacatgattgctacttctatttccatggatttgaataatgagatatgcagtattttcattaatgatgctttgcctgatacaatgatttgggacccctctcagagtggtacttattatgccatccatgggaacctagatgttggctctccaattaccagaacacatcaaacacttcctatgggtaatcacaaaagtctacctactaatgcttttcgtcttcatacacacatttctactgattctctttgctgcagatcctccacttggatgtgtcgcaacaacacactgacatggattgctctcattggatgcggcgtttggcaacatccaaatttaggtgtgttcttctccattgcttgttggtacatttggaaagatcaaaatgaggaaatctttgatggttgggttcgcaactcaacttcagtcgttgttttgaaggagttcccaaccaacaaatcttcccctaccattagacacgttgggtggttagctccccttcatggcttcgttaaaatcatttga

SEQ ID NO: 63726 - DNA, 591 bp, Glycine max
  Peptide Sequence Number=SeqID_180504
atggagctctcggattccaccggcggtgaccgaaacctcaacgcgccgccgccactgccgccgccgcacaacaaccacaaccaagacgcgcgttccggcctcggaatcgacctaaacgagatcccgtcgccttcatcttcgtttccagaaaccctaccgggctccgtcaccgtcgacgtcgtccgctcatatcacgacaacccggcgccgcctccgggaggtcccgccgccctcccccgcagtggctcctctccctgcgccgcatgcgccaagccctcccccgccgccggcagccaccaccaactcgtcgtgtgcgacggctgcgagcgcggcttccacctcgcctgcgccggaattcgcggcggaggccggcaggcagcgagcctcgacgaatgggtctgcggcgagtgcgtcgccgccggagtgaagagcaagcggtggccgttgggcgttaagcagcttctcgatatcaatgctccgccgccgagcgacgccgaaggcgacggaggcgacgatgaagtgcagttaaaccctttaaggaggtttttcagtgaggatgttgggaatgagtggtatggcttgttggtttga

SEQ ID NO: 63727 - DNA, 1051 bp, Glycine max
  Peptide Sequence Number=SeqID_180505
atggcctctcattctcccaatagagaaggccattatcttaatattgtactattccttgcctttctcatctccatcatcaacccttcacaacaagacccttcttcccctcttcccccattaaacccaagactcaccaaagcttacacagcactccaagcatggaaatacaaaatcacctcagaccccaaaaacttcaccttaaactggtgtggccccaatgtttgcaactacactggcatatactgtgcacctgccctagatgaccctcacatctacacagttgctggagttgacctaaaccatgccaccatatctggttcattgccagaagaacttggcctcttaactgacctatcactttttcacataaactccaatcgcttctgtggttctcttcccaacagcttcgacaaactccacctcctccatgaacttgacatcagcaacaaccaattctcgggaccattccccgaggttgttctttgcatccctaacttaaaatacttggatatcagattcaacaacttccacggcaacgttccctcgcgcctcttcgacgtcaaactcgatgcactcttcatcaataacaacaatttccaattctctttgcccgagaacttggggaacagtcctgtctctgttgttgtgtttgcaaacaatgacctaaaagggtgtcttcctttgagtttggttaaaatgaaaggtacccttaacgagattatcatcaccaacagtggcttaacggggtgtttgcctagtgagataggggatttggacaaggtgactgtgtttgatgtgagcttcaacaagttggttggagaattgcctgagtctttgggaagaatgaagaggttggagcagctgaatgtggcgcataacatgttgtctggtgagattcctgagagtgtttgcatgttgccgaggttggagaatttcacgtactcttataactacttctgcagtgagtctccagtatgtctcaagttgaaggagaaggatgataccaagaattgtattccttataggccgttgcaaaagtcacctgatgagt

SEQ ID NO: 63728 - DNA, 258 bp, Glycine max
  Peptide Sequence Number=SeqID_180506
atggacgtgcctctgcctatggttttggctttgttgacggatgttgtcgactgtgtgctgacacagttagccttcgatgcctctctccatcatcatccccttcatgtgaggggctcgggccctcatgagagggatcacacccatccacgaggaaggaagaaggagaaggagaagggacacgagtttgggacgaagatgaagaagaagaaagggaaagagttgctaggaaggggaagagagaggggtggggaattttaa

SEQ ID NO: 63729 - DNA, 177 bp, Glycine max
  Peptide Sequence Number=SeqID_180507
atggtcttcaccagtgccattggttttcttcttctgcaaactctttcatcagctacaagtgatttcctatttcctcttagtcccctgatcgctccattatgtgggcgagttaagttcagaggatgtgtgcaaaggagtggaatgtggatagggaacatgcaaaccttctcagaatag

SEQ ID NO: 63730 - DNA, 228 bp, Glycine max
  Peptide Sequence Number=SeqID_180508
atgaagattttgctcatgactcaccttagctttaattcagaggaaaaggctataacagcgatcaccaccttgttggaccttaaagctttgctagagggtacaagtcattatcagaccacacaaaaagctctacaattattgcagaagggcttcaaagctgggtgtagcttagaaaggcaaaggaagaggactgccaaggatggtggcaaaggtggaaaaggcggatga

SEQ ID NO: 63731 - DNA, 180 bp, Glycine max
  Peptide Sequence Number=SeqID_180509
atggcacaggctggtggtttggaattattattagagctatttaatgtgtttggtggcttctatctggatgatgaaattcagatcacagaatcctcagctctaacacccatcttgcctgtccctgtcccatctccacccccttcaacttcaattgtgctttatacgggttcagtgttctag

SEQ ID NO: 63732 - DNA, 159 bp, Glycine max
  Peptide Sequence Number=SeqID_180510
atggagcaaggcaacaagggtaggatgggaagttcgaaaaaaggagaagagaaagagaatgtgagatcaaaggaggaagatgatgacgtagccaggcacgccaacacgcgcaattatcagaagaaatcccttgagttgaggttaagaagaatcacgtga

SEQ ID NO: 63733 - DNA, 138 bp, Glycine max
  Peptide Sequence Number=SeqID_180511
atgggtcttactcttggcagaggcggcatcagatttcactccattgtttacttagtaaaaaccattctccttgctcgtagatttcgtgatttgaagaagaagcgccaccatcacggcgtaggggcggatgcattgtaa

SEQ ID NO: 63734 - DNA, 546 bp, Glycine max
  Peptide Sequence Number=SeqID_180512
atgacagttattttaacagtggtgttattatttgttggatttgtgttcctggtcctacttcatgtttgtttttccgagagactctttaggagaggatcaatggttgagaggggtgcaaatgtaggcagaagcatgtccatagatgacttggagatgcttccatgttatgattatgttgccaaaggcaacacaagcagccctgtggattgtgcagtttgcttggagaacctcatcacaggagataagtgcagattgttacctatgtgcaagcacagttttcatgcccaatgtgtggacacatggcttctaaagacacccatatgtccaatttgcaggtgtaatgctcattctcatagtggaaaccaagttgtaggtaacaatgactactttgttgcaccaaatagtgggtctagggagagccaaagtcagcaacatgacaatatggtattggtgcagttgagagaaagcctagaaaatgttccatccacaaatgttgacatagaaaatccaacattaggaagtcacaacttggtcagagagcactaa

SEQ ID NO: 63735 - DNA, 252 bp, Glycine max
  Peptide Sequence Number=SeqID_180513
atggcgtcgtcgccgccgcgagcttcgactttgatttcagcttttctgagactcttgcgtcattaccggaatgtggccagtgtaaacgacgaagccgttcacccgcgtgttggtggtgtcgttttcggaatcgggggaaacggtggcggcggtgtaatccagggggggagggggggggggggggtaagagaagggaaggggacatgggaatcggagagagagatagggttttggagtaatgttgttgattga

SEQ ID NO: 63736 - DNA, 171 bp, Glycine max
  Peptide Sequence Number=SeqID_180514
atggagttgacaatgacaccaaacttaggaaaagtgatgaacaaacatgaaacatacttgaacaaagcagtcatgaaagtggagccttatgagactagcaagcattcgaggtgtgctgaacctgttgatgagaagcatctatttatagagacacatggcctctctgaatga

SEQ ID NO: 63737 - DNA, 255 bp, Glycine max
  Peptide Sequence Number=SeqID_180515
cgagcattcgttaagcgcgacactcagtggctaagtgcaaggaagaagccagaagaagatgagctgtcaggttcactgagctcaccgctccaggtcatcaagcgcaccgcttcagctcatccactaagcgatagaagcacgctaagccaaaatccacttatgcgcgctaagcgattcaggagtttggcattttttcttgagaagcctctacatgcacgcgagtctggccttggcttgaagcttttgcatgtttag

SEQ ID NO: 63738 - DNA, 330 bp, Glycine max
  Peptide Sequence Number=SeqID_180516
atggtgtgcactagaccggatttgtcatatgttgtaagtcaagtttatgtccaacctaggcaagcgacatttggaagtagcgaagtggatcttaagggtgatccttcagttgtggaatacgtggattttgactatgctagtgatctggatgacaaaatgtctacaacatggtatgtctttgctcttgtaggtgagcctatttgttggaagtccattgttcagtctcttttggcaatgccaacaaccgaagtggggtacatgattgtagcaaaggcaaggaaaggagttgtgtggttaacacgactagtgaagaagttaggcattgagtaa

SEQ ID NO: 63739 - DNA, 213 bp, Glycine max
  Peptide Sequence Number=SeqID_180517
atgtgctataacgtattacagagcaagagcctggtcaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagaattctggacttagcgtaa

SEQ ID NO: 63740 - DNA, 498 bp, Glycine max
  Peptide Sequence Number=SeqID_180518
atgagagtcgtagagaaagtttcaagaacggatacacgtatgcctgccagtttcgtcaggcttttctttcatgactgctttgttcaagctcatggtccttttttaaaatttcccttgggaaggagggatagtttaacagcaaaccgaacccttgccaatgaaaaccttcctgctcctttcttcaacctcactcaacttaaagctgcctttgctgttcaaggtcttgacactactgatcttgttgcactatcagctcactgcttgttcattcttgaccgattgtacaatttcagtggtactggcaggcccgatccaactcttgatacaacttacaacaactgcgccaaatatgctcccaagaattactactccaatgttaaggttaagaagggcttgcttcagagtgatcaagagctgttctcaacacccggtgctgataccatccccattgtcaacaagttcagtggtgaccaaatagctttccttaaacttcaatga

SEQ ID NO: 63741 - DNA, 852 bp, Glycine max
  Peptide Sequence Number=SeqID_180519
atggggcagttccgccccgccgtcctgccatgccgattcacaacagaaggattcgtgtatgaagcgacacacgcaacgctccgcgccaccgcgctctgcgcgcctggcccttgccactgccctggtgctgggcagcctggccgtcaccgcccaggcccaacaggccgatccactggcggggatacagtggcacctgctcaacaccgggcaggccgtactgggcgataccctgccggtggccggcaacgatctcaacgtggacggcctggcgtgaccatcgccatcgtcgatgatggcctgcagattgcccacccggacctggccgccaacgtggcggcggtcgcgggcaagaacttcgccaaccagagcaacaacccttcaccgtccaatccggaccgcgacaatcacggcaccatggtcggcggcatcgccggtgcggtgggcgccaacaacctgggcgtgcgcggcgtggcctcggcggccacactcaagggcttcaatttcctggcatccaatgcccagggcaattcgaactccaacatcgagtactcgtggtgggacggcgccgaagtggccgacgtgggggtcttcaacaacagctggggctccagcccgggcaaccccaacctgccgttggcctacagccagaacgacatcaccgcctatgagcaggccatgtccggcacccgtggcgggcgcggtggcatctacgtgaaagccgccggcaacaaccacaacaacggcgcacgctcggatggcaccgacatctgctcggcagacaccaagaaccgcaacacgggctgcattccggccggccgcgatccgcgcaacaacctgttcaacgtgatcact

SEQ ID NO: 63742 - DNA, 829 bp, Glycine max
  Peptide Sequence Number=SeqID_180520
atggttgatcgaggaaacgcggtcgcgggtgatctggccggtatcgtacggaatcagttcggacagctcaccgcaggtgtaggcgccgcaggactggtccgcattctccggcgaggccacgtaccaggcccacgcataatcgggatagaagatgtcggccttccagcccagcttgcggatcatgtcgaaggagatgttgttgtagccccagaccttggccttgctgtcggacaggagcacggtgaagtcaccccaggcgacgtcctgctgcagcttcaggtcgccgcgcaggaaattctgcgtgccctcgccctggtacttttcggccgatacacgctgcaggtcgaccagcactttcgggccatgctcaccgagctggccgctctgcccggatacggtggtgaccaacgtgttgttgctgcccacgccctgcttcacgcgaatgctgggcgtgtcctgcaggtcgcgcagccggtattccaggctgccgccgttgacgctgctggagaatacgctgaccggtgcgccaccggggctgaccgtgatcgcgccgatgccatcgggaacgcccacgttcaccacgctggtgccggtaagcgagaggaagccgttgtcgttcagcggcacgccttcgaaggtgatgcccatttcgttcatgcggaagccgcgcacgaacaggctggtggcggagatatccaggcccagcccgtcggtggcggtgtagctggcgcccggtacctgcttcagcatggccaggccgttgttgccggtgaccatcgcgtcgaggtcttcggccttgatgatgtagcggttggggccgatcacctgg

SEQ ID NO: 63743 - DNA, 900 bp, Glycine max
  Peptide Sequence Number=SeqID_180521
atggatcttgagtctgtgatccacaggaacacaattaaggaagaatcatggaagacagttttgactttggcctatcaaagcttgggggttgtgtatggagacttgagcacttccccactttacgtttacaaaagcgcttttgctgaggatattcagcattcagacaccaatgaagaaatctatggagtgttgtcttttgtgttctggacactcacactgattccactgctcaagtatgtgttcattgtgctgagagctgatgacaatggtgaaggagggacctttgcactctactcattgctgtgccgccacgcccgggttagcttgttgcctaacactcagcttgcggatgagcacttaaccgagtacaccatggacaatggaactgttcctgtcaataggaaaaatgttgggttggggctgaaaaacttgttggagaaacacagggtgctgcaaagggtgctgcttgttcttgccttgatagggacttgcatggttattggggatggtgtgctcacaccagcaatttctgttttttcagctgtgtcaggtttggagctttccatgtccaaagaacagcacagatatgtggaggttccagtggcttgtgtaatactgatatttttgtttgcccttcaacattatggcactcaccgtgtggggagtctctttgcacctgttgtcttgacctggctgctatgcatcagtgctattggtgtttataatatcttccattggaatccacatgtttatgaagctctctccccatattacatgttcaaatttctgaaaaagacacaaaagggaggatggatgtccttgggtggaattctactgtgtataacaggttcagaagccatgtatgctgatttaggacacttttcacaattgtcaattaaa

SEQ ID NO: 63744 - DNA, 204 bp, Glycine max
  Peptide Sequence Number=SeqID_180522
atgaagaacagcatcaacaacttcaacaacagcatcccaagttgcaacaccaacagcaccaacaggtcaagctccaacatcagcaccaagttcacacgcgctattcttccacccctcaaggttattatgagcagaactgcgagacaaatgagattgtgtttggtgcagttcaagagcatgatggaagacgagaagccatggtga

SEQ ID NO: 63745 - DNA, 237 bp, Glycine max
  Peptide Sequence Number=SeqID_180523
atggtttgcacacataatggtgggcatttcttacagcatggatgtaattctggttggctcttgaaagacaaccttctgatacagcttgttataaaggtgacatcaccatatgaaaacaatcttcatcacaaggagaacacaacacatgccaaggattgggattcagttgctagaaaagagaagattgaggtaaacttccaagagattcgcataattttgaatctccctatactatag

SEQ ID NO: 63746 - DNA, 186 bp, Glycine max
  Peptide Sequence Number=SeqID_180524
atggaggtgcgttcctcggagttggaagagcttgttctagaaggatttaaggaacaaacggtcgtggtcggatacaatggtattaggcaacctgtggagatggaaaatctcaatattgaaatgacaagccaagtcacgagcagtaaaaaaagcaggtttgacaggcctgcaactagtgtagagtga

SEQ ID NO: 63747 - DNA, 951 bp, Glycine max
  Peptide Sequence Number=SeqID_180525
ccgcctccgccaccgccacctccgaagaagcttgtgtcgaaggcggcggcgcctcctcctccaccgcctccgccgccgaaggccggtagagaagttccggcgaaggtgcggagagtgccagaggtggtggagttttaccactcgctgatgcggagggactcgcattcgcggcgggactctgcctccgccgcggaggtgctggcgacggcgaacgctcgtgacatgatcggcgagatcgagaaccgttcgactcacttgttggcgataaaaacagatgtagaaacacaaggagactttattagatacctgatcaaagaggtggagagtgcagcattcacggacattgaagatgtggtaccttttgtcaaatggcttgacgacgaactctcttatttggtggatgaaagggcagtactgaaacacttcgattggccagagcagaaggctgatgctttgcgtgaagctgcgtttggttattgtgatctgaagaagttggtatctgaggcttcgtctttcagggatgatcctcggcagctgtgtggtcctgctcttaagaagatgcagactctcttagaaaaattagaacatgggatttacaatatctcaagaatgagagaatcggcaacaaagagatacaaagtgttccaaattcctgtggattggatgcttgatagtggttatgtcagccagatcaagctggcatctgtaaaattggccatgaagtatatgaagagagtctctgctgagcttgaaacaggtggtggtgggcctgaagaagaagagcttattgtccaaggagttagatttgcattccgagtacatcagtttgctggaggttttgatgtggagacaatgagggcgtttcaagagttgagagataaagcgaggtcgtgccatgttcaatgtcacagccagcaacagaaattattttgcaggtctgccacatgctaa

SEQ ID NO: 63748 - DNA, 594 bp, Glycine max
  Peptide Sequence Number=SeqID_180526
atggttgccggtaaggtaagagtagcaatggggtttcagaagtcgccggcggcgccgcacactactcctccgccgcagaagaagcagcctcctcctgcttctccgtccaccaccgcgaagtcttcttctcacaagtcctctttctctcgctcgttcggcgcttacttcccgcgctcctccgctcaggtgcagccgcggccgccggacgtggcagagctcctccggctggtggaggatctccgggagagcgagtcgcgcctgaagacggagctgctggagcacaagctgctgaaggagtccatcgccattgttcccgttctggagaacgagatcacagcgagggaaagtgaaatcgaaaggagcagaagaagagcggaagaagcggaatcggagaacgagaggttgagaaaggaattgcaggaactgaaggtgaaagcggaagaagagaaaaatgagaacgagagaaaaatcaaagcgctggaagaggaaataatagagttcaagaaaacggcgtcgtttattggtagtaacagtagcagcaacagaacagaggcattggagagtcacgagcaagaagaagctacacagaagctt

SEQ ID NO: 63749 - DNA, 621 bp, Glycine max
  Peptide Sequence Number=SeqID_180527
atggttactgtagatatggtcatcccagttcatccttcggaagaaataactccagcaatggtcatctatctctcaaagatgtttctcagtctagcttcaaggacctctgtggatcatgacaagctttgggctatgaagcacggataccctaatcccttgtcgtgtccggtgtccgacacggaaacaacaagcgctttaattaataacaaagccatctccttccactcagcaatttcgttgatagttgggaaaattagaattacaagtaatgtttcttcatcttgtatgaactcttctatccaggagtttgtcatcagcaagctgcttggtatttttgatcatcctagaatagcagattgcatttctccagtcacttggaacccccctttgcagggttgggttaagtgcaacaatgatggctcggctaagggctctcctggcttagctggttgtggtgccatcttcagggatcactcagctaactctcttggttgcttttctcaaaatttaggtgtaaataattctttttttggaaagattatgggtgccatcttagctattgagatagcttttaacaaaggctggttgaatcttggctggaatgtgattcaactctggtag

SEQ ID NO: 63750 - DNA, 297 bp, Glycine max
  Peptide Sequence Number=SeqID_180528
atggtatcagatggagtagtggacaatcctcattctaaagttgaggagatccaagaatttgatgggcacagagattctgatactggtagggcaaagaaagacaagaaaaaaaggaaaaaggaggagggagaagggtgcaatcaggaggaagtttatattatttcctctgttgacgatgactgctcaaaaggaatgaaaaaatggatcatggaataccatcaaagtagaccaggattggatgtattgcaaaatcaaattgatgactttataacagctcatgaggcaaaactggaagag

SEQ ID NO: 63751 - DNA, 849 bp, Glycine max
  Peptide Sequence Number=SeqID_180529
atgagaccaaagatatttcttttcggcgattcaatcactcaggattcatttgctgaaggtggatggggtgcttctctcgccaaccatttctcccgcacggtagatgtggtgttaagaggttacagtggctacaacacaaggtgggtgttgaaggtgttggagaaggttttcgctgcaacacaacatggtgatggtggaatcaatggagcaccagttgctatcactattttctttggggccaacgatgcttgccttccagatagatacggtgcttttcaacacgtgcctctccttgagtataagcagaaccttcactctattgtgtccttcttcgtgatgatcgaggggacccttgagaatggggaaaaaggtcaaacagataacaggaatgttatttgttgtaaggtatgcaagcaagaaaggattttggaagagaagagaccctcatttactttagagaagcaatggccaacaacacatattctccttataacaactcctccaattgatgaagaagcacgtcttagatatccatatgcatacaatccacagggtcttccagagaggacaaatgaagctgctggtgagtatgctacagcatgcattgctgtggctgaagaatgtggagtacctgtgattgatctctggaccaaaatgcagcagtgccctgactggaggaaagaatatctatgtgatggtctgcatctaacccaaagtggcaatcgagttgtttttgaggaggtaatcttgaagctgagagagaaaggcttgagtttagaagctatgccagttgatctccctctactagctgatatcgacccgaatgaccctctgaagtcatttcagtaa

SEQ ID NO: 63752 - DNA, 375 bp, Glycine max
  Peptide Sequence Number=SeqID_180530
atggctcagggaagaagcagtgctgcaacaatgctattgttatgtatgttagtgctttactctgagatggttcatgcagccacctatgtggttggtgatgcaactggttgggcgtataatgtcaataactggcctaatggaaagagttttaaggctggtgatatactcgaattcaaatatagtcctttcgctcacaacgtgatacaagtggacgagtttggatacaatacatgcattcctacattcaactcaagattgttcttttcaggagatgatcacatccagcttgccaagggtctaaactacttcatctgcggttttcctggtcactgccagctgcatgggatgagaatagcagtcaatgctactgcatga

SEQ ID NO: 63753 - DNA, 243 bp, Glycine max
  Peptide Sequence Number=SeqID_180531
atgtctccaaaggccttcgccatctcagttccgcattttccgttttggacgctaatcgaccctggctctgctactggatcttccactccattgctttgtcgggagaatccgtcgatgatgaactcgaagataacgctatcgattttcttaaccgttgccaggatccgaatggtggatatgccgggggaccaggccaggcaagcaactattataatcttttgccaatttctatttgattactga

SEQ ID NO: 63754 - DNA, 258 bp, Glycine max
  Peptide Sequence Number=SeqID_180532
gctaacggcggtgctgaaggtcacgacgctttgtccatgcaagggccttctttgtttggtttttgggacaggctaacggcggttctaaaggctaacggtggtgctgaaggtgacggcgttttgccatgcaagggccttctttgttcggttttttttttccgctttggtttttatgttgctttggatgggaaaaaggatggtgaagctgcatctgaggaggtgacaaacagttaccatgttctgagacaaatagagtga

SEQ ID NO: 63755 - DNA, 525 bp, Glycine max
  Peptide Sequence Number=SeqID_180533
atggttgaaaatgagacaatgttaaagatgaaaaagcttagaactaacaatggtggtgaatatgaagacaccaaatttaagagcttacatgtacagtcaagcctacgaaagcagttttgggcagaagctatgaacacaacaacttacttgattaaccgaggtccactagtaccattggaacatagaatactagaagaggtggatgatgtcccagaaactcttgtaattgtgagtcatcaaccagaggaatcaatggaagataacaggaagcctaaaaactatgaagaagcataccaaactataaatgctggcaagtgggagcatgccataaaagatgagatgaaaattgttgctagtgaagagctctaccttgagcaattggatgtgaaaattgtatttcttcatggagacttagatgaggatatttacatgcaccgacctgaaggtttcttagatgaagggaaaaagtatatggtttgcaagctaaagaagaacttatatggccaaaaacaagctcagggatag

SEQ ID NO: 63756 - DNA, 924 bp, Glycine max
  Peptide Sequence Number=SeqID_180534
atggtgcttgctggtacaccacaaccttattgcagtccttgggtcattaatggaaattctagggttgttaatggcagtctgcaagttattggtggttcttcaaggaccgaggggcgttattatccttctttgtgcaaactctctggtgatccgaatggttcagaaatgcaactttcgggaagagaatgtggggtggaaaaactcgaatgttgtgtgcacgggtttaaggagtcaatctgggaggaggattttccgactaagttcagccacagatttgtcgtctccttatgttatacttctcttatgggcttaattgagttgtcatttgcacaacctcttatttttgcagatgtagttgtcattattgagatcgacgttttgagctcgaggctatttgttgcatgtgtttcatttacggtgtgcctggggagattggagacgataatgctaacctacacttgcggcaatgacttccaagattatattgatgatgccaaagaatcaagagttaagcaagttccaaagaatctggagtctaaaagcttcaagaatcaagtttcaaagaatcaagattcaagaacaatcaagtttcaagattcaagattcaagattcaagaacaatcaagtttcaagaatcaagattcaagaacaatcaagatcaagattcaagaatcaagagaaggctcaatcaagataaggtacatcctttgtggtacaagtagagggtatatctacttgggttgttatactaagaacaagagagggtacatgtcttgtggatcaattcaagtggagggtacatccacttggtttttcaaagagaacaagggagggtacatcccttgtggatctttggcttgtaaaggattttacaaggttgacagaaatctcaagaaccgttggttgcttggggactggatgtag

SEQ ID NO: 63757 - DNA, 207 bp, Glycine max
  Peptide Sequence Number=SeqID_180535
atggataggccaaagcgtttgtctccaaaggagaaaatgggcggagtcgccaccaacgtttatttgaggaaaacgttagaaaaactaaaaaggcgaaggtctgtggattttgaaaatgagggttcaggagttgtttacgcacggggaagggtattgccctggctcctacgtagcctcaggtgcgatgaggaacttagacctatgtag

SEQ ID NO: 63758 - DNA, 735 bp, Glycine max
  Peptide Sequence Number=SeqID_180536
atgagtgaaatagaggaggtgcaagaacagatgaaggccgacatggaggccatgaaagaccaaatggctgccatgatggaggccatgttaagcatgaagaaaataatggaaagcaatgtggttgtagttgccactacgagtgccgccactgaggtagacccgactcacccatcgggccttaatcaagtaaatcctccattctggaatatgagcaagaattctttcccactatacggcttgcctcccaactatgcaccacccaatgctgtgcaagtgcctgacgagaacgccaaccactctactcatccttacctcggacatgccattgaggggctagcatttggtggcgttccccagtctaacacctcgaggggcccgcagtaccacccacaaccacaacccttgccttttgcaatgggaaaggtccctttcgccatggtggaaagggaaaaattcaatcatatagaggaaaggttgaaggccattgaggggattggtgactacccttttcccgacatggcagaattatgcctagtgcttgatgtcgtcgtccctcccaaattcaaggtgccagacttcgacaaggatctggtagctcaagtagcgccccccatggtggagagggagatgataacaatgatagtagacatgttaccagtgttctactacgagaagatggtgggttacacgccttcaagctttgccgatttagtttttgtcggcgaaaggatcgaa

SEQ ID NO: 63759 - DNA, 397 bp, Glycine max
  Peptide Sequence Number=SeqID_180537
atggagacacatcttgtgctcgctagttactcatattctgattatgttgtagatttggatgtatggagatttgtgactgggtgcgcgttcacgattggaaattttcttaagggcaaggatcaagtctatcatgagaagactaagggcattgaaatcagataccacttcatccgtactaagaagagggttgaagtccataaagttgatgcgagggagaatccaactgatatgttcatgaagcctattccaagaagcaacttcatgcattatggccccttggagttgttgtttatctctaccatagagtgtgacgtgggagttcaagaagaagaagaggtagaagaaagcatcgtgctagagaaagagatgaaagcacaagccaaactttcaacccaag

SEQ ID NO: 63760 - DNA, 138 bp, Glycine max
  Peptide Sequence Number=SeqID_180538
atgctgcgtcagagccacatgagtgaaaaagatttggccaaggctaaggatgtcactaagcaagtgaagtttaagagctccacaatcaaaaacattattgatcaaaagcagtttgaagcacctgatgagattgattag

SEQ ID NO: 63761 - DNA, 792 bp, Glycine max
  Peptide Sequence Number=SeqID_180539
atggatggccatcatcagaagcaaaaaaacaagtacagtataattgttcctacatataatgagcgtctcaacattggtctcattgtttacctcatcttcaagcaccttggggatgctgattttgaaattattattgtggatgatggcagtcctgatggtactcaggatgttgtaaaacagctgcagcaagtttatggagaagatcggattctgttaagagcacgacctaggaagctgggtttaggaactgcttatattcatggcatgaagcatgcatctggaaattttgttgtcatcatggatgctgatctatcacaccatccaaaatatttgccaagcttcattagaaagcagtcggagactggtgctgatatagttacagggactcgttatgttaaaggtggtggtgtgcatggatggaatcttatgcgtaaactaactagcaggggggcaaatgttcttgcacaaacacttttatggcctggtgtctcagatttgacaggatcttttagactttataggaaatcagtgcttgaagatatcattagttgctgtgttagtaaaggatatgtctttcaaatggaaatgatagtacgagcatccagaaaagggtaccatatcgaagaggttccaatcacatttgttgatagagtatttggaagttcaaagcttggtggatcagagattgttgaatacctaaaaggcctagcatatcttttggctgaggtcttctctgtttcgccccttctaggcgccaagacgccaactgtaaaattctgctccaactattga

SEQ ID NO: 63762 - DNA, 1374 bp, Glycine max
  Peptide Sequence Number=SeqID_180540
atggcttccacgtttggcgcatcttcaattaccttcctctcttcacgatactactcttcccaatcccttgccaccgattctccctctctaaccacagtgcagatatttgggcgcaagttttgcggcggaggaaatggatttcacagcgtcaagggaaggtctctgttcccggttgcgagtgttcttgccactcaacttaactctgcacaacagtgctggattttcacaacttttggtaaaggattgaatacttcacatacacatattggtgaagtatccaagagaattggtattggatatgaatacctaaagcaaattaaagctcagaagattgcttttaccgagagccagaggccagtgtacccattttcggctatagttggacaggatgaaatgaagctttgccttctcctaaatgtgattgatcccaaaattggaggtgtaatgatcatgggggacaggggaacagggaaatctacaactgttagatcattggttgacttgcttcctgaaatcaaggttgttgctggtgacccatataattcagacccagaagatccagaattcatgggtgttgaagtgagagagcgtgtgataaaaggagagcagcttcaggttgtctcctccaaaattaacatggtggatttgccattaggagctacagaagatagagtctgcgggacaattgacattgagaaggccctcactgagggtgtaaaggcatttgagccaggtctactggctaaagctaatagaggaattctgtatgttgatgaagttaaccttttggatgatcacttagttgatgtattgttggattctgctgcatcaggatggaacacagtggaaagagagggtatttcgatttcacatcctgctaggtttatcctaattggttcaggcaaccccgaagaaggggaactcaggccacagcttctggacaggtttggaatgcatgctcaagttgggaccgtgagggatgctgagttaagagtgaagattgtggaggagagagctcgtttcgacaaaaacccaaaggttttccgagattcttacaaggcagagcaacaaaatctccaacaacaaattgcctcagcaaggagttttctttcttctgttcaaattgaccgcaatctcaaggtaaagatatccaaggtttgtgcagagttgaatgtggacggattaagaggagacatagtaacaaacagagctgcgaaagctcttgctgccctcaagggaagagacaaagtaagtgcagaggatattgctactgtcatccctaactgcttgaggcaccgtcttcgaaaggatcccttggagtcaatagattcaggtttacttgtcctagagaaattttatgaggttttcagatga

SEQ ID NO: 63763 - DNA, 2355 bp, Glycine max
  Peptide Sequence Number=SeqID_180541
atgaattttaatctggatggtgaattcaacaagatatcatcatttaagttggacatgtcagatcttgattttacatgcccagccaagaagaattcccagtctaaggataagaaaggagaagtttctggttcacaagaagggaagcaagatgggtttaatttcagctttgattttaatgattattggcataggttgggtagcttcaattttgattcaagcttcatgaaagtagtaactacctccaacagtagcccaagaaaaaagggagtaactacagaaggaagtgataaagaaggtggtgaaatgcttaaaaccaatgatgatgaaggtgctcgtgcatctaatgatagcacaactgtgaaatcccatgcatcagtgaggctggaaacttcgaaggttgagactgtggttggtagcccagggaatctagtttccaaacaggatggttctgtttccaaaatttcatcctctgggaatcttgacatgccaatggagaatcaaactttagatataaataaacataaaagtacagaggaaattgatcaagaaagagacttacctgaaaagtcaaacttaacaggatcaaaatctgagcaggttatcaatatggcaagttctcagtcagtaggtgagagtgattcagaacagcacactatctcagaccagcatacaaatgctttttcatctggaacaagagtcagtaatgtttcaggagataaacaagtggttaacgataagacaacatatcagtttaaaaaatgtgacatacaagaggttaatgataaggcaacaaacgtgaaatctgatagtgtagacttacaattagagcattcctccccacatcacgtcactaagtcagatagcagtgttggagaagcaattactctaggtagcagtacccaagaaggagttactagtgaccctcagccagaaaagagtaaacctgtagttgaaaaaatgatgctgatgaaagataaaaaactccaagatctgcagtcaaatatgttcagcacaccagagggcaaaaggtctttaaaacaaccttcatccacaattgggacaaagggtagttctcttggcaacgaaaaaaatattgacatcctcctcggatccattactcaagcacggtgtgttatgcttgtgataacagttatagttattggcctttcaatggtggaatgttcatttatatcactcaacagggagaacttcaggtcaaatgacacaaaacatggaaggaaactggtaggtgattccctcacagattccagcaaattaatgaggaatgcaggagttttgcttggtagtaaagatgatcttaaaagttgtagcaataccagggagggcattgtttctgatgtctcaccatgttcaggaaaattggctgggaataagcaatcattttttgatgaagtaaataaaagcaagaccacatttctagaaattggcatttcaactgaagatgttagtatgctgaggagctttggagctaacagggttctaacaactgctttacaccaaaaagaaacaaactccctagtaagctctggccaaagcatggacaaatggggtattacaacatcaaagaatgaccattctattgacagcagtgacaatcagaagtcctcaaccccatttttgaagaggaaaactattgagaaattctttgaacatctaaaagactcaattccacaggcttctgatgctgattttacattgttgaggcccctaaagtgcatctcccagtcttctcctaattctgtagtttcttttattggtacttctggaaaagtaacaattcttaactgcagaagttctaaagaatcttcagaagaagttgttggagaggagacttggggatatttaagtgtgataattgtcaatactagattttttctctctctccatattacccaaatttccttccatgaaagtcaggtagagagtatgcccaacaatttactctacaatcattcaacctctggacttaaaagttcacctgtgattaaagtgacggaagtggaaatacatgatcctttactcatggaagataacaacaatgttgaaaaggctgaagcgtatattaaagaacttgaggatatttgtaacatgctgaaaaagaagcaagatgaagcaaaagaattattagttcaagccattgtgaacgacaataacttgctgatccttgaccatcccattcatgaagaagaaatatcctctcactattttttttattcatttccttctaatcatttaagagtagacattaatgctggttatttccttgacatttgtgaacatttgaaaggtacagaagtttgcttcccagttgatgcccaaggggattcaaactag

SEQ ID NO: 63764 - DNA, 573 bp, Glycine max
  Peptide Sequence Number=SeqID_180542
atgggttcaggtgattggtttaagacaataattagctcaagaaaatcaaaagaaggaagatcaaagaaattaaagactaagatttatacaagaaaaaagtccaatggtttagcaaatggaatgaaaagcgaaaatctagagtcagatggggtatcagttgaaactattgctgcaacaaggatccaaacagcattccgagcttataaggctagaaaatatttacaccgcttgagaggattcacaaaactgaagatccagactcaaggttcctctgctaaaaaacaagccgttaccactataacttatcttcattcatggagcaagatacaggctgagattagagctcgtcgtatatgtatggttacagaagacagaatcaggcggaagataatacattctcaactaaaacttgaggccaagattcatgacctggaggtaacttgtaaagctaacaggtggaatggtgtagtggttctgaaaccaagaaggaaatcctttcaaggttacatcaaagagaagaagcagcagtcaagagggaaagaaccatggcatatgccttctctcatcaggtag

SEQ ID NO: 63765 - DNA, 236 bp, Glycine max
  Peptide Sequence Number=SeqID_180543
atcacgtgcttaaggaatctgaacccctttcacttcgaccaacaaatgttggtggctccattagtaatttgtttttgcaactatatagagtatgtggtatcaatgtagcccttcttctgataagacatggagcagatgtggatgtggaggacaaggaagggtacacagtgcttggtcgagccacacatgagtttagaccaatattaattgatgctgccaaggccatgcttgagtga

SEQ ID NO: 63766 - DNA, 1026 bp, Glycine max
  Peptide Sequence Number=SeqID_180544
atgatggaatggaagtcttacgcggcagctattggagacgtgaccataacagaagacagattgaaatatgtagactttactgcgtcatatgcagaatcaggattgtcaatgatagttacagaagagttcaaagcaccgacatggatgtttacgaagcccttcacctggcaaatgtggttggcaactggtgccgtgttgatttatacaatggtagttgtgtggtaccttgagagggaacccaatcctgagtttcatggcaatttgcaaagccagatcagcactgctcttacgtttaccttctcctctctattctttgctcacagggagaaaatctatagccacttatctcgcatggtgatggtatcgtggatgtttctagtattgattcttagctcaagctacactgctagtctttcttcgattctcacagttcaacgactgcaaccaactgtgacagacatccagatcctgaagaacaacaacaagaaaattggttgtgacggagattcatttgttaggacatacctggagacagtcgaagagttcaagccagagaacatcataaacattggcagtgaaaacagttatgatgatgcattcaaaaacaactcaatagcagctgcttttctcgaactcccttatgagaaagtatatatcagtaaatactgcaagggatactatgcctttgcaatcaacaaaaaatttggaggactgggatttatcttccagaaaggctcaccagtggccagagatttttccaaagctatactgcgtctcttggaggatggaacagtgaaggaattagaagacaaatggttgaaacctgatggagactgccacaataattcgacctcacagggtacagaaagtttgaggcttgaaagtttctgggttctgtatgtgatctatggtgccgcttctactatttgttttctacttcatacaatcctgtcgctgaaatctagacaaacaacccgggatgaggcacgagaaggtaatgccaacccaggtgaggaaagccgatga

SEQ ID NO: 63767 - DNA, 888 bp, Glycine max
  Peptide Sequence Number=SeqID_180545
cttcctggagaacggaaagtagatttactcagaagccttgcagaattttcaccttatacaacaccacaagattcacgccaaatgcttccttctattgttcagttgcttaagaaatacatgacttggaagaagactggagaagagatgaactttacctatgttgagtgcttgttgtacacatttcatcacttagctcataaggtggttaccttaccttgtctaaagcaaatatgtgatagtagttgtatacggtgcataattgaacttggtgatccatctgataggcttggagaggacttttcagagcattataatgattttactgagagcaaaatctggtttggtctagaaatgctcactcctgttcatgactgtccttttgtcattgtagtgtggatcttcttgttgatcttattgaataatgttgaggagttcacccgggctacaatcaagaaattaactcaaggaatggatgaaaacaacaaatctatggccggtgctaaaactgatgaagaaaaggaaaaaattaaaactaaaaagcagaatgctacaactgggttgcggacttgtaataacattttgacaatgacaaagccattgcacgccaaagtgccttcttttattggagataagagaatcaatctttcttggaaagaagcaacaaaagcagcatctactgcaccggctgctggagcaaaacggcctgctaatgctgccaatgggtccaacaatattgtctcaaagaaaggtcgaggtgctggtggtttgcaaaatcaacttgtcaatagagcgctggaaggattgtctggtggtgggagagggggtatgaggggcagaggccggggctggggtggtcgtggaagaggaagaggagggtatcatcggtaa

SEQ ID NO: 63768 - DNA, 1671 bp, Glycine max
  Peptide Sequence Number=SeqID_180546
atgaatcttccatccactattcctctagcacttccaacctatttattcatttcgtttgttctagttaattgctaccatgctgaggctacaaatggagacgacatggttatatctataggagcaataattgatgttaactctcgggttgggaaagaacagcttgtagccatggaccttgcagctcaaagtcacaataacacttccaagagccacaagatggcccttcattttcaggaacccaccaaagatcccttcggacccacttctcttgctagaaatatgattaaaacacagaaggcgcaagtgattatagggatgcacacatggacagaagcagcttcagtggctgaattaggacgcgaaactctagttcctgtcatatcctttgcagcacctaccatcaccccaccattgatgccaactcgctggcctttttcggtaagaatggccaacaatggtactgcatatgcaaaatgtgttgcagatgtagtacatgcttatggttggcaaagagtagtagtcatttatgaagatggagattatgagatgctagctttgctatctgagaccctccaagaagttggttcaatgattgagtaccgtttagctcttccatcgccttcttatctacctaatcctggagagtttattcgcgaagagttgtataatttgattaaaaatatacaatcccgggtgttcattgttctgcaatcatcattagaaatggtgatccatttgttcagagaagcttcacacatgggacttgtggaaagagaatcagcttggataatcccagagagcataactaatttgcttgacactgtcaacaagtctgctatttcctacatggaaggagctttaggaatcaagacctactactctaaccatagcaatgaatatcaagactttgaggctcagttccgaaaatcttttcgggccaagtatcctgaggaggataactgtgatccgggattttacgctctgcaagcatatgatagcattaaaattgttgcgcaagcaatagatagaacggccagtggcagaaagactttgctaacagaaatactatctagcaatttccctggcttaagtggagaaattcgatttgaagcagcccaactcttgcagaatcctaccttcaggatggtgaatgtagataagaagagttacagagaattagacttttggactctaaaacgcgggttcatcactagcctcactacagaacaaggttcagatagtgtttctaggaacacagagagtttacgtggtgtaatatggccagggaaactagttagatttccgaagggctggaatctgcctactaaacaaaatccaatgcaaatagcagttcctggaagaacctcctttcccgcgtttgttaaggttgatcctgacgagcatcataattcatataaatttaatggattctgcattgaactttttaataaggtgatagggattttgaagtatgatctgccgcatgagtttcatcccatcaacggaacctataacgatctggttcaacttgtctataacaagccttacccttgcatatgcgaagaggctgtttccagatttgaacccatgaccaacaagtcaccaaggcacaactttaccgctgcaccagggctcgccctcaagttcccttacaatcagcaaaataaataa

SEQ ID NO: 63769 - DNA, 1497 bp, Glycine max
  Peptide Sequence Number=SeqID_180547
atggagaaccctagcagtggtgaaagatggagcagagcaggaatcgatgacaacatgctggctatgtttgatgcctccgaaaccaaggatgttcatcaagatgccctagatgaccggattgcttttattgatgctgttcgtgcttcttgtgaacatggaaaaccgcccacttcaaagatttttggggcagttttccacatgctgaggacagggaagtctctagagttgattgtgggaagttataagcttctggttgatttagacaagcacttccctcgtgtgtatttatctggcatggatgattcccgatcatcatctaactctccatcaaaattggttgtggttaaagaggcatgggctcccattattggtttcgtggataaggccactgctgttagtgaagccggtgacaaacagtctggtggatctcttgaccactctagctttcaagctctgattgaagagctggctgaaattttatctgagaccaaatttgaagcagcaagcatggagcccttgaggaacatgttaatctttcagtaccttgtcgttgtttttgaggatgattttctacctcgcaacgcaaccttgaactggagcatgcagagggagtctttgctcagcctgctactgggatctaggaaaataaattacaaaagcttgatgaagtatttcatggcaattctgtgtcaactatctcaacttcaaagtgaactcagtaaacatccagtgcttcaagaaagttctgaatctaagttatccaaaaattgtcatactgcactatctcttgctttacatggagtattaaaggacacatgtgtctcaatggagaaacttctagtgatgattatggaccttgatatggcaaggaagatagcagatattgaaggtcacactacaagaggagacagtccaagaacacctttgatggacataattctggatgaactctcttacaacaaagatagtgtccctgtttttcttaaggtggctcccaaataccatctctcttcccttcccctctctgttcctctcacacacttctctttcgttgctgataactgtctgtatatggggctagatgaaatcttcagtgaatctaaatggaagctagaaatagttgtgcagtatctgtggaaatacataaccaagccttctgttcgtacccgcaagtcaaatggtcatactgaggatgcaacatttgatggggctttgaagtgcttttcaaataaaactggcactaagagcttaataaaaaaaattggtgtagatgtagttcaattccttctggctcatggttttcaggctcacttgtcaatattgtcaaaaggaaatgctggtgataaacaagggggagacagtgctattgtggattcgtgtcagacttttatctctgcttttgatagtttgagaagcacagatgcgcaaatggagatattgtctataggaaaagaggcactatttactgcggcaactattatcttcatgaaatcatag

SEQ ID NO: 63770 - DNA, 392 bp, Glycine max
  Peptide Sequence Number=SeqID_180548
atgactacaactagggtggtagcgtcaaagagaaaaaaaaccaacaaaaatagtgacctaaggttgatcgacattggggagcaatgttggggaggtagggcaacggaaggggatttggtaatggagaaaggagttattgggaagaaggagatgggaaggaaacataaatcacatcacatagggagaaatatacgaattgaaaatagagataagaaaggaggaaggacatttcgccatcactacgagcgaaacaccacgtggcagcatggcatgcgtttcgccattggtgttggcgaaacatgctgcaacttttttccagcgtggcatgggtctcgcacgggtgctgacaaaataagcttgatggggtttggccagtaccactggcgaaacag

SEQ ID NO: 63771 - DNA, 1050 bp, Glycine max
  Peptide Sequence Number=SeqID_180549
atgtctctcccttcttttgctaccacttctttttcatttctattcacatctttctttgttttcttcatcttgtgtggaaattcttcatcttccttagcaatacatgccaacactacacgcccccctcgccagctctcagtaagttactatgccaaatcatgccctcaggtagaacagcttgttggctcagtcacctctcaacaattcaaagaatcacctgtttctggccctgccaccattcgtctcctcttccatgattgttttgtaggaggttgtgatgcatcaattttaatagcatcaaagcctgggagcaaggagttggcagagaaagatgcagaggataatagagacttgaaggtggaagcttttgagactgtgagaaaggctaaggaacaagtggagagaaagtgccctggtgtggtgtcatgtgcggacattcttgtaattgcagccagagattatgttcacctggcaggagggccctattaccaagtgaagaagggaagatgggatggaaagatatcaacggcatcaagggtggcctccaacatccctcatgcaaactccaccgttgatcaactcatcaaactcttcacctcaaagggtctaaccacacaagacctagtagccctatcaggggcccacacaatagggtttgcccactgcaagaacttcgtggcccgcctctacagttaccgaggcaaggctcaaccggacccaaacatggacccaaaactattacatgtacttagaatgtattgtccaaactttggtggaaactctgacattgttgccccttttgatgccactaccccattcctatttgaccatgcctattatggtaacttgcaaaagaagttgggcttgttggcatctgaccagaccttggctttggacccacgaaccaagcccattgttgaggatcttgcaaaggacaagcagaagttttttaaagcttttgtgggggctatggacaaattgagtttggtgaaagtggtgagagggaaaaggcatggggagaaaagaagagattgtagcatgcatatgtga

SEQ ID NO: 63772 - DNA, 534 bp, Glycine max
  Peptide Sequence Number=SeqID_180550
atggaagcctctaactcacattcgtttctctctcttgtgcacctttttgtgcttttcttattgttatgttttgtggttacaattgaagctaattcaaagaagaaggtctcagccttttatgtgtttggagactccacagtagacccaggaaacaacaacttcatagacacggctttcaggagcgattttcctccctatggtagagattttgttaaccaggctgccactggaaggttcaccaatgggaagcttggcactgattttcttgcttcatatctgggcctaaaagagttggtgccgccatatttggatccaaatctcagcgacaaagaacttgtaactggtgtcagttttgcctctgctggttctgggtttgaccctctcactccaatgctggggaatgtaattccagtagcaaagcagttggaatatttcaaagaatacaaaaagaggttagaggcgcaggcacaaatgactacgtcattaactatttttcgttgccaatacgaagaaagacctacaccacccccttaa

SEQ ID NO: 63773 - DNA, 225 bp, Glycine max
  Peptide Sequence Number=SeqID_180551
atggttttcaaaagcataggaaatggagctagcaagggtgcagggcttggttacacgggtgcagggcatggaggcatagtcggcataggaagtggagccaatggtggtaattgctcagaagaagaagatgggaagtgttggatggttaccgggatatgcaattttagcagaatgacattgagtttggagaccatggaagctagggtcacgacggagtggagttaa

SEQ ID NO: 63774 - DNA, 276 bp, Glycine max
  Peptide Sequence Number=SeqID_180552
atggaaacttatgccctaatgtcacatcctatcaaagcattatgtctcgacgtccttcagcacaaggttccttatagcaattcagctagtcatatgctcccccgaacacaaggagaccagtcagggtcacggtgttttgcgagaatgctccaaccatatgggatcaacataggcttaaaggagcactcaaatcgggtgacccccaagacctacactccaaagagtctgtcaagacctctccctcttgattcaggtccaacccagaaaacattttag

SEQ ID NO: 63775 - DNA, 114 bp, Glycine max
  Peptide Sequence Number=SeqID_180553
atggctcaagcccaaggcttatccgcaaggtgtgcacagccacagctttggaaggattggggaggaaatgtattcatcggaagggtaagaattgttttcatttgtatactttaa

SEQ ID NO: 63776 - DNA, 2741 bp, Glycine max
  Peptide Sequence Number=SeqID_180554
ttggttgcagcagcatgatggaggaagaagaagaccagcagaagcttccagatctggtgaaggaactagtccaccgcctcctctcccaaaacctccccccaaattcccctcccctaaaccctaactcccccgaattccgcaactccctccgctacgccctccgcatcctctccagccgcctcaccccctccgtcgcccccgacgccgccgccatcgccgactccatcaagcgccgcctcgctacccacggccactcctccgaagccctctccttcgccgacctcttctccaaattctcctccaaagcccaaagcgtcaacaacaaattcgccgtcatctacctcctcaaaatcgtctccgaagatcgccacaccaccaccgcaaccaccacccctctcctccccaacctcagtttctccgaacctacctccaacaaaaaaccctggaacgacaacggcgccctcctcatctccaaggaccccgagaaccgccgcgacgtcgcgtttcgcgagttcgtcgatctagtcaaggaagaaaacgaggtgtcggaagaggttctcgtccaagacgtgctctatgcttgccaaggagtggatggtaagttcgtgaaatttgacggcgagagtaagcgttatgtgatacctgattcaattagggttccccgagccactaggagtatggtttacaatctctgtgaattgggggttttgtttagaaacgttagcggttacatttcgctgagtatggatcggtttcccaatgaagatgtgggaactgtgggccaggctttttgctccgctttgcaggacgagcttagtgagtattataagctgctggcggttcttgaggctcaggcttccaacccgattcctttggtttcggaatccgcgagctccgggaactacctttcgctcaggaggcttgcggtctgggttgctgagcccttggtgaagatgaggctgatggctgatttagttgagaagtgcagggttttgcgcggcggggcgatggcgggggcgattcatttgcacgcgcagcatggtgatccgttggttcatgagttcatgaggaggttgctgcagagggtgtgttcttcgctgtttgagatggtgaggaggtgggttttggaaggggagttggaggatatctttgcggagtttttcattgttggacagcctgtgaaggctgagtccctctggagagaagggtataggctccatgattccatgcttcctttgtttatctcaccttcgcttgcacagaggatattgaggaccgggaaatccattaattttcttcgcgtttgttgtgaggatcatggttgggctgatgctgcgaccgaggttgttgctgatcatggagcaacggcgagaagaggtggttttggatatggagaaacggatacccttgagtttttggtggatgaagcttcaaagaggattgataagcatttgttggatgtgattttcaagaggtacaagttcaaagaacactgtcttgcaattaagcagtatttgttgcttgggcaaggtgattttgtgcagtatctgatggatatcgttgggcctgaactttctgagccggctaacactataagctcttttaaactttcgggattgctggaaactgcaattcgggcatctaatgctcagtatgatgatcctgaaattttggataggctcagggttaaaatgatgccacatgaaagcggtgataggggctgggatgtattttcactagaatacgatgctagagttccacttgatacggtgttcacggaatctgtgatggcaaggtatttaagaatttttaattttctgtggaagcttagacgagtggaacatgcgcttactggagcctggaagaccatgaagccaaactgcattacctctaattccttcaccagattgcaacatgcagtaaagatgcagttagtttcgacattgaggcgctgtcaggtatcatggtcaaattttttggctgagatggaagtagccaaggatcttgatgatctacttgctgctcatgaaaaatatctgcattctattgtagagaaatctctccttggagagctttcccagtctctttacaagtcactatttgtaatttttgatcttatattacgttttcggagccgtgcggatcggttgtatgaaggtattcatgagttgcaagcaagattcacagaatcctccctatcctctcgagacaagaatcaatcacgatctcgaaagcaactaagtgataaatctgcagaacaaggatcctggattgctgatgggagaaaagccctaacacaacgagctggtgaatttctacgaaatatggagcaagatctggatgcaattgctaaggagtattcatcattgcaagagggattcatttctcaattgcctgtacagcagcatgttgatctaaagaaatttgtgaataaggctgagggtcaggctgaagcattgtttcttcaaaaagacaaggcattaaaagcgttgcacccagctaacttccattgtgtgtttgagtggaacaattctattgttgctaacttcctttggaccaacagaatggatatgaagctattaatattcaattggatgcccgatatgagtagtacagacgaaattgctggtttggctgaaaatgttggagcggttcaagcaactttaggtttttggaaatgttgtgagaagtctgagttagctcaatctattgcatctgcaggaggtggtgatacaggttga

SEQ ID NO: 63777 - DNA, 291 bp, Glycine max
  Peptide Sequence Number=SeqID_180555
atgggtgcatactgcaacggcaacgtttcgttgtcaccatcctacgacgtcgcttcagcccaagatcccaggcttcgcgagttgaaacaactaggtgcagttttgttgccatccttgacactacgggacattataggcaaatgtggttcatgtggctgcaaatgtggttcatgtggctgcaattgcggttgtggtgagtcaaaagaccttgaggttgaggccaaaatttcagatgtggaccattttttaaaaccactagtggaacattttttgaacatttccctggcatga

SEQ ID NO: 63778 - DNA, 1137 bp, Glycine max
  Peptide Sequence Number=SeqID_180556
atgacaatctatcatgatgaagtgagaagaagcaagcagcaagtggataacatatataaaggagaggccaagaaccacaaactcaaccaccttcactcgcaaaacatggtggttttaaagtccacttcaccactctcatctctcacttcccacttctttaacctttcttcctcctcctcctcctcctccaaattcacctccccacactctctccgccgccgccacttccaccatgtccactccacttcaagagttgcgcaattcactatcagagcctacatggagaaccccaacacattaggcagtttcgccaacagggtcattggtgcactccccgtggtgggactcattgccaggatcctgagtgatgaaggtggcgttggagatgacctcgtggattttgctgagttcagaaggcgcgttggaaagaagtgctccgaaactgattccactgccttttatgagttccaagaccgacgaggaaaggcaggggatcctctctatgttctgttatgctgttggctagcagccattggtgcaggtcttctcaaaaccgaggatattctggaaggggtggctcggctccggatctccaatgacattgaatttgaggagcagagtttcatggctttgatgaatgagtcaaaggaggaatcctctactagtgaaagtattaactgggtagtaagaaagagattgagagagtgtttggatagaagaacagaaggaatgttcctcttgttcatcaatctgcagaaatacaaagtgaatagaataggaaaaacaattccaagatatatgaatgatattcttgcaagacgggcaaggcaaaacgctgatcctcctgctgtcccaatggagattcgagctgggaaggctcttgatgctatctatgtgtgttgctttggaaaggactccatagaggaagaagacaagagactgttgactgcaatgcttggcgctgttttcgcatcagttcaacgcgaagagatccggcgccttgtcaaagacaaggcagagaaagtagcagcaggagttgatgatgaatatgtttcagaactcaagcctctatcaaaagaagctgtggaactacaaatgaaagaccttcagttccttcaacaaaatagtgagacttaa

SEQ ID NO: 63779 - DNA, 903 bp, Glycine max
  Peptide Sequence Number=SeqID_180557
atggtggaagtggcggcggcggagagagtgtggggaggtgaatttggaggaggaggaggaggaggaagaaaggttaaagaatgggtctgcaccgatgagcttcacttcaatgaccttgttgctgacagaatcaaaggggcccaaaccaagacgctgcttcttctcagttctctcgaatccggaatcttaaatcctaaatccctaatccctaatcaatcgcatgttcgaacccctaatttcaacccgttcttcctcaacgtgcgtcgtcagcgacttaaggcagagatagacaaagcgatggagggttcacgacggctacatggacagtctgtaggggttttcaatgaagggatttgtttagttttatctcgctggtctgctcttcgatcggccgtcgagaacgaatggggtggccgtgagtcccgccttaaagccgatcaacttgccagtggcattcttaactggttcactcaatcaaaagagccactttatattgatgacttagaagacatactggatcaaggtatgctttctctcaatgtagaggtcgaggatggcagcgtcgaggaggtagctgaaaaactaatggttatgcatgaagaattcttagaaggtaattttagttcttttgaagatctcaggaaagccaatcttgagcaagctactcttcctcatgtaacacagattgcaaatgaagacgatacagatgaagatggtgatgatgatgaaaaaatgattgtggatgataattcttcaaaaatgaatctggatatttcaacatccgattcaaacatgaattcagtgaacaggccagttaatgagcctctaccaaaggtttcaggtgaagcagatgatggatgggttgtagtttcaaacagaagaaataagggaagaaaaaattag

SEQ ID NO: 63780 - DNA, 186 bp, Glycine max
  Peptide Sequence Number=SeqID_180558
atggctcacggaggaggcaatgttgcaataacgatactttttgcaataatgttggcgtattcctccgagatgcttcatgcagatgtaccaccgaaaatttcatcaaaaatctccaaagccagccttgaattccaacctgagtatcctctcaagatgatgtccgcctatgttaccatatatatttaa

SEQ ID NO: 63781 - DNA, 970 bp, Glycine max
  Peptide Sequence Number=SeqID_180559
gtcacatgaacaaatgtcagtcgatatggttgattatattgttgatgaacaccatattgatgtttacccccaaatgataagaagagtcaaggagatgatactggcaagctctgaatatgctccttcaatgagctcaagtgagaaaagtttcttgtatgatattgttgcaaatggccgaaatggaattgatgttgacaagtttgattatcttcttcgtgactgtcgagcttgtggtctaggatgcaactttgaatttcaaaggttattggagacaatgcgggttttggatgacgagatttgttatcgtgctaaggacttgtttctaattgtcccttgctttcggctgtgcaatttgctagaccttaccatccacaaaatgtttgccactcgtgctgatctttatagaacagtttatacacatccaaaagtgaaggcaatagagcttatggtggttgatgcacttgttcacgctaatagttatttggggatttcgtctaatatacatgatccttctgagtactggaagttttgtaatgagtatcccgtaccaaaggatatgctggacaattataagaaggtcactgctcaagatattgtttgttctcaggtcttcaatcttgttaaaccttctcatttgcataagagtggtggagttacactgaaggaggaggatgtagctgtttgtaatgtcaaaattgatttgactcgtggaaagcataatcctctggaaagcatccactttttcaaggattatgaaagtgatgagaaatttacaatacctgatgaccgtgtaagccacttactacctacatcttaccaagatatgatagttaaggtgtatgccaaaaagccagaactggtggaggcaatttcagaggcttttgaaaattttcagttgaaaacttatgggatcaaaacacaggcacattcaacaccacagaagaagcgtcgatacaattcatttatataa

SEQ ID NO: 63782 - DNA, 1365 bp, Glycine max
  Peptide Sequence Number=SeqID_180560
atgaagaagagtgagagtggggggtatgtgagagcggatcagatagatctgaagagcttggatgagcagcttcagaggcatctgagtagagcatggactatggagaagaacaaggagaaggaggaagaagaggttgaaggaaggtccacaagaagcagacaagaatgggagattgacccctccaagcttgtcatcaagactgtcattgctcgtggcacttttggcactgtccatcgtggaatttacgatggccaagatgttgcagctaaagagttggatataaatgatgtcttatttggtcagcagatccactgcttaagttttgttttgcctgtttctgcatgtgatttcgttgtgcttgtacctttacaatcaagcaacaatttctgcttggacatgagtccttgtttccctgagttctttgagaaggcatctaagttgatgttgtttgttaagctccttgactggggggaagaaggccatcggtcagatgctgaaatagcttctttgagagcggcttttacacaggaagttgctgtttggcacaagcttgaacatcctaatgtaaccaagtttattggggcaacaatgggaacatcagagctacagatacaaacggaaaatggtcatataggcatgccgagtaacgtttgttgtgttgttgttgaatattgtcctgggggtgcgctgaagtcttatctcattaaaaatcgaagaaggaagctggcttttaaagtggttgttcaactggctcttgaccttgcaagagggttgagctatcttcacacaaagaagattgtccacagagatgttaaaacagaaaatatgcttctggacaagacacgaaccttgaaaatagctgattttggagtagctcgtattgaggcctccaatcctcatgacatgacaggtgaaactggaacccttggttacatggctcctgaggttctaaatggcaatccatacaatagaaagtgtgatgtgtacagtttcggaatatgcttatgggagatatactgctgtgacatgccatatcctgaccttagcttctcagaagtgacatcagctgtcgtacgacagaatttgaggccagagattccgcgatgttgtcctagcgctctggccaatgtgatgaaaagatgctgggatgcgaatcctgacaagaggccagagatggatgaagtggtgaccatgttggaagctattgacacttcaaagggtggagttatcgaggaccttgaaagatttttcactgtcaaggaaattgattatggagggatgatatacagtagtagcatggattgttcggacactaatatcaaagtcctgatgggtcatttgatgtcctatgaagcctacaagtga

SEQ ID NO: 63783 - DNA, 1338 bp, Glycine max
  Peptide Sequence Number=SeqID_180561
atggagtttaattgggttgtaccatcattgaaatgttcacagggaagcctccttggagtgagtatgaaggaggaagtaccttggaaatattgcgagattgctattgtttctctgattgaggaaaaattgggtcaggtagccttatttaatgtggaaaaagcccttcatgctttcacatatgcctcttcaactcgaacaacacttgcatcttctcaagcgaagctgaaacagaaaacgagcaagacaccgaacctcaaccatgttccctacatcattgatgttctcaaccacactttcacgacggcgagctcttcaccctctcacattcacttcccttcaacatttcccaaacgaactctctcatctcctcgaaccgtggcaaaaaccgcgctgctggatatgttctcaaaatgtgggtctttggatgaagcaacaaagggggttctaagagaaatggggagggagaatgtggagcttagtgagttcacttcctgttccgcgttgaagtctggtgcttctttgaaggccttggagcttgggaggcaggttcatggtttggtggtgcgtatggggcatgacttgggttggaagaatgatatgatgtataactcaatggtttttcggtgtgttaggaataggagttatgatgaggctgttagagttatgggcttggtgaggcccaatgttgttgcactcacgagtgctctggtgggttgctatgagaatttggatttgtgggcagggaagcaaattcattgtgttgtggatgtgatttcttggacttgtatgattgatgtgtatggaagaaatgggcaaggaggtgaagctgttgagatgtttcaggagattaaggaggatggaagtaaggtgttaccaaattctgtgacttttttgtctgttttattagcctgtggtcactctggactgatggaggaagggaaaaattgtttcaaattgttgagggagaagtatggtcttcaaccagattcggagcactatgttttctacatagatattttaggtcgagcgggtaatatagaagaggtaaggtctacatatcacactatggttgagcagggtactgggcctactacaggagtatgggtagcattgttgaatgcttgcagccttaatcaggatgtcgaaagaggtgaactggctgcaaagcatgtcttacagttggagccctataaagctagcaatattgtgcttgtatcgaatttttatgcagccactgacaggtgggattgggttgatgaactgagaagcatcatgaggacaaaagggttggtcaaggaagttgggaatagctggatcaatgttctaggcttcaattga

SEQ ID NO: 63784 - DNA, 816 bp, Glycine max
  Peptide Sequence Number=SeqID_180562
atggggcaatcgttacctaccctagtccctgcttatcaaccaattaaacccagatattacctatcaacagttaatttcaatgccaaagccatttcaggttctcaatggatggttaaaaggaaagggttttcaagaggaagtggtgaattgttggaagccaaggagattcttgttaaaatcaatgatctcgacttgaaagatgaagagggaattctatctttgagggatttaagggagaaagattacttcaaagtgagattcaaggaagatgcttgggtgagacccaaactagatggtgtttccttcaaggagctaggtgaggaagacaatgctttgttggtacctaaattaaaggaaaaggaaataaaagaagccatatggaattctgatggagacaagtgcccagggtccgatggacttaacttcaactttatcaagcatttatggaagatacttaaaggggacttcatcaacctcatgaatgagtttcacacaaatggagttctactaagaggaggtcatgcttctttcatcactcatatgcctaagaaggacatcccacttggccttggtggcttacaacctatgtcccttattggatgtattttgaaagtcatttcaaaagttctatccaatagagtgagaaaagtcttacctaaggttatagatgtcagacaatgtgccttcttgagtgagagatacatgtttgatggtgtccttatatccaatgaggtggtagaagaagttaggaggtgtaggaaggaatgtgcaatccttaaggtgggctttaagaaggcgtatgacattgtatcctag

SEQ ID NO: 63785 - DNA, 948 bp, Glycine max
  Peptide Sequence Number=SeqID_180563
atggctcctggaagcagtgttttcaaagaagttcttgaatctcacctgatgtcttcagattatgaaatgggaaaagctaaatctgaggccaagagtaacagtacatctacaaaatctagcattgggttgagtggaaagagtggaattagttcaaacaatggcgtataccctgcccatcctgcaaaaggaagttcaggaatgagacttgctgattctaagcctatatttataaatactatgtgcccaaatggccatacattatgttcccattgtaaagttgaagtccataatatctgcccgtcctgccatcatgatcttgggaatataagatgtttggctttggagaaagtggcagaatcattggagcttccttgcagatatcagagtcttggttgccatgatatattcccgtactatactaagctgaagcatgagcaaaattgtggatttcgtccatacaattgcccctatgctggatctgagtgctctgtgatgggtgatattcctactcttgttgcccatctcaaggatgatcacaaggttgacatgcatgatggatgcaccttcaatcatcgatatgtcaaagcaaatccacatgaagttgaaaatgccacatggatgctaactgttttcaatagttttggaagacatttctgcttgcactttgaggcgttccagcttggctcggctccagtgtatatggcttttttgcgattcatgggtgatgacaatgaagcaaagaaattcagctacagcttggaggttggtgcaaatgggcgcaaacttatatggcaaggaattccaaggagcattcgggacagtcatagaaaagttcgagatagtcaagatggacttataattcagaggaacctagccctttatttttctggtggagaaagacaagagttgaagttgagaatcactggtcgtatatggagagaagaatga

SEQ ID NO: 63786 - DNA, 783 bp, Glycine max
  Peptide Sequence Number=SeqID_180564
atgttgtgctgcggaggtgcagaggaggagagcaccgggtccccggcaaatcaatacccaactgcaccacctagagggggtaacacatacggtggaggaggtaatgatagaggagagcctaggggcaatgttgcaaagagtggtgccccgcagaaagtattgccaattgagataccctctatgccgttggatgagttaaacaggttaacagggaactttggtacaaaggcttttattggcgaaggttcatatggacgagttttctatgcaaaattgagtgatggcactgatgctgcaattaagaagctggataccagttcttccccggaacctgactcggattttgcggctcagttatcgattgtttcgagaatgaagcatgacaattttgtggagttgattggatattgtctagaggcagataacagacttttggtttatcaatatgcaagtttgggttctttgcatgatgtgttacatggaaggaagggtgtacaaggggctgaacctggtccagttttaagctggaaccagagagcaaaaattgcatttggcgcagcaaaaggacttgagtttcttcatgaaaaggttcagccttctatcgttcaccgcgatgttagatccagcaatgtcttactattcaatgactatgaggccaagatagctgatttcagcttgacaaatcagtcttctgacacagccgctaggctacattcaacaagagtcttgggaacatttggctatcatgccccagagtatgtccttaagaaaccttccttatag

SEQ ID NO: 63787 - DNA, 246 bp, Glycine max
  Peptide Sequence Number=SeqID_180565
atgcccaaaggacaacaaagtcttgtaacttgggcaactccaaggcttagtgaggacaaagtgaaacaatgtgtggatcctaagctaaacaatgattatccgccaaaggctattgctaagttggctgctgtggcagcactttgtgttcagtatgaagctgacttcagaccaaacatgaccattgttgtcaaagctctccagccacttctcaatgcaaaaccgtctggtcccgatcctcatgcttga

SEQ ID NO: 63788 - DNA, 830 bp, Glycine max
  Peptide Sequence Number=SeqID_180566
atgccgggattagcgcaaaggaatgaacaccaacttactaatggctcatccacgccgacgtgttcgctctctgcgaatagattctggtcgaagaattcggacgaggtttgctacaatcagctccagaagggaattgtgggtaaatgcagtcaatgtggttgtgaaaaccttagaaacagcaatatcgcagccacaacagtgttctggattgagctgtcgctgcaagctcggcaaaaactcttgaggatagacaaacaatccctttttgagcaagctcgtaaaaatatgtactgctctaggtgcaatgggttgcttcttgagggttttctgcagattgctatgtatgggaaatctttgcaacaagaaggggtggatgctcactttccttgcaacagatccggaggtttgaaaaagctaaataatgacgaatcaagcattatcaatggatgccaagatgaaattcaagatccatctatccatccttggggaggtctgactacatcacgtgatggctcattaacacttatgagctgctacttgtattcaaagtctttgaaaggactgcaaattgtctttgatggtgcacgtgctagggagagggaaagggaactgctttatcctgatgcttgtggcgggggaggccgtggttggataagtcaaggaatagttagttatggcagaggacatgggacaagagaaacgtgtgccctgcatactgccagactttcatgcgatacactagtggatttttggtcagcactgggagaggagactcggctttctcttttaagaatgaaggaagaagattttattgagagacttatgtacag

SEQ ID NO: 63789 - DNA, 222 bp, Glycine max
  Peptide Sequence Number=SeqID_180567
atggtgattgtaatttggtcatgccacttgtcaaatgttgtgttggcaatagtgaaggctgcatttgactccattgactttgaggtgcatgttggtactgatccttggcttggtgttatggaccacatttgttttcaccccctgcttgatgcttccttggatcatgcagctaatgctgctaggtgtttagccacaaacatgggttctactctacaaggttag

SEQ ID NO: 63790 - DNA, 174 bp, Glycine max
  Peptide Sequence Number=SeqID_180568
atgggaaagtacaccctcgggacagaacttattggtgctagtgcaatgaacaaagagcaaaacccagagaattatgcagaaacagagcaggaagaaggaaagaatgaaagcagtggcagaccaaaacgtggaagcaacagaccaaggtacctggaggattacgtggccaagtga

SEQ ID NO: 63791 - DNA, 198 bp, Glycine max
  Peptide Sequence Number=SeqID_180569
atgtgtctattggggaaggagatgaatggctcttctttcttgggagatcccactgttctttcttccgagggcaaggtttatggtggtttgaggttttggctcaaaaggctttgtagaatggctggacatgatatatgtcaggatgttggtttggccaacgattcaggggtaaaggaaagtctcacattatttccatga

SEQ ID NO: 63792 - DNA, 303 bp, Glycine max
  Peptide Sequence Number=SeqID_180570
atgggcgcctggtatcaacaaagaatgaagaatgcgtttgacaagaaggtgcgcttgcgcaagttccatgagggggaccttgtgctgagaaagatgtcccacgctgttaaggataatcgagggaagtgggccccgaattatgaagggcctttcattgtgaaaagggctttttccggaggggccctggtgcttaccaacatggatggcgaggagctacctttacttgcgaactctgatgttgtcatgcgataccacgcttggaatctggggcaattgaagatgtcgttgcatgttctgttatag

SEQ ID NO: 63793 - DNA, 582 bp, Glycine max
  Peptide Sequence Number=SeqID_180571
atgtgcagtcctatgaaggcgaggacgtgcagtcctctgaaggcgaggacatgcagccctctaaaggcgaggacgtgtagccctcttaaggcgaagacgtgcagtcctctgaaggcgagggcgtgtagtcctctgaaggtgaggacatgcagccctatgaaggcgaggacatccagtcctgtgaaggcgagggcatgtagccttctgaaggcgaggacatgtagccctctcgaggcgagcacgtgtaagcctctgaaggcgaggacgtgcagccctctgaaggcgagaacgtgcagtcctctgaaggtgaggatttgtagtcctttgaaggcgagggtgtgtagccctctgaaggcgaggacgtgtagtcctctgaagacgagggcgtgtagccctctgaaggcgaggacgtgtagtcctctgaaggcaaggacgttcagttttctgaaggcgagtacatgcagtcctctgaaggtgagggagtgtagccctcagaaggcgaggatgtgcaattatctaaaggcgagggcgtgcaaccctctgaaggcgaggacgtgtatccctctaaaggggaatgcgtga

SEQ ID NO: 63794 - DNA, 435 bp, Glycine max
  Peptide Sequence Number=SeqID_180572
atgggtgccaagcacctcacaaggaccaaagaatggtcgcatgtcatcaagcaaaggtccccggacgaaattagggaaattctatgttcaattttgagagtctcaatatgttatggctcacaatcggatattaaagtcagaacttatggccatttaaattttcctgaagcattcgtgttcaatttggggattctcgatatattttgggactcaatcggacattcgattcaaaatttatgtgatgaggacatggccaagagcaagggcaaggatccacttgaaggacttgcaggacctatgacaacggcgagagcagggaatggcaatgaagctcttcaacaagtactgtccatactatttgaatacaaacccaagtttcaaggagaaaagtccaaggttgtgagttgtatcatggcccaaatggaggaggactaa

SEQ ID NO: 63795 - DNA, 297 bp, Glycine max
  Peptide Sequence Number=SeqID_180573
atgccgcaaatcaaaaggaagcaggcttacgcgatccgtgaaattccgttatgtggcggaaaccaacaggaggtgtttttacgcaatcctttcttcctccagaaggcggttgcttctagaggaagcaaccttgctcgcctgggcgagctgggtggcaagctcctcccctattttgctataaataggggaaggagtgaagaggaaaggggttcagccttcttggcacttcttattctctcgaaattgctgaggaaaattgtttccgtgaagaaaatccaagccgaggcgcttctgtaa

SEQ ID NO: 63796 - DNA, 183 bp, Glycine max
  Peptide Sequence Number=SeqID_180574
atggcaaaaggtgcagaagacgatgttagtctctacgcgtcaatgggctcgtttgccccctcgttgatgaaaggtgcggaaggtgcaggaggcgatgttagtctctacgcgtcaacaggctcgtttgccccctggttgacgaaaggtgcgggtaaccataaggtaaccccgcatgtcacctga

SEQ ID NO: 63797 - DNA, 276 bp, Glycine max
  Peptide Sequence Number=SeqID_180575
atgaatccgtccatgaggcgctggccacgctgtccggccgagcgccaaggggaaggccataaaagccgtacaattcagccgtgtgtatggagcttggcgttcgtctgcatgagcgctcgcaagcctcgcggtttcggtttggctgtgtcggcgcgatggccggcattcggcgcactgcgttctgcgccaagtctcagcgggcgtcctttactccgaggggtaccgccgttacacaatgtggccagcgatagccgggaaatctgtttgactcggtga

SEQ ID NO: 63798 - DNA, 346 bp, Glycine max
  Peptide Sequence Number=SeqID_180576
ggttgagacaaggagaccctttggctccattactctttcacttagtggctgaaggactgacagggctaatgagggttatacgaaccggctctccacgcaatcaagagaatgttgctgctgtcttgtggtcactatgcaccggagatccactgcaattaaaactagcgaaagaacatggtgcagaagcagcactgcaggagttgtcagaaaatggaactgatagagctaagataaaagctggaagcatattggaactcttgcagcgaatggaagggggacctgctatcaagtcagcagcaacaacagaaccaggtagtcaaaacggaaagaaattggaaggtgggag

SEQ ID NO: 63799 - DNA, 1629 bp, Glycine max
  Peptide Sequence Number=SeqID_180577
atggcgcatgccaccggtgagcttcgattcaattttgcaaaaaatatcaatgtacagtggcaaggcaatagcatcaatgacggcgccaatagcgttagcaatactttcaaaattaaggggtatgaccaaggttcggtattaacggctaacctcatcaccaagaatgtgtatctcaccacaggtagcgatggtacgctttccggcacgattgccaccaatgtaggtaactttacgcttttcccccagatcgatttggcgggctatcgcggtacgggttctatctaccttgacggacaattagtcggcaacgagggcaggcacgtatttgatatcggcctcttggccgatccctctatcgctaacatacacaacaaggattataagcatatcaccgacctgaaagcccccgagctttgggatcctgcgtggggaatgccaaacggttttacgggttcatacggttttgcgctgtctggctttgccgataacgttacggtgattaatgtgccggtagattcatttatggatgccccttttagccaacgcgctctggaaatcaccggtaatgccggtgaaaacagccatattaccttcgagtacgcccctgattaccgttataaaaatttttcacccgtgatgacaattagttttgatgcgaaaaatatagttcacgctgatgccggcactttatcgttcaaaaccaatacggtctatattgactctggcattccagaggtcagagagtttttggaaatatcatccaagggagatgcggaaaacaccctacgccttgagggccatgacaaccatatcagtgaaattaacattaccggtgataaggcgcttaacctcaccatcaaaaacaatttcagcgaagaattgaaatccatcaccagtcacatggctaatagcacaccactgcatttgaccatggaacaagggggaaccggcggcgggcagttctatcagctgctaaaacaattagacggactgacgggatacgatgccatcatgtcccaattggccggttaccaactgtcgatcgccaacgatgcccctacgaccagcggcatccaggctaatcatatctacaacgtaatgggcaatacgagtctggcaaccggcaaaggcgctgatacggtggtattcaaccacagtaccattgataacatggtcacctttaacgattacgaaaacagcagtacgcaaaatgcatcatgggttgaaggcgacaacattgccgtcggtgatatcgaccggcagtggctcttttccgcgggtggcagcaagactatcgatctcgtcggcagcttatccctgaatgagctgacagtgctactctccggaatgaatgtccagacgaatacgactccgcaacaattgttcattgaactggtatatacagtcactcaaggccacagtcagagtgcattgagcgaagtcagcgccttatcgttgaatggattctattttgtgatggtggataagaatctgaatcacagtttagacaacgatgacattatttttggtctcacaaacgacaatgccttcaacatggcccattacgattcacccgttctggaaattaatggcattggcagttttacccatgatgccgtcgctgcatag

SEQ ID NO: 63800 - DNA, 503 bp, Glycine max
  Peptide Sequence Number=SeqID_180578
atgagcctggcgccctacgccggtgatgacgtagacattcagcgcgtgatccagatggcgctgctgcatgacattgtggaaatcgacgccggcgacgtgctggtctacgatctggcggcccgcgcggcgatccacgatcaggaagtggcagcggcgcgccgcctgttcggcatgttgccggaggctcagcgcgagtatttcaccgctttatggcaggaatatgaagatggcgaaagcgccgatgcacgcttcgccttgctgctggatcgcaccatgccgatgctgatgaacctgcacaatgaaggccagagctgggtagagaacggcatcagcctggagcaggtgctggcgcgcaatgcatcgatcgccgacgtgcaccccgagctgtggcaccacatggagcaacacctgcgggatgcgcagcgcaaaggctggttgaacggtcagttcaagcaaacccagccccggcacgggatatgtgtctcatacttgcttaaccccag

SEQ ID NO: 63801 - DNA, 504 bp, Glycine max
  Peptide Sequence Number=SeqID_180579
atgcatagatctcccacaggcaattcagttccactagacttagaaattgaagctacgttgcaaaggaacagggccggaggagaaggaaacttctgcaagacagaacagttgcagccattcttgaggaggagactcatttctccgacttattatcacctgattcaccatcatcaagagaatctgccactcaattacctgaagccattaccatggcagaagagaatgactagaggattacccttgaggattattcaagggaacttatttcaaggattacctaatgaagacccctatgcacacttggcaacattcattgaaatatgtaacactgttaagattgctggtgtaccagatgaagctattaggctcagccttttctcattctcattggccggagaagccaagaggtggctccactcattcaagggcaacaatctgaaaacctgggaagaagttgttgaaaagttcctaaagaaatacttcccagagtccaagactgcataa

SEQ ID NO: 63802 - DNA, 1207 bp, Glycine max
  Peptide Sequence Number=SeqID_180580
tttcccccctcagaatgcgaggggggaggatagaagagctttagaagaaattggaagggagattgttaaaaagtgtaatggattgcctttagcagcacggtcacttggaggtatgttgagaagaaagcatgctattagggattggaataatatacttgaaagcgacatttgggaacttcctgaaagtcagtgtaaaattattccagccttgagaattagttatcaatatctccctccacatttaaaacggtgctttgtttattgttcattataccctaaagatcatgaatttcaaaagaagaacttgatcttgttgtggatggctgaagatcttttgaagcttccaaacagaggaaaggcgttagaagttggttacgagtattttgatgatttagtttcgagatcattttttcaacgatcaagtaatcgaacttggggcaattattttgtaatgcatgacctcgttcatgatctagcattataccttggtggagaattctatttcagatcagaagaacttggaaaagaaaccaagattggtataaagactcgtcatttgtcagttacaaagttcagtgatccaatctcagatattgaagtttttgacaaactacaatttttgagaactttattggcaattgattttaaagattcttcattcaacaaggaaaaggcaccaggtattgtagcatcgaagcttaagtgcttgagagttttatcattttgtgactttgcaagtctggatgttttgcctgattcaataggtaaattgatccatttgcgttatttaaatctctcttttacaagaataagaacactgccggagtcattgtgtaatttgtacaatctacagactctggtgttgtctcgttgtagagtgttgaccaggttgcctactgacatgcaaaatcttataaacttgtgtcatcttcatattgatggtactgatataagagagatgcctagaggaatgggaatgttaaggcatttgcagcatttggatttctttactgtgggcaagcataaagagaacggaatcaaagaactggggacactttcaaatcttcatggttcgctttctattaggaatttggagaatgtaaccagaagcaatgaagcattggaggctaggatgctggataagaagcacattaatcatttatccttggaatggtctaatggcaccgacttccaaactgaattagat

SEQ ID NO: 63803 - DNA, 667 bp, Glycine max
  Peptide Sequence Number=SeqID_180581
atgcatagattttcggcgcttttcttcagaaaacgtgctatttcctcccttctatcattggtaatcagacacgaaaccaccgtatgccatttcttctgtactacctctgaggtaagttcttctcgaacctcttcactattaccaccaccaccacattgcaattcaacatttgacaaccatggctgcttaacaaaccaatttggcctcattcgtctccaagagatttcaataaatcacacagacgaccatacccatgacgagtttgcttctgatgtggagaaggtatatagaatattaagaaagtaccattctagggttcccaaattggaacttgctctcagagaatctggagttgttgtgaggcctggattaacagagcgtgtgttgagtcggtgtggtgatgccgggaatttggcgtatagattctattcctgggcctccaagcaatccggtcatcgactcgatcacgacgcgtacaaggcaatgattaaggttttgagtaggatgcggcagttcggtgctgtttgggcactgattgaggaaatgaggcaggagaatcctcacttgattacgccccaagtgtttgttattttgatgaggaggtttgcctccgcgaggatggttcacaaggcggttgaagtgttggatgagatgcccaagtacggct

SEQ ID NO: 63804 - DNA, 1209 bp, Glycine max
  Peptide Sequence Number=SeqID_180582
atgaggtatcggtggaaaccgagtgtgaagcattttacttcattgttgtatggttggtgtaaggaagggaagcttatggaggccaaacatgtgttggttcagatgaaggacatgggcattgagccggatattgtggtttacaacaacttgcttggtgggtatgctcaagctggcaaaatgggggatgcttatgatcttttgaaagagatgaggaggaagaggtgtgagccgaatgctacatcttacacggttttgatccagtcactatgtaaacatgaaaggttggaggaggcaacacgtttatttgttgagatgcagacaaatggttgtcaggcagatgttgtcacgtattccacattgataagtggattttgcaagtggggaaaaatcaaaaggggttatgagcttttggatgagatgatacagcaagggcatttcccgaatcaggttatttatcagcatatcatgttggctcatgagaagaaggaagaactggaagaatgtaaggaactggtgaatgagatgcagaagattggttgtgctccagatcttagtatctataatacagtcattaggttggcttgcaagttgggtgaggtcaaggaaggtattcagctttggaatgaaatggaatcaagtgggctcagtccgggcatggatacctttgtcatcatgattaatgggtttcttgagcaaggctgtctagttgaagcttgtgagtatttcaaagagatggttgggagagggctttttactgctcctcaatatggtaccctgaaggagctgatgaattctcttttaagagctgagaagcttgaaatggccaaagatgcttggaattgtatcacagcttctaaaggatgtcagctaaatgtgagtgcatggacaatctggattcatgcactcttttcaaaaggacatgtgaaggaggcttgttcattctgtatagacatgatggataaggatttaatgccaaatccagatacttttgcaaagcttatgcatggtctgaagaaattatataacaggcagtttgcagcagagatcacggagaaggtaaggaaaatggcagctgataggcagatcactttcaagatgtataaacggagaggagagagggacctgaaagaaaaggcaaaggaaaaaaaggatgggaggaagaggagggcgagacaacgccaatggggtggaggccgtcagaaattataa

SEQ ID NO: 63805 - DNA, 1587 bp, Glycine max
  Peptide Sequence Number=SeqID_180583
atgaactgcaccgacacaactcgtgtttgcacttctttcttggcctttaagcctcaaccaaaccaaaccttggctgtgatacaaagcatgtttgacgtgttgcccggtgagatcaccgttgaaggcaatggctgggattacatattcatcaggaaaaactgttcttgtgctgctggtatgaagaagtatgtgtctaacaccactctaactgtgaaatccaatggaggttttgagcatgatttggtgatggatgcctatgatgggcttgctctcttgccaaacacgacgacgcgttgggcaagagaaggcggtgtcatatctctgagcttgttctgtagttgttccagtggactgtggaactatctaatgagctatgtcatcagagatggggacagtgttgaatcactagcaagccggtttggggttagtatggataacattgagacagtgaatgccattgacaatcctgatagcctcactgttggttctctctattatatacctttgaattcggttcccggtgagctttaccacttgaagaatgatactccatcagctccaatcccttcgccatctgttgataatttttcagctgaccatgtgacccagaaggctcatgtaccccatgagtggatcgtaggaggtttagggattggtcttgctctgataatattaaccattattgtgtgggtggccctgagatcacccaattgtttggttgaagccagaaataatgcaaaagattctgctgggaagatctctaagaagttctatgtctttgggaatccaagtttgttttgtggatgtggcaaacctgtggaccaacatcaaacttatgctctaatgcctgacatgttggacatggataagcctgtagttttttcatatgaagaaactttttcttcaactgatggtttctctgattcaaatctacttgggcgcagaacatatggctctgtttaccatgggctcctccgtgaccaggaagttgctattaaaagactgacaactactaaaactaaagaatttatgtcagagataaaagttctgtgcaaggttcatcatgctaatctggtagaattgatcggctatgcggttagtcatgatgagtttttcctaatttatgaatttgctcagagaggttcactcagcagccatttgcatgatcctcaaagtaagggttattcacctctttcttggatcacaagggtccagattgcacttgatgctgctaggggccttgaatacatacatgagcatacaaaaactcgttacgtccatcaagatatcaagacaagcaacattttccttgatgcttcctttagagccaagatatcagattttgggttagcaaaacttgtaggtgaaacaaatgagggagaaatcgcagcaaccaaagttgtaaatgcatatggatatcttgctccagaatacttgagcaatggtcttgcaacgaccaaaagtgatgtctatgcatttggtgttgttctttttgagattatatcggggaaggaggccataattcaaacacaaggccctgaaaaacgatcattggcatctattgtaagttatgcttatgagacatga

SEQ ID NO: 63806 - DNA, 600 bp, Glycine max
  Peptide Sequence Number=SeqID_180584
atggacaaaatcccttcccgcaggcaggttgctgccatgaaacagtccctctttgatcagggatatctggatgagcagtttatccaactggaagaattgcaggatgatgctaatcctaacttcgttgaagaaattgtcactctttactaccgtgattcctccaggcttatctctagcttggaccacactctggaaagtaacccactggatttcaacaagctggacacaattatgcatcagtttaaaggaagcagctcaagcatcggagccaaaaaggtgaaagcagagtgcactctgttcagggaatattgcagggcaagaaatggagaaggatgcaggaggagcttccaacaaatgaagagagaatatgcaacactgagaaagaaacttgaaacatattttcagctggctaggcaagttgggcccgtggagacagcatttaggcccaaagaaggcctcacccctacccaaggcaaacaacacagccaggcaaaagacacagcactaccagaaacacaaacatgcatgcatgttcgtatgctaaaaccgtgtctaaaccaaactaaatgcatcttgacaacctcgttgaactctatgtag

SEQ ID NO: 63807 - DNA, 246 bp, Glycine max
  Peptide Sequence Number=SeqID_180585
atgaaaggaccaaataatgatgattggtccaccagcaaagagatggccaaatcaagaaaagtaaggccttgtgaatatcaacctttccataaaggatatgatatataccgcataatgctgcctctactctgttgtcgagaagtgagattttctactggaacaacatatgatgactcattgatgaatattgaattcaatgcaacgtttgtcactacaaaggcagatttagggaaaaagtacccatag

SEQ ID NO: 63808 - DNA, 417 bp, Glycine max
  Peptide Sequence Number=SeqID_180586
atgaaaagaatgagaacctttttttctatcaccgcggcgccttggggcgggtcggagcacggggagcttggattgggcgatgaggccgcggggaggttggaagaagaaggagatgaacggaattgcagatgtgcggcggcggcggaggaggaggaggaggagaggttaaggttccccatgctagcgctcttctttatgattgatccatccgtcagcctcaccccgaacagcttgacgccgccccctccccgcgacgggcatgtccgggagttgtggccgttgttggtgcagtgggagcagcgccgagtcatgccgattcgccgccgcctgactcggtccagagagcaaatggaattgaaattatggatagaagaagaagagaaaagaaagaaaagtgcatgtagtatgtgtttgtaa

SEQ ID NO: 63809 - DNA, 420 bp, Glycine max
  Peptide Sequence Number=SeqID_180587
aacctatcgcctttagaggactacacgtcctcaccttcagagggttgcacgccctcgccttcagagggctgcacgccctcaccttcaaagggctgcatgccctcatcttcagaggactatcactcctcgcctttaaagggctacacaccctcatcttcaaagggctacacgctctcaccttcagaggacaacacgctctcaccttcaaagggctacctggctacacgcactcaccttcgtagggctacatgccctcaccttccgaggactacatgtcctcaccttcagaggactacacgtcctcgccttcagaggacaacatgtcctcaccctcaccttccgagaactacatgtcctcaccttcaaaggactacacgtcctcgccttcgccttcgtagggctacacgccctcacctttag

SEQ ID NO: 63810 - DNA, 372 bp, Glycine max
  Peptide Sequence Number=SeqID_180588
atggtcataagcaggatatgcaagaggctggaattgtggaaagaagtagagtctaacacaattgacatgatgatagaaaatgacttctctagagaggataaagaaggtgatcgcaaaaatagccacaacaaggtcgaggacagtagcgaccttgatgttgacaaaagtaagctgccattgaagttagccattgtaggacgccctaatgttgctggtctgacaagagattcaattagaacccagtctgaatttcaaggaagaacaatttatctggttgatactgctggatggttgaagaggacgaaacaggagaaaggagagcatccttcagcattatgcaatcaaggaagagtctactccaggctcatataa

SEQ ID NO: 63811 - DNA, 282 bp, Glycine max
  misc_feature (108)..(108): n is a, c, g, or t
  Peptide Sequence Number=SeqID_180589
atggccgagataagaatggatggtttcattaaaccgatgaaagaacataatttggaaacattgggtctgtttgtgcaaatccccaaccgtagtatcacaatgccatanacgggatgcttgagtggccacctggctgtggccatgactaattttgcccgttgtttcccaatcatcattgttgcacgtgcctcgtggaataatatggaagttcggcccgagaccgacaccttggcacacaaatttgttttgtcccggatatcaggaacgggctcccacgattag

SEQ ID NO: 63812 - DNA, 185 bp, Glycine max
  Peptide Sequence Number=SeqID_180590
atgcagctaccgcaagagcccttgaacaagaaaccaagagggctcgcaaggaagagtatggctgtgacaaatttcgtggagctttgtgggggcagcaatagtgagttcaagcttcgaaaggaagagagagaccaatcaccagcacacagagtggtcctgaaagaggagttagttgcttgctcaag

SEQ ID NO: 63813 - DNA, 294 bp, Glycine max
  Peptide Sequence Number=SeqID_180591
atgtttggtaaaggaaccgattgggaaaataacaaaaaaccgtattttcccctcaccggaggctccgtacttgataatggaggatgcatgaacagcgctaggcaatcaattcatggggcttcgaataagatggtggaggatgcacaaacagcgctaggcaatcaattcgtggggctccggactcgatggtggaggatgcatgaatggcaatcaattcatggggctccgaacttgatggtggaggacgcacgaacagtgctaggcaatcaattcatggggctccagactcgatga

SEQ ID NO: 63814 - DNA, 327 bp, Glycine max
  Peptide Sequence Number=SeqID_180592
atgggtgaagtagaggaggcgcaagagcagatgaaggccaatatggaggccatgaaagagcaaatggccacagtgatggaggccataatgagcatgaggaagataatggaagccaatgcagttgcagtttccgctaccagcgctgtcgctaagacacatgaaatgccccaccataatctagtggactttgagccttgcctcggatatgccactgaagggcaagcagttggtggtatacatgccaaacactttgaagggcccttagtttcgcccgcaaccacaacccttgcattttgtggtgggaagagcccctcctgctatggctga

SEQ ID NO: 63815 - DNA, 228 bp, Glycine max
  Peptide Sequence Number=SeqID_180593
atggcggacaagattaggaagggggctgagaagaccaaggaggtggcaacatctgtgggggagacgctaaagaacatggggggagaaggcgaaacaaggcgtgcaaagagccaaagctaccatgatgattcaccaagatgttttgatgatgccaaagttcaaagagttgtttcaagattaaagaatcaagcattcaagattccactcaaagattcaagaatcaaatga

SEQ ID NO: 63816 - DNA, 240 bp, Glycine max
  Peptide Sequence Number=SeqID_180594
atggcttctatggatacctctgctaaggtcaactctaagatctttccatgcaatctaggaatgcgggggtccggggaatttgtccccttcttagatacaacgtctaggggtagcaaagtgccccaacgtacgtttttaagaaggcgacacggaccctccgttggtttgtttacagaagggatcaagacagaacccatatgcgatgcctatgcaaaagacacaatgcgggaatgtacatag

SEQ ID NO: 63817 - DNA, 1071 bp, Glycine max
  Peptide Sequence Number=SeqID_180595
atgatcgatcttaatttcaactctccggcgttgccggaacaaaccgttctcctgcgcgaggcattaaaaaaactgtctggcgcgggcgatctggaggcgttgttacgctatcaaccgcacgccggacgcatgagcgaacgggaaatagtggcccagcatcttaacagacagggtatggcggccagcgccgggcaggtcgctatcgttaacggcgctcagcatgggctggcggtcacgctcggcggtctgctgcgtcccggcgatgtggttgcggcagatgccttgacctatccgggatttcgcgccctcgccaggctctatcaactcgaactggttgctatcccgcacacaacacaagggccggatctcgatatgcttcgcaacctgtgtgaaaaacggcgggtaaaagcgatttacaccatgccgacgctgcataaccctctcggctgggtaatgaatctggcgcagcgtagtcaactggttgatattgcccgccagttcgatttgttcatcattgaggatgccgcctatgcatggttgattgaaaacgcgccgccgccgctgatgtcgctggcgcctgagcgtacggtctatgtgtgcggtttttcaaaaaacatcgccaccggtttacgggttggcatggtggtatgccgcgaagcgttaatgccggcgatagagcggacgatccgcgccaccagctggaatacgccggccttaacgacggcgctggtctgcggctggatccaggatgggacgctggcccggctcgaaaccataatgcgcgcagatgcgcggcggcggcaggctatcgcccgtcaggcgctggctggcttaccgatgatcggcaatgaaaatgcctggttcctttggctgccgttgggcgaggacgtccgcgccgatcgcgtcgtgaaacagctgctaaccatgaatatcgctatttccaccgccgaaccgtacagcgtcggtcgtgatgtgccgcatgctttgcgtctggcgctggcgtcaccgagcctcgataaactgagcgctgcgctgaagataatgcggcctattatcgagtacggcgtttaa

SEQ ID NO: 63818 - DNA, 381 bp, Glycine max
  Peptide Sequence Number=SeqID_180596
atgttggatgagggtttggttcgtaagagcttaaatccttgttcttttttggtgcccaaaataggtattatgaggcaccaaatccctatgataggtggtatgatgaatgtgttgagtggtgcaaccctcatttgtaaaatcacccatgcatccaacatcttcatgattcacatatatagggactcattagcaccactcattgagttggtgaggaaccatgttccctcatggaagatgcccaggaaatggggggatggaatgatgcaatcctacccctcaagggcattgaatagaagactccaagaagattgggctagagatgcaagagaaggcgctatggttctcatgagccttagggtagatttcgggcccgtgggctaa

SEQ ID NO: 63819 - DNA, 594 bp, Glycine max
  Peptide Sequence Number=SeqID_180597
atgactaccttgacccagatatggatgacactgctgcatagcaatgtcttgccgagcgaccacaactttgacctccctctgcctaagtgtcagttggtgtatgccatcctgacgcagatgagcgttcacatggcccaagtgattgctgatgtcatttatttgtttgcaggaatagcgcctactaggcaccctctggacccagagaagtccaacagggccttggggtttccggctctgatcacgggcctctgccagtcctacggagttcctatcacccccagcaaggtaatccgaccactgatcacccgagtcttcatcgagaagtactgcacgcctaggcaggcgcagggcaacgcacatcaggacgcgggtgcaccgccaccacctcggcaagccgattcggttgggccactgctcgtggagcgatatatatatcatttggttcgccagcaggcggccaaacaccatggacaggtgcagatacatgagtgtctctatcagttcagcctcagtcagcaggaccagggttctgccccttttgtatgtcgtaccccagagcagtttggggctgaggtcgcatggcctggtgactag

SEQ ID NO: 63820 - DNA, 327 bp, Glycine max
  Peptide Sequence Number=SeqID_180598
gttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagtttgccaaacaatttctggtcaaggatatgagggttaacctctctcctgtgcttgacggagttcagtctgtctggagggaatcatttcttctcaatgccatgatactttctgttttgtcgagccctgctttggtctctggtttgatggttgcacgtgctaaaaatccg

SEQ ID NO: 63821 - DNA, 165 bp, Glycine max
  Peptide Sequence Number=SeqID_180599
atggtgtgtgaaaacaaatatgcgaacgtgttggttcctcctacagggttttatatggaaatcctattggtggcctctcgcggagcgccaatctcgcgcttagcgcgcattagtgaacagtggctcagcgccaatcttgcgcttagcctggaagatgacggatga

SEQ ID NO: 63822 - DNA, 1302 bp, Glycine max
  Peptide Sequence Number=SeqID_180600
atggacagaaatatgaacttttcgtatttggaggagaagcaatcctttttcggtttcgctgtttccattttcagctttgctcttgtgtttgagcatttgaatctcgacaaagtggttaaatttgtgaaaaaggaagctcagggcagttctagttccctgccacctttcctcaccaagatttatgagatggtggatgatccttcaactaattccattgtttcatggagtgccaccaataggagtttcattgtttggaacccaccagagttttcaagggatttgttacccaaatactttaagcacaacaacttttccagtttcatcaggcagctcaacacttacggctttagaaagattgatcctgaacaatgggaatttgcaaatgatgattttgtaagaggtcagccacatcttttgaagaacatccataggcgcaaacctgtccatagccattctttgcagaatatccagggtcaaggggtttcttcgctgactgaatcagaaaggcagagttttaaggatgagatagagaagcttaaacatgaaaaagaacaacttcttcgggagttagagatgcatgaacaggagtggaaaatgtatgaggtacaattacaacactccaatgatcgtttggaaaagttggaaaagaagcaagaaaatttggtttcttctgtctctcaagtgttgcagaaacctgggattgccttaaatctcttgctgttgacagaaaacatggatagaaaacggaggttgccaagaagtggtctctttagtgatgacgctagcattgaagatcatatggaaacttcccaagtattaccaagggaaaatgcagatggtgcttctattttctcatcgagcacagaacggttggatctccttgagtcatccatgacgttttgggagaatattacacatgatgttggtgacgtctttgttcaaagtcatttaaacttggattttgatgaatctacaagttgtgcagatagtccagctatatcttgtgtgcaactagaagttgaagatcagcctaagtcacatggaatcaacgtgagttctgagccagctgtagttgcggctcctgatcttgatgcatcaaaagaacaacctgtcgaaacagctcctctgactactggtgttaatgacatattctgggaacgattcttgacagagaatcctggttcgtcagaaatgcaggaagctcagtctgaaagagaggattctgatggcagaagtaatgccaaattttggtggaacattaggaatgtaaataaccctccagaacagatggggcattcttag

SEQ ID NO: 63823 - DNA, 1912 bp, Glycine max
  Peptide Sequence Number=SeqID_180601
gtcgccgacgttggaagcgtttctggcccccgttgacttaagcgacgtcgctttggttcagaccctcatctccgttgccaacgagattgtgtcgtgtttttcgaagcgtagtttcttcttccagcgcaagaactcgcggtctctgatccgaaaagtggaagtttttcagttgcttttggagtatttgcgtgattcccaatcgggttcttcgtgtcttccacccacggcggtgctttgtctcaaggagctctacctcttgctctaccgctccaagattctcctcgattactgcgcccaatcgagtaagttgtggctcttgcttcagaaccattccatctctggtcacttccatgatttgaaccaggagatttctacccttatggatgtttttcctgttaaggatgttttgttgagtaaggatgttagggaacaggttgagctcttgcagaaacagtctagaagagctaagctttttatagatatgaaggatgatgctctcaggcttcggtttttctcctttcttgatgagtttgagaatggagggattcctgattctgctgaattggggtctttctatgttgagaagctgcagattgttgatgcggctagttgtaggactgaaattgagggcttggaggagcagattgttaatcatgaaggtgacattgagcctactatttctgtgcttaatgggttggtggctatgactagatattgcaggtttttgctctttggctttgaggaggatgagcttggttttgagagtggaagtcagaagaagcctaagaggaggttgattactcaggaaattgctgaaacgtttttgactgttcctaaggacttttgctgtccaatttcgttggatttgatgagagaccctgtgattatttccactggtcaaacctatgatcggagttcaatttcgaggtggatggaagaagggcatactacttgccccaaaacaggtcaaatgcttgctcacactcgtcttgttccaaaccgggctctgaggaatttgattgtgaagtggtgcactgcacatggagttcctcttgagccaccagaggtcatggatgcgatgggtgaagttttcccgtcggcctgtcccaccaaagctgcccttgaagccaacagagccacagcgacgcttctcattcaacagctcgcgggtgggtctcaagctgggaagactgtggctgcccgggaaataaggttgcttgcaaaaactggaaaggaaaaccgagccttcattgcagaagcaggggcaattccgtatctgaggaatttactttcatcgcgaaatgctgttgctcaggagaattctgtgactgcgctgctcaatttgtccatttttgacaagaacaaaagtaggattatggacgaggaagggtgtctaggatcgattgttgatgtgttgagatttggacacaccacagaggcaaaggaaaatgctgctgcgacgttgttcagtctatcggccgtccatgactataagaaaataattgcagatgagatgcgagcagtcgaggccctcgcaggactgttgcaagaggggactccaagaggaaagaaggatgctgtgacagctttgttcaatctttccacacacactgagaattgtgttagaatgatcgaggccggggcagtgacagctcttccaattggggccaaagcagtggtgaatgaggaatcagcagtggctggattaattggaatgatgcgttgtggaacaccgagaggtaaagagaatgcggttgcagcgatgctcgagttgtgccggagtggaggtgcagctgcaacagaaagggttgtgaaggcaccagctttggccggattacttcaacccttctttttacggggccaaaacgcgcaagaagaaaagcagcttcacttgcaagagtttttcagagat

SEQ ID NO: 63824 - DNA, 240 bp, Glycine max
  Peptide Sequence Number=SeqID_180602
ggggagggtttcgctgagcggtggctaggccgatggtggtggttcacggagggggagggtggcgctgagcggtggctaggccgatggtggtggttcacggagggggagggtggcgctgagcggtggctagtggtggctagtggtggcttggctgttggtattccgactgttcgtattcacctctgccctctctctctgacatgcacagtaattaatgcagcatttaaaggacataattag

SEQ ID NO: 63825 - DNA, 1497 bp, Glycine max
  Peptide Sequence Number=SeqID_180603
atggtagccttgtgcaaggaaactattggtcatcaagacattgtaagttcgttgtttaagggaatgcaaaaagagaaaaagactatcaactctgtagaattgtcaaaagcaatgttcgatgcagcacaatcaggaaacgttacgattttagagtttctttttaacaaccatccagatttgctatttgaagtggattccacaaagcaaagaagcttacttcatattgctattctatatcgacaagaatatgtataccgactaatattaagcaagggtgctttcaagaatgttatgatacagttgattgattccgacggtaacaatgttcttcacttagctgcagagttcgattctaaagaaagattaggattaccatcactccctgttctaatgtgtagtgaggagaaatggtttcaggaagtggagaaaatagttccacctgctatgaaaagaatgaaaaataatgatggtttgactcctaaagaagtatattaccggtcacacaaagatttgcacacagaagcggcatctatagtgaaaaatttggcaaatactttattagtggtggcaattctaattgtcaccctagggatcaccggagctataaccgttcctattaaggatcttgatagtacaagtagtcctttttttccaaagaagacatggtatacgttcttttttctatcaattgcatttggaacatggctttgtgcttcatctatgttctgctacgcttccgttattcttcctcaaatcatgtatactgctgctatttctggtgccatagtggtctttgacttcttatccaattggagcatttacctcatttgtggatttggggcccctaaacccccagccaaaccagcccctgccacaccaactccagctccagcaaaatcattggttccctcattaccccaatcacctttctctgattcttcttctaatcaatacaacttcaaaattctaaggaagaccaaatcattcagcacactaatccgcttgctcaaaaccacccaaattatcaaccaagtcaatgcacaacttgtaactacaaaatctggaggaggtttaaccatccttgcacctgatgatggtgccttctcacatctccaagcaggttacttcaactctctcggcgatcgccaacaaaaagcattgatacagttccatgttcttccagtttctgtctcaagctctaattttgactctcttagcaatccagtaatgacactggccagcattatgtacagtgataagacacttgccatacatcatgtggacacggtgcttattcctttgtatttctcaaagcctaagcctccagctcctgctcccacgttggcaaaggcacctaaagctgataaggataactcatctgcgcaagatgatgatcagggagagtcaaataaggccacttctgctgccaatgccatcaatttaattagcattcacggaacaatgttggtgtcccttggtgttgctttagtggcagca

SEQ ID NO: 63826 - DNA, 207 bp, Glycine max
  Peptide Sequence Number=SeqID_180604
atggctacatccaggtgggcactcaagcatcccgtttatggcattgtgatactacggttgggaatttacacagacagacccaacgtgatgcaatcctatcccgcaagggcattgggtagaagactccaagtagattgggctagagatccaagggaaggccctagggttcttatgggccttagggtagatttcaagcccatgggctaa

SEQ ID NO: 63827 - DNA, 696 bp, Glycine max
  Peptide Sequence Number=SeqID_180605
atggtagccttgtgcaaggaaactactggtcatcaagaaattgcaagtttgttgtttaatgcaatggacaacgagaaagagtgtctcagctatgtacagttgtcaacagcaatgttcgatgcagcaaaatcaggaaacataatgatattagagtttcttttgaaggaccatccagatttgctatttgaagtggattgcaaagagcaaagaagcttacttcacattgctatgctgtatcgacaagaaagtgtataccgactaatattaaacaagggggattcaaagaaagtgatgatacaattgattgattttgagggtaacaatattcttcacttagctggaatgccggcacgacctgaagaaagattcggattgtcaacagaccatgttctaatgcatagtgaggagagatggtttcagtcacacaaagagttgcacaaagaagcagtatctgaagtaaaagatgcggcaaatactttagtagtggtagcaactcttgttatcagcctagggatcaccgcaggcatgaccatttccgttaatgacattgatgctattcttccttcaagttgggaaccaaaagatgattctgtccacttgcggcaaacaaagttggtatttgggaatataacactttttggcgtctcttgcaatcatgtttactgctattgtttccggttccatattgatctttga

SEQ ID NO: 63828 - DNA, 493 bp, Glycine max
  Peptide Sequence Number=SeqID_180606
gcatctcactgaaacatgtatgcgagcggggaatactgatatctatggattcctcgagccacagtccattcagaggtctgggcaatcgcaatttgagtctgaaagttacataaagagttggaagcagagttcacaatgtgatgtctatcttggagcctacctaaatgggttccactgcagtggacactggcagatggtggtcatcctgcccaaggaacacctagttgtctgtgctttcaagggtcttgatgatgctccacagcctaaatcaaaggcttctgctaggtggattgtcgtcaagtgtaatagacaaaaagaaagtactgagtgcgactactatgtcatgcactggatgtccaccatcattttaggaacttttaggaataactgggaagcgtattttaacgatgctagaccattggagccagagagattaaaggcgttgcagatccaatgggcacagtattatctccgagttagagatcagacctag

SEQ ID NO: 63829 - DNA, 990 bp, Glycine max
  Peptide Sequence Number=SeqID_180607
atggaagaagagaaagagcctctcaactctgaacaattgtcaaaagtagtgttcgatgcagcaaaatcaggaaacattatgattttagaatgtcttttgaaatatcatccagatttgctatttgaagtggattccagagagcaaagaagcttgcttcatattgctattttgtatcgacaagaatctgtataccaactaatattaagcaagggggattccaagaatgtgatgatacaattggttgattctaagggtaacaatgttcttcacttagctgctggagagttggcacctgaagaaagatttggattaccaaaccatgtactaatggctagagaggagaattggtttcaggaagtggagaaaatagttccacctgcaatgaaaacaatgaaaaacgaaaggggtttcactcctaaagaagtgttttatcagttacacaatgagttgcacaaagaatctgtatctgcagtgaaagatgcggcaaatactttaatagtggtagcaactcttgttatcaccttaggtatcaccggagctttgagcattcctattaaggatgttgatagtacactcactcctatatttcggaagaagacatggtatacattgtattttctagcaatcgaagttggaaactacttatgtgctgcatctatgatgttctatggttcagttataattccttcaagttgggaaccaaaatatgagggtgttctcttgcggcaaagaaagttgatgtttgggaatatggcactttctgcctctcttggactcatgtttactgctattgtttccggtgccatattgatctatgacttcttatccgattggctcttttatttcattgctggacttggttgtatcacattgatatcgccaaaattaatccgcaatatctatgaagcctatcacccattgcaatcagtcaagaactgcaatggatctgaatcctctaccttcacaggatatggagtgtttgcagtttag

SEQ ID NO: 63830 - DNA, 642 bp, Glycine max
  Peptide Sequence Number=SeqID_180608
atgtcagactcaggtgcagttaccttgccagctgtagatgacattcccaagcatgagaattgtagcgaactgggtattgttgtggctgaagctgagcatctacagtcactggaacccgaaagttcttttttggagctagacagaacgcataaaaggcaaatatatatagcagcaagttcaggaaattggagtgaggctttatcctatttcaaaattcatcctcattggtggcgaattccattgacttctcgtggagttacagctctacacgttgcagttagcatgagaaaaactagttttgtggaaaagttggtggatcgtgtggatcgtatgaacatgcaagatttggaaattcgcatggcagatgggaacacagccttttgtttggctgcgataacaggaaatgtgaaatgtgctaaaattctgttgggcaagaatccggggttgctttggattagagaccacaaagatatgctaccaattcaattatcatcttctgcagggcacattccaatgacggaacttttatttgaagctcaagatgacctacacaacaatatacccttccatgacatcgttaacctatttttcttgaccatcaccaacaacattcacagtaagcttatccacattaatttctaa

SEQ ID NO: 63831 - DNA, 525 bp, Glycine max
  Peptide Sequence Number=SeqID_180609
atgggatcaagtcaaaagccttcgcttaaaaagaggttttatcaagtcaaaaatcaagagcttagaggtcaccagtttacgaaagttggggcaattaatgggtcaactttcaacggcaagccttccgcaaagcctatgggagtcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccgctcgtgcatcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 63832 - DNA, 114 bp, Glycine max
  Peptide Sequence Number=SeqID_180610
atgtggaaggggcagttggatattgaagcggaagaaggagttctttcgcgggaacctgcgaaagaaaggggagaaggttcttctgcgggttccggcgggaagaaggttccgaag

SEQ ID NO: 63833 - DNA, 489 bp, Glycine max
  Peptide Sequence Number=SeqID_180611
atggcggaagaaacgaacaaagctattcaatggaggatgccaatgcctgtggaggaaaagaagggaaccaaatttcaaagcgcggaagaagaagcttgccattgtatacacagaagacgaaggaagaagacaaacctttttggaaggaaggagaagaacgaaaccaaggaagaagaagcttgcagggaggttgctgggtgcacgggagaagaaggaaagcgcagaagaaaacggtattttaggaagttcattcaattgctgggtgcaccagcaattttgctgggtgcacctagcaacagccaaagcggaaacccatctaacatatgcttcatccaaacaaagcacattttattaattgggctattgcttcctgcacctcctttatggcttccagaagttatacttccagcacctaaaaaattgattcttgaaaaggcgaaatgtaatttcatattttggattgatactagaagcaattcatgggggtga

SEQ ID NO: 63834 - DNA, 574 bp, Glycine max
  Peptide Sequence Number=SeqID_180612
atgacccgcaccaagaaaatttgccaaatgacatctaaggtagcaaaggaaattgttgacaagattgcctcacagggttcctttgtcaccgatggacgtcagaatgtactaaccactgccattgggagaccaaaacaccctggtcgtgtgcgtgctgctagagttggtgtcacaatcaaacaacactttggactagctccaatgacctcctgcagccaaatgcaatcacagggactcgcactatctcctgagcctgaggttgatccttcagctgcttgtgtcagcacaaaggagagttatgttaatcccataggaaatgacccaaacacaagtgactcagagaaatgcgggttgtgcatcaaagaaaattctctccgtctggcacttaacaccttcattacaagtctgacacatcttgtcaagcgtttctcagagcagggagttgtgggaccggagaaacctacaaataggtcagatcatgatgttatgtgggaagctaccgtgtttgaggtgtttaatgacaactttcccttgtacataaagcataaagatgtgtctgaaatagcacacggtg

SEQ ID NO: 63835 - DNA, 303 bp, Glycine max
  Peptide Sequence Number=SeqID_180613
atggcccacgggcaagtcgaccgccgagtcggaaggatccagccacagcacgtcaggcccgtttcaatcttgaagcgctgttcaacaagcgggagggggacactgatgcgtgagcaaggagagtcccttctgccgctgaaagtggtgcagagccgagtggggatgggcaagaccaagatctatgagcagatcaaggcaggcgccttcccggcgtgcatcaagaatgggcgaacgtcggtatgggttgcgtcagagatcgagaactggattcaaaaaacagtgcagcaaggtcggaagggctga

SEQ ID NO: 63836 - DNA, 522 bp, Glycine max
  Peptide Sequence Number=SeqID_180614
atgacacgaacccatatcaccagactcgtcgccagcgtgctgtccgtagcgcttgtggttgctgggttttggtatgggcgtaatattccgtttgctacgcagtggcctctctatgaagcactcggaactaccgccgcaatcatcttcgcccgccttcgtttttctggtcgtcgcgatagtgaggtggcagcgaaccctgaaagaggggagggcattgggcgattcttcacgcccattgcgcattcgactgcaattctctgcctaatcttgctcatcgggatcgtcgctcctatcgcaaagcaactccccattgtccttgagcatgttgtggtagctcgttcgttggcctatggggtactggtgtctttgacgttgtggcagttgtggaccgtagtcttgacgcttgttcccgcggatgagataaagcgcgcctctgataatgaggaccggcgtagagaccttgtggctccattgacgaagctagggtcagtggttcgtcgcggcgacggtccggctagatag

SEQ ID NO: 63837 - DNA, 565 bp, Glycine max
  Peptide Sequence Number=SeqID_180615
atgccaccgcttatcagactattcacatctgcaggagatttcatggttcgtaaggctcttctcgccgcgctgctgctggcggcagctcaggcgcatgctgactatcagtgcagcgtcaatccaaaggatgatgtgatcatcaaaccccagagcgtgcaggtggtgggcagcaacggcaaccttgaaatcacgccgcagggcgatgtgcagttcaacggcaagtcggtgagcgtcgataacgccacgcgccagcaggcgattgactaccagaacgcgctgcgtcgcgatctgccgtgggtcgacagcggcgcaaccacccgtctggagcgcggccgcgtggcgctggataaagtgatcgtcgagaaactcggctcggacagtaatgtgcgcaatcgcctgaccacgctgaacggccagctgaagcagcagatgaaccgcatcatcgagcatcgtccggatggcctgaccttccatcatcaggccattgagcaggtgcgcgccgacggcgagaagctggtgcagagcacgctgggcggggtgttgcaggatagcctgaacgagatgg

SEQ ID NO: 63838 - DNA, 1064 bp, Glycine max
  Peptide Sequence Number=SeqID_180616
tggtcgttgaatgcgcaaaacaagatcagaggcagaaaacgttggggttacatctctggaacaaaggttgcaccaaaaaacaagaaatctaatgaatatgaagcatgggaagatgaaaactgcctaacatacccagtcagccaggatgtgtccagatcgtatcaaccatatcgtgaggtaatctctactcagcaaaatggaagctctgttattacatactttgttcatggtcgtatccttgctaccactccccttccaaatgtccaatcagttcatgcaattgtttgtgtcgaggcaaatcgccaagagcctatgcttgatagtgagtctactatgggaactgccattgatgttaagaagtattctaagaaaggaatccacaagtgtacccgttgcaatggggataatcatgtcgtggagacatgttttaaactccatggctatccgaattggcatccaaaaggcaaaactactcccaataccaaggtagatgctacttccaagagccatatttctattgttgctggatttgtgaccaagtcaggaagtgagccaatcccaaagatggacaattcttttttggataatatagtgtcttctgatcataaccaattggctcaatcttctccacaggttcgacttgactcttcagaggtatcttctgatcctatctctgataatactaatgtagatgaaactgatcgtgaaattgtttctcttgatcctacccttgataatactaatttagatggaaccaatcatgaaattgatccttgtctgtgtgagatcaccagcaatccaaacaatgagtctactattgtccaatataatcttccaccctgctctaattgtggtcaacctccagctaaatatgaaccagacctccaagccaaagttaagaagctttggcaaatcctagatggaccgaagcaatggttgatgagatggcagcttcagacaaaaaacaacacttggaatcttgtgtccttaccaagagagaagaaaattgtgggctgcaaatggatatttacaattaaacgcaaaactgatgaaactattgagag

SEQ ID NO: 63839 - DNA, 492 bp, Glycine max
  Peptide Sequence Number=SeqID_180617
atgaaaagatggtgggctacgcaccctcaaagctttgcggatttggtcttcgccaatgaaaggatcgatgtgggtccgaaaagaggcaaatttgatcatcctactaggacgactgagaaaaatggggcaaataaaaagggtgagaaagagggagaaacccatgctgtgactgccattcctatacgaccaagtttcccaccaacccaacaatgtcattactcagccaataacaaacctcctccttacccaccacccagttatccacaaaggccatccctaaatcaaccacaaagcatgtctaccgcatttccaatgacgaagaccacctttagcacaaaccaaaaacaccaacaaaaaggaattttgcagcaaaaagcctgtagggttcaccccaaattccgttgtcatatgctaaacttgatcccatatccactcgataattcaatggtagccataaccccaaccaaggttcctcaacctccatttttctga

SEQ ID NO: 63840 - DNA, 546 bp, Glycine max
  Peptide Sequence Number=SeqID_180618
atgatgcaccgagaaatcgaagtctatgtggacgacataatcgccaagtctaaaactgaggaggaacaccttgtcaacctgcggaagttgttcaaaaggcttaggaagtatcaattgaggagcagaatcgtcttaggcagtggtcaaaatgctgagatggggctaaaggcagaaatcaatcaagtaaatattggatgcctaatctaccctgagggagttcgagttagctcgcctgggcgatcaacccctgcacgagatgggttaaaagagggggaggggaacgtttttttcacccaaaactccccccccccccccccgccccactttcaaaaaacgcaaagccacgagacttgctgtttttgcgcccccaagccacctttggtttcattttgcttccatttttgcacttttgctcactctctacaagggatggctgtaggcctattctatattctgaaatgcatgggcatgttgcattgcccccgtgcctcattttttcatgtccaaccatgcgcccaccaagtgttcggtgaaatgcctcaatga

SEQ ID NO: 63841 - DNA, 228 bp, Glycine max
  Peptide Sequence Number=SeqID_180619
atgtggaaacggaacatgcaccgcctcgacgccaccgaggtttttctcaagaacgctactcgccaggaggaggcgtgggaggatcacgtgttgtccaagagcagaaggattctccataagtttctgtatgaggatacgcatgtcgttcccgcatgtattgctgcgtcagttgttattgcttcttcgctgccagccatggctgctgccgccgccgccgcaactcactag

SEQ ID NO: 63842 - DNA, 351 bp, Glycine max
  Peptide Sequence Number=SeqID_180620
ctatttgagttcttgaaaggcttggttggtggggtcatcttcattttttcaatccatgttgtgaatgcattacttggttgtgcaagtttctcttggcctcatattccaacttctttagatgccataacttggctaaaagtgtatggacatatgggtctggtagttgttcaaggaactgtgatggcaagtgctattgcagtggtggaagaattgctttttaggtcatggttgccccaggaaattgaagttgatcttggatatcatcagggaattattatttcagggctggcattttctttcttgcagaggtatggcctgattcattcccagccacacagtaactctgcctaa

SEQ ID NO: 63843 - DNA, 222 bp, Glycine max
  Peptide Sequence Number=SeqID_180621
atggggatgaagaggctacctccatttctctgtcgggcacctgacaaagacatagacaaaagccaaagtccagttgatgtgggactaaaccaccaccctcaagattgcacttcaagcaatccgcaagccacaaagaagccacaactaagtcgggctaaggggtgtctgcaattaaggcagcttttccaacatccctattttagatacctagtgcagtcatga

SEQ ID NO: 63844 - DNA, 4367 bp, Glycine max
  Peptide Sequence Number=SeqID_180622
atgttggtgctggcgctaacttcctttgcacccgccgcgaatccctttcgatttcgaccccgcgcgttctgtcgccgtaggctcaaaatcaataactctctcccaccgcctccttcacccgcagttcctttcgagaatctcttccacagcttaataactcagttcccttccgtcaactcactcaatttcattactcccgctctcggtttcgcttccggcgtcgctctcttcttctcctcgcgctccaatgattccgattctaccctctccgacatcggagagtggatcctgttcgcgagtccgacgccttttaaccggttcgtgctgctgcggtgcccttctatatcgttggagggcgagaggctggtgagggaggagaggcactacgtgagaggagggaggattgaggtgcggagtgggagggagagggaattggaggagctcagttatcagagggtgtgtgtgagtgctgctgatggaggtgttgtttctttggattggcctgataacttgcagttggaagaggaacgtggattggacactactctcttgctcgttcccggcacgccgcaagggagcatggaccccaatgtgaggttgtttgtggtcgaagctctcagtagggggttcttccctgttgtcatgaatcccagaggatgcgctgcttcgcctctcaccactccccggggaactgctactcttcattttcatcttccattctcatccagccaaccaaccaaaggattatctacttctctgccttcttcctctttctctcctttctccaatcctggacttctcaactacttcattttctgtaggttatttactgctgctgacagcgacgatatctgcatagctataatgtacatcaacaatgcaagaccatggacaaccttgatgggtgttggatggggatatggtgcaaacatgctgacaaagtaccttgcagaggttggggaaagaacaccattgacagctgtcacatgtatagacaatccttttgatttagatgaagctacaaggtcctctccttaccacattgttactgatcagaaactcactgatggactgatagatattctacaaaccaataaggcactattccaaggcaaaaccaaaggttttgatgtggaaaaagctctgttggcaaaatctgtacgtgattttgaagaagcaatatctatgtggctcacagcagtggagctgggactcttgaagggccgtcatcctcttctgacagatatagatgttagcataaatccttctaaaggattagttgttgtcgaagaagtaaggtcaaataaggatgctaaagttggcacactgttggatcttactcggtcagatgcatttaatggatactctgccgatcccactaaagatttgcttgaagaaaatgagaataacactggtctccaatttaattcccaacaaggtctaaaacggaactttgagcaggatgatatgaatttacaggtaaaagatggcccattacagcagactagatccagtgatgcagatttaattgaagaggagaatgttgtctcggcagatagtgaacatggtcaagttctacagacagcacaagtggtaataaatatgctagatattaccatgcctggtactctaacagaagagaggaagaacaaggtgttaactgctgtgggtcaaggagagacactcatgaaagctttagaggatgctgttccagaagatgtccgtggaaagttaacagatgcagtgactggaattttgcatgcaaggggctctaagttgaaggtagataggattcttaatatttctcaggctcctgaatccgtatcagggcagaagaaccaagaaaaattcagagtatctggtgcagaagttatggttgaagatcagccctctgtgaatcagatgaaaaagactagtagtcctatagatggctctgatgatgctccaggtagcattggcaagcttgctgaaggaacagaaacagaagttattcccatagagaaatcaccaaattctacaaatttagcccagtctcaagaatcaaatgatgaagttagttcttctggttctttaaggaaggaaacagacgagtctaatgataataatgacacaaatgaggaatcaaaaggaaaatctgttcctgatattgatcatattaagaatggattggaaacaggctctaaaccatacactcctgggcttcctgatggagcaggtggctttgaatcagcagctgtgggtgagcagaaaagccaaaacagtggaatagctcaagcagacccaaaggaggaaaacactatcctgaaggacgagcagaaaagtcaggatttctctagcgatcatagtaaaaatacttcaactgatgcaaaagaagaaccctcttcgccttctatgtcctctgagcaccaaacaatagaaagggaaggtaatgatagtgagaaaaaagataataagaatatgcagcatgtttcacaccagacccactctaacaatttggcttctaatgcccctgccttcagtgtttctcaagcattggatgccttggcagggatggatgattccacccaagtggctgttaatagtgtttttggtgtgatagaaaatatgatatctcagcttgagcagagctcggagaatgaagaagtcgaggatggaaaagatgttgaacagaagatagaagaaaaacaaaaaactaataggcaaacaaaggattccaacacatctgctgatccttcagtagatgatcaccacaatgatatgcacttgaataatggttcttgtcatacagaggaacaaccatctcaaagtcttagtgaaattaatgggaaccgtatattcaatgctcaaagttgtaactctaatgatcacctagttcagaaggaaaataatacaaatactcaactgattgacaaaagatttctcattggtaaatgggatggacacagacacatggataggatgccagagttcatagctggtggttcgtacgggggctctccttacaatgaaaatttccataaatatcttgtttcaaagattcctatcaaaccacttgatttaggcacaacaactgcattattgcttgactatttcccagaagaaggtcaatggaaactttttgaacaaccacaaaacatggaaattgcttcttctcatactgaaactagtgaagaggctgggcccaagatgaaggctccctcctctgcaaaatcttctaatgcagagaaatatattgaaccaccatatgtaatattagatgctgaaaagcaacaagaacctgtcaaagagttcattacaacagacacagaaaacagaatgactgacaccagtgatgacaggtcagatgaattgatgcaatttgtgaaacagagtgtgttacattctttgaagatggaagttagtcgcaagctgaatgcttcagaaatgatagaaatgaagtcaaagcttgctgaagatatggaacatgtggcaaatgcaatttcaaaagctgttgtacatagcaaggtgcaacaactatatactgaagaaagcaaggtgcaacaactatatactgaagaaagcaaggtgcaacaactatatactgaaattcaaggtcgtaatgttgagggggctatagaaaaggtaggtactcttgaaggggagcatgtcattaatgtaatttcttcctccattcagcaaacagactgcctgagaaaagtggttcctgttggtgttcttgctgggtccatcttagcttccttgaggaaatattttaatgtaactacacttcaagatgatcacagaagatctctgatccatgatgatgaggaaaaacctagcacgaagaattatggcaatgaaggtgtcacagagatagatcaagtacctgacgagaaaactagtttggatcatcctattcagacagagagaatagaaagtgcatcaaaagatactagcaaaaatactgtcatggttggcgctgttacagctgctcttggggcttctgctttattcatgcaacagaaggatccccaacaagaaaatgaaaccgctgaaagctcatccacatctctgaaaatgaataattgccataaaaaagagccagaacgacttcaggaggaggtctctgagaagaaccagaataacatagtcacaagccttgctgagaaagccatgtcagttgctggtccagttgtacctactaaagaagatggtgaagtggatcaagaaagactggtcgcaatgcttgctgatttaggacatagaggtggcttgttgaggctagttggaaagattgctttgctatggggtggtatacgtggtgcaatgagtttgacggacaggcttctctcattcttacgtattgctgaacgccctttgtttcagag

SEQ ID NO: 63845 - DNA, 1344 bp, Glycine max
  Peptide Sequence Number=SeqID_180623
atgccaatgatactaagctggtcttcgagtaaaaacaaaaacagcttcaattcatctaagctttcaatttcaataagcataaatccaaacatcatcaacacccttcttaagtccctccaagcagcaatatctggagccacaaaactatctgatctattaaacaatgctggaaacaacatcatagataacaaaataggagcagtccaagactgtagagaacttcaacaatccaccttagcttccttaaaacgatcactatcaggaatccgttcccaagactctaaaaaactagttgatgcaagaacctacctaagtgcagcactcaccaacaaggacacgtgtctagagagcatagattctgcttcgggtacccttaagccagttgtagtaaattctgtgataagctcttacaaagatgtcagtgagtctctctcaatgctccctaaacctgagaggaaggcctccaaaggacacaagaaccggcgtttgttgtggttgtcgatgaaaaaccgtcgccgtctcttgcaaagcaatgatggaggagagcttgttgtggctgctgatggaacgggaaactttagcttcatcactgaggctatcaactttgctccaaatgacagtgctggtaggacagtgatctatgtcaaagaagggacttacgaggaaaatgttgaaatcccaagttataagaccaatattgttctgtttggcgatggaaaggatgttacagttattactggcaacagaagtgtcgttgatggctggaccactttcagatccgcaactttaactgtctctggtgagggctttctggcacgtgatatagcttttgagaacaaggcaggcccagagaagcttcaagcagtggccttgagagtgaatgcagacttcactgctttctacaggtgtgccatgtatggttaccaagacactctttatgtccactcctttagacaattctatagggaatgcgacatttttgggaccatagattacatatttgggaatgcagcagtggttttgcatgcatccaaaattatcacaaggatgccaatgcctggtcaattcactgtcatcactgcacagtccagagattcccctgatgaggacactggcatttcaatccaaaactgttcaattctagccaccacagatttgtactccaattctggtagtgtcaagagctaccttggaaggccatggagggggactgataaccgagttaattgggctgggtaccatgtaatggattatgacagtgcctacaacttcacagtttctgagtttattattggtgatgcttggcttggctctacttcatttccttatgatgatgggatttaa

SEQ ID NO: 63846 - DNA, 1812 bp, Glycine max
  Peptide Sequence Number=SeqID_180624
atggcgtttcaggactttgatctcatctcagagaggagaaggaacgagaagaggcaaaaggcgaggaagaggatcatgattggcgtggtctcttccgttgtcctcgttgccatgataggtgcagtactcttcgttgtggttagaaacgacaacgaagcaggcaacaaaaaaagcaatgaaaacaagtcacatggccattcacaacaatctaccacccccggcaaggatcacgttgtggcgcattcgaagatggtgaaattggtgtgcagctccgcggactacaaggaaaaatgtgaagaccctcttaacaaggcaatggaggatgaccccaaactcacgcaaccaaaagaccttctcaaggcatatgtcaaatttgctgaggatgaggttagcaaggccttcaacaaaaccatctccatgaagtttgaaaatgagcaagagaaaggtgcatttgaagattgcaagaagctctttgaggatgccaaggacgacattgcaacctccatatccgaacttgaaaaaattgagatgaagaacctttctcaaaggactcctgatttcaacagctggctcagtgctgtcatctccttccaacagaattgtgttgatggctttcccgagggaaacacaaagactgaacttcagactctcttcaacgattccaaggaattcgttagcaactcccttgccattctgtctcaggttgcatcggctctttcaacaatccaaacactagcacgcggcagccgttcgttgctgtctgagaacagcaactccccagttgcttctctagacaaagctgatggccttccttcttggatgaaccatgaggaccgaagggtattgaaggctatggataacaaacctgcacctaatgtcaccgtggctaaagatggcagcggagacttcaaaaccatctctgaatgtttaaatgctgtccctcaaaattttgaaggacgttatgtgatttttgttaaagaaggagtatacgatgagactgtgaccataacaaagaaaatgcaaaatataaccatgtatggtgatggatcccaaaagagcatcatcactggcaacaaaaactttagggacggtgtcaggactttcctaactgcaagttttgtggtagagggagatggattcataggcctagcaatgggattcagaaacactgcaggccctgatggccaccaagcagtggctgcaagagtgcaggcggatcgtgcagtgtttgccaactgtcggttcgagggctaccaagacactctatacacccaagcccacagacaattctacaggagctgcatcgttacaggaacaatcgatttcatctttggcgacgcagctgtcgtgttccagaactgcatcatggtagttaggaagccattggaaaaccagcagaacatggtgactgctcaagggagagtcgacaagcaacaagtcactggaattgtgctgcagaaatgcacaatcaaggctgatgattcactggttccagagaaggacaagatcaggagctaccttgggaggccgtggaaggagttctcgagaacaattgtgatggaatcggaaataggtgacttcattcaccccgatggatggacagcttgggagggagactttgctctcaagacattgtactatgctgagtatggcaacacaggacctggtgccagcaccaatgctaggatcaagtggcctggttaccaagtcattaacaaggatgaggctagccagttcactgtgggatctttcttgagaggcacatggctccagaacacgggcgtgcctgccacgcaaggcttgtacaattaa

SEQ ID NO: 63847 - DNA, 235 bp, Glycine max
  Peptide Sequence Number=SeqID_180625
atgatgatcatgaagttgaacgttctacaagaaacatttgcttcaatatactttcttgccgtatattttgatgtgaagtcattgtacaagatgagtgatgatttagagataggtagtggaaattatatggagatcatgagtatgagtgcatctaatcaatgctccatctatctccgagtcttcactcataagattgcctattactatcagcaagaatacgggtcactggggaaag

SEQ ID NO: 63848 - DNA, 747 bp, Glycine max
  Peptide Sequence Number=SeqID_180626
atggatatctcggcggctgaagttgaaatgtgtagaatccaacggcgtaggaaacatccatgcgcggaaacacggagccgctcacgccaaagacattggaatctcacccttatgcaaacagaaaagtggatcgaaaccgccgaagcccaaggccacgccactgtcttcgtcgccaaattctttggccgcgccggcctcatgtccttcatttccaacgttccagaaaatcaaagacctgctctgtttcagtcgctgctcttcgaagcgtgtggcagaacggtgaaccctgtgaacggtgccgtggggcttctctggactgggaactggcacgtgtgccaggccgcggtcgagacggtgctccgcggcggcacgctgaggcccatgccggagctcatgggcctcgacgctgccgctgccgccgcggccgccgccgacgaaacatcggaggccgaagtcggatgcaccgacacgtggaggatccgaaacccgaacacgaattgccggttcacaagctcgcgatcctcctccggcggcggcggtggtaaacgcaagcggtcggaggagctggcaaagcttcaggagcagcagccgaatctcgatctccggctgacgccggttttcttgcagaaggaggagagccgccggccagagtctccgtcgatgacctccgaggagtccggaacgacgacggagaacagatttggggatcagtggagtcactggaaagttctcaaccttttcatttga

SEQ ID NO: 63849 - DNA, 588 bp, Glycine max
  Peptide Sequence Number=SeqID_180627
atgggtgacatcgttcagttcgtgccccgcgttgagaaggacgcagatgcgaacctcatggagttcatccggttgacgagggaggagctcaccgcttttggaggtgacggctcttgggtagatgatagatggcaggacggggcgacgacggtcgtgtttgcgacaaagacggcgccgctcgatccctacagcttcactcctatggctgagccattcaagcagttcgccaaggcttatgttcgttactcatggagccacaggcccgtcagaaatctgtcctctatgatcctggcgctccgatgtgtagaggccggattgctcgcggcctgtgggagagcggatgttgggcttctcggcattgcagctatggacgtgtgcgcgaacaagtgcgctgagttctgcggcaccaagcagattcagtacgcggttggtcgccacattcaattgatcttcgactttctgcgtgacaaaaagcttgttcgattcctgccgctttggaaatcacccttcaagaagccggcgatcctgacagagggcgtgggcgaagccggagcggcataccgtgcatcgaaacttccttccacacag

SEQ ID NO: 63850 - DNA, 346 bp, Glycine max
  Peptide Sequence Number=SeqID_180628
ggtgatgggttcacagggtgagaccgtgtcggcatgcgaggatcgtgaagcttctcctcctgcaagcacgcgagcccggcggcctggaccaaggtcatgggctggagggcctgtacctcgcgacgaatatcaagcgcaaggccagacacgaaacagctcaagaggaacaggaacccgcaatggtgagtctgtcgtggtcactggtgccatgatactcaaaaaatcggttgatcttaaagatccaaccaagggagaaagctggtgtgacatgggtgaggagttcatcaatcttggaggtgagatggagttgttgttgggtgaggcgaagaagagcctcctcaaggcg

SEQ ID NO: 63851 - DNA, 2821 bp, Glycine max
  Peptide Sequence Number=SeqID_180629
tgagcatgggctctgtttctcctgcgatgagaagttgcataggggccatcgttgtgcccctagggttcatctcttaattgttgaggatgatgacccgccagacccagactcctctaaaatagatggcactgacccggctccagtttcccctgatgggcctgacccgtacctggcccagataagtttaattctctcacgggccacgtcgcacctgaaacactcaggccctcgtcactcagcttggtcttccttgtcgagccacttctcctttgagagtcatggcactgatgtcgttttgggagtgcaatggctccagtccttgggacccgccaccacgcctactaccactaccactcacctttcccctgaacttcaagctctcctcatccagttcgatgctttgtttcaacctccacaaggtttaccgccagtgagggatactgatcactatatccaccttatttcgcaagcaacccttgtcaacatacggccttatcggtacccgtactaccagaagcataaaattgagattcaggtggactctatgctacaacaaggcctcattcagcccagcacgagtccgttcttgtcgtcggtgctgttggccaagaaacatgacggctcatggcatttcttcgtggattatcgcaccctgaatgccttcaccattaaagacaggttccccatccccactattgatgaacttctggacgaactgggcggagcacgttgcttttccaaattggacctgttacagggctatcaccagattcaaatgcatgcggcgagcatccctaagacaacttttagaacccatcatggccattatgaattcaaaggaatgccatttgggttgtgtaatgcaccctcttcttttcaggcgacgatgaacctcatttttcgaccatatctccggcaattcatcattgtggagtacctgggtcacatggtctcgcaccaaggagtagaacttgttgcttcgaaaatcgctgcaatccaccaatggccccaaccacgctccatcaaagctttgcaaagcttccttagtctggtaggattttatcgtcgcttcattcgtggatatgccacgatcgcaactccgttagtcaagttcaccattgttgatcccttccactggaccccacaagctcaattggcctttgacaatctcaaacatgccttgtcgacggcgcctgtgctggccttgcctgagttcaaccttccattcacagtggaaacaaacgcgttgagagtcggaatgggggcgctcttttccatcacctcggcggtcaagaaatggcgacaatacctcctcggccaccgcttcaccattatcacagaccatcgcaacttaaaggagcttttaaccaaaatcatccaaactctagaacaacatatgtacttggcgcgtctaatgggatacgattacactattcaatatcgttctggcaattataatcgagctacatacgcactgtcttgcttacctgagcaggaatccgtgacatttttgatcctatcgatgccatgtttgactttcattgaggaattgcgccgccaactcttggaccatcagaagtaccaacttctgtcccaacaaattcgtgcctgcctagatgaccaccagggatactccatctcccaggaccttgtcatgtacaagggtcgactttggttaccacgaggactacccttgatttccacactactcactgaatttcatgcaacacccacaggaggccatgctggcgttgctaaaaccattgtccgcgtatctgaaaatttttattgggaggggttacacaatgatgttgctcaatttttcgccaagtgcgtggattgccaggtcactaaatatgaaactaagaggctcacagggttgttgtgcccacttcctgttccttcccgcccgtgggaggatttatcattggacttcattgtcgatttgcccctttttcatggtaacagtgctcctcgtgggatcctctgttcgtcagccgattttggcaagaactttttcgggcaagtggcacacaattacggatgggctttgcctaccattcacagagtgatgtggtctcacaacacttcgttgaatggaggttccggcaccaccccttttgagattacctttggccgtaagcctttcaattttccaaaatatgttgtcgggactttgaagatcgacgctgttgaagagagcatctcagacagggaaaccacgttccaagccattcgaaagaaactcataaaggctcaggaacgcatgaagctttatgctgataagaaacgacgcgaagtcacttatgaatgtggagagtgggtgttgctcaagcttcgccctcaccgacagacctcggctaagggaagtcaggcaattatcggcaagttggccaagcgtttctacgagccatttcagatcacgaagaggataggcccagtcgcctatcgcctgcagctgccagagaatgcgcgaattcacccaatctttcattgtttcatgctcaagtcgttcaaaggatcaccggaaaatatcaaaccagcggagctacccccaaactttgctgatgagcaaccccttctttctcctttagcaattttgggccgacgacgcacatcttcagagccaaactcaccgtgggaggacaaggtgactctacaagggctgagggatgatacaagggcaacaaaggaaatgactcaggcaataaacacaaaagcagaaaaggaggaaaaagacaaaccagccagtcaacagtgcaatgcaatcttgcttgattcccttgaattcggttttgcaattgtcgatcctaggggataa

SEQ ID NO: 63852 - DNA, 1050 bp, Glycine max
  Peptide Sequence Number=SeqID_180630
gtccattatcttagtgggccaatcagaattctggataatgatggggtcccagcccagcctggagatctgcttgctgttgaaatatgcaacttaggtcctctaccaggagatgaatggggttttacagcaacatttgacagagaaaatggtggtggcttcttgacagaccattttccttgtgccacaaaagctatatggtactttgagggaatatatgctcattcgcctcagataccaggtttaacacaccccgggataattggaactgcaccatcgatggaactcctgaacatatggaatgaaagggagagagatgtggaagaaaatggcattaagtctttcaaactttgtgagattcgaaaaggcactagtgaatgggataagattgcaaaggaagccgcaagaacaataccaggacgagaaaacggtggaaattgtgacataaaaaaccttagcagaggtgccaaggtataccttccagtttttgtagaaggagcaaatctcagcactggagacatgcatttttcacagggtgatggcgaggtctcattttgtggtgcaatagagatgagtggtttcctagaactcaagggtggaatgaaagagtaccttacaccaatggggccaactccccttcatgtcaacccaatatttgagataggtcctgttgaaccaagattctcagagtggttggtttttgagggcatcagtgttgatgaaagtgggaggcaacactacctagatgcaagtgttgcatacaaacgagcagtgctcaatgccattgactacatatccaagtttggatactccaaagaacaggtgtacctccttctgtcttgcatcccttgtgaaggaagaatatctggaatagtcgatgcccccaatgctgtagcaactctggccattccaacaactatatttgaccaggatattcgtcctaaaaataacaaggtgccagttggaccccgccttgtaaggaaaccagatgtcttcaaatgcacttatgacgggaacttgcccattacaaggaatccaagtgccacgtcatga

SEQ ID NO: 63853 - DNA, 387 bp, Glycine max
  Peptide Sequence Number=SeqID_180631
atggcccagaaaatcggaaagtccacgcgccgccccggtgcctcctccaaggcccgcgtctatgccgatgtcaacgtcgttcgccccaaggaatattgggactacgagtccctcaacgtccagtggggggagcaagatgattatgaggtggtgagaaaggtgggtagggggaaatacagtgaggtgttcgaaggtgttcactgcaccgacggtgagaaatgtgtcattaagatcctgaaacccgtgaagaagaagaaggctgtgaatgtgaatgtcatgcaagtggccttagtgctacagagtagttctagttgcttccatttggttactcagaataaagatgctctagtagcagagggctgtctagttgtttattttaaagtataa

SEQ ID NO: 63854 - DNA, 669 bp, Glycine max
  Peptide Sequence Number=SeqID_180632
atggatcctcctcctccgctgcggcaactaaaacaccacatcccggagccatcggagcatccccgacaccaattccaccctccttgtcatcttcaacattattctcctctaacgaacaacgtcaccgtgtttcaaaactatggattgattccctttatgtctttgaaactaccatactatcctgaacttgtacgagtcttttactcaaatttgaaaattcaggatggaaatttgatttctgagttacctagtcaaggtgcaccttttgagggcaccattgttgatgactggaagtttgattactccaatcatgatgcccgccacatgtatattattgttcgcattctgcatccaaggtcttcaaacttagctcaggcctctgaggaggatttaatcattatgtgggctttcttgattggtcatcagatcgattgggcccatttgatccgttatcgcatgcataaagcattgcagtctagtgcacctctcccctatcctcagcttgttactcttttccttcgtcattttcaagtcccattagataatgagccatttgttcaagtgaaacgttcttatgctattggtgtcggtgcagtaatctcctttgactaccgtaaggaaatggacggacaatggttgaagaaaggatgcacaatctctgcaagatga

SEQ ID NO: 63855 - DNA, 505 bp, Glycine max
  Peptide Sequence Number=SeqID_180633
atgaataagttaccgcttgcgctgctgatcgccagtgcgctggccggcagcgtggcggccgcgcccggtccgcaggtggcaccggtagcgtggctgctgatgcagattcgtaccggcgaatccaccaacaaatacgatttggtgcagcagtcgctgtaccggctggaaaaaatcgatccggataacccgcaggtgctggcggcacgtattcgtatggcgctgcgtcagggcgatcaggccaaagcgcagcagctgttcgatgcgctgcaaaaggctgcgccggatgacgccgccacacgcgaatctgcggcaggtttgcgcctgatgagccccgaaggacgtcagcagctgcagcaggcgcggctgctggccaccgccggacggctgccggaggccaaagcagcgtgggatgcgctgtttcacggcgtctttcccgatgtaaacaccgaactggagtactggcgactggtggcgcgcctgccgggccagcagccgctcgcctggc

SEQ ID NO: 63856 - DNA, 246 bp, Glycine max
  Peptide Sequence Number=SeqID_180634
atggccaagtttgatccagatatagttctcgagttttacgccaatgcttggcctatagaggagggtgtacgggacctccgatcatgggtaaaggggccagtggattcctttcgatgcagacgccctaagtcaattcctgggatacccgctagtattggaggagggccagagtgcgaatatggtcagaggaggaccgggcagatggatttgatgaggaggtcatcgctcagctgctatgcataccag

SEQ ID NO: 63857 - DNA, 201 bp, Glycine max
  Peptide Sequence Number=SeqID_180635
atgaagcttgcttctacaaaatcggctatgcccagcacaagagcgcttagcaagtcaagggaatctggaagggcatatgctacgcaagctcgcgtttaccgcgatatcaacttgctttccaggctcaacgcaagattggcgctaagctcatattcacttactcctgctaagcgcgaaaatggcactaagcgcgacctctag

SEQ ID NO: 63858 - DNA, 369 bp, Glycine max
  Peptide Sequence Number=SeqID_180636
atggcatatagatccatcaaccagaatgtgctagcaaatgcaccttgctcggtcggaattctagtggataaaggcttaagtggctctaaccgtctggcgggaaatcaagtatctcatcatgtagtagtgttgttctttggaggaccagatgatagagaggcattgtgctatggatggagaatggtggaacatcacgggattagccttaccataatgcgttttgtccaaagtgatcaagtacaagtagagccattgaggcaacaacatggtggtattgatttggatgaaccaaggcatgatgagaagcttatacatgagtttaggataaggtgtggggatgatgatgcggttgattatgttgagaaggtg

SEQ ID NO: 63859 - DNA, 765 bp, Glycine max
  Peptide Sequence Number=SeqID_180637
atgggtcagctccagcggcaagcttttcacaaaacttacggtaaaatctgggacttagcagcgatcgacgcttttctcgcctatcataaccacaaggaaagcccggttgtcgctatgctagccgacctttatgacaccttcaaccgaagatgtgaaaagagcaatacgaagattgtttgttgtactctagctctttatgtatggttggtttcgcacctttttcgccaagaggtgaggcatgcttgcctgctagaaagccaccgttcatgcacagagaaaaaaggggcaaattgggatcaacccttagcaaacaaagaaggagcgtctatcaactggttccctcgatggaaagaaggaagagtcggagttcttatttcatgcggaggatttccaaatgttcccttgatggggacgaggggttgcatcagctacaatcccgttcttgttataagaccacttggctaccctatgagaagagcaccactagaggaagagctcgcgcctattattacacgaggcttcaataagaccaacatggaggcacttcagaaggtccgcaaggcgtgggagatggtgcaaaagaaggacaaagaactcagaggcagtaacaacgggcccatcggcgactatcgtaagtggttgaaagcccacatgcaaggtttggattggctcccaagcttgagaaccgctaaaagagaggaagttgaggcaccggaggaagacaaagaagtgcaggcccttagggtggaactcaagcaaggctaa

SEQ ID NO: 63860 - DNA, 420 bp, Glycine max
  Peptide Sequence Number=SeqID_180638
atgggtgccaagtacctcgaagtggtcaaacgagggttgcatcccaacaacggatggtccccggacgaaattagggctaaagatctaacttcagccctaagcaagcaactcgtctgggcaagctacagctcgcctgggcgagtggatacctgggcgagtgcaacaaattctcttgggcgaggcctaggatcttcatcatcaatggattcctttgcttcttcgaaaatgaatggcagcggaatggagagggaagagagagagaggagacgccacttcaaggagaagatgagtctagaagaagctcaccaccataggaggccatggataagagcttggaggaagaaggagatgaatgaagggagagggagagaagagcacgaaattttgtgctctaagagagctctgaactttgaagtttaa

SEQ ID NO: 63861 - DNA, 1482 bp, Glycine max
  Peptide Sequence Number=SeqID_180639
ggtgccaatggggatgagttgaagaaggtgaaacatgtgatccaatatggaatctttgcagcctatcatctggcgctggagacatcttttctggctgatgaaggtgcttcacctctagagtttcccttgaaatctcccataaccgttgcattacccgataaaccatctagtactgtgagatccatttccactatccctggattttctgttcttactgctagagagtctcagggagcaaaaccttttaaagaagtaccaaaatcaaatgatatctacaagactgaaagaaccccatctagctgcagtgagtccactgaaagattattggtgggtgactcaatccatatgcatgaagtgtctggaggtatcacccaattggctctggatatgccatcttccaactgcaatagtttcgtttcaaatacttcttctaaggagaatgataagaaatgtcccaaggaattttttcaatacagaccagatgagagaagggaaactatgttgaacaatggtcttatttcaaattctttcggtacctttgagtcttcacagcaagatggcaatagccacctcagagctgcagcattgtttgctaatcaaggagctaaccctgagccacctaatgtaaaacatgacactaataattttaataacaataatgatcatgatgatatgatacattcaaaagaagattttcctccctcaacttctgaccatcagagtattttggtctttttatcaacacgttgtgtgtggaaaggaactgtttgtgaaaggtcccatcttgtaagaattaaatactatggaagttctgataagcctttgggacggtttttgagagatcaactacttgatccgagttacacatgctgctcatgtgagttaccatcagaagctcatgttcattgttatactcatcggcaaggcagcctgacaatttgcgttaagaaattggagtttgctttaccaggagaacgagaaggtaaaatttggatgtggcacaggtgcctgaaatgccctcgcatacatggttttcctcctgctacacgaagaatagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatctccccccatctaaacttgaattcaactatgatagtcaggactggctacaaaaagaagcaaatgagctgcataacaaggctgaaatactgtttagtgaagtgtgcaacacactgcatcaaatttcagagaaggtttcaggtcctgtgttgcaggagggtggaaatagggtgtcagattttaggaatctaattgctgaacttaaagggatgctgcagtatgagaaagaagaatttgag

SEQ ID NO: 63862 - DNA, 222 bp, Glycine max
  Peptide Sequence Number=SeqID_180640
atgatgtttgaaaatatagctaacaacacggaatgttgcaaaactgtaggtgcatttgtgggagtttctttggaaggaaatatagttgcaaccaggatggatgccaatttgcgcttctatggtgatccttacctcaccacatctgatattctactgggaatggtggacagaccaaaggctgctcaacccataattgcaagtgatgtgataaatagtgcctga

SEQ ID NO: 63863 - DNA, 210 bp, Glycine max
  Peptide Sequence Number=SeqID_180641
atggtgattgtggatggagctgagaggatgaggaaagatcaatacctgaggctcgggggatctgagtgttacagagaaaaagttatggcatcgttagagaatgaaccttgtcacactccttctgcctctgaccaatcccctttttcttctcctcctcctcctccttccaatgtctgtatgcagaaatttaggctatatgagactcgatcg

SEQ ID NO: 63864 - DNA, 1710 bp, Glycine max
  Peptide Sequence Number=SeqID_180642
atgataggaagggacaagagcagaacatattggaaagtactaaagattgaccgtctcgatccttctgagctaaatttgcgtgaagattccaccacatatacagaaagtgaatgctctgatcttttgagacggatacatgagggtaacaagtccactggtggactaaaatttgttacaacttgttatggaattgtagggttcatcaaatttttggggccttactacatgctgcttatcacaaaaagaaggcaaattggtgcaatctgtggtcatacagtatatgctgtctcaaagagcgagatgattccattgccaaattcttcagttcggtctaacatcaattttaaaaatgaaaacaggtacaagaggctcctatgcatggtcgaccttacaaaggacttttttttcagctattcataccaaattatgcgtagtcttcaaaggaacatgtgtgataatgagacaggccatgttctttatgagaccatgtttgtttggaatgagttcttaactcgaggaattaggaatcacctccagaatactatttggacagttgcgctagtgtatggattttttaaacaggaaatgctaatgatatccagacgggagttcacacttacgctcattgcaagacgatcacgtcattatgctggcactagctttgcaaagttgaccatgagttggagaagagattttctgacacagtatttgaggcgtggtgttaatgagaaaggaagagtagcaaatgacgttgagacagaacaaatagtctttgaggatgttgcagaaggtcttcccatccaaataagctctatcatccagaaccgtggttcaatccctcttttctggtcacaggaaacttcaaaactaaatattaaaccagatattatatttacttatttttctccagtgtcaaaaaaggatcagagttatcaagccactagatatcactttgaaaaccttgtcaaaagatatggaaatcccataattattttgaatttaataaagacccatgagaagaagcctcgcgagtccatacttcgtcaagagtttgctaatgccatagatttcattaataaagatttatcggacgaaaacaggcttagcaaagctacaaatgtcttgcagcttctcggcaaagtggctgcatatgcattgacattaacagggtttttctattgccaaacaacaccaaccttgagaccagaagaatgtctgaaatggccaagtaccaacaatgttgataagggaaccttttcacctactagacatgtcaatgatgacaacagggttgacaacagggatgcagatgaaaattattctgtcaaaccacccatgttgcagaggggggtgctcaggaccaactgcatagactgcttggatcgcacaaatgttgcacaatatgcatatgggttggctgctcttggccaccagctccatgctctgggggttattgaccacccaaaaattgatcttgatgagcctgtagcagatgatttgatggggttttatgagcggatgggtgatacacttgcacatcagtatggtggttctgctgcacacaacaagattttctctgagaggaggggccagtggagagctgcaacacagtctcaggagttttttaggactcttcaacgctattatagcaatgcatacatggatgctatgaaacaggatgcaatcaatgtgtatgtgctacagtcatga

SEQ ID NO: 63865 - DNA, 1671 bp, Glycine max
  Peptide Sequence Number=SeqID_180643
atgtcaaaagtactatctgaaattaaagacttggtagctgccatctctactccagaagaaattatggcagcaaataaggacgatctaatagcaaagatcacacagttgaaaaatcaagggatcaccattgcatctttagaaaggaagctggagaatgttcaaaaatctattgacaaacttgtctctgcttttagcgcagaggagactccagaaaacaagaccccgctgagaaggaagagaattcttcctttcaccttaagcaacagtcccaacatgcaacatataatacgtgctccttgctcgcctctctcctcttcgcgtaaagcaatggaacatgaaattgagaacagggcaccagaaaacaacattggcgtctctggcagtgattcttttgctaagttacataaagatactccacgaaaggatgatgaaagttgtgattctgttttatcacgggaagcaagcccagctacacggcaatcaaaatcagtgaatgtgaagaagattccaaaaatgttcaagaatgttggagcttcagagtttatgttactgaggggagacccttctgatcagatatatatggaagttgaacttagaagattgactcggttagaacagcacctggcggaggttgggaatgctacacttctaggtggtgatgagcctgcaggctctgtttcagcaagcatcagagctctgaagcaagaaagggaacatctagctaggaaggtgaacactaaacttacagcagaggagagggaactgctttatgcaaaattggaagttcctccggttggaaaacagaggaggctgcaatttgtgaataaattgtggaccgacccttataacatgcaacatgtgcaagaaagtgctgaaattgtagcaaagctcattgatttcagtgtatctgatgaaaacagcaaggacttgattgaattaaacttttcaagtccttttaataagaaacaatgggcggggtttgcgttgagaaagagagagatgggaagagaaaaggagacaacaaaggtagcttacacagtggagcagcttgtagccttcaatccatacaatcccgatattcttccagatctcgaaaactatgtcaacgaccaggtttcgtcgcaaacttacagcctggacgcgaatctctgccttcttcgcctctaccagtttgaaccagagaaaatgagttcccagattgtggcccgcatattggtcaaggctctcatggcaatgccggcgccagatttcagcctttgtctctttttgattccagaacgcgtgcaaatggaggagcagttcaagactttgattgtcctgtctcactatttggagttctgggatgaagcagcaaaaagtcgtcatatagttgaagctgtgccaggatttgagcaggcaatccaaggatatgcaatccatgtcctttccttgacttaccaaaggattcctagaactgtgcttgctgaggctattaacatagaaggtttatccttggacaaattcattgaacatcaagtagccaacagtggttgggttgttgagaaaagccaaggcaggggtcaactcgttgtcctccctagaactgaatttaatgacccagctttgaagaaaaatgctgcagacagtgtaccattggagcacattactcgcatcttccctattcttagttga

SEQ ID NO: 63866 - DNA, 171 bp, Glycine max
  Peptide Sequence Number=SeqID_180644
atggaatatcgctccagactcgaaaatggaggacacgtgaatgacaacgcaattcactcacgcggctccggaaaaggacgagaatggaggattgccttgagctccagactcgaaaatggaggacacgtgaatgacaacgcaattcactcacgcggctccggaaaaggatga

SEQ ID NO: 63867 - DNA, 216 bp, Glycine max
  Peptide Sequence Number=SeqID_180645
atgtcacatttagtggtatcagagcaggtcgaacctttctgccatagacttactctgttgtggtggtacatttctcaaagttttgctacttgcctgacacagaaagtgatggctgcgagaaatgaacataagcgacttcttaccgaggtagaagcttgggagaggtccaaatatgtgaagtttatcaatggcctccgaccaaatgtggagatgatg

SEQ ID NO: 63868 - DNA, 384 bp, Glycine max
  Peptide Sequence Number=SeqID_180646
atggaggcaaagggtgtgcggttcttagcgtaccaatcaatattttcgagcgttggatctggggactttgatggggtgaagaaactggtggagaaagtgaagaatgaagaatggtcatcgctctctgatgtgatgtctcttcagaacgatgctggagagactgcgctatacatcgctgcagagaacaatctgcaagagattttcagcttcttgctcagcatgtgtgacttcgaggtcgtcaagattcgctccaagaaggctgatatgaacgcctttcacgttgctgccaagcgtggcaatctagaatcggaaaatcctaaacggttcaaccagaattgcatagccatagtatttaacaccataccctacatggagaaatattag

SEQ ID NO: 63869 - DNA, 279 bp, Glycine max
  Peptide Sequence Number=SeqID_180647
atgggttttcctttgccggcggtcacttatcttgtcgaaaatttatctggtctgaagcattctattctccctcccttgaagagattccgctatcctttgcttcgggggaaaggatggggatttcttttgataggccaaggttcaaaagattctaaggttgcatctcaatgggggtttttatcatgggagcccgatctcgatatcgggggcaaaacaaatttggtgtcaaggtgtcggtctcgggccgaacttccatattattccacaaggcacgcgtga

SEQ ID NO: 63870 - DNA, 246 bp, Glycine max
  Peptide Sequence Number=SeqID_180648
ttctatggagtgcccatcgcccccagcaaagtcatcaggccccctactaaccgagcttccatcaagaagtattgcgcatccaggcagccgcagggcaagacaccacaacagcctggggatggccggcagcaggcaatagacgcaccaccgccacctctagagccccttagctcatctacaaaggctggagctttgcctacgacccatggccgaccagcaggcgaccaagtccaaagccaaaggtaa

SEQ ID NO: 63871 - DNA, 273 bp, Glycine max
  Peptide Sequence Number=SeqID_180649
atggaagaaaatcacaagatgattctcaaatccttaggtgttataaatgcaaccaaattggtcacatcaaggccaaatgtccttcaaatgatgaatggtcagagaaaagtgaaaagaaaagatttgatgaaagaagaactaagaaagcatacattgcatgggatgacaatgattcatccgatggttcggaaaaggagattaatcttcaaaccaaagattatgaaagtgacgataacatctctcaagaatgaaaaacaaggagaaaaagcatga

SEQ ID NO: 63872 - DNA, 783 bp, Glycine max
  Peptide Sequence Number=SeqID_180650
atcagagagctacacgcccccaccctcgaagaactacacgtcctctacatcagaggattacccaccctctccttcagaggactacacgtcctcaccttcagagtgttgcacgccctcaccttcagaggactacacgtcctcgccttcatagaactgcacaccctcaccttcagaggactacacgtcctcgccttcagaggactacacgtcctcgcaatcagaggacgacatgacctcgccttcagaggactacacgtcctccacttcagaggactagatgtcctcgcctttaaaggactacatgtcctcgccatcagagggctgtacaccctcaccgtcagaggactacacgtcctcgccattagagggttgcacaccctcatcttcagaggaccacacgccctcaccatcagagggcggcacgcactcaccttcagaggactacacgtcctcgccatcagagggttgggtacccacaccttcaaagggctacacgccctagcattcagaggactacatgtcctcgcctttagaggactacacgtcctccacttcagaggaccagacgtcctcgcctttagaggacaatacgtcctcgccatcagagagctgtacgcccccaccctcaaaggactacacgtcctcgccattagagggctgcacgccctcaccttcagaggactacatgtcctcaccatcagagggctacacgccctcaccctcagaggactacacgtcctcgccatcagagggctgcacaccctcaccttcagaggactacac

SEQ ID NO: 63873 - DNA, 962 bp, Glycine max
  Peptide Sequence Number=SeqID_180651
cccaacatttcattggagacccatccttgtggaaagacagatccgcagaattattatcaaatcttaagtgtagaaccttagcagattttaggtggtacagagatactttcctaactagggtttacacaagagaagacagtcaacaacctttttggaaagaaaaatttctagatggtcttcccagatcattaggagacaaagttagagataaaatccatagtcaatctgctaatggagacattccatatgaaaacttaagttatggtcaattaatttcctatgtccaaaaggtagccttaaaaatctgccaggacgacaagattcagaggcaattagccaaagaaaaagctcaaacaaaaagagatttaggttccttctgtgaacaatttggcttaccagcctgtccaaaacaaaagaaaaaacaagcctctaggaaagaagcccacgatcataagccagccaataacagaagattttcaaaacgaagatactctcaaaaaccctcaaccagccacattagcaaatattgtagactaaagaagaagttaagaaaccttaacctagaaccctcaattgaagagcaaataaacaatttgctcatagaaacctcggaggaggaaacagaaacagaaacttcatcctctgtactttccgatgaaaacctaaacctaatccaacaagatgaccaactatcatcaacagatgatgatgggcaaatcaatactctaacgagagaacaagagctcttgtttgaagcaatcaattccatacccgacccccaggaaaagaaggttttcctggaaaaactcaagaaaacattagaggtaaaacctagacaaaaggattttatcacgaacaacaaatttgatgtaagtaacatactcaagagactagaaaattcttcaacaaagccaatgacaattcaagatctccaaacagagataaacaatctaaaaagacag

SEQ ID NO: 63874 - DNA, 378 bp, Glycine max
  Peptide Sequence Number=SeqID_180652
atgttctatgcccagcaagatgaaacgtcacaacatctatttttcaactgccaattctcgagagatgtatggagtaagtgctaccaatgggctggtattcagataacttatcatgaagagagatcctcgaagaaactccatgcaatattctatccaaggggagaatctcaagatatatcaatgctggaaggcgtcttggtgtgcagcggtatatatggagtatttggcttctcagaaacaattgatgtggagaagactatagagcttattaagatgacatcttggatgtggttaactgcaaaggataagactttttcatcatcatggattgcttgggcaacagatcctgttttgtgcaagaagggaaatctgttgtga

SEQ ID NO: 63875 - DNA, 681 bp, Glycine max
  Peptide Sequence Number=SeqID_180653
atgggtgacgacaattccaatggtcaatctcacattaactcacttgatcaggataagctcctcactgggattgtcctagagccagagccaccaaatttctcatttcatcaaagtgtccaccaccaccactcttctaccatgtcacaaaataatcatcatcatagtaataacaatgttttggttcccaccacaagcaccatgggaagtagtaccttatcctatgatgaggatgcaagctttgatgagaggcatggcaaaatgctcaagtgtaatagctcaaactccatcactatttctcaagatattgttgccaattcacagataccatccaaatctaccttcattttgtcctttgaaaactcaactgtggaacctgctctccatgatagacctaattataacaattcccctaagcattttgaggccacatgttcttcccttttgagctcagaaataacactcaacagtgactatatcatcactaaatcagaggccaagcaaggtgccaagaagcatagaacctcgtctgagatcaaagatcacataatggctgagagaaaaaggagacgggaactcactgagagattcattgcactctctgccaccatacccggattgaagaagcacgcaggcaataatcagacagcggtagcaagaaccggttcattgtttgatgactag

SEQ ID NO: 63876 - DNA, 348 bp, Glycine max
  Peptide Sequence Number=SeqID_180654
atgtcagttcctccaaaagagttacccataacaaaactgaaactagaaatagcctcttctataactatcaaacatagaaaaggttccagttccacaaacatgggaaaagaaatggaaaaaggtatatgcaaacgggtgaacaaagaggaaggacctaaatttctcaaagaggttatgaaacttgatgcaaaaggaattaatcctgttgaagaatcatcaggtaagaaaatagctggaaaaggatatctcacaacctataattgcggcaacaagacctcaatatcaacaaggaatcccctccacaaaattgaggaagctaaaaagtgggtccagattcgacatgaatga

SEQ ID NO: 63877 - DNA, 288 bp, Glycine max
  Peptide Sequence Number=SeqID_180655
atgcaaggacttggccagaagtttaaacagccagcaggaactagtattgatttttcaacatttgaggagtctgagttattgaaagtaggggacatggatgtctatcctattgcaattaaagcagatggatcctccagcgaccatggtgattcaaaatcaaatgaaactccatcatctggtagctcaaactctcagataactcaagtagtgtttgagaaggagaaaggagaattacaggtgaaggttgtgaagcagatcttggtagcttatgtaatcatgttggaatag

SEQ ID NO: 63878 - DNA, 1023 bp, Glycine max
  Peptide Sequence Number=SeqID_180656
atgggacagtatactcctttggatcaggtgctaatttttgtcttggccatggtgaccaacatgatgagttgcagccatgtcctatacagaaattcagaaggaaagggatattgtggtgctttaggccatggggatgagattgacaacacaactccagagttattgattagtctcaagaatcaattggatgttcaggtctgtacaaggaagaggaaaacatttgttctagttaattctggtttagtgtatggctttggctcaatgggatttggcagcctcagattcctggatagaagggtatcagataaagtattgaaacctagaatcctagataccatgagagctcaccatgtttcccaaattagcactggcttgtaccacactgtgctcttgtccttgatgaacaaaagatacaaagaagagaataaggtcccaaaaggatgtgatggaaatctcatcgatccatcatcttatagagatattatgcgtgatgaaaagtctgaagatattgcagaagcttcttttaggagaaaatatactatgaaacctgaaagagacagaattgaagcaaagatgattggtagaacgcaggctaatccatttggggaacaaagtaatccaaaggggtttcaaagaccacagccttcagttggtggctgtctaagtaattgccaagaggaacttaagaaggtgattaaggagagtttggttaggcaaaatatgtttccaaagacctctgaaagattaaactctggttcagaaacattctctacaagcacaagccaatattttgttgtcaggactaacagcctttttgatccttctttcttagcaatagctccaaagatggaaaaagcacctagcctaattttcaagctgatgggtttagaagaagccccctcaaaatcatttccagttgagagttttgtcaaagagcccaagcttcatgtgcttcatttcaatgataccaattccaagcagtttggtgatttatctcatattgcacttatgaaacctcgatga

SEQ ID NO: 63879 - DNA, 468 bp, Glycine max
  Peptide Sequence Number=SeqID_180657
atggatgcccctgacttaccagaggatgatgaggacccgctccctgacattgattctccagaggatattatgttagcatctgagaaaccgctcgctcgaacccacagaaccccctatcgaagaaaactcaaagaaaaccctacactgctcttggaaccgtggctcgaagaaaaccctacatacactcctttactaggtactagggtgctgaaacactcgtcggttctcaaagctcaaagctttctccgtgaggtacgtagaacaaggccacataaacccaatgctcaagctagcaaaactgttgattcagttacacttagatgctccacattgacaacaacacaagagaaagtgcattccattttacttcaccctcgttctgtgttctggaaacatagagtgaaaagatcagttaaggtgcctgctaccagcaacaaacttgcggatatccctccccatgatcaataa

SEQ ID NO: 63880 - DNA, 857 bp, Glycine max
  Peptide Sequence Number=SeqID_180658
atgccctcgcctttagagggctacacgcctttcacctttagaggactacacgtcctcaccatcagagggctgtatgccctctccttcagagggctacgcgccctcgccttcagaggactacatgtcctcgccttgagcgggctacacgccttcgccttgggtactagtaccctcaccttcagaggactacacgacctcgccttcagagggttgcaccccctcaccttcagagggctgcacacgctcaccttcagagggctacatgccttcacattcagaggactacatgtcctcaccttcagaggactacacgtcctcggcttcagaggacttcatgtcctcaccttcagaggactagacgtcctcgccttcagaggactagacgccctcacctttagagggctgcacgccctcgccttcagagggctacacgccttcgcctttaaagggctacacgccctcactttcagaggactactcgtcctcgcctttagaggactagacgtcctcgccatcagagggctgcacatcctcgcctttagaggactagacgtcctcgccttcagagggctgcacgccctcgtcttcaaaggactagatatcctcgccttcggaggactagacgtcctcaccttaagcgggctgcacgcccgcgccttgggtactagtaccctcaccttcagagggctgcacacccttaccttcagaggactacacgtccttgccttcaaagggctacacgccctcgcctttagaggactacacgtcttcaccatcagagggatgtatgccctcgccttcagagggctacacgcccttgcctttagaggactacacgtcctcaccatcagagggct

SEQ ID NO: 63881 - DNA, 561 bp, Glycine max
  Peptide Sequence Number=SeqID_180659
atggggataattgcaggagctatcaaaggccatacaagggccattgcagcactagaattgctaaacgttgctgcttgtgatgaaccactttctgttattgttgctgtaattacacctaatattctagctctttatgaagcttactttgggattccaatggcaagggttttgttgaaccctcataatattaggctaaatgcatccacaatagcttttcttcttggccattgcacagctgcagtagtaatagttgaccaagagttcttttctttagcaaaagaagctttgaaaatatggtttgagaaggccaaaaccttcagccctccatttttaatagtcattggtgatgaaaattgcgacctaagtgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 63882 - DNA, 3144 bp, Glycine max
  Peptide Sequence Number=SeqID_180660
atgccttcgctctctctctctgaccctgacacccccaaacctattgccaagaagaaaaccaaaacccagtccctcaccgatcccgacctcgatggggtttcggggaagaagacgaagaagcgcaaggcttcagatttagaacaagaggccatgccccccgccgcttacaacaacgatggggacgacgagaccagctccgacctcgtccaacccgaacctgcttccagagaagacgacaacaagaataagaagaaaaagaagaaaaaggttgttaagtccgaagaaaaggaacagcctttggtcacggaggctaatggagaaaagaaggaggatcccaacgcgctttccaacttcaggatttcggaacccttgaggcaaaaattgaaggagaagggtatcgaatcactgtttcccattcaggccatgaccttcgacaccgttctcgatggttctgatttggtcggtcgggctcgcaccggtcagggtaaaactctggcatttgtgttgcccatattagagtctttaataaatggtccaacaaaagcttcaagaaagactggcttcgggaggactccaagtgttcttgtgcttctacctactagggaattggcctgtcaggtgcatgctgattttgatgtttatggtggggcaatgggattgagttcatgttgtttatatggcggagctccgtatcaaggtcaggaaattaagcttaggagaggtgttgatattgtcattggcacaccaggtcgtgtgaaggatcatatcgagaaagggaatattgacctgagccaactaaagtttcgtgtccttgacgaagccgatgaaatgctgaggatgggttttgttgaagatgttgaaatgattctaggcaaggtagaaaatgttaataaagttcagacacttcttttcagtgctactttgccagactgggttaagcaaattgctgcaagatttttgaagccagataagaaaactgctgaccttgttggaaatacaaaaatgaaggccagcatcaatgttaggcatattgttcttccttgtactagttctgccagggcccaacttatcccagatattattcgctgttatagcagtggaggccggacaattgtttttaccgagacaaaagaatctgcttctcagcttgcagggatcttgactggagcaaaagctctccatggtgacatacagcaatcaacacgtgaggttacactgtctggctttaggtctgggaaattcatgacattagttgccacaaatgtggcagctcgaggtcttgatattaatgatgttcagttaattatacagtgtgaacccccacgggatgtagaagcctatatccatcgttctggacgcacaggaagagcaggtaatactggggttgctgttatgctttatgacccaaaaagatcgaacatatctagaatagagagagagtctggtgtaaaatttgaacacgtatctgctcctcagcctgatgatattgccaaagccgttagtggggaagctgctgaaatgattatccaagtgtctgatagtgtggttcctgcattcaagtctgctgctgaagatcttttgaacaattctggtttaccagtcattgaattactggcaaaggctcttgcaaaggctgttggttatactgaagtaaagcaaagatcacttctaacttccatggagaactatgttacattacttcttgagactggcaaaccaatctacacccaatcttttgcctatggagtcttgaggagatttttgcctgaagagaaggttgaggccgtgaaaggtctttcaatcactgctgatggaaatggcgttgtttttgatgtagcagctaaagatttagacatatatcttaacggtcaggaaaatgcctcgaatgtaagtttagagatagtgaaaacattgccacagttgcaacagatggagcaacaccaaagaggtggcagatttggtgatggtggtggtcgtggttaccggtttggtggaagaggtggaggaggcaggaatggtaggttctccaatggtggcggaagaggtggacgtggcggcaactggggtggaaagagatgtagatattttgacaagaaaagaagataccaccctgttgctggcacggtcatgcaccaaatgttcaactttcataggctgctcgattacatgatcgaccgtacaaaccagaggaaaacttacaggttgcttagcttcatcagaactgaggtctacactgcaaaccctgttaattttgagtatatcctcaccacaaatttcgcaaactacggcaagggttggtttcaccatagtgtcttgtcagattttctaggagatagtatattcacgatggatggagagcagtggcgccatcagaggaaggcagcaagctatcaattctcaaccaaaatgttgagagaattcagcattcaagatttgttcatgaaagcaactctagattctgtatgcaaggttgtccttggtgttgaactggacaccgtgtgtggaacctataaacaaggcacagagttctccaatgcttttgatgaagtaagtgctgctatcatgtatcggtattttaaatttctctggaggattatacggttcttgaacattggatcagaagtggtacttaacaaaagtttaagagtgatcgatgaattcgtttatgaactaatcagaaccaagattgagcaagcccaaaagctacaagataattctcctgtgagaacaagtggtgaaaggagacatcttgtcaaggtttataattggaagaaactgatccaaaggaaagatacaatatcagttactctttcctggtttctttacgaactttgcaagaaccctcatgtgcaggagaagattgcacaagagattagacagacaacaaatgtagaagctggatcaaccattgatgaacttgcagctagagtaactgaagaaaacagggagaagatgcagtacctgaatgcagcattgaatgaaacactcaggctccacccagcagttccagtggaaggcaagttttgtttttcagatgacacgtggccagatcgatatagtgtgaggaaaggtgatcttgtgtcattccaaccatatttcatgggaaggatgaagagagttggccagatgaaaatggaattttga

SEQ ID NO: 63883 - DNA, 279 bp, Glycine max
  Peptide Sequence Number=SeqID_180661
atgaaagctatgctttcactgtcaaaaacctccaacatggaagcattttcaagaaatgtagtgaaaggcaccctgcagtggcttggaggtttaagacatgagaaatccacaagtaggtcccagttttgcacaagtaagaatgcttcaattaagaaggtacaaggccaaagaagaattgagagttttgaaaggacctttgacaagagagtgaattggtcaggggggattgcatggaagagaggaacatggttttggttggaaatggcttccattatgtga

SEQ ID NO: 63884 - DNA, 297 bp, Glycine max
  Peptide Sequence Number=SeqID_180662
atgaggtctcgttgtcgtcatacaccgaccatagagggtggtgtggcaatttggatttgtgttgtgcatggacaatgtgcaccggactacatggattggttctacatgatttcacatccattcatgaagctggcacaacctggtgatccacccagacatccagctgtcatgcaagatgagacatatatggaaccagatatgcctaagtacccggtggcaacaatagctatagaggaagcacctgcacaagcaccttctgatgtggaacagcctagacatgtagtggaggcttgctaa

SEQ ID NO: 63885 - DNA, 498 bp, Glycine max
  Peptide Sequence Number=SeqID_180663
atgaacaaaacagaattctacgcggatctgaaccgcgattttcaggcgcttatggcaggcgaaaccagttttttggcaatgatctcaaataccagcgcgttactgtttgaacgtctggaagaggtcaactgggccggtttttatctcctggaaggcgatacgctggtgctggggccgttccagggtaagctggcctgtgtacgtattccggtcggccgcggcgtgtgcggttccgccgtggcgcagaaccgcgtccagcgcgtggaagatgtccatgcgtttgatggccatatcgcctgtgacgccgccagcaattcggaaatcgtctttccgttgcaggtgaataatcagattatcggcgtactggatatcgatagcacggcgtattcccgcttcaccgcagaagacgaacaggggcttgcagagctggtctcgcgcctcgaaacgctgattgcggcgaccgattatcaaaaaatctttgcccacgtcgcaggataa

SEQ ID NO: 63886 - DNA, 2337 bp, Glycine max
  Peptide Sequence Number=SeqID_180664
atggctctcattctagcgagctatctcgtcttgagtacactcttttctgcaaatgctgagtttgtcaagaagacttacatcattcaaatggataagtcagcaaagcctgacaccttcaccaatcaccttaattggtattcatcaaaagtgaaatcaattttgtcaaattcagtagaagctgagatggaccaggaagagagaatcatttatacttaccaaactgcttttcatggactggctgccatgttgagccaagaagaagctgagaagctagaggcagaagaaggtgttgtggccatattccctgatacaaagtaccaactacacaccacaagaagtccaactttccttggacttgaaccaacacaaagcaccaacaacatgtggtcattaaagctagccaaccatgatgtcatagtgggagtgctagacactggggtttggcctgagagtgagagcttcaatgacacaggcatgagaccagtaccttctcactggaaaggcgcctgtgagactggtagaggcttcagaaaacatcactgcaacaagaagattgtgggggcaagaatgttctaccatggatatgaagcagcaacgggtaaaattgatgagcaagcagaatacaaatcaccaagagaccaagatggtcatggcactcacactgcagctacagttgctggctctccagtgcatggtgctaattttctaggctatgcttatggcacagcaagaggaatggcaccaggagcaagaattgcagcatacaaagtatgttggactggtggatgcttcagctcagatattctgtcagctgttgatagagctgtggctgatggagttgatgttctatccatctctttgggtggtggagtctcctcttactaccgtgatagtttatctgtagctgcatttggagcaatggagaaaggtgtttttgtttcatgttctgctggaaatgcaggacctgaccctgtgagcctcacaaatgtgtcaccttggatcaccacagttggagccagcacaatggatagagattttcctgcagatgttaggcttggaaatggaagaaagataaccggaacctcactctacaaaggaagaagcatgctctcagttaagaaacaataccctttagtatacatgggaaatactaattcaagcatccctgatccaaaatctttgtgcttggaaggtactttggatcgtagaatggtttcaggcaagattgttatttgtgacagaggcattagtccaagagtgcagaagggtcaagtggtgaaaaatgcaggaggggcgggaatgattctcacaaacactgcagccaatggagaggagctggttgctgattgtcacctccttccagcagttgcaattggagaaaaggaaggaaaagagctcaaacgttatgtgttaacaagtaaaaaagccactgcaactctaggttttcaggctacaaggttgggggttagaccatctcctgtagtggcagcattttcatcaagagggccaaattttctcacccttgaaattctgaagcctgatgtggtggctcctggggtgaacattcttgctgcttggagtgaggccattggtccatcaagtttgccaacagatcacagaagggtgaagttcaacatactctcaggaacttcaatgtcatgccctcatgtgagtggcattgctgctttgctcaaggctaggcatccagattggagtcccgctgccataaaatctgctttgatgaccacagcttatgttcatgacaataccatcaagcctctcagagatgcctcaaatgctgaagcctcaactccttatgatcatggtgccggacacatcaaccctagaagagctcttgacccaggtttggtctatgatattcagccacaggactactttgaattcctgtgcacacagaagcttactacatctgagcttggagtttttgccaagtattcaaacagaacttgcaagcactctctttcaagtccaggggacttgaactatccagccatatctgtagtttttccactgaaaaattccacttcagttttgactgttcacagaactgccaccaatgttggtcttccagtttccaagtaccatgttgtggtttcaccttttaaaggtgcttctgttaaagttgagccagacaccttgagttttacaagaaaataccagaaactatcttacaaaattaccttaacaacacaatctcgccaaacagaacctgaatttggaggtctggtgtggaaggatggtgtgcacaagatcatagaacatgcatgtcttggacaccgtatgagttacggtttcatcagcacatacagtcattaa

SEQ ID NO: 63887 - DNA, 1004 bp, Glycine max
  Peptide Sequence Number=SeqID_180665
atgccatctcgacaactgcccacgtctgcaccacctcccaaccaccgcgtctcaacccctctcttcgctttcaccgcctccgtctgctctttattctttctactcctcctctgcctccggaagcgtaaacgaacaactccatcctccaacccccctcacccgttctcctaccccgtcctccgccgcgccacgaactcgttctcgacgcgcctcggccacggcggcttcggccccgtcttctccggcaccctcgccggcgaccccgtcgccgtcaagctcatggactccgcctccctccagggcgagcgcgagttccacaacgagctcttgttcgcgtccagactccgctcccctttagtggtccccgccatcggattctcctccgacccaaaacgacgccgtttcctcctcgtctatcacctcatgcacaacggcaacctccacgacgccctcttgcgccgcaaaaccccccacctcacgctctggaaaaaccgcttctccataatcctcgacgtcgcaaaaggaatccactacctccactccctcgaaccccccataatccacggcgacataaaacctagtaacattcttctcgacaattccttctcagcaaaactagcagactttggcctcgcgcgcttaaaatcggagatagaagaattcaaactaaaacgcgaggaaaagaaaaaggaagagtcggagagcgatgctggttccgaattagaaactcagagcgtcaacaccgaacagtcatttgatgatactggcagagagaacgctgcctcggattatgtgatggattggattgggaaggaggtgagaaaagaaaggccgaacgaggtgaagaagaatggttcttcttctgctgctgctactgcagcatcgagtagtggaacggtggagaagaaaagtaggaagaaattggaatggtgggaatccatggacgatagtggggttttgaagaaggagaagaggagaccagcaagggagtggtggaaggaaga

SEQ ID NO: 63888 - DNA, 204 bp, Glycine max
  Peptide Sequence Number=SeqID_180666
atgtcaaacaccacctactgtcgtccccctttccgtaatccgatgaggccgccgtcaccggactcatcgacgtcgagtcctgccatcgcgtggtgtgggaccatgaggagaaggccgagttctgcagggaacccgacgaggaagaagaggctgcgttcagaggaacacaccagcttcttcgtggggatgaggagatgcagatga

SEQ ID NO: 63889 - DNA, 207 bp, Glycine max
  Peptide Sequence Number=SeqID_180667
atggcaagttcaacatgctttcaacaaatctcttcacaaataactatcacaaagcataaaccaaagatacgcttcacgactccaaaaatgtctttctttcgcgatttggagcagaaatggctaccaaaggttggagctttgttggagcttcaatggtggaggaagaagagaatggcaacgctagacagagaggaaagagctttctga

SEQ ID NO: 63890 - DNA, 351 bp, Glycine max
  Peptide Sequence Number=SeqID_180668
atgagtgataaacgcgcagagacaaattatggtcattctgcgccctttgtcattcaggagcagcaagtcgataagtcgagtgataaatgcgcagagacaaattatggtcattctgcgccctgtcattcaggagcagtgagtcgagtggtgggcggagacaaattatggtcattccgcacaccttttcgccatccagaggcgattgtgtccgatggcacgcagagacaaattatggtcattttgcacctttccatcgaggcccgatcgtgtccgatggcgcacagagacaaattatggtcattctgcgccttgtgtcaaccaagaggaatgaattcggcagtatcaggatga

SEQ ID NO: 63891 - DNA, 258 bp, Glycine max
  Peptide Sequence Number=SeqID_180669
atgccaagttctacaaagaaaaagatgaagaagttccatgatagcatgatatttaagaaggacttcagggttgggaaaaaagtgttattgtataattctaagctcagactcatgagtgttgagataaaaaacgactccacaaacaagagctccaaggtcaatggacaccgacttaagccattcctcacaaacccttctttagtggacgtagtggtggaagggacttccttactccaccctactcttcctccaccatga

SEQ ID NO: 63892 - DNA, 273 bp, Glycine max
  Peptide Sequence Number=SeqID_180670
atggataaagttgatatctttgtccctcatcctctcacaaacgcatgtttgcttattcaactttcaccagaatgtgggtgtaagccattggtctgtttgctcaagcaacctgcgctcttgagtgttgacttccaagaccgttcaatcagagattactcatcttgcgcgttggtgggggaatcctctacaacaagagacccacggtctcttaatcccttttcagaaataagaagaagagaagaagaggtctctcgtaaaagaggtagattgtaa

SEQ ID NO: 63893 - DNA, 120 bp, Glycine max
  Peptide Sequence Number=SeqID_180671
atggatgatttgatggccaaaaaacatgcaatatgctcgtccaaaaagccaagtgagattgatggcatcaacacgctggagcttgcaaatgtaacatcagggatgtcagaagatgcatag

SEQ ID NO: 63894 - DNA, 1044 bp, Glycine max
  Peptide Sequence Number=SeqID_180672
atggaaagctacttgtatctgcatccgagtgagaatccagccattgctctcgtctctccggtcttggattcaaccaactaccattcatggagcaggtccatgatcactgcattgagcgccaagaacaaagtggaatttgtagatggaagcgcgcctgaaccattgaaaactgacagaacgtatggagcgtggcgccgatgtaacaacatggtagtctcctggatcgttcactcagtagaagaaatctggcgtgatttgaagtcgcgatactcgcagggagatcttttgcgaatttctgatctccaacaagaagcatcaacggtgaaacaaggcgcactctcagttattgagtatttcactagattacgtataatttgggatgaaatcgagaatttcaggcctgatccaatttgctcctgcaatattagatgttcttgttccgctctcgccattattgtgcaatgtaaacttaaagatcgagctatgcagttcttgcatggactgaacgagcaatatgccaatattcgatcacatgtgcttctcatggatccaatacccgcaatatcaaagatcttttcatatgtggcgcagcaagaacgtcaattgctaggtaatatttcttcgaatctcaatctcgaatccagagatatctccatcaatgctgtgaaggtcgtctgcgatttctgcggacgagttggccatatggaaaacgtctgttacaagaagcatgggatgcctcccaattacgatggaaagagtaaaagtaataacatgagatatggaaaaatgtgcactcattgcggtaagaatggacacaccattgacgtctgctacaggaagcatggcttcccaccgggatacaagacctacaatggaagaacaaccgcaaataacgtggtggcagtggatagtaaagccacagatgatcaaactcagcatcatgagtcccaagatatcgttcgtttctctcctgagcaatacaaagcactacttgtgacaccctctacccctcacatatatattaataaaggaataaaaatttaa

SEQ ID NO: 63895 - DNA, 342 bp, Glycine max
  Peptide Sequence Number=SeqID_180673
atgaatattgtgactaacgatgcttcaaaccaaatgataagtgtctcggagcttatgctgcaggaaacaagggttcaatatattattgctcagttgtcattaatactctacctaccatatgcaaactatttcacaaatgggcatttagactctgccatagactggattcctagcttgaagaacatcactctaagggaccttgctggaatctatcgtaccacagatccaaatgatatacttttggactttgtggtggaacaaattaaaggaacttcaaaagcttcggctattattatgcccactggagttgctccttgttcaaacttcaaagagtacatttga

SEQ ID NO: 63896 - DNA, 225 bp, Glycine max
  Peptide Sequence Number=SeqID_180674
atgactgtgaaaaagaggctaagtcatgaagtgctaaaagtgacaattgagcttagctcattaggtacacctggggtacagattttgcacagaattccaaagcacaccacagtgcctatttggggaaaagagctttggaggcagcaagaggagccagcttttgtagagatgcctaggttttgtaatctcattattgctagggggttttctgtaatggctggctaa

SEQ ID NO: 63897 - DNA, 804 bp, Glycine max
  Peptide Sequence Number=SeqID_180675
atgaacataatttttgagcttcaaggagggaggtcgttctccatggaagtaggttacttcgacacagtcttagaaatcaaagagaaagtacaaaagtatcaaaacattcctgtctccaagcaaatcctaattctcaatggccaagttctccatgacaatgacgatccttggaaggtcgaaatccttcacaacacacgcattcagctccaagtgacccccaaaaaggaggagaatagtaaggacttagttgtcaattccacgcacacgaaaattcagctcaacgtgaaaaccgcgtccaaaacgcacgtcatccctctcgaggtggacgtgaacaacgacaccgttttgaggctgaaggagaggattcatgagatggaaaccgtagcggttccggttaaccggttgcttttcttgcattcttcgaacggtgtagaaatgcttgatcaccaattgctgcgagactgttatgtttcggagaacgccgagatcgacgttggttttcggccgtcgccgcccgctgcggcgtcggcgtctccggggtcgaagaggctgaagcttatggttctgccaaagagcgggacgaagaaggttccggtggaagtgaatccgtcagataacgtgggagagctgaggaaggagttgcagaagctgcaccagagggttcagtttcatttgccgcaagacgggtatttcttcatctacaagcaaaatgttatggatgatgataggtctttccgttggcatcatgttgcacagggtgataccattgaaatcttcaatggaagtgttaccggtggatcatga

SEQ ID NO: 63898 - DNA, 357 bp, Glycine max
  Peptide Sequence Number=SeqID_180676
atggaggtcaatgatgttgacgaagccaacagattcggggtcggtgccggtggcttggtacattgtgatggtgagggtggtgccattggtgatctggtggagcttcttagcgccgaagtagttgaggaggacgtggagggagaggatgttcttgacaacgtagatggaggggtgtttcaagagaaggttcgacatggcggcattgtcgacggcgcagacaatgatggcagttttgccgttgatttcaagggcgaggtgggtgagggtgaggtagtggttgaaggtgaagaactcatggtgctttgcaaggatgctgctgatgttatgcgtgtcggagagggtggcgaggaggagtag

SEQ ID NO: 63899 - DNA, 911 bp, Glycine max
  Peptide Sequence Number=SeqID_180677
atggaagaacccgtcatggaacaacaaccctccgctgctgcctctgggaacactgccagacccaggcttcagaagtacgcactccgatctgccaataagttgaaggaagagaagtcagaaactcccaattgctccattcctacttctgaaaccatgagggggagaagtgtaggtgcttcaagtgtaagtaaaagtgtgagtgttcttgatttttctggcaaggacaagtctggtagtgccaagccacccagaaggctctcaattcctgccaaaacaccagccacttcaagacccaagctgggtggcaacagtaccccaatcactgagactagaactgggaggagtgcttttggtcaaggcagaagcaaaacaccaatttcagacatttccaagacatcttcacgaaccaagttaaatctcctaacttcggcttcgtattggttaaaccagatcaagctctctgaatccgcggccaagcactcaatttcacttggcttcttcaaactagctttggaggcaggatgtgagcctctcgggccaatgcaagaagggctaaaatcatatgtgggcagacatcagcttgatggtcttgaagaaactgtgaaagcattgtttgagagctataacatctcagaaacaatggagcagtggcaggtgtctgagactatttcacatgtgccagaagagggaactcggtcttccgatgatgatgtgcgtagctcttcttctaccatggggactagaaaactgaaaccaaagtgcttaaacactgattctactcaactcacaccttcgacagagtcagcaaagaaggagacaagtcaaaagagtaatcctggatccaggttgagagggaatctcagcacaaacaccacaactccaaggcctgctctagacaacaggaataatag

SEQ ID NO: 63900 - DNA, 688 bp, Glycine max
  Peptide Sequence Number=SeqID_180678
gcacaccgggtcaggatttcgcccggactgctgcagggaggcgggtgcggatcatgcgcaccagcatgacaacgttgacgcagatgtggatgacattgctgctcagcaatgtcttgcctagtgatcataactccgaccttcctctgctgaagtgtcagctggtgtatgccatcctgacacggatgaacgtccatgtggctcagttgattactgacgccatctatttatttggaggtatgccacccaccaagctccctctagacccgaataagtctaatagggccctggggtgtccggcattgatcacgggcctctgccagtcattcagggttcctgtcactcctagtaaggtgatcctaccgtcgatcacccgggccttcattgagaagtattgcacgcctaggcaggtgcagggtgatgcgcctcaggccgcagacgcaccgccactaccttatcaggctgatcctgctgggtcattaggcatggagcggtatctacaacacttgggtttcgctccttttgcgtgccctactccagatcagtttagggctgaggtcgcatggcccagagattggcccaaggcccaggcaggggaggcgcctgcaggagctcccgacgatgcagaggaggcccgcatggatgaggagatgacggacttgctcgatttcttgagagggagcagagccac

SEQ ID NO: 63901 - DNA, 603 bp, Glycine max
  Peptide Sequence Number=SeqID_180679
atggatggaagcaaacaagatttacccacaagaaaaagacttggcagtggatggcagatgatattcgttaccatcacagaatacaatatccaaaccaaggacaactcacagatgaagaggtgcaacatagatatttgtgttgaattgaggaccttttacaaggaaatggtcatgcaccagagcatgttggtaataagcttattcatgaagagttggactataataaagaaacactacaacacgatttcaattcttattattcttcactcacagcataatgtggtggagttttcttcctctatggatatggaggtactagaaagactttcatgtggaaaacattggcatcgacaatccaatcaaaagattcttccagttgtacctaagggaagtagattcgatatagtccatgcagccataaattcttcttatctttggaatcactgtcagaatatgacacaaaaagacgggttgtgcaatggtactaggcttatcatctcaagacttggtgctcatatcattgaagcaaaaatcatttttgagaagaacattggccataaaacatatattccaaggagagtgaataggcaatttagtccctga

SEQ ID NO: 63902 - DNA, 282 bp, Glycine max
  Peptide Sequence Number=SeqID_180680
atgtatccggaagaaattttaggcacagcaggaggaaggtccggaatgaccacttccggaagaccttcttccggaagtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggggtgaatgaaccacatgtcgattgttcaaatgcttttaatacatctcag

SEQ ID NO: 63903 - DNA, 870 bp, Glycine max
  Peptide Sequence Number=SeqID_180681
atggatttagctactcaagtaaggagaaaaaggaaattaatactgcaagaaaatagaaaaaacaagaaaagcattgaggatatgctgaaagatttttatgatcaaactacgaatttgtcccatgaagatgcagaatttcattttggtagtccattaatgacggacaaagaaagctgcaatgatgatgaaaccagacatattaatgcaggttaccatgacattggagaccctatttggacatgtcaagaatgtggagcacaaatgtggtatggtgaaaggataaacaaagataagaagagtctaaatcctaggtttagtctttgttgtgatgatggcaaaatacaattgccaattcttgaaaaacctcctgatattctgaaagaacttttgtttggaaattcaagacaaagcaaaaatttccaaacttatattcgatcatataacttgatgtttgcatttacatctcctggggcaaagattgacagaacattaaatacaggaaagggacctccatcatttcgaatacaaggtcaaaatcaccatttgattggaagcctcttaccaatgccacagaattcaccaaaatttgcacagctctacatttatgacacagagaatgaagtgcaaaatagacttgctcataattctaacaaagattcaatggaggaagagattgttgtgaagataaaacaaatgtttgaccatgaaaacatgtatgctcagacctttagaatgacaagggataaattttgtgactcctcagtttgtgatttaaaattgaaacttatatgtgacaaacagactgatggtagaatatacaacttgcctaaggttgctgaagtggctgctcttatagttggtaatcaataa

SEQ ID NO: 63904 - DNA, 270 bp, Glycine max
  Peptide Sequence Number=SeqID_180682
atgtacccaagcagaagagatgtgagtccaacagatgtgagagagactattgttttaattcgttgtttggagtggctgggcttggctctaacacaagtgatggacatggatggttctgggcagttcagaatgggggttggttggtcctactggtcatcttcgatggctctggtagaactagttttaggactgagcatggtgggtcttgattcacagaacagcgaccatgggcttgtgagttgtgagggatctgcagaggtggctggttga

SEQ ID NO: 63905 - DNA, 613 bp, Glycine max
  Peptide Sequence Number=SeqID_180683
atggcatttttaggagaaactagcagtcagatgattttcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagtcattcaccgatacaagtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacgggaaatggaacatgtcaccgcagaacaaatttgttggatgcgcgttcacaggaaaaaatcctaagaaatttcaaattccttcaacatgtaccatcgatgaactgaagaatttaatcaagcaagttgcacctaaagggattcccccctcttggaattcacgaatcacaaacg

SEQ ID NO: 63906 - DNA, 201 bp, Glycine max
  Peptide Sequence Number=SeqID_180684
atgaggagtggaggttgcatagcagctcgcccaggcgagttgcttgcttcctccagaagtaaccttgctcgcccaggtgagctcagctcgcccaggcgagctggttacttcagccttaagctttctagtggcccagattgtgcggcaattggtgttaagcaactcaattcggttggcaagaatccaaatgtttgcaaatga

SEQ ID NO: 63907 - DNA, 1221 bp, Glycine max
  Peptide Sequence Number=SeqID_180685
atggtactgctccgttgtcggcttcgcgtaatgtgggtgggttcggctggtttggttaatcgcttttacttttacgccttgccgctgccgctggccccttacacgttttacgttacaattattaccagcgctgttgacagttcgatggaaggtgagggaagcgatctattggaaaaggtaccgaaggaggccttaagtacaatggatcaaaatctagatggacctgcgattcctttgtcagatgttgaattgctaaggcgaagcttcaacgcagttgggcatgaagtggaactattcagatcattgatctccatgaaggcttcaatcgggaccgtggatgtttgtgaaccactacctcattattcaaagatggagatcattcttcccaatgcatgcagaagagacgaagaagatagcgttggacacaaaaaagagcaatgtagtgagatcatggtgaagaaggtcgtggctgctgagagtgagaccctagctaatgatataatggatacacaaaatgttaatgaagaggggcctaataataatgcagattttaatatagcctcgaataatcatggaggagtgagtgtagatcatgtgaaaaccaactacagagaaatgtctaaaagagagggaggaaaaaacccacaaggtggaaagggaggtgagctgaagataggaggaaagtctacattcaaaaagaatgttcatcctattgttaaacataaagtgcaagtgggaatgaaggtagcaatcagttgtacaataccgccaatgatggaagttcacatgactgagtatgccattgagctggtgaataggaggaaacaaaaagaccaaatggagattgagcaatctaaaaaggagaaacatggaattgtcgtggaacttgctctcgtggttttaggccccttatcaaagatatttgtaaggagtatgaaacatccttattgttattgttggagacttatgcttctagagagtctggacaacggattattccaaggttgggattggatagtcactttgtctaggaaggtagtggtcagtctggaggattttggtgcttgtggaattctgatatgtggaagatcgaagtccttcacaatgaccaccagtccttgggcagtcattggggactttaatacaatgctcatgatcgaagtggtggaagtgcaaacccttcttggaaggggcacaagatttacaggaaatgatacctga

SEQ ID NO: 63908 - DNA, 663 bp, Glycine max
  Peptide Sequence Number=SeqID_180686
atggctatggctttgagtctctcccaattccctgttcgtgggtctgtttctttgcccaaaagaagactacccagaagaagcttttgcattaggggcatgtcagaaacctcttccacttcttctgtgagcacccaacaagaacaaccaacttctgataatgcttcttcagtgacaattgctcctccccctaacttcaagccccctgagcctaaacgctttgcaattaggcctgataagaccagtgaagtgtttggagctttgcttcctttgatctttcgttttgccactggagttttcgtttctgggtattctttttcaattgtttctaaggatgaaattcctacagacgaatatgctttggaacttaatggtagcacctacattctcttctgtttagttgaataccagacttttggctttttacctgccacactacagaattcgctaattccaagtgctgttttgttctttgattatatgccgtcttggatcatatgcagctgtccattttgccgaaaggttagagaaattgttgccattttggatcttgatgttcttttctatccttgtccaagaaatggcccaaatttccgtcaaaaggttctagagatgggtggcaaactgcagttcccctacatgaaagatgggattaaagttgactaa

SEQ ID NO: 63909 - DNA, 330 bp, Glycine max
  Peptide Sequence Number=SeqID_180687
atgatttcctcatcgcacttgaggatacgtaggagcaagggcaacacccttgtcgaccccaaaaagctgccgtcccttgtgacgggcgcatggggtgctaataccttcccctatttcatgcaaactaactttgcaaatgcatccccacaggaaatggctctgaagaagcttccagctaaaaggtcaaggaaaaatgccgctggagagggttccaatgcggccccacaggtggacgtggagtttgatggacacaatttctggagtggggaacaccagtgccgatttgaggcaatcaagggctggtcgttcctcaaggagaggagggtctag

SEQ ID NO: 63910 - DNA, 1200 bp, Glycine max
  Peptide Sequence Number=SeqID_180688
atgcagggtgagttacaagctctccaattgaacaatacttggactctcactacccttcctcctcacaaaactgccattggttgtcgttggatatataaaatcaaacatcatgctgatgggtccatagaaaggtacaaagctcgcttggtagcaaagggttatacacaaatggaaggattggattatcttgataccttttctccgcttactaaagaagtttacatgcaagttcccccggggctttcagtcgaaaatcctaatcttgtttgtcatcttcaaccttccctatacgagctcaagcaagctagtaatagcatcgatgaaattcaaagtatcactacattacttgatcaaacattcaagataaaggacctcagcaacttaaagttttttcttggacttgaaattgctcgaacctctcaaggtattcacctatgtcaatgcaaatacactctggatattctctctgactcaggcatgcttggttctcgcccacattcaacacctatggattattccgcacggctggttggccggctcatctatctcactaatacacgtcccgacattgcctatgatgtgcaacaacttagtcaatgcatgtctaaccctaccaacactcaccatcaggttgcttttcgtgtgttacactaccttaagggcacaccaggttccagcctcttctttgctgctaccggaacccctcaacttcgagcttttagtgactcggattggacagggtgttgtgactccaggcgatcaatcactgggttctctgtttacttcggttcttccttaatatcttggcaatcgaagaagcaatccacagtatcccgtagctcttcagaagccgagtatcaggccttagcatctaccacttgcgagctacaatggctcacgtatgttcttcaagatttttgtgttcctttcattcaaccagctacactttattgtgataatcaaccagccatccaaatcgcaaccaatcttgtattccacgagcataccaaacatatcgaaattgattgccacatcgttcggcacaaggtcaattcaggtctcattaagctcctcctcgtttcttcttcaaagcaactcgttgacatcttcaccaaagctttatctccagctgtttttcacgacctttgtaacaagttgggaatgatgaacatccattcccagcttgcgggggactcttaa

SEQ ID NO: 63911 - DNA, 319 bp, Glycine max
  Peptide Sequence Number=SeqID_180689
atgccaaaggtctataggaatgacattacatctagggtgaatgatagtagaacatatggttttggggattatttggtctggtgtgagctggtaaaggccatgtctcacttcaattgtaccaatcttcacacgattgttcgtatcctgcaagctcctgaatctaatatccaggaggtggatgttcgagttataagagatggagatatacctgagtttggtgttgtatcagtggagcatgaggagatggaggcaacctgtttggtctgtgattggttagaagctgtgttcccggatgatggttgttggattaaggcgagta

SEQ ID NO: 63912 - DNA, 330 bp, Glycine max
  Peptide Sequence Number=SeqID_180690
atggatcacttcttgtgcaatgataatggtatcatcgctttgcctattagggataaagttacactgccaaggatcaataagctcctgcatgacctgtctaagtcttgttgttgcaacctatccttcgacgggagggcaacgcgagactcacgggaaatgaggggtggaggttgcacagtagctcacccaggcgagctgcttgcttcctccagaagtaaccttgctcgcccaagcgagctcagcttgcgcaggcaagctggttacttcagtcctaagctttttggtggcccaagcaagccaaaggctagcctaggcgagccaggggcctga

SEQ ID NO: 63913 - DNA, 2175 bp, Glycine max
  Peptide Sequence Number=SeqID_180691
ggatcagaatcagagccagggaacaccaattttctggaacctgctttcttttcggaccttcctatttattatctacagaatcagtgcacgcagaactctacattctccgtttctgttcagatgtcagggattagcaagcagcaagaggtaatatgtgctcagggtttacgtttatggcgtaatagttcttctgaggtgaacaatgagctatataaaggttattggagaagtaacatagagagacagatcaatgagatagctgcaggttatgattttttaaattcaaatgggagtatatttaacgtcagcatatggtacaactcaacctacaaaaaggacactggctttaatccaattgcattggcgcgtattcctcgttctgtaaatttggtatcaaatgcgtaccttcagtttctgttgggacctggtaccaaaatgttttttgagtttgtaaaggaaatgccaaaacctgagaccccaattaaattggatttggcttctcttttgggtggtgtcttctttacatgggtcatcttgcaacttttccctattcccttgacatcgctagtatatgagaagcaacaaaagttaagaatcatgatgaaaatgcatggtcttgatgacgggccatattggatgatttcgtatggttattttcttgccatatccattgtctacatgctgtgttttgtgatatttggctcagtcatagtacttgcatatataggtatgtttggaactgggctattagctgactttcctttccatttttttgttcaagacacatcatttccaagagggtggatcattgttatggagttgtatcctggttttgctttatatcgtgggctatatgagttttcgcaatatgcctttagtggggatgctttggggaccgatggtatgcgctggagtgatctgagtgatagcacaaatggcatgaaggaggtcttaattatcatgtttgtggagtggctattggtgcttttgtttgcttattatatcgatcaagttttgtcttcaggatgcaggaaaagtcctcttttcttgaaaagatttcagaaaaagccccattcatcttttcggaagcctagtatccaaaggcagaaatctaaggtttttgttcagatagagaaacctgatgtcactcaagagagggagaaggtggaggaactgctacttgaatcgactattaatcaagcaattgtatgcgacaacatgagaaaggtctatccggggagggatggcaacccggagaaacttgcagtgagagggttgtcccttgctttgcctcaaggggaatgctttggtatgcttggtcccaatggtgctgggaagacttcttttatcaatatgatgattggtctcaccaagccaacctctggtaccgcatatgttcaaggtcttgacttaagaactcatatggatggaatatatactagcatgggtgtatgcccacagcatgacttgctgtgggaatccctaaccggaagagagcacctactcttttatggcagacttaaaaatcttaaaggttcagccttaacccaagcagtggaagaatcgttgaaaagtgtaaacctttttcacggaggagttgctgataagcaagctggaaaatacagtggaggaatgaagaggaggcttagtgtggcaatttcgttgattggagatcctaaagtggtttatatggacgagccaagtactggacttgaccctgcatcaagaaaaaacttatggaatgttgttaagcgtgcaaaacaggatcgtgcaatcattcttaccacacattccatggaagaagcagaagtcctatgtgatcgattaggaatatttgtagacggtggcttgcagtgcataggaaatccgaaggagttgaaagccaggtatggaggaacatatgtcttcacaatgacaacatctattgatcatgaaaatgatgtagagaatttggtgcgacagctcttcccaaatgctaacaagatctaccatatctctggcacccaaaaattcgagctaccaaaggatgaggttaaaatagcaaatgtattccaagctgtagaaaccgcaaagagaagcttcaccgtttcagcgtggggtttagctgataccacattggaagatgtcttcattaaagttgcacgtggggctcaggcatttaacaccttgtcataa

SEQ ID NO: 63914 - DNA, 1095 bp, Glycine max
  Peptide Sequence Number=SeqID_180692
atgttcaaagtgtatctggtttcatcttttctgttggggcttctgctccttgctcaagcacatggaaatgataagaaaattgggttttatcaactcaagagaggagatttgcatctgaatttgacaaattatggtgcatcactcatatctgttattgtacctgataaacatggtgtgttttatattcttagttacgtatggaatttagatgacattacgcttggctacgatgacattgagcaatacaagaatgattcatggtacttcggagccactattggacgtgtggcaaatagaattggacacgctcagttcacattggatggccacacctataaattgcctgctaatgatcacgggaacaccctccacggtggtttcaaagggttcagtgatgttgtatggacagtaaaaagtcacaaggaagatgaccacataacatttacctatgacagtcatgacaatgaacaaggcttccctggaagacttgaagtaagtgtgacctacatgctcattggcacaaacaaatatagtctgaaaatgattgccaggccaatagataaagccacaccagtgaacctagcgcatcacacatactggaatctaaagggccagaatagtggtgacaatattctatcccacgaagttcaaatttttggctcaaagatcacaccagtggacaaggaactcatccccaccggaaaattcgaatccgtgaagggcactccatatgatttcctagaaccaagggaagtaggtagcagaatcaatgaccttcctggcctatatgacatgaactacgtgctagacgcaagtagcccttatcacttcagaaaagtgattatagtgagagaaaaagtatctgggaggaagctagagttgtggtcaaaccaacttggtcttcagttttacactggtggcatgttgaatgctacaaagggtaaggatggagccatttatcataagcatggtggcatggccttggagacacaaggattccctgatgctgtgaatcgtccaaatttcccatcccagatagtgcgtcctggggagacatataagcactacatggtctacagattcacggctagctga

SEQ ID NO: 63915 - DNA, 279 bp, Glycine max
  Peptide Sequence Number=SeqID_180693
atggaaaaatccgacaagaaaactttaaaatataagaaaggaaagaaagcatatattacttgggaagataatgatatggattcatcaagtgatttagaaaatgaaatcgtaaatctaagcctcatggccaaagactatgaaagtgaagaagatgactccttgaagaaaagttggtacattgatagtggttgctccaaacacatgacgagagatgcatcaaagtttactcatatttctctcaagaatagtggacatatgacctatgatgaaacaacaaag

SEQ ID NO: 63916 - DNA, 205 bp, Glycine max
  Peptide Sequence Number=SeqID_180694
atgtccccttcctatttccacttatacaacttcttcctgatgtttgttgcatcagcccgtcagttggcaaaagctttagaagttccattggtcaatgatttaggatatacaaagagatacgtgcggtgccttcagatatcagaagtggtaaatagtatgaaagacttgatagattatagcagagaaaccagaactggtcccatgg

SEQ ID NO: 63917 - DNA, 1218 bp, Glycine max
  Peptide Sequence Number=SeqID_180695
atggcactgcaactgcaatatgttaatggagatccaaattcagtcttaagttggttggagcgctggtcagcatcttacttttggaaaccagttccccaacccaagaaaattcgagactctaaatctcagagaaagcagggtaatgtttcaaatggggaagctcaaattaccaagtcaaaacgcactaccaggaagcttcctattgcaaattttgaaacagccctggagcaaacaaatcctgaattcgagaaaccaaaacgtaatttcaggaaaacaccataccaagtgtcagatccagagcaagaaaatccacaaagtgagcttgaaaaggttaaacgtagcttgagaaagattcataaccctgttgttgagaatgctggtcagccagaagttgaaagtgagacccccaagcagcatttggaaatgacgaaagttattccgggtcacgctgttttagaacaagcgaccattacttctgatgataagatcaagatggaagaaacttcaaccatctcgaatgtgcctgatgtcgaaatcactccaataccatcagtcaacaaggaagtgtctgagattctaaacaattatcaagtgtctgtagaatcaaagcccttgtcagagactccaactaaagataggaacacttctcatgacgaagttaaaaacaagctaggcaacctaccagagactattttcaaagatgaaaactccctattaacaaatggagatttgagtcatagtgatctgacaggtaatgaaaaccagaaacctacccgtaaaatctcaaatttgacaaagcaggagaatggagaagacggcataaagaacagtccaaaattaccaagttatatggcagcaactgaatctgccaaggcaaagttgagggcacaagggtccccaaggtttggacaagatgggactgagaaaaacaacactgctggtggttctgggaggcattctctgccatcttcaactaacaaccagattagttcgcattcacctaagccacagagatcagttccggcaggtggcaaagggggaaacaaaagtgacagaacagtaccatcttctaaagcagggaatgggaaggtaactcaagctgagtggaggagtaatacagagactgatatcagtgtagcagcagaagtaacaaagaatgaaggaaacctaaagggtgatattgcttattgtttgctgggtgggaggtttcttccataa

SEQ ID NO: 63918 - DNA, 291 bp, Glycine max
  Peptide Sequence Number=SeqID_180696
atggggttcttttggttttatttccggcatggggtagttttgtacgtgaacagtgcgccatgcaggacccaaaccgccattgccaatggcgagtttggtgtcactgagcaagctgcaaatggcactggcgagacgtgcctaaaccgccattacaggtggcgatttgtacaagcccggaaccgccagtcaaactggcgagttcctttgtcagctaggttgcagggttgcaggagctgtgtgttttctgaatgcataacgagtagcagaaatagcttagacgaaaggctttga

SEQ ID NO: 63919 - DNA, 2814 bp, Glycine max
  Peptide Sequence Number=SeqID_180697
atggcgaccactatcagcggcatcccgctggtggcgctgcaagtcaaggcgctcttgaagaagaacctcttgctgtcatggcggaacaagagggcgagtctgctacagttactctcccctttcatgttcattttcctcatcttcgcaatcgacaaagccatgaaggcaaagacctcgacctcttcctcctacaagagcgtcacagaacctcccatggagccttctctccccatcaccccctgcgaggacaagctcttcatcaatctcccctgctacgacttcgtctggagcggccaccagagccccaagtttcggatcatcgtgaaatcgtttaaggacaagagtgaagtggatgcatggcttttcagtaaccctatgcggtgtccagcggcgcttcattttatagagcgaaacgataccgttataggctacggtcttcagacgaattccaccagtcttcagcggcgagggaagttcgagaaccccacggcgtcgtttcagcttgccgcagaacgtgaaattgccagataccttattggagacgcggaattcagttggaatgtttttctgagggaattcgcgcacccttccacgactcctttctctgttgtggcttcaattggtccagcgtttttcctcgtgatcgccatatttaattttgttcttcagattaggtctttggtcacggagaaagagcttaaacttcgccaggcaatgactatgatggggctttacgactttgcttactggttttcctggctcatctgggaggcagttgtcgcaatcctatcgtccctcctcatagttctctttggaatgatgttccagtttcgctttttcttggataacagttttgtggtcctgttcttttttttcttcctatttgaacttagtatgactggcttggccttcatgatatctgctttcattcggaaatcatcttcggcaacaacagtggggttctatatatttattgtgggctttgtgactcagcttgtggcactagtaggatttccttacaaagatagcttctccaaaaccacacgaaatttgtggtcattattcccccccaatcttttttctcaaggtataaatgtgctttcagatgcagttgcaacttctgaagacaaaggtgttagctggagtaaacggggagaatgtgctcttaacaaaacagactgtgttataactattgatgacatttataaatggcttgcagctacattctttctctggtttgttctggccatttactttgacaatataatcccaaatgcatcgggtgtgaggaaatcaatatggtattttctaaatcccaattattggatgggcaaaggaggtcaaaaagtgaaaggttcagccctatgtcaagaacaaagtacaccagatgatgatgtccttgaagaagaaaacaaagtgaaacagcaactaacagaaggtcttgttgatgcaaatattgctgttcagatacgtggccttgcaaagacataccctggcacacgtagcattggttgctgctttaaatgtaaaagaacttcaccttacaatgctgttaagggtttgtgggtgaactttgcaaaggatcagttattttgtcttctaggacccaatggagctggaaaaactacagctattaattgtttggcagggataactccagtaactgatggagatgcattgatttatggacattcaatcagaagttctagtggcttgtcaaacattcaaaagcttataggagtatgtccacagtttgatatcctatgggatgcactgtctggtcaagaacacctccaactcttcgctactattaaaggcctgtccccatcttccataaaatcaattacccagacttcattagcagaggtgagactcacggatgcatccaaagtgagagctggaagttacagtggaggaatgaaacgccgtctcagttttgctattgcccttattggtgaccctaagttagtcattctggatgagccgactactggtatggatccaataataagaaggcatgtgtgggacataattgaaaatgcaaagagagggcgtgccattgttcttacaacacactctatggaagaagctgacattctaagtgaccgcataggtatcatggcaaaaggaagtcttcgctgcattggcacctcaatcagattgaagtcacgctttggtgctggttttattgctaatatcagcttcaatggaaacaatattgaatgtagtcctgccagtggagatgcaatatctacagaacatcatgaggcagtgaagaaattgtttaagaatcatttagatgtagtgccaaaagaggagaacaataacttcctaacttttgtgattcctcatgaccgagaggcgctcctgaaaaatttcttttcagagctccaagatcgagaaaaagaatttggcatatctgacatccagcttggtctaacaactctcgaagaagttttcttgaatattgcaagacaagcagagcttgaaagcgctgcagctgaagggagactagtgacactgaccttaacatctggggaatctgtgcagattcctataggagctaggtttgtgggaattccaggaacagagtctgctgaaaaccctacttggttcatggtagaagtatactgggaacaagatgatactggtgccttatgcattgccagccactcacagaaggttcctattcctcatggcgttcaactatcatcttctccttctagaagacaccgtagatatttaggccagtcaggaacagttcatggggttgtgattgatccaagtcaagttagttcagtggattttcaatga

SEQ ID NO: 63920 - DNA, 1242 bp, Glycine max
  Peptide Sequence Number=SeqID_180698
atggagttgaatatgcttactgcattaagcgcgaagaaaaaatctgagtttgttgatggttctattcaaagacctgcatcagatcatgcagcttggaagaggtgcaataatatggtgatttcgtggttggttcattcaatctctctttcaattacacaaagcatactatggatggatgatgcacaagatatttggaaagacttaaaatcacgatattcacaaggataccttttgagaatttcagaattgcagcaagacatgacatcaattaaacaagttgacaagtctataattgagtattttacaagattgcatgtgatttgggacgagttagagagttatagacctgatcctatatgtgtttgtaatccaaaatgttcatgtgatgcacttagtaatgttttagaaaggaagaaacaggatcatgtgatgcaatttcttagaggattgaatgatcaatttagtacggttagatctagtgtcttgatgatggatccactacctagcatagctaaggctttctcatatgcaatgcaacaagaaaggcaaattaatagcaatgatgcattaggaagcactggtttgattaatacagcaaacactagctcatcaaactcacccttttcacatgttacagaaaaaatgactttcctcataattcatcttctagaggaagaaaaagtggttcaattggttttggtcgaggaaattcaggtggaagagacagtaagatttgttctcactgattttactaaccacattgttgatgaatgttatagaaagcatggataccctcctgatcataaatatcataagccccaaggttcatcaatcaataatgtaaatgttgcaaaagaggaaaatgcaaattcagatgtagagcagaatcaagaggcacaaggttcagatgtcaaattgactgctcaacaatacaaaaccttaatgacactactacaaccacaaggatcttcaactcacaatagttcacatgtgaatcagattggcacaatgattggttctagtcatgcacttacaagtaatgtgtcatcaataagttgtagtatgagcaaggtaggtgagagtgaatggatattggattcaggtgccacagaccatgttacatccttttctcacttgtattcttcatgtagacaaataagtctcattattgctaaacttcccactggtcatacaactattgcaacatatgtaggcactgttagattttctcattcctcatag

SEQ ID NO: 63921 - DNA, 390 bp, Glycine max
  Peptide Sequence Number=SeqID_180699
atgtcttatcatagacaatctaagaactcgtggatttggagtattgacccatctggctcttatattgtaaagtcagcctattctgcacttcacaactggaagtttggcactaagatctgttactgcaacaaattcacttccacacatggtcatggccgtcaagtttaccaaaggactttagcttctcatttcaatagtggaacaccagtcctggccattgtatccattatgttgtataactggggctttggctcgtgtggtgcttttggtagattgggagtgagagggtttcaactaatgctttatttttgtgcgggggtatatcttgttggcttggattatgacacgaattgtatgttcaaatttgattgggggtgccaaccttggtag

SEQ ID NO: 63922 - DNA, 225 bp, Glycine max
  Peptide Sequence Number=SeqID_180700
atgacaaggatgatggaattggtgctggggatgctccggtggctccgggacatgatgttctatgtgccgcagtggaggtggatgaacccttgcgcttcttggatgatttttccatttggctttgtgggaggtgatttggttgagaaacgagtgagatatgagaattggaagttttgggagaaagggggcgccataactcgagaagttcatgactgcagcttctga

SEQ ID NO: 63923 - DNA, 243 bp, Glycine max
  Peptide Sequence Number=SeqID_180701
atgttagtggtgatgcggaagaagccccttagcgttgaaggccaacaacatctgcacgtagacaacgaacgtattgacttgaagttggcctctcatgggagaaagatagagaaattcagaaggcttgcacctaagattgaaggcataatgattgctactggattaagttctctgattacatgttcgttggacactggtgacaagggacttttatatgcttttgtggagaggtggcacaaatga

SEQ ID NO: 63924 - DNA, 756 bp, Glycine max
  Peptide Sequence Number=SeqID_180702
atgaacgtggctaaggtaggctccataatctcgcatgtcagactaagaatatcttttgttaagaggacaagaggggggacctgccaaacaaaggactctgatgctcaagtaattaattatctacaaagtcacacattatctataaggtacgattatcttctaatttttatctataagctacagtttatctttagcattatctacaagctcttggctattatctacaagtcgggaattatctacaaaggctataacagcccttaccaacaaggacccgcaattacactccactcctataaatatcaggtcccttctcctgtcctctcaacaagggctaccctcaaagttgacatgcgaagtcctagagcccactttggccatgtccaccctgacatgcccccaagctctaagccagcttgtgggcaaaagagattgtctgatgtcgagggtagaagccttgacaagtgggagggttgcaagttcattgtgcccccaagcatggacaagtgtcatccggtgtctagagtggtaacttccacaaatgcaacagttgcaggtctgtcaagcttgtcaagccccccagcctggacaggtgttgtttgggttgctgctgtaaagttgtccaaggaggacattgatgcaatcctacccccaagggcattggatagaagactccaaaaagattgggccagagatgcaagagaagaccctagggttctcatgagccttagggtagatttcggacccatgggctaa

SEQ ID NO: 63925 - DNA, 318 bp, Glycine max
  Peptide Sequence Number=SeqID_180703
atgcctttggtgtttgaaaacattgggcatatttataaagtaaattatgtttttggtcccgccaacctatttagcttttatggtttggatcccttaacttttcaaagggtgtttgggttgggtcgctccttgacggtgatgggtgctgatcacaatggttgggtttggtggctatggcggcatgacggtggtggtggcttgggtggcggcggcatgctgaagagatggtgcaagtgctattgtttggttatgtttgggtatggtttcagatctagatccttctttgagcagttgcttcttcagttctcacaaatttag

SEQ ID NO: 63926 - DNA, 792 bp, Glycine max
  Peptide Sequence Number=SeqID_180704
atgcatctaggaaacacaacaactgacagggttgagtttgcacattggtccttaaagagactactacagaataacattggagacctatgtagtatttgggaagccatgaacaacatgatcactctgcaacacactgaaattaagcatcttttgagacaagttttatttgagtatgaagtcaacataaccgaagagatggaagccatatccaagcggtttgaagagcttgatgtatgtggcaaagtgactatagagagtaaactttgggaaattgcctaccctgatctaaattctatgtgtgctcctcctaaaatggtgaaaacaaaaggtgctcaaaagaaacaaatgaccaaacatccaagatcaacaaagtgtgactatcttactagaaaacttgcaaaatggtctgatgagtatatgcacatgcttggtggcatagacaaatatgaggagttaaaacggtcgctacttgctgatggattatccatggtttctagggataagtggaataatgtaaccgacatgggttatgtgattccatcaaggcataatgtcatccttgtttctctttctctccaacaaagcatggtgttttttcctcttagaagtcaactaccgagagatagttatgtacatcgcgttatatgtattggttatgtgtatagcaatcattttgttcaagtatttctaagagatgtttgtccattgtcgctaacaactatgttatggtcaacacattgtcattatcatgcaaaacagtggcctactccttatattagtagaatgcattag

SEQ ID NO: 63927 - DNA, 147 bp, Glycine max
  Peptide Sequence Number=SeqID_180705
atggtgtgcttcactacattaatagaggaagagaaagctaaagccacaacaattggaattaagccatattcgtggcatgaattcttgcacttgtttgaacacccatttgcaacctacgcagtgcttgccatcaggcaaaggaactaa

SEQ ID NO: 63928 - DNA, 633 bp, Glycine max
  Peptide Sequence Number=SeqID_180706
atgttcattctaaccccaattgtgatagaatcatcccttacctctaaacgggctcacggtttccaagcgttagagagaaggggaagagattatagcctccattttactatcaaggtttcaaaggtggtgtccaaatttcactatgatccaacggttaacgattccgggatcatagttttactaggacaggtttgggtgtatgtgggaaacgagaaaggtcagtgcgaggaacatttcttccaccatagaaattgtcccaaatatcccaacggtaggccctacagtgtgtctcagaggaattcctatgtccctcaagcaaatgttcgagcaaacaagtggtttcaacaagggaacgaaggatctagttcacattttaagaagtttgaagtgagtagtttgacacttcgaaggggaggaacgactgaaggtttgaggaagggatattatggctatcaaaatcctccttgggtgaatcgaaatatgtcaaaaacccaatggaaaaggcatcagaggatgaagagagatgaaatattagcaatgcatcataaaaatgttgtaagaccgttagtctttagcaaaatcaatgaaggtccacctcctaggtttgaaaagaaaatctcgatcaaggattag

SEQ ID NO: 63929 - DNA, 312 bp, Glycine max
  Peptide Sequence Number=SeqID_180707
atgaagcaagcaccaagaatatttgctcctaatgtcttagaggctatcaaagcagaaatcgaaagtctactgaaggccaagtttattcaaactacaagattaaagaatgaagttgaatttcaatgggaaaaggaacacaaagaagattttgatgacactaagagatatcttgcaaacacactagttctagtgccttatgcaaaaggaaatgacttgacattgtacattgtagcatcatattcaactattgcaagcatgctggtgcaagaggatgataatggcatagagcatgttgtttattatctaagttga

SEQ ID NO: 63930 - DNA, 369 bp, Glycine max
  Peptide Sequence Number=SeqID_180708
atggcacttcctaggctgtctgttgctgaagtgttgtctgattctggtgctgatgtcttgtcaacccagaagtcatttgcaattgtctccccaaatgagcaacagaagctgcggaagacattttctgcagaagatgatgtgggagtatcctcttcgcctgaagctggggctgtagaatctatatcatcagaaggctttattagaggaaggtcttacaatatccgacttgatgatcaagttttgcttaaattttcccctaaaaattccgactcaacttattacttcagtgatatgataggtggcactctcactttctttcatgaaggagctaggagatgccttgaggtgactgcccttgtcatctgttga

SEQ ID NO: 63931 - DNA, 324 bp, Glycine max
  Peptide Sequence Number=SeqID_180709
atgtctatatattatgatgcatatgcttgcagacatatcacgtgcaacttgtctgacttggctcctgagtgtccaaaccctcatgatagccgatattaccctgaaagaattctaatatatgatcaacatcatggagggtgtggaatttcagtacaggttcaaccctatttcacgaagttcctggcagctgcactagagcttctcaaatgttgctgctgctcagcggaagtaggttgccctaattgcgttcagagctttgcttgccatgagtataacgaggttttacacaaggatgcagccatcatgatcatcaaggtgacttga

SEQ ID NO: 63932 - DNA, 3042 bp, Glycine max
  Peptide Sequence Number=SeqID_180710
atgacagagaacaacgagaatgctgaaatccaaatccgtgccctaaccggcgaatccatcattcttcccatcactcccaccacaaccggagacaaattgcgattgcagactcaaatcggctctttccccatccaacacggcgagtttcttgtcctcgttccctttgccaagaaggaaaaggaaccttctcgaacccacgaatcggacacggtttcgaatgttccaacctctactactctcgcggactccacgtggtccaccataaaggaggatttgtcacttttacacgacgacgacaccactgagaactgcgacaatgcctctaattccgagtcaaaaaaagaggaaatgttgcagacacaatccatagcgggtttgggttctgagaagcagatagagcttccatatcatctcatattagacacattgcaagatagtagtgagggagttcttggagagcataattgcgaggtcttcgtgaaggttttggagtctgtgaattgcttatcggacctgcctctcggacactgcaagttgttgaaacaagcttgtgaaaaaagaggtggtggtggtggcttgagaaaacgtcgtagggaattgaccttagttctgctggaagaggcgcttagcgagcttgcgaagtttggggttaaacttggccttgatgacataaagcttctttcgctactttgtcctcatctggtatgttttggagatgaagtagaaaagacaaactttggtgatgtcattgttgttaacaatgcaactggcaatgatgatcaagttgaagacaatcctaaaagagtgcgcaagtggttgtatgtttcaaagattgtcagtacattgaagagaagggatagctctttcagaaaaagtttaggatgggcttttgagcagcttccgtttgaatttggagatgagatgactgtgggaatttccttggaagagctgcttgcagctgtcaaggaccgtgattttgtaggaaaagaagacaaattaaaacgtgtaaagagaagcaaaactacctcaaaacctggcttaaacaatattgggtgtcatgatacaaagacattactggctgtggacatggttgatcatcttaagaaaggaattggatctgaaggacagattgtgcatattgaagacatatgtgccagaaaagcaatttacagtgagatcccaattgaactatcagagaaaatgagatctgtgctgaagtgtattggagtttccaaattttacagtcaccaggcagagtctatacaagcttcccttcatggcaaaaatgttgctgtggctacaatgacatctagtggcaaatccctttgctataacctaccagttctagaagtgttgtccaataattcttcttcatctgctctgtacatatttcccacaaaggcattggctcaagatcaactaagagctttgttacacatgacaaaaggattagatattgacttaaatattggaatatatgatggggacacttctcacaatgagaggatgtggctacgtgataattctagattgttgatcacaaatccagatatgttacacatatcaatcttgccccaccatcaacaattttgtcggattttatcaaacctaaggtttgtggtaattgatgaaactcatacttacaagggagcatttggatgtcacactgcacttatattgaggaggctaaaacgactctgttcacatgtatatggatctgttccttcttttgttttttctactgcaacttctgcaaatcctcggcagcattctatgatcattaaaaagactcagttttctaagagtactgatgagctggcagatgaaagtgcaaattttgttcgctcaagcccgattgtggatgtttcacgcctttttgcagaaatggttcagcatggtcttcgctgtattgcattttgtaaatcacggaaactttgtgagcttgttttatcctatgcacgcgagattcttcatgagacagccccgcatctggtggattccatatgtgcatatcgtggtggctacattgcagaggaaagaagaaaaatagagagttcattttttggtggtaaaatatgtggtgttgctgcaactaatgctcttgagttgggcattgatgttggagaaattgatgccactctgcatctaggatttcctggtaatattgcaagcttgtggcaacaagctggtagaggtgggaggagagatagaccatctcttgctgtctatgttgcatttggtgggcctcttgatcaatacttcatgaaaaatcccaagaaactctttgaaagaccaattgaatgttgccatgttgattcccaaaacaagcaggttcttaactttgacctattcttgttcaagattatctattttgagtttgaacaaatggaaggggttatgctaattatgacagattttgttcaggttcttgaacaacatttggtctgcgcagctcatgaacaccctttgagtgtgaactatgatgagcaatattttggtccttgcttggagagtgtcataatttctctaaaagctagaggatacttgagttctgttctatcatctgattcttctagaatatggaactacattggtccagaggtatatgaaggtgctgtgtatatgtaccaggggaaaacctatttggttgaaaaattagatctatctaacaaaactgctttctgcaaagaggctgatctaaagtattatacaaagactcgagattacactgatattcatgtcattgggggtaatattgcttatccagtcaaggtagaaaccaacatgtttccaaaaacaaatgcccgggttgatgtatgcaaagtaacaactacttggtttggcttttatcgtatttggagaggaagcaatcaaatctttgatgccgttgatctcgcacttcctcaatactcatatgagtcacaggcagtttgggttcctgtgccacagtcaataaaagaagcagtaagcaagcaaaattatgatttccgtggaggtctgcatgctgcttcacatgcaattttacatgtagtgcctttgtaa

SEQ ID NO: 63933 - DNA, 246 bp, Glycine max
  Peptide Sequence Number=SeqID_180711
atggagaatgatggtgcttgtagcatagttgctgaaggtacaatgcaaattaagagattgatggtactagtaaaatttagcactggggttcaaagaacacgagggactcttgattatatccattcagacatgtgggcttgcccaagtagtattgggacagaggcagttaatactagttatttggtgaatagatctccttctacaggtattaattgcagcactcctgaaaaaatatggtcaacctaa

SEQ ID NO: 63934 - DNA, 2118 bp, Glycine max
  Peptide Sequence Number=SeqID_180712
atgaagaaattcttgaagaaatactttctagaatcaaagacagcacaaggaaaggcagagatctcttcaattcatcagtttccagacgaatcactcagcgaagctctagatcacttccgcaggttactccgttggactccaatgcatggattcaataagccaatacaactgaatatctttattgatggcttacgtcctcactcgaagcaatttctagacgcttccgctagaggtaagataaagttaaaaacacttgatgaaactatggagcttattgaaaacatggtagctaatgataatgcaattcttctggatagaacttacactcctacaaagaaaaatctacttgagctcacttcccaagacacattgttggctctgaataagcttctagcaaagcaactagagaccttgactaacacccttagcaaacttccccaacaactacattcagctcatgtgttaggcacttgcacgactcaagaggaagcctcaaaagaggcaattcaggttatcatcaacaaggaggaaatttctctcagaaccaaggttagccttggaggttccacccagggtctaaatctgtatgaaagaaccaccaagccggaggacactctggctcagtttatgcaagcttttatttcaaataacaagagtattgagtccgctataaagaatttggaggttcaagagccagtaagaaatggtttggataagaatgaaagtgtaggagaagtaggagaggaagagaaaaaggatgaggaggaggaagagagaaaagatggtggtgaggtcttgaattcgaagaccaagaaccaactagctagagaaggcaagaaggaagcaccagttgtagttgcaaaggatattccttatcctttgataccttcaaggaaagacaaagacaagtattttgcttgctttcttgatatttttaggaaattggaaattaccatccccttcgaagaagctttacacgctataatccagcgcatcctaccgcaaaaatttaaagatcttgagagtgtgactatcccatgctacataggaacgattgtagtagggaaaactctcatcaacttacgggatgtccttgtgaaagtcaaacaattaacttccttggtgaactttgttatcatggacatcgaggaggatgtcaatattcccataattctaggtcgacccttcatgctcactgcaaactgtgtagtggaatggggaacgacaacttggagacgagaacaattgattaagacccgtgagggtcccttgcgtcaagctggtgacgttaaagaagagctcgagcgaaggcattgggacaggaagctcactaggcttctagagaagaagatagatgtggccttggtgaaggagttttactccaacatttatgatcctgaggacgactcacctaaacagtgcaaggccattgaggtcaagctctgcctacctggaggtcatttcattctgaacattgagggaactccttggaagattctgaggaaagatatgaccaccctggctcagatgtggagtgttttctcctactctaaccttgcccttaccttccacacctttgaactcaacatggaccaagcccacttcatttatggtattattacgaagatggacatggacttaggcagcatgctctcctctcagatcacccaaatagcccagtccaactcttccaggcttgacttcccagctctcattgcgtctctctatgatgccaagggggtccattctgatatcttgaccttcaaaactagtgttggtccctcctgcaccacaactagctcctatttttgcatccactcctcctccactgttgccaccatctcaggagctttcacagcccatgttgcagagcattcatcacggctagttcctaatcatgcagacattgtagtagattgggataacactccacctgcccatcatgatgctagaggaattcctctagcgcctactaccgcaattgttgttcctaatgagcctattcctgctaaggaccctgctgctgatgttgtggatctaggacataatgaggactacattgttgatatctcgatggctcagactccagcctgggatccatcatctacacatgattag

SEQ ID NO: 63935 - DNA, 168 bp, Glycine max
  Peptide Sequence Number=SeqID_180713
atggattcttcaagtggacagggaatgaagaatgctctcctagaacctaaatgttcgagttatgagaaaaaccatgattccttgttagtccagccaagttacaagcctgataaagtccgtagtgatccatattttcaatgtagcagagacataaaagaggatgaatga

SEQ ID NO: 63936 - DNA, 249 bp, Glycine max
  Peptide Sequence Number=SeqID_180714
atgggttgggctatagatttacatggcggtgccggagagatccccctttcactgccggcggagtgccatcgtggactagtgaacaaaatggttggtcatactgaactgtcgtgctcaacgcaacctcctcactcagcgagtcaaaaccgctctgtccaagctagccgcttagcgcaaggagtcacattggaagacaattgtcacgagcaaaagcgcatcctgcgcttatcgcatgaccacttgctctag

SEQ ID NO: 63937 - DNA, 510 bp, Glycine max
  Peptide Sequence Number=SeqID_180715
atgacatgcggagacaaattatggtcattccgcacaccttttcgccattcggagacaatcgtgtccgatggcacgcagagacaaattatggtcattctacgtccttttgtcatcaagagacgagacaaatcatggtcagtctgcgcccttttgtcatccagaggcggcgagcccgatgacatgcggagacaaattatggtcattctgcataccttttcgtcattcggagacaatcgtgttcgatggcacgtggagacaaattatggtcattctgcacccttttttcatccagaggcggtgagcccgatgacatgcgaagacaaattatggtcattctgcactatttgccatccagatacgatcgtgtctgatggcacgcagagacaaattatggccattctgcacctttcgtcatccaggggcggcgagcccgatgacgtgcggagataccttatggtcatccgcgcctttcgtcaatcgaaaggaacaaattcggcagtatcaggatga

SEQ ID NO: 63938 - DNA, 369 bp, Glycine max
  Peptide Sequence Number=SeqID_180716
atggacatgaacataggagcactcatttctggccagatgacttctatagcccagtctaactcttctagacttgggtttcctgctctgatcaccgtcctatgtcgagccagtggggttgtctctgatagcctcacctttgagcgcctgagcctggtcattaatttgtcctacatcaggaagaactgttggaatcctgatgatctgatagtttctatccgagggaataggagggcaagggcaaggccaactgatcttccttccacatctgcagctcctactccatcatctacttcagcagctccttcagtcccagctcagattgattctcagcgctttgaagccatgcttcagggcattcatcagggatag

SEQ ID NO: 63939 - DNA, 864 bp, Glycine max
  Peptide Sequence Number=SeqID_180717
atgaagctggacgcccgccagtacggcgagctcaacgcacgcgaaaagaacgcctacgactcgatcatcggcctgctggccacgctcgactcaccgcagacccgtttcatctacaacgtggccgagtacatcaccgacccggccgcgcatgccaatgcggcgattatcggccagcaggaagtgatccataacgagagctacagctacgtactggcctcgatcaccgacctgccgaaccagaaccgcatcttcgagatcgcccgcacccacccgaccatcatcaagcgcaatgccccgatcatgggcgcgtatgacgacttcatgcgcgagaagaccgccgagaccctgctcaagtcgctgatccagtcctcgatcctggaaggcatcaacttctattccggtttcgcctacttctacaacatggtgcggcagaaccgcatgaacggcaccggcaagatcatcagcttcatcaatcgcgacgagctggcccataccaagttcatcagcgagctgatccgcgccatcatcggtgaaaaccccgagctgcagaccaatgagttgaccgcctacgtgcaccagtcattcgaacatgccatcgagcttgagacgcagtggtcgtcggaggtgctggatggcatcgatggcatcgacgtggacgagatggtgcgttacgtgaagtaccgcgccaacaagatggccggcatgctcggcatcgagcgcctgtacagcgacaccaccgacaacgtgatgccgtggatcaaggcctacgccgacaacttcaccgagaccaagaccgacttcttcgagatgcgcaatgcaagttacaagaagaccaacgtcgacaacggcttcgacgatctctga

SEQ ID NO: 63940 - DNA, 633 bp, Glycine max
  Peptide Sequence Number=SeqID_180718
atgaacgagaaaatcgactatcacatcgagaaataccatttcgcgccgctggatgaggccccgcggcttgcgcgccagtggagcgaggtgttgaacgagtgccgcgagacgcaagcgggcgcggaagagcgcctgcgcattgcgttgctcaacgtggactatgtgaccagtttcgaattgccgtttcgcttattgctggtgcgggcgccgcagttgatcgccggcctgcgcgatgagctgtcgatcagtcaaaaaaatgtggtgttcaacggcaagcgtttcggctgtgtctacagcctgaaaagcgatttgagcggcgtgccggaggcttttcagtacagcctgtcgacccgtattcatcgaacctcggcgtcgggcgtggacgcgctgccttaccgggaaatcgccaaggcgctcaaagcgccgcgtgagcggctcaagctggcgctggagcaggggctgccggtaacggcgctggatggattgttctggttcggcatccagcgcattgccgccgaggtgcgcaggctaagaaaaaccggcatggcgatcgtgacggcggagaccgagatcttcgacaccctgaccggcacgacgcgcaaggtcccggtgtaccgccaggccgagagttaa

SEQ ID NO: 63941 - DNA, 807 bp, Glycine max
  Peptide Sequence Number=SeqID_180719
atggaaaaaggacaggaaattacgcgcagcagcaccgatccctggaagggggatcccgactttatggcctctttggcgcgaggattggaagtcctgcaggcttttacgccgcagcggcggctgatgtcggtatcgcagattagccagcgtaccggcattccgcgcgcggcggtgcgccgctgcctttataccctgagtaagctgggctttgtgtacgcggaagacggcaagaattatgagctgcgcccgcgcgtcttgtcgctgggccataactggctggcggcttcgtcgttggccaacgccgcgcaaccggtgttgaggcaactcagccagacgctcaatgagtcctgttccatggccatattggacggtgatgacattctttatatcgcccgcgcatcgacttcgcggatcatgaccatcgatttgcacgtcggcagtcgcttacctgccagcacgacgtcgatggggcgggttctgctgagcgggctcgccaatgagccgttgaatgactatttggcgcggctgacgcaactgcgttacaccagccataccctggtgagcgttagcgcattgcgggaagagctggcgcgcgtgcgtcagcagggatatgccatcaacgatcaggaactggagattggcctgcgttcactggcggtgccgctcaccacgccggacggccgtatcgccgcggcgttgaacgtcggtgtgcatgccagccaggtttccgcagagcgtttgtatcagcaccacttgcctttattgcgctcggccgccgaagagatatcgctgctgttgcacgattaa

SEQ ID NO: 63942 - DNA, 486 bp, Glycine max
  Peptide Sequence Number=SeqID_180720
atggagctcgcccctgagggcaggaccctgaagtattgcagggtgcgaggacaggtcattcgatttgatgttgagaccattaacgacttcctcgacaccccagtgatcctggttgatagagagggctatccggcatactcccagtacctgagcatttatccagaccatcaggccatcgcagccaccctgtgcacaactgggggcaagtttgttctgaatgtcgatggcgctcaggaggttgtctctaacactctgatttttgagtcactaagccatgtgatcaacttggcttatattaagaagaactgttggaaccccaccaacccatccatcacattccatgggacccgacgcacccgcactagagtcgtcgcaccagatgctcctcctccttcaaagcctccttctcatgtcgttcctcgtttgcaggcgtccacttcagcactactagacgcgcacaacctgatgctccagtccttatactag

SEQ ID NO: 63943 - DNA, 219 bp, Glycine max
  Peptide Sequence Number=SeqID_180721
atggtgttggtactacgtgggatgcatccagattttgatcatattcgtgaccaagtcttaactggccaagaaggggatgaggtggtcgtgaaaaccaaggaggacaagctggaagaggaggtcgccctcaatgttcttactgaacgtggtacgggtcggacgattggcgtaggacatgaatctcatggtctttactacctcaagcctaatctttgttag

SEQ ID NO: 63944 - DNA, 165 bp, Glycine max
  Peptide Sequence Number=SeqID_180722
atgattgacaatgcatcatctaatgatgttgctgtgacattttttaagaagaaattgaagattatgggtgggttagttatggatgagtgtcaagcatgctcaataggaggacatgaagaagttggatatgcttttacatttagtctaacactcgatcacaattaa

SEQ ID NO: 63945 - DNA, 213 bp, Glycine max
  Peptide Sequence Number=SeqID_180723
atgttgcttaatcttcacaagaagaaatggactaatgttatcaaatataacaagtttgatcaagaggaggatgagctgtctccgaaaaagcctgcaatagcaaatgtgggaagacaagatgcaaagaagcaccttgaagaacatgtctcaaatttgatgtcttccaacattgttcaaactcttggaatgatgcttgccactattgtcttctaa

SEQ ID NO: 63946 - DNA, 243 bp, Glycine max
  Peptide Sequence Number=SeqID_180724
gaagtcttcgtaagtttgagctttgaattgaacatcgttgtccgtgacaatggtatatgggaggtcatacctgcaaatgatatgtttccagggccaaggggagctcaagctataaagattatcgggaggagtgcgtgggatgtctgcaaactcttggcattgtttgcacctcatggtaaagttgaggatgtctgtcctgagtgttggctagtagtagctggctcacaccactttggtggctag

SEQ ID NO: 63947 - DNA, 480 bp, Glycine max
  Peptide Sequence Number=SeqID_180725
atggtctggttttcactgcagcatatcaccgaaatccttccgggagtggggcttgatatgatcatttgtattggggagaccagaagtcagcccaggtctacaagatctatgtctttgggaggcatggattatgtggatccaaaaaggaagggcaattttgttggaaaagtttttcttgctgcagcattaacggcattatgcattatcatgatcaagagatctccatctttgaatcccccaagtccgttttccatccgtgaaccaggtgtcactcatgttttagtgacaggaggtgcaggctatattggttcacatgctaccctacgacttctgagggaaaattatcgtgtcaccatagtggataacctgtcacgaggaaatttgggtgctgttagggttcttcaagagttatttccagaacctggaaggcttcaatttatatatgctgacttgggagataaagaatctgtatccttataa

SEQ ID NO: 63948 - DNA, 726 bp, Glycine max
  Peptide Sequence Number=SeqID_180726
atggaggagaagagcaagcgtggacataaggaacattcgtgtactgaaagcccaacgctcaacatcgacccaccatccccagttgcaagacacttgaagtggaagatcgcccgcactaagcggcatggccaaatgacgtctaaagtggcacaagaaattgcagacaaaattgattcattacaggaacaagcaacacaggggagttttgttccgcatgggcgacaagacatactcaacacggcccttggccgacctgagcatccaggccgtgttcgcgtcgcagggacaggtgtcacaataagccaatactttggccaagcctcacgtgcttctagcacatcgtcaccatcgatcaaccaacaacaattggctgatatcatcggtgtaattaaggatgacataagaaagcagctacaagatgagataagaaaggagtcagcccctattaaggcgccagaaatacaagctctacttgggcgtgttagcacaaagggtagctgcgctggacctgaaggaagcggattacttaaagagcttttgagtggtggtgacgatctgatgggcttgttcgtagttgttggggaaaatactgtgtttgcgggcttgggaaaagtgtttgagaattcatccaccatacataatgttcattatgaaaatgatgttgttaaggttcaggttgtcagaacatacatgcctcatgctgaggtccctattcctacatcagag

SEQ ID NO: 63949 - DNA, 390 bp, Glycine max
  Peptide Sequence Number=SeqID_180727
atgacgacaatacgcaagaaatgggcagcctattttctagaagttggaaaatggatgtcagcgtttgacatgttcctgcttgggtcgttcagtccgccgcaaccttctcatacattggtccaagaaatcatcggaaaagctcctcaggatgcattgggtaaccaagcagagcatgcattagcctctctggcatcgatgatgttggaatctccttccttcatagtccaatttacacatggtttgaatttgagtctaagctctaaggaatatactcatggagttgtgattcgatttcgatccgttgaggcatttgagatatttataaacagcaaagagtacaaaaatatttctgcacttgggctgttatatgccatccagatattggtctaa

SEQ ID NO: 63950 - DNA, 252 bp, Glycine max
  Peptide Sequence Number=SeqID_180728
atgaaagaaagggttagaggggctcaaagagtgtttgagggctatgatgcgatcaaggaacaagccagagtgagtttgctatgtgcccctaattcaggaaccaaattgaaaggactatcaacgacaatgcatcaccaaaagaggaaaactctagatgaggattcactgttatcaagcgagtcagagacccagcatgaccatagatcaacctctactccctatggctcacatagacccaggtatagggcctaa

SEQ ID NO: 63951 - DNA, 337 bp, Glycine max
  Peptide Sequence Number=SeqID_180729
cttcacgagttaggattatcagaaatcgtttgtgtggataaccacttgggtatctctgcatgtcacctgacttcacaggatgacaaaggtgcagaagacgatgtaagtctccgcgtgtcaacagaaatcgtttgtgcggataaccacttgggtatctctgcatgtcatcggacttcacgggtcacgatagcaaaaggtggggcggtcgacaaaagcgaggctctttctcccacgtatcctcaatttgtgatgaggaactcagacctacgcagttcttgcaaaaatggtgcggataaccgtaaggtgtctccgcatgccaccggactcttgggtcacg

SEQ ID NO: 63952 - DNA, 924 bp, Glycine max
  Peptide Sequence Number=SeqID_180730
atggaaatgatgtgggacattcccttatcccggaaccactggccaaaccaatgccctgacttacatcatgttcagcctttctacaagcctttcgagccaaaatctcaaacccttcaaccagccttgacccaggatgggaaattttgcccaggcccccggaagaaggaacagaaggatctctccgagaaagaagatccattcactgttaagctacaaatagacacctcatggttatccgcacctttcattaaccagaggcaagcaagcccattgactcgcagagaccaatgtggtcatctgcacccttccaagagatgtcagcatcttccgatcgagactactttagtctcaccttggtcatccagagacaatcaaggaccaatcatggtcatccgtgccttcgtcaaccagaggcaagcgagcccgttgatcgagactactttagtctcaccttcgtcatctagagatggcaagcctgatgacatgtggagaccaatcatggtcatctgtcgcctttgtcaaccaaaggcaagcgagcccattgacacacagagaccaatgtcgtcacttgcacattttcgtcgaagactcaacagacaatcaagtctgatagcacgcggagacacttcatggttatccgcacccgcgtcatccagagacggcaagtccgatgacatgcagagacaacatatggtcgtccgcacccttcctatccagagacaatcgaagacaagcgagtctaatgatattcaggatgatggtcattcgtttcttatcattttggagattttgcagatttacctttgtcatccagggatgatcaagtccgatgatgcgcaaagactcttttctgcttaccagagacagtcaagcactgaggtttttgctgatgctcctgatgccttttttggtctttctgattga

SEQ ID NO: 63953 - DNA, 714 bp, Glycine max
  Peptide Sequence Number=SeqID_180731
atgactgaggacaggggcggctgcatgagtattttcaccagtacactcttaactagcagggccatgtgttttgatgataacaaagatgatgacaaaaagcccatgagaatgatttcaagattgagtcaagaacaattcaagaatcaagagaaagattcaagagaaagtttcatcaagaagattcaagattcaagaataatcaagatcaagattaaagactcaaagattcaagaatcaagagaagacttaatcaagataagtattaaaaagttttttaaaacattgagtaacacaagaagttttcacaaaatcattaccaaagagttttactctctgggtacatcctttgtggtacaagtagagggtacatctacttgggttgttgtgactgagaacaatagagggtacatctcttatggatcagttctagcggagggtacatccactaggttgttcaaagagaacaagggagggctacttgatccaacaggccagggttccaccccttacatatgccctactccagagcagtttgaggatgaggtcgcatggcaaggagactggcccgatactcagacaggggcaggacctacagggacccccagagatgcggatggagcccaagaagatgagaatatggctgagatcgccagacctgtgatttctcctcatttaacattgctgctttcagttattttgtcattttcattatga

SEQ ID NO: 63954 - DNA, 387 bp, Glycine max
  Peptide Sequence Number=SeqID_180732
atgggggtgtacttatcaaaatgtggggggaaatgggctgagcttgatgggtccaacaatttttgcattgagctttcacttgaaattagtgaggagaagagaaagaagggaaaaattccaagccgaggtgcttccataacgcttccgagacgttttcgtgagcgattccgtgaaagttcttcattgttcttcgttcgttctttgattctcaatcgagatcactctggttctttgcttggagcaactgaaggtttgaaggctagtactctctttcttccggttgttgaaaaagcaatagctgatgtacctaatcttaaggatgctttggggtcaatagttgatgtaatgcaggcaatggcatccttgatatactctctttcttcaaag

SEQ ID NO: 63955 - DNA, 471 bp, Glycine max
  Peptide Sequence Number=SeqID_180733
atgacgttgttaggtactgcactgtctatcagtgtgattagggttacacttacccatttacgcgcgccttctttctccaaccgggcgagtcgactcagctccaactcaatgagtcaatccgccgccaccgccgaccccaacgctattgcgacaacgaatgacgcgccgtcgcagcctgaaaacgcggatgttgtggtgcagtacgtggtgctccggcgagacctgatcgacacttggccgctagggagcgtggtcactcaaggttgtcacgcttctgtttcggccgtttggtccaacaaagaagatcctttcaccgttgattattgcagccccgataaaattgattccatgcacaaactgcaacatctagatttttggccttttggggtttctgtgatcacaattgagactgcatttgtctgcaatatcaatgattataaaactgcaactgcagcaactactgcaatttaa

SEQ ID NO: 63956 - DNA, 789 bp, Glycine max
  Peptide Sequence Number=SeqID_180734
atgatagaagtctctgcggaagccattgcatccctcactcagtattatgatcagcccctaaggtgcttcacgtttggggactttcagctagtgccgaccgtggaagagtttgaagagatcctgggatgtccgctaggagggagaaaaccatatctctttagccaaggtgtggacttagcagcgatcgatgccttccttgcttatcaccatagcaaggagagtccggtcattgttgtgttggctaatgcctgtgacactttcgaccgaagatgcgataagagtggcgcaaggattgtttgttgcacaccagctctttatgtgtggctagtctcgcacctctttcgtcatgaaagtagacccgtctgtcccctacaaggtcaccgcttgtgcaccgagaaagggaaggcaaactgggagcaactcttggctagtgtggtagggggatccattaattggttcccccgatggaaggaaagaagagttggggttttgtcttcatgtgaaggattcccaaatgttcccttgatgggaacaaggggttgtatcaattataatcccgtcctcgccataagacaacttggctaccccatgagaggagcaccatcggaggaaggcgtcacacctttcatcgcatggggtttcagtgaccccaatgctaggatacttcaaggattccgtaaggcatggggtgtagtgcaaaggaaagataaagagcttaggggaagcagtaatgggatcattggcggctatcataagtggctgaaggctcgagtgcaagagttggattag

SEQ ID NO: 63957 - DNA, 614 bp, Glycine max
  Peptide Sequence Number=SeqID_180735
atgaatagagactttgcctttacgattaagagcagttctttcgatgaagattataacccttctgaaagtacgcgtatcaccaccaacttcgccaatttggccagaggggaaaaccgccgggagaacctgcgcaacacgctggtgatgattaacaatcgcttcaattcgttggcgcattgggataaccccaaggccgaccgctattcggttgagcttgaaatcatttcggttgagatgcgcgttgaagatcagggggccagcttcccggtgattgaaatcctgaaaaccaacatcattgataaaaaaacgcaaaagcgtcttgagggcatcgtcgggaataacttctcgtcttacgtgcgcgattacgactttagcgtcctgctgccggcgcacaataaaaacacggcggaattcaacattccggatgatttcggcgatttgcacggcaatatctttaagcacttcgtcaattcaaacgcataccatgagaatttcagcaaaccgccggtgatctgcctcagcgtgtccagcaaagacacctatcatcggacgggcaatcaacatccggtgttcggcgacgagtatcggcaagacggcgcttcgctgaccgaccg

SEQ ID NO: 63958 - DNA, 393 bp, Glycine max
  Peptide Sequence Number=SeqID_180736
atggccaaagtccaaagaacggctaaaaaatcacgcgttcaggcccgtgaggccagagaggcggtggaagagaacaaaaaagcacagcttgagcgcgataagcagctgagcgaacagcaaaagcaggccgcgctgtccaaagaatacaaggcgcacgtgaagcagctgatcgagatgaaccgcatcgtcctagcgaaaggcgatatcggtttcaacttcaccgacggtaacctgatcaagagaatcctggtggataaggcgacgcagacccagctgatcaatggccgtctcgccattgcccgcttggtggtcgagaaccgcgaagagtgtgaatacgcgattatccccgcgagcgtcgccgataaaatcgcgcagcgcgatgcggccagcatt

SEQ ID NO: 63959 - DNA, 114 bp, Glycine max
  Peptide Sequence Number=SeqID_180737
atggcgggtgaggagtcgatgttccatctagaggatgagtgcacttggaggtggtggatacccaacgtgatcaaaggcatggatcactacttggggtatcccgttgtgccttga

SEQ ID NO: 63960 - DNA, 873 bp, Glycine max
  Peptide Sequence Number=SeqID_180738
atgggtgtgggccgcgacatagacgatctgcccaagaacgacgccaaccacactgccttgaccccgctatggttcttggaaagagcagctctcgtccaccccaccagaacttccgtggtgcacggatcacggcactacacgtggcaccagacttatcaacgttgccgtcgattcgcttctgcactttctaaccgttccattggtctcggccatactgctatcattcaattaattggatgcataagatttagcttgttcacttatcatggatacatgtggcggttattgcacccaacattccagcactttcatgaagctcattttggaattccaatggcaggagctgtgttgaacaccattaacgtccgtctaaacgcgtcagcaatagctttccttcttgttcattcatccgccgtggcagtgatcgtggatcaagagttctttcccgtggcggaggagtccttggaaatctggtctgagaagagcagaagctttaatcctccaattgtagttgtcataggtgctgaaaactgccaccccaagaatctcatacatgctttggccaaaggagccgttgagtacgagaaatttcttgaaagtggggaccctgaattcaagtggaagcctcctcaggacgagtggcagagcattgctttgggttacacatcaggtaccacttctagtcctaagggtgtggtgttacaccaccgaggagcgtatctcatgtctctgagtggtgctcttcattggggaatgagtgaaggtgctgtgtatctgtggactctttccatgtttcactgcaatggctggtgctatccttggacacttgctgctctttgtgggacaaatatttgtcttcggcaggcaaattaa

SEQ ID NO: 63961 - DNA, 627 bp, Glycine max
  Peptide Sequence Number=SeqID_180739
atgcagatgttcctttatcaaattctctgtggcattgcttactgtcattcacatagagttcttcatcgagacttgaaaccacagaatttgttgatagatcgccgtactaattcactaaagcttgcagattttggattggctagggcatttggcattcctgtcaggacatttacacatgaggtggtgacattatggtacagagctccagaaatattgcttggatctcgtcattattctacgccagttgatgtttggtcagtgggatgtatatttgcagagatggtaaaccgacgacctctattccctggggactctgagattgatgaattatttaaaatattcagaatcttgggtaccccaaatgaagacacatggcctggtgtaacttcattgcctgattttaaatcaacatttcccaaatggccatccaaggacttggcaaatgtggttccaaatcttgatgcagctggtcttaatcttctttctgtaagtgcaagatgcgatatagtattctttttcattgccattattaaaaattgtgcaaataagtgtctagttcaactgccaccattctcagtccaaggctggggtgtggtgatgttgtcaagaggttcaattctccactag

SEQ ID NO: 63962 - DNA, 189 bp, Glycine max
  Peptide Sequence Number=SeqID_180740
atgacgaaggaaccaaagatggggagtgttggaggggaaacagaaaaaccaaagatgcggagaggtggcttgatcgttggagattgcaaggcaattgaagctgagactccatttgggttagagggttttagatttgaaaaagaaagaatcgttgggttagtcgagaatctaaaaggggaggttgaatag

SEQ ID NO: 63963 - DNA, 915 bp, Glycine max
  Peptide Sequence Number=SeqID_180741
atggatagggttatctacttcttgttttgtattttgtttctaatggcatttgttggatctattttctttggcattgctactgaagatgacttggacaatggattgatgaaaaggtggtacctaagaccagatgattctacaattttctttgatcctaaaagagcacctgctgctgctatatttcattttttgacagccttaatgttatatggtttcttcattcccatctcattgtatgtttcaatagaaattgtcaaagtccttcagagcatcttcatcaatcaagatatccacatgtactatgaagatgcagataaaccagcccatgcccgtacttcaaacttgaatgaggaacttggccaagttgacacaatactttcagataaaactggaactctgacctgcaactcgatggagttcatcaagtgttccattgctggggtagcttatggccgtggtgttacagaggttgagagggcaatgaatagaaaaaatggttatcctttggttgatgacacaaggggctctactgtcagaaattctcccgtcaaaggatttaacttttcagatgaaaggataatgaatggaaaatgggttgatgagccttatgctaatgtcatccagaattttttccgcttactatcaatctgtcatacagccataccagaagttgatgaagacacaggaaatgtctcatatgaaactgaatctccagatgaagcagcatttgtgattgcagcgagagaaattggttttgaattctataaaaggactcagactagtttatcaatgtatgaattggatccagtttctggtgacaaaattgaaagccctataggtttggcaagttttatacttgtaggcccaagagggcaattatgtctaaccattagtggacttttgagaggagaataa

SEQ ID NO: 63964 - DNA, 1848 bp, Glycine max
  Peptide Sequence Number=SeqID_180742
atgtacaagcttcttaatgttttagaattcaatagctcaaggaagcgaatgtcagtgatagtgaaagatgaaaaagggagaattttcctactctgtaaaggtgctgacagtgtcatgtttgagaggcttgccaaggatgggagggagtttgaagagaaaaccttggaacatgtgcatgaatatgctgatgcaggtctaaggaccttgatcctagcatatcgtgaacttgatgaaaaccaatacaaggaatttgacaatgaaatttctcaagcgaagaatttgattagcgaagatcgggaaacactgattgaggaagtatctgataagattgagaggaatctaatcctccttggtgccactgctgtagaggacaagctccaaaatggggttcctgattgcattgacaaacttgctcaagctggaattaagatctgggttttgactggggataaaatggagactgctatcaatattgggtttgcttgtagtttacttagacaaggaatgaaacagattatcattcatttggaaactccagatattaaagcattggagaaggctggagacaagggtgctattgtcaaggcttcaagagaaagtatccgccatcaaatatctgaagctgctcaacagcttactgcctccagaggaacctctcagcaagcatttgctctaattattgatggaaaatcacttacttatgctctagaggataatatgaagaacatgtttctagaccttgcaattcgttgtgcatctgttatctgctgccgttcctcaccgaagcagaaggcactggtcactagactagtcaaatctggtactggtaaaactacattagctattggtgatggagctaatgatgtgggaatgcttcaagaagcagatatagggattggaatcagtggcgttgaaggaatgcaggcggttatgtctagtgatattgcgattgcacagttctgttatttggaaagattacttcttgtacatggacattggtgttacagaaggatctcatcaatgatatgctatttcttctacaaaaacatcacctttggctttactctattcttatatgaggtgtatgcatcattctctgggcaacctgcatacaatgactggtttttgtcactctataatgtcttcttttcgtcacttccggtgattgctcttggggtctttgaccaggatgtgtctgctcggtactgtctaaggtttcctatgttatatcaagaaggtgtgcaaaatgtcctctttagctggcgtcgaattttcagctggatgcttaatggctttattagtgccataataattttcttcttctgcacaaaggcaatggagattcaagcctttgatgagaagggaagaactgctgggagggatatacttggagcaacgatgtatacttgtgtggtttgggttgtgaacctgcaaatggctgtttctataagttacttcaccttgattcaacatattttcatctggggctccattgctctatggtaccttttcctcatggtatatggagcattgtctcccagcttttccggaaatgcttacaaagtcttcattgaaactcttgcaccatctccttccttttggattgtgacattgtttgtttccatctcaacacttatcccatacttctcttactccgcaatacagatgaagttctttcccatgtatcatgaaatggtacagtggataaggcacgagggaaagacaaatgatcctcaatttgtcgctatggtgcggcaaggatcattgcggccaacaactgtcggttcaacagctcgcttagcggccaaggataatgactttagagacagtggcactaaccatagatag

SEQ ID NO: 63965 - DNA, 741 bp, Glycine max
  Peptide Sequence Number=SeqID_180743
atggcgtttctgttgtggagagcattgagtgatcgacttccaacaaaagagaacttattgaagaggggaattattgtggaagaagttgatcatttatggcctctgtgtaaccaacatcttgaaacttcatatcacattttcttaaattatgattttgttcaaaagacctcatatgaaagaatatgtccaaccttcaagaatggaccagtgctcgttaactctactcctgaagaacaatatgtcaatattgagatccctgaacaacttatcagaggatggcaacaacagggatgcacccatcttcattatggagcaataagaaatcgaataagcaaattgaacatgttcttcagcggcgattcctccactcgtaagcgcgttgatttaggtggccgcagctcgaaggaacgggacaggaataatctcctggagcagacgcggttggagcggaaccggcgcatgtggttgcgccagcagaactctgctgccctcaggattcaggaaacaatgtttcttgggaattcttttggccaagtttcccatggggggagttgggaatctaagtttcccaagttaaaaaacaagttcaactacggtaatattgatacaaaagaggaaacagctagcagaggcaacagagttcatcaagcaaaggtgcagacacaggacaaaggggtgcagatagcagcaaaggcaaagaagaccatcacaaggccctcttaccttagtgactacgtatag

SEQ ID NO: 63966 - DNA, 570 bp, Glycine max
  Peptide Sequence Number=SeqID_180744
atgttgtctccgagggggagcttcgcctgcgcgatggtgccggcccgcgggagcatttatgtggccggtgggggctcaaggcatacgatgtttgggccagcggggtcgaggattcggtcggtggagcagtacgaggtagggagggaccggtgggtgctgatggagaatctccccgggtgcgtggggtttgtcggagaagaaggaagggagttgtgggtgataggaggtgatgggagtggagagtggcacttggagagagttggggatatgtcggggaatagggagagggtcggggttgggaagattgtggtggttgaatataatggatgtcccatgcttttcatgcttgatagaaatgagattttgaggaggttggttgacttactattggcaattgggagatcattctttttgttgttttgtgttatggttttgctagttaggattggagcaattaaagtcttactccatgtcgtcagattctgtgatcctatgcacagactatggtgccatgttacttcagctcaacaatggagtgtaattgggaatttgagatggctgatgatgtaa

SEQ ID NO: 63967 - DNA, 330 bp, Glycine max
  Peptide Sequence Number=SeqID_180745
atgcaagagttagattggctcccgaagctaaggacctcaagtgaggaagaggctgaaacccctgaggagagtgaagaggtccaagccttaaaggcagaacttgaaaaggcgcaagcggtcaaggaaaaattcaagatgatagctatcaaggtctggaaagagtgcgatgaactaagagacatcaatatggccactgctgaagcattggatcgggaaacaaagagggcccgaaaggaagaatggggccaaaacaagttccgaggggcattgtggggaagcaacatcgagcttaaacttcaaagggtagagagagaccagtcgagagtttag

SEQ ID NO: 63968 - DNA, 1302 bp, Glycine max
  Peptide Sequence Number=SeqID_180746
atgaacagtgaagctaataaaaatacttggaaaagaaaaagacgtttttgtggttttgctattaaaaaagagcctaaggccacgagtgcacgtgttcataggctcgttgtgttaaccttggggagcagtcggcaaactagattgcatcaagtatggggatgtcttgctaaggtagctctaccagatttcaagaggactaatgtagtgcctttacatttgcatacttcttcctctgtaacaaatgaacaagttaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaacttataatgagactgtaacttccattgatgccaatttttggaaagaggcaattaatagtgaattagattctatcatgtctaatcatacttgggatttagttgacttacctaagggaagtaaaccaattagatgcaaatggatttttagaaagaaactaagaactgatggaaccattgataaatttaaggctagattagtagttgttggttacacacaaaagaaagaaattgactattttgatacatattctcctgttattaaaatttccacaattcgctctcttgttgctttagctgctattcatggacttatagtgcatcaaatggatgtaaagacaacttttcttaatggtgacttgagagaggaaatttatgtggaacaacctgagggctatgtgattcaaggtcaagagaacaaagtgtggagtgttatgtttctcatgaattgtactagacccgacatagcatatgctgtgagtagactaagcagatatactcacaatccaggtggaggtgccatatcatggaagtcttccaagcaaacttgtatagcacgttcaactatggtatcagaatttattgctcttgatttagcaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttatacttgaatcgtcgagggggatggggcttaaacctttgtgttga

SEQ ID NO: 63969 - DNA, 696 bp, Glycine max
  Peptide Sequence Number=SeqID_180747
atgattaatcaggttctccgacgaagattaatcatcgacagaattgatggatacactgtaccgacatggaagccacgcttcaaggtgttgtgcccatcaacactactgactagtacgcaagataagagcttgactctattttttgatgttacaatgctattgccgccaacccaacaacactctttgatgatggcatctcattcaccgcggattttatcactcacccgaagggccttttcttcttgttcctttcaaggagaaggggtttctatggttcaaggagcttccagaggaattggcctcgaatttgtaaaacagcttttagagaacgatgataaagagcatgttattgctacatgccgtaatcctagtgcatcaactgggcttatccatctgaaagataaatttgcagaccgccttagaattttgccgttggatttgactgttgagaattcaatcgaggcatctgcattgtcaataagagagacatatggccgtctaaaccttctcattaatgcgtctgggattctttcaatacctgaagtaatacatccagaaacaacattgaacaaagtggagaaatcatctttaatgcttgcatatgaggttaatgcagtgggtcctatcttagttatcaagttgtcaatgagaaaagacaatggctgtcctgctattcctacttatctggcacattga

SEQ ID NO: 63970 - DNA, 1508 bp, Glycine max
  Peptide Sequence Number=SeqID_180748
atggcatcagcagaagggaaggctccttatacagctaattgttttactcaagatttccggattcccctgagttctctggatcatccgtcatcagtttcaaaaaaattagtatctgattgggttcctaataattctattaatgatcaaattctttctaattcagtttttgtaccccataatctgaattctgataagctaccagaaatgaaatggtggctacatgtgaaaagtgacttgggggatgaagcaaattatacatgtcaacagctgaattcctacgagtctgaacttggttccttctatgctgaatttcttaatggcagtgccaagagtgggggagatcaattggtcaaagactttgattttctttctaatattgaaagtgctaatttatatgtagagcagccgtggcatgttgtctctcctacatgtatgaaaaacaatacaagaatgccaaaaattgaggcttcactgaataatactgatttacattttactcctaagaagaaagatcaggaggaattctatttttcagatagtcattttatggattgtgatatttccaatttcttggtctctgaacaaggtaaaatgacatcatctgatctagaatcacatttgatgggagcagagaaaactgggccttggtggcgcactgcgggaaaagatgagttggcttccttagttgctcggaagtcacttgagcatattgggaattgtgatctccctcatccccagactaagcatgttagtccgagacccccctacccgaagggtgttgaccatcatgataagactccaccatctttgaaccgtaaaactgagactggttcttcctatgcagatggttatacaactgggatatccacttctgactgttcatttcaggattcaagcaagcattccagcaaagactctagctcaagcaccgaaggttgccaaataaattccgagaatggtagcatgtctgagttgttgaaagctttgtgtcactctcaaacaagagcaagagaggctgagaaagcagcgcagcgagcttacagcgagaaggagcacatcctgagtctcttttttcgacaggcttcacaactctttgcttacaagcagtggctccacatgctgcagcttgagaacctgggaatgctgcttaagaaaagtaatagcaaagctaggaagaggaggaatagtaacaaaagatgtgtgattgcaaagtgcgttgttgctgccgtgggattaggcctcgccggtgccggagacgtttactcttactggggtattgttctagttctttgccatggtctctttctgcggataatcgcattgaagatgatttgcgcggctctgaagggtactggtggaaacataaatggagatgcagttaaggaaactacagaatttataggatttggtgtggtgggtctgcttggatttggagtggttggtctgcttattttaggtgttgtaggcctacttgatgaccgagatccagtgcgtagaagggggaaccg

SEQ ID NO: 63971 - DNA, 585 bp, Glycine max
  Peptide Sequence Number=SeqID_180749
atgcatggtgccaaccgcacaaagtcaaaacatgtggggtacaacctagatgacgaagatgaatggcctaactttaggaatggggttaaccttaagtataaacttatattccttttattacgtttgtatcccaaagctgttcgagctactatcagagaaacaccaccatctacagcaagaagagggcgctccccatcaccatctttacaacctcagagatctggagctttttcattcacttcgaccatgcctaaaaaagatttagagaggcgatcggtttcaccataccggttcccccttctacgcactggatctcggtcatcaagtaggcctacaacacctaaaataagcagaccaaccactccaaatccaagcagacccaccacaccaaatccttctaatgcaagacaaaggtacccttcagagccgcgcaaatcatcttcaatgcgattatccgcagaaagagaccatggcaaagaactagaacaataccccagtaagagtaaacgtctcctgaaggccttactaagccggcgcaagtctaagaaggatgacatgctatacacatacttggacgagtactga

SEQ ID NO: 63972 - DNA, 1518 bp, Glycine max
  Peptide Sequence Number=SeqID_180750
atgcatgctaataatgtgaaggccattaacaaatttgtggccaataacaaatatgtgccttaccaaaaatacgggggtaagaacccaaagggtgtgaagataagggactatggagttaaaggaaagtctaatttcaagaagactgtcaactctaagattaaatacaaagaacaagtaggagcacaaattctccagcaggtgatgaagaaagatactgatgaagccaagaaggatggcagaacttatgatgagagcgatatagcctttgttctaagcaaaaggttagaaacaggagactcattggtgactgatggagatatggactatacgaatgagacaattatagggactgcaatggtcctggtggaaaatggtgggtttaacacgcttatgaaggatacaatgaagcaaaataattcttcctttttgattctcttggaaactcaaactagtggtgagaaaggaagaagcataattagaagaattggtcttaaaggttgttgtgtggaggaagctagtggacattggggtggaatctggtgcttatgggacacaaataattggagtgtgactattggtaccactgtagttggagaatgggccattgttggtgacttcaacaacactttgtctaccagggagagtgcggaaggtgcttcaaaaggggggcatagagatatggaagcagcttcagaatataagaagacttggatagaatatgaacaagtcttggctgaagaagaacttcattggtttcaaaagtctaaagctaaatggttgtatatgggggaccacaataccaagtattttcatggtatcacaacgatcagacggaagcggaataaacatgatatgttgaaagatgagaatggtaattggatcttcgatactcgagccgttgaaagtcttgtcaccaatttttataaggacttgtacttggacaatggtattgttattccatatgttcttaataatgccttccctcctttagaagagaattggatcaataagcttagtagaatgcctacaaatgaggaaatccatcaaactatcaagtttatggggagcctcaaagcaccaaaactggatgggtttcatgttttgttcttcgaacatcattggagtgtagtggggagagataaatgtgaggtcaattttattaaagatttcagacctcttagcttttgtaatgttatttatgaagctatgactcgtcttatctctcaacgcttgagaccaatgatggggaaattagtgggtcatttccaatctagccttaccccaattgtcaaagtggggataatattgtgcttgcttaagagttttggaggaattttccctatggagaggcatccgataaggcgatcccctaacttctacctctttgatttgtgtatttctatagctacagatcaaggtatttggcgccctattcgattgagcagaaatggtccccctattactcatttagcctttgtggatgatgtaattctttctgtgaaggcttcgcttgaccaa

SEQ ID NO: 63973 - DNA, 1380 bp, Glycine max
  Peptide Sequence Number=SeqID_180751
atggcaagagcattgtgggaggttatatcagagacagagcatggtttgtgcacgtggcatataatgaaaaatggaattaaacatcttggcaatttaatgaaagatggaccaaatttcttatctaatttcaagaagtgtatgtatgataatgaggaagaaactaatgttgaagcctcatggagaaccttattattgaaatacaatgtagaagaaaacacgtggttgaactccacctaccaaatcaaagagaaatgggcagcgtgttatatgaagtatgcttttacgcttggtatgcgtagtacacaactaagtgaaagcattaattcagatataaagagttgcacaaggcctaatttgaacatcaagcaatttgaaaggattgtcaaagaaaaacggtatagtgagttaaagcaagattatgagatgcgtcagaagttgccaagaatgatcatacaaagttcacctatgattagaaaactttctcaagagtacactcctcccatgttcaatttgtttcaaagggagtgggatctaatagctgccacaaatatctacaaaaaaaaaatggaagctaatggtgaatatgtgataacaatggtggatgaaaatggagagtggagagttagttatgaatcccaaattgagaatggagaattgacaatcacttgtagttgtaggaagtttgaaaaatggggaatattgtgttgtcacttattgagaatattattccgcaaggatgtcaagcttcttccaaacaaatatatattgaagtggttggagagttcaaatcgatataagcaattatgtgcaatgcttatgagattggccgatgaggcatctgactatccggaagcatgttctttagtttatcaaggggtgttagagcttagcaagaaagtggctgaaattcgattaaaccaatcaccacatggtcctcatgattccacatgtgaagccacaaggtatgctattgagcctttggcatccaaaggaattggatttaagaagagagatgtgtggtatgttaattcaaaaactatgatatatcaagaaagtcaagtcttgttggaagcatcaaattcaaactcgttgataggatttgctcatttaaatcaactatcattacaagaaccaacttctattcttccgaaagcatatactcatttagtgtcttttccacctcaaccaagtcaaatgagttttactagaatgcttgtggctcaagatgaagacaacattccatcaccaaattggtttctctgttgtcctacaacagagaagccaggtcccattccatcacttgaagcattggactttagtcaaataatctctaatgatagaatttgtcgaagccagatccgaatttgtcatggtcaatga

SEQ ID NO: 63974 - DNA, 933 bp, Glycine max
  Peptide Sequence Number=SeqID_180752
atgttcttcaactttgaggaatctgcagtcaaaacaatcaaactctcctttaaatacaaggtccagcaggatcttccttttttgcaaattcagaggtacagttatgtgaatgtgtatatgaaatggaaaaaagattcatactatgactcagttgagcacatccacgactccgttcagctcaagcctatcattgccctcaaaaactgcattgcctgggatctcaatgggttgacaccggaagctgctgagattgacagggatgagaagagagtatatgaagaatgcagggaggacttaaggtccaggttgaggaagatgatattgatgaccagagagcatgttctacctttaaagataattcaggggatgcagtggtatttggggttgcttagtgattttctgcagcacccagaacaaaatcttgatgaatctttcaggtttgtagacatggaagatggattgaaggggttggctcttgacagtggagaaaagatttattctttaatggaaaaaaatgccacaaaaagagataaaagacttgtgggagttctccatgagctactttccctttttgttgagcattcagccgagaggaagaagttgttttgcctcaagaagtattttgggttgccacagaaagtgcatagagcatttgagcggcatccccatatgttttatatatctttcaggaacaaaactcgtacagtcattctaaaggaagcttacagcaataaatcagctatagagaagcatcctctgttgagggtcaggaagaagtacatcaagttgatgaagaaatcggaagtgattttaaggaacaggagggtgaataatcgattttctaattgtaatgcaaaattggatatagattcaaatgatctaggtgaaaagggacatgagatgtcaagttgctctttggaacaggttgcgtga

SEQ ID NO: 63975 - DNA, 912 bp, Glycine max
  Peptide Sequence Number=SeqID_180753
atggctaaacagactccttcctcaaccaagcacccccatccatcctcctcaggcaacctccaatcatttgtttggatagcttcctctgcaggaggagtccttggaaaccttcttggtggcatttttattggccggttctccccacaatccatgtttttatattttggccttctccttgccctccaattttttataaccatctcagttcgtgagagttctcttgggctcccaaagagtccatctggtggaataaggaaacagctttcacagctattggttgctctaagaaagcctgaaatctcatattcaatatcatggtttacagcatcttacgccattattcctgcacttactgggaccatgttcttttaccagacacagtatttgaaaatagactcatcagtattgggtatctccaaggtgtttggccaggcaacaatgctcttatggggcatcatatataatcaatacttcaaatctgtcccaccaaggaaactgatatcagccattcaagcaatgatggcattcttaatgatttcagatttcttgttcgtgcgaggtttttatcgacaaatgggtgtgccggactcgctctatgttgtgattttctcaggattcttggaggttctatttttctttaagattctgccattcagtgtcctaatagcacagatgtgtccaccaggatgtgaaggttctataatggcatttcttatgtcttgtgtagccctggcattaattgtgagtggataccttggtgttgcacttgcatcatgtattaaggtaacagcaagtgacttttcaggacttccacttggacttctgatacaagctacatgcactctcttgccaactttttggtcatcatgcatacctgataaggtagaaacaaaagccaagaggaaagactaa

SEQ ID NO: 63976 - DNA, 300 bp, Glycine max
  Peptide Sequence Number=SeqID_180754
atgccaccaagaaggtttccaaggactcctcctgcagaggaagctatccaaacaaatgattggaggttgcctgaggaggatggatgggggtgcttggttgaggaaggagtctgtttagccatctctgcaacaatggcatcatttgcaacctcagctatagaagcacctaggttactaagaaggaggtatatggagatagtgaaaatagacatgtttgatggagagattgctatgaccagccatgacagtgcctgcaagaaagctgcaaagacagattcaaggaaatattttaggaattag

SEQ ID NO: 63977 - DNA, 348 bp, Glycine max
  Peptide Sequence Number=SeqID_180755
atggccatacctaagtcgagatttgcaactacaaaagtgtcatttaaattaagcagggacacattccaagaaacaattacgagcttacttttatcttctttaacccaccaccacatcatgggggaaaagtgcatgaagatggtactatgggttctggtggtgttcaaggaagatggtgatagatggtgcggtgttgtcatggagacaacagtggcttgtggttcacagagggcattgtggttttgtcgatggtcgttcattggttgcgggtgtgctggttcgagtttaaagcaaaattgttggttgccactttgtcaaattgttgtatttctaaaggaactagattaa

SEQ ID NO: 63978 - DNA, 603 bp, Glycine max
  Peptide Sequence Number=SeqID_180756
atgaagagattctacaggcagagaaaaagtactactaacaagtcgtcttctaaatcaagaaagaaatctaaagttgttgagaaatgtcccgaagattatagttcagaagaacatgttttgcggatgtttgacatgaatatgaagtatggaccttgccttggattgacaagattacaacgttgggagcgtgcacacaagatgagtttgaaccctcctgagcaaattaagtgccttttggaagctgaggatgtgttgtcgcaaacgagtcgagttaagatccgtgggcttgccgggtcgaactcggcgacgatgaagtggaagaacacgttttccgggcacgaggagtggcagaggacgaagtgcactgcaacgatggagccgcggaggttgacgaaacgggcaacctgccccgtttcggtactccgacgcctcgatgtagtggaagaatgcgctgtcgtctgtggtagtcaggaaagagcggattccgagacagagcaatggttggaagaagaagcagagaatgagggaggaaacgacgacgctttggcggaggagaggaagttccagagcgagaaagagagagagctggagttccgagagtaa

SEQ ID NO: 63979 - DNA, 423 bp, Glycine max
  Peptide Sequence Number=SeqID_180757
atggtggcatcagacggtggcggtggtgggaaattgacgaagaaagttctgggtttggggtattgggtgcaaggattcaggtgttttccatggttggtagtgagtttctacctcaaagatggtctcaatgtggacccttccattcttcaaattcttcagagttccgctaatcttccaatggttgggaagcccctctatggcctcgtttcagactctgtctacatctctggccagcaccgagttccctacatcgcccttggagattctttaaattcgttagattatagctggcaaagtgggttgcttgctttactgcgacaactgctaactggagtcccattgtcagtttattctgattcatctgttgtacctaaaaatatgtggattaggattgtgaacttatcattgtcatctgagacttga

SEQ ID NO: 63980 - DNA, 621 bp, Glycine max
  Peptide Sequence Number=SeqID_180758
caagtatggcacaagtgtcccttttgctcaatgttcatcggggacaagcgttgccaagccattgagaccgtgatggaatcattgaaaaccgtgtgctgtaatgcaaaacatggttgtaatgcaattgtgaggtacagtgagaaacgtgagcatgagaagacatgcatctttgtaccgtgtttatgtccccagccacgttgcgattggatttccaattccaacgaattagggcaacatttcaatgcgcgacacccgacgactcgtgttcttcaagctgtaagtgatggaaaattgtttgtgatcagcaatgatgagagggagaaggaaaatccattgattctttttcatgttgggcctgactcgtggatccctgagtttgattatgaaagcactcaagaactgaagtttgagttttctttagcaaccgttttacacattccaattgagatgtggtcttcttgtaatggacagatcaaattgcagtttctgattactactgtgagtggtgcatttaaggttgttagtgaacaaaagaatgagctaataaacgatccaacaccaaacgggaggcccaaaaggatcaggaatcgccctgctggattggacgatttttatccctaa

SEQ ID NO: 63981 - DNA, 828 bp, Glycine max
  Peptide Sequence Number=SeqID_180759
atggaggtttcaccattggagggtttctccgaacttgattggtggacaccgcagttgccatattcaagcaaccacctttgcttcaatgagttcccggatttggaaaatctggacctcgatttcagcctcccatcccttggtgaacatttggaggaggtggaccaaaagccctcgaacattgttgttcccgaagggcttcgttgcaatcatgaaaaggtttttggggatgctttattggccactgaacatgtttctgccacttgtgtgaagaaagagcaagtgctgaataatattgatcagagtccattgccagtgcttctagctagtaacagcactacgaggaagaagccttgtgctttggaatttgaggaagcttcattcgcgattcaaaatcaaaatgggtcagccactgcgagttatttgaagaaagaggaggtgcagaacattattcatcagaggccattgccagtgtccagtagcagcaagaagaggacgtgtgtgttagagtttgatgagataaagaagcattttggggttcccataactgaagcagcgaagagattgaatgtgggactaaccatgttgaaaagaaggtgcagggagctcagcatcacgaggtggccacataggaaactcaagagcttgcaattactcatcgacaatgttaaagaaatgggtttggaagacgaggttccaaggttggagcgacaaaaaaggttgttggaaaaattaccaggactggaactaagtgaagaagccaagaagctgaggcaagcttgctttaaagctaattacaagaagagaaggtgtatggcactccaatcttga

SEQ ID NO: 63982 - DNA, 234 bp, Glycine max
  Peptide Sequence Number=SeqID_180760
atggaagtggataaaagtagtggtgatgctgatacaagtctccctataaagataaattgttttctagggaaggaccttttcctttttctgttgatggacgatgctttggagtccctaaagaagaaattcatgctcctatttctaagatgtcagaaattccaattgatccattcaattaatgatgattttcttcaaatgggttactactatacaagcttggggacagtttgctag

SEQ ID NO: 63983 - DNA, 876 bp, Glycine max
  Peptide Sequence Number=SeqID_180761
atggctaataaggtgactttctactgtcatcttggaaaaggtcctggatgtaacatgcatacagaggatgagttggcagattttaaagcatggtttgaaatcctttctcgtaaatcctctaatggagaagatcaaggaacatcatctaaggatactgacttgaagaagaaaggaagcacaaacagagggaacaagcccactaggaataatactgcagaaaaagagaagtattccagtgaaatcaaagatgaatttagtaggttaaaaggtgagtatgataagcttgctttagaaaaatattcggaggtgacggcactcttggcagaaaagaaatttgtgtggaatcaatataacataatggagaatgattacgctgataaattaaggactaaagaagctgaagtagaaaaagcaaatgaaaagataaaggtacttgtttctagcatggagcagctacagtctgaaaaatatgaaaaggatagtaaaatatcagaattacaaagtaaaatggctgagatggaagctgagacaaaaagattaaacaaagaaatatctggactttcagtggagttggaatctttaagaaagttcaggaacaaccaagttacaccacctgttttaaatcattgcacacaaggaactaaagcacctgagtcaggagttgttaagagcaacagaagtagaagaaatatgacttccaaaaaagaaatatgtactcccaatgcaccggttccagccaaatcctctgaaacggggacaaaaacaaaaagcatgaagaggaaagaggctccagttattcccacctctgatactccaaagctgttctcttccagcttcaaggttccaaaactgaagtcctctgtaagggtcacatga

SEQ ID NO: 63984 - DNA, 399 bp, Glycine max
  Peptide Sequence Number=SeqID_180762
aaagagaaagtgcagattattgatcagagtcctctagctagtagcagcagtacgaagaagaggccatgtgctttggaatttgaggaaataagcaagtattttggcgttcccataaatgaagctgccaagcaaatgaatgttggggtaaccatgttgaagaaaaggtgcagggagctcaacatcatgagatggcctcgtaggaaaatcaagagcttgcaaatggtcatcgacagtgttaaggaaatgggtttggaagacgaggttgctaggttggaggagcataaaaagttgttggaaaaattaccaggactggaactaagtgaagaagccaagaagctgaggcatgcttgctttaaagctaattacaaaaagaaaaggtgcatggcactccaagcttga

SEQ ID NO: 63985 - DNA, 1344 bp, Glycine max
  Peptide Sequence Number=SeqID_180763
atggacaagctggcaatggaagaagctggcttcttaaattgcgtcagtgtccctgatggtgcacctccatcaatctcctcaaaagagttgccacctcaggacaaggcaactcgggttatacttgccactgatggggatccacctggtcaagccttggctgaggagcttgcacgccgcattggaaaagaaaaatgttggcgggtaaggtggcctagaaaatcgaggtctgacaattgcaaagatgcaaatgaggctagattggaaagttggaaactaaggactgcaaactcaagcaaccttataacttattcacaggttctcatgtatttgggccctgatgcactcaaggaagtgattgagaatgcagaattatatccaatacgtggattgtttaacttcagagattactttgatgagattgatgcatattaccaccgaaccttaggatatgacattggtatctcaaccgggtggaataatctgaatgacttatacaatgttgtaccaggagaactgaccatagtaactggagttcctaattccgggaagagtgagtggattgatgctcttctatgcaatcttaatgaaattgtcggctggaaatttgcactttgttctatggagaacaaggttagagaacatgctcgaaaacttttggagaaacacttgaagaagcctttctttaacgaacgttacggcgaaagtgttgaacggatgagtgtggaggaatttgaacagggcaagctctggttaagtgatactttctctctcataagtggcacagttgaagcaggctgtagcaataaaattcactgcattttgctttgcttggactacttggctgctgatactaggtgtgaagatgactcacttccaaatataagttgggttcttgatcttgcaaaagctgctgtattaaggcatggggtgcgtggacttgtaattgatccttacaatgagcttgatcatcaacggcctcctaaccagactgaaacagaatatgtgagccagatgcttaccttaatcaaacgttttgctcaacatcatggatgccatgtttggtttgtagcgcatcctaggcagctgcataattgggttgggggtcctcccaatctctatgatataagtggaagtgcacacttcataaataagtgtgacaatggaattgttattcaccgtaatcgggatccggaagctgggcctattgatcaagtacaggtttgtgttcgaaaggtacggaataaggttgcagggacaataggtgaagccatattgttgtataatagggttactggtgagtacacgccatctgataacaacagaccagctgatagaaagagatag

SEQ ID NO: 63986 - DNA, 1497 bp, Glycine max
  Peptide Sequence Number=SeqID_180764
atggcttccagagcagcaaaacaaaacaacatctcgggaaaaagaatccccaacggctcctctgtgttggatccacttatgttaccgttgtttgtaactatgactgctgaggttatggctcaagaggagacacaagcagctgaggttgttgttgctgttgagcccctgaaagaggagaaggttgctgaagaaaatgtgaaaccaagagagtcatcagtggaagcatccaaacccaaaatggtggagaaaagctcttcttacaaggaagaaagcaactacctttctgatctcaaggagtttgaaagaaaggctttgagtgaactcaagtcaaagcttgaggaagctatcttggggaacaccctttttgagccaaagaaggaggctttgctagagaatgaagagaagaaaaatgaaggtgaagagaaggaagaagaggaggagaaaaaggttgacgtagaggagaatgatgtgtctctttggggggtgcctcttttgccaagcaaaggtgcagaaggtgttgatgtggttctgttgaagtttttgagggctagggaatttaaagttaatgatgcatttgagatgctgaagaagacccttaagtggaggaaggaatcaaagattgattctgctgtggatgaggattttggctctgacttggcctctgctgcttacatgaatggtgttgaccacgaggggcaccctgtgtgctacaacatctttggtgcatttgaaagtgaagagctttaccagaagacttttgggaccgaggagaagcgcagtgagttcttgaggtggaggtgccagttgatggagaagggtattcagaagctcaatttgaagccaggtggtgtgtcttcattgcttcaaatcaatgaccttaagaactcccctggtccttcaaagcttagggttgccacaaaacaaactcttgcaatgttgcaggacaattatccagaaatggtggcaaaaaatattttcatcaatgttcctttctggtattatgctctcaatgcccttttatcccccttcttaacccaaagaacaaagagcaaatttgtggttgctcgtcctaacaaggtcactgaaacattgaccaagtacattccaattgaggagatcccacttcactatggtggtttcaagagggaaaatgattctgagttctcttcccaagatggtgctgtttcagaactcattctcaaggctggatcaactgcaaccattgaggttcctgcattggaggttggaaactctttgtgctgggatttgactgttctcggttgggaggtgagttacaaggaggagtttgttccaactgatgagggctcttacacggttattgttcaaaaagggaagaaaatgggttcacaagaatggcctcttaggaacacttttatgaacagtgaaccagggaaagttgtcctcacaatagagaacacttcaaacaagaagaagagggtactgtaccgttacaagaccatcaagagctccttctga

SEQ ID NO: 63987 - DNA, 288 bp, Glycine max
  Peptide Sequence Number=SeqID_180765
atgttacaatgggtatctaaggaagcgtcgcaagcccgatcgagatgtcgtaaccaccatcatgtagataggcggacaatgatgctggtggtggggtcacctgccggaaaggtcgttggagctccggtggcagacaacagaaaacgaaaagaggacagcaagcagaaaggtcaactagaatgcggaaaaaggacaccggaagaagggcgacaagcggagagctccaccgaaatgcagaaaagggtcatcagtaaagtgacagcagcaggaaaaatcactggagaataa

SEQ ID NO: 63988 - DNA, 360 bp, Glycine max
  Peptide Sequence Number=SeqID_180766
atggagaatggatgtagtgaaaagaaaaatgaagcatacacattattggaaagtgccttgattgtgacttatctaactgccttaattgtcgtcgcatgtgtcttgaaaagggctacctatagaggagctgagcggaaaggccgagtgaagcgtggtagtgtgcaacggctaggatgtcatctctcagcagctttctatgaccaaggtgacattcttttagcagaatttcttgctacaagagacaggctcaatatttgcttggataatgggttgcaaggtgttgatatgcgagttggattctttggatgccgtcaaactcaaatttatgactttggcagtacaatagacctacatcaatag

SEQ ID NO: 63989 - DNA, 255 bp, Glycine max
  Peptide Sequence Number=SeqID_180767
atggcaacatgggtgccaaatctgattagttctctacctaaggatatatcagatgaatttcctacctatgcctgtcttcttggaaatatattagaaactggtggatttgctttgtctcgacctgactgttcctttgatatggccatagaccttgctgctgttattacatttttgctggaatcacacccatctctaacaagatctgatggtagagagagtatgctttctattcacacacttaagttttcttgttaa

SEQ ID NO: 63990 - DNA, 381 bp, Glycine max
  Peptide Sequence Number=SeqID_180768
atggcacttcatgtggctaccgaaaagtatatgcatcttgttgatatagtccgaggtgttacatgcccaccagcttccgcttggttcgtcctcgaatcacaccgtactgagagaaaggtttgctctgataccatttgtaacatccctgattgtcaatgtctcagcggctctaatactacgatacttcacacggtgacacttcattcaactcctcgttggtcagaaccctccaccggtcaaaaccctccgcgtgtggcgcattgtcttgggctgtgcttctactgccgaagtcgcccttcttgtgcgagcataacctcagagtttgcctcaaatgaagcatctttgaggcagaaggcagaaggcgcagtcaagatggattaa

SEQ ID NO: 63991 - DNA, 1347 bp, Glycine max
  Peptide Sequence Number=SeqID_180769
atgaagcattatcctattgccatttccctttctaaacaaatggaagccaaaggaattgagccaaatcttgttactctgagcatcctcatcaattgtttctgtcacatgggacaaatggccttgtctttttctgtattgggcaaaattctaaaattaggttatcagccgagtaccataaccttgaccacactcatgaaaggtctgtgtctcaagggtgaggtcaagaaatcactgcactttcatgacaaggtcgtagcacaaggatttcagatgaaccaggttagttacgcgaccctactcaatggactatgtaaaataggagaaacgagatgtgccatcaagttgctgagaatgattgaagacagatcaactaggcctgatgtggtaatgtacaacaccatcattgatggcttatgcaaagataaacttttaatgggagcattgagtttattaaatgaaatgacattgaagaacatcaacccggatgtttatacctatagtatattgattgatgcattatgtaatgtaggaaaggtgaaagaagcaaaaaatttattagctgtgatgacgaaagaaggagtaaaacctgatgttgttgcatataatactttaatggatgggtattgtttagttggtggagtgcaagatgcaaaacaaatattacacgctatgattcaaacgggagtaaatcctgatgtttgcagctacactataattattaatggattatgtaagagtaaaagggtggatgaggccatgaatctcctaagaggaatgttgcataaaaatatggttcctgatagagtcacgtacagttctcttatcgatggtttgtgtaaatcagggagaattacttctgctttgggtcttatgaaggagatgcaccacagaggtcaacaagctgatgtagtcacctacacttccttattagatggtttatgcaaaaacgaaaactttgacaaggcaactgcactattcatgaaaatgaaggaatggggaattcagccaaataagtacacatacacggcacttattgatggattatgtaaaagtggaagacttaagaatgcacaagaactttttcaacatctcttggttaaaggctattgtataaatgtgtggacatatactgtcatgatcagtgggctttgtaaagagggcatgtttgatgaagctttggccatgaagtcaaaaatggaagacaatggttgcatccctaatgctgtaacttttgaaatcattattcgttctctttttgagaaggatgagaatgataaggccgagaaacttctccatgaaatgattgctaaaggcctagtacgttttaggaattttcatggtaggtga

SEQ ID NO: 63992 - DNA, 399 bp, Glycine max
  Peptide Sequence Number=SeqID_180770
atgacatcaattctgacagaaagagctcaagcaccggctgcgaaggaagttatgaaggcctccttcgatgcattcctcacagttttgcttgcaggtggaaccaccagggtgttcaatgaatcagatcacgaaagtatacgagaggattttgacagtttgaagcagctattctgcagttttggagaagaattgatagcagaaaatgaggtggagaaagcggctgagatagtggagggagtgatggcactaatgggaatgagtactgaacaattgatggaaaacttaagtaccttatcaaatgagacaagtggaataggagtcattggtaatggtcagaagttgccaatgccaccaacactacaggaaagtggaatagagcagaccccaacacaatattga

SEQ ID NO: 63993 - DNA, 188 bp, Glycine max
  Peptide Sequence Number=SeqID_180771
tcttgcggccaatgcgattctcgctgattccccaaggaatattagaatcggtttgctgaatatgtatatcactatcaacactacaccggctagtgagagaaaaggtcgacgaagccagaaagctgcagctaatggtggtagtggtggtggtggtcgccttgcacggagatcatggtttcgacgaagag

SEQ ID NO: 63994 - DNA, 264 bp, Glycine max
  Peptide Sequence Number=SeqID_180772
atgccgatctccccctgcagaaatatcagttggtctgtgtcattccgacatagggatcgcgcccgcaagacactcagtggacccgaagaagtccaacaggatcctagggtttccagttctgattacaggcctctggatcgcgcccgtaagacacccagtggacccgaagaagcccagcagggccctgggtttccagctctggttacaggcctctatcattcctacagagtgcccgtcccccccagcaaagtcataccatcgtga

SEQ ID NO: 63995 - DNA, 302 bp, Glycine max
  Peptide Sequence Number=SeqID_180773
atgttgctaagcagcaacgtcatccatatctgtgcaagagtggtcatgttggtgcgcatgacccacactcatctctttgcagcggcacggggggtggcccgggaactgataaaaggaaactactggccccataacccagagcgcaagtctcgcccactgaaagtgaggacgtatagtcctctaagggcgagggcgtgcagccctctgaagttgaggatgtgttgccctttgaaggtcagggcgtgcaaccctctgaaggtgaggacatgcagtcctttgaaggcgatggcgtgtaacgcagg

SEQ ID NO: 63996 - DNA, 291 bp, Glycine max
  Peptide Sequence Number=SeqID_180774
atggcgttatggcaattaatcatgcgcctgggtttgtctaaccaagggaatgtaaatttgttggaaaagacaacgatggatgacttggtcaaagagcgaagtaccggctccgttaccttcactttgagggtgtcttccgtgaacatgtttaagtcaggttcaatttccacgaggactgaagagatagtggcaatttgtgaggggttgaaggttgtgtttcagaataataatgccaccactgggacaatggacaataggggaaaacctgctgattgtcagctatatatttga

SEQ ID NO: 63997 - DNA, 297 bp, Glycine max
  Peptide Sequence Number=SeqID_180775
atggaaactaaacaacatcctccaccacaaagcccactagttgttgccaacatgcataatgaaagactgcaaccacctcctcaatcatctgaattcacgccacaacaacaacatcatcaagattatgggaacaattcgttgttcttcagtgctagtagagaagactttatgagcaacctcatagatttagatcttcaaacaccgaagtctgcttatgtgtacatgcaaatgaaagagaaacttgttgttactaatgaacaacttcaatccaaagaacatggacaagttcatcaatag

SEQ ID NO: 63998 - DNA, 393 bp, Glycine max
  Peptide Sequence Number=SeqID_180776
atggcttcgtccaatcaagaaaaaggtaattcccaaacagaatcaccaccattgactaaccaatcctcagaacaacacaccgacccaccaccaccaaccactacacaccccacccatccacctcctcacccaatgtattaccaaaaccctcacacatacccccaatacccacccggttacccacccggttacccgcccggttaccattacccccaaaacgcaccttactatggtcctcctcccacctatcaaacctcttcacccggtacccgattcattcgaagcttcatattatgttttatgatgatcctcacgttcttttttctctcgagcctcgtcttagccttgatgctacgtccggagctacctgtgtacaaggttgtctccttcaat

SEQ ID NO: 63999 - DNA, 117 bp, Glycine max
  Peptide Sequence Number=SeqID_180777
atggcgtcgcaaaaggggatactggagcctcactgctttgaggagtcacgttttcgatgcagtgaacagccaagggttccaaagaaaatggaggatataggtctagtgaatggttaa

SEQ ID NO: 64000 - DNA, 318 bp, Glycine max
  Peptide Sequence Number=SeqID_180778
atgactaggtggatgactttaaagaacctcatgctagaagacgctgggacacaatgctctgggtattcacaacccatcaaagaaaataaacttgttataatcataagcctaagatcgtacaatctacctacggctcattatcactcatacaaaaaaagaaaaagagagaactcactcctcttgacctcaaatgaagcaattcctcaacaaggaaaaagaagacaatctcatgaccactcccatgatcagattgacacaatggctttgtccaccacgatcatcacgacaactcttactatggcaaaacctaggttgtga

SEQ ID NO: 64001 - DNA, 258 bp, Glycine max
  Peptide Sequence Number=SeqID_180779
atggcaaagtcatttgttgggcatccatatgtgggtcgactaactaaagatgagaagattgttgttgttgatatgacgaagtccttggtgcagcaaagaaatattcttttgatgttcaaggagcacaatgctaacagttatacaacaatcaaacaaatttataatgccagaaatgcttaccgttcttccaagaaagggagtaacatcgaaatgcaacagctcatgatgctgcttgaccgagatcaatatattcactga

SEQ ID NO: 64002 - DNA, 138 bp, Glycine max
  Peptide Sequence Number=SeqID_180780
atggaacacttacttggtggtgatgaacaaaagcgcaaaacggaatcaaaaaatgcgaaaaaggatgaccctagggctgcaaactcgtcaatcccgtgggggaacattaaccatgtcccctcccttctcatggattag

SEQ ID NO: 64003 - DNA, 674 bp, Glycine max
  Peptide Sequence Number=SeqID_180781
acaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccaaagtctgataaagaaggtaacttatcaatttcgacccgattggaaagaactctcggttaaaaagaaagagagtacaaccactcttagaactctcagtaactccaagagaatacctttctttaatgaaaaaggtaaatatgtaagtacagatccacttgatatcaatgacttgtcatctctaaattacattggaacaaaactattagaaagttttaaaaggaaaacagctcttttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 64004 - DNA, 372 bp, Glycine max
  Peptide Sequence Number=SeqID_180782
atgcactgtgtaatcgattacacatacctggctggtaatcgattaccagaggcctccacaaggttccagtccccttttctaagcctggtaatcgattacacccctgggcaatcgattaccagaggcttccttagcttcttgacctcgttttcaagcctggagctcgcctatttaggtacatcacaggttctcactgaccgactatgcccgggttgggtcgggattggtcaagcttggttttgggcaatagcacccaacctgacgtccccaaggtctcctgacccccgcgacatatctccaggtaccactttgtggtcaacaataaaagcaggaagtttcacccttcaacacttcctcatctcaagcttgtag

SEQ ID NO: 64005 - DNA, 1038 bp, Glycine max
  Peptide Sequence Number=SeqID_180783
atgagcactcttatcgtcattctggctgtcatgctggcctgttcgttagtggccggaatcggctactggtacgctatgcggcatcgtccgccgttggcgaaaccactgccgtttatcagtccgccctgccgtaaactcaccgatgaagaacgcgctgccgttgagaagtatattgcgtcgctgggtaaagcgcgtcagcacagcggcgggcgatcgacccgatcgtcacgggaacccgaagcgctggcgctgaccgcacagagcaataatgtttatcccgttacccgctccatcacccgttacggcctctccactgacgatccccacaaatggcgctactacctggatgaagtcgaggtgcatctgccgccgctgtgggagcagtacatcgctgaagaaaactacgtcgagctgatccgtacccagaccctgccgctggtgatctcgctcaacggccactcgctggtgaactatgcggtggaacaaccggcgctgccgccgctggtgcggccgatgtcgaccaacgcttcgattcgtaaagaggagagcgaaaacgtcgagctgctacaggtgcgcaaagagtcgccggaagagtatcagctgtcgcgcgccgacggcacgcgtgaagcgagcgccatttgctgcgccttcctgctgtttttcctcagtctggtgctgcccggcagcctgatgctgtggattgcgctgcccgccggcgcgatcgttgctgtcagcctgtggtttatgtatcgattccccggtgaaaaagggctgcgcgatgtgcactgtctgcgcggcgcaccgaagcgctggggcctgtttggcgaatccaatcaggagcagagcaacatctcgctcggcatcatcgacttaatctatccggcacactggcagccttatgtggcgcatgacctgggccaggtggtacgccaggggcgcttcctgtcgctgcaggatgaagtccgcaacttcccggtacagcgctggcgtaaaaacctggtgctggcgtgcggttcgctgctggtgctggtgatgctg

SEQ ID NO: 64006 - DNA, 507 bp, Glycine max
  Peptide Sequence Number=SeqID_180784
atgggaggcatgggcgcgaccgcccaggcgcgcaatgtcgacgcgcgcattgccggcggcgagctgggcgtgtcgtaccaggtcgcgccgcgctggaaactgggcggcaccttggcgtatgcgtggggccagaaccgcagcgacggccgccccatgccgcagatgccgccgctcgaagcccggctcagcgccgcttacgacgatggcacctggtcggcgggcgccctgtggcgcgaggtggccgcgcagcgccgctacgccctcgagcagggcaacgtcgtcagcaaggacttcggcccgagcgccggcttcggcgtgttttcgctcaacggcggctacgcgttcagcaagcaggtgcaactgtcgctgggcgtggacaacctgttcgacaagacctatgccgagcacttgaacctagcgggcgacgccggtttcggctttgccgccaacacggccttcaatgaacccgggcgcaccttctgggcgcgcctgagcttcaagtactga

SEQ ID NO: 64007 - DNA, 612 bp, Glycine max
  Peptide Sequence Number=SeqID_180785
atggatgatctgatgcaggccgcactcgtcggtgaagcgcggcgtcagttgctcgaaaccgcgcatggcggcggcgatatggaactggcggctgccttcgccgatgtcttgcaggcagcgggcgagatgggcctgcaatcgcttctcgatgaagccgtaagccggcgcaatggtttgcagacctatatcgccgagctgggcgtgccgccacatcgcagcgaaactttgcaccgggcattcggctttgacccacaaaccagcgaagacgatctcctcgccgatctctggccgatgccggaattttccgaggatgcgctcgatctcgtcatgtcgatccagaagggtgcgtcgcgtgcgcaggattttgcgctgcagctgcgccgtttcgacaaggtgacgggccagcgcgaccgcgaagcggtgttgcgcgcagcatttctcaaaagcacgggcgagcctaaatccggctcctatgtctgctctgcggcggtgaaaaaacttctgccggatttcgaggagggtttcgacacggcggcggcgcgtgttgaacaggggctcgaccggttgaaggaattgcgtctggtgcggctcaatctggccgcgccgacgctg

SEQ ID NO: 64008 - DNA, 231 bp, Glycine max
  Peptide Sequence Number=SeqID_180786
atggaatgtgtttcgccaagtaggtttcttaagttcagaaaatttaggcatcatttaaacctttttatagactttcttaaaagagataaagcatcaaactacaaccatattgaccactctaggcttgttgagagcatggtcatgcttagtgaagcatgcctatgcaaggttttcaaatcgttgtttcttgagcatactcgtgctaagtcaagtacgttcgcgctgatgtaa

SEQ ID NO: 64009 - DNA, 1767 bp, Glycine max
  Peptide Sequence Number=SeqID_180787
gacaaaatcaagggaaaggtgaacagaggcaacgaggtttgcacgtcagatggagctattgatagccatggtcatcctgcagttcgaaaaagaactgggacttggactactggaattttgattttagtgaatcaagggcttgctactttggcattctttggagttggagtgaatctggtattgtttttgacgagagtgatgggtcaagacaatgctgaagcagccaacaatgtgagcaagtggacaggaacggtttacctcttctctcttcttggagctttccttagtgactcttactggggaaggtatatgacctgtgccatcttccaggtcatatttgttattggtttgatttcattatcattgtcatctcacatatccctattgaagccgagtggttgtggtgataaagaattacaatgtggatcacattcatcataccaaacggcttttttctatctttccatatacctagtagctttgggaaatggaggataccaacctaacatagctacatttggagctgatcaatttgatgaaggggaccctaaggaacggctttcgaaagtagcattttttagctacttttatttggctttgaatcttggctcgctcttctcaaacaccatattggattattttgaggataagggacaatggactttgggattttgggcatcagctggctctgctgctattgcattgattttgttcctttgtggcacacgaaggtatagatactttaaacctgtaggaaatcctcttcctagggttggccaagtttttgttgctgccgcaaaaaaatggaaggtcaaggtaccaagtgaagaaaacctttacgaggataaaaaatgctcgcccagtggaaggagaaaaatgctccacaccaaaggatttaggtacttggataaagcagcatttatcacatcaaaagatttggagcagctagaagagaataaacgcaacccatggtgtctatccaccgtgacacaagtagaagaagtgaagtgcatactaagactactcccaatttggctatgcaccataatgtactcagttgtttttgctcaaatggcgtcactctttgtggtgcaaggcgatgctatggccactggaatttcaagtttcaaaatccctccagcaagcatgtccagcttcgacattttgggcgtggcattcttcatcttcatctataggcacgccctcgacccttttgtggccaaagtaatgaaatccaaactcacagagcttcaaaggatgggaattggtctagtccttgcaatcatggccatggtctcagcagggttggtagagaaattcaggttgaagtttgcaataaaagattgtagcaattgtgatgggtcaagttcactttccattttctggcaagtgccacaatatgtgctcacaggagcatcagaggttttcatgtatgtgcctcaattggagttcttcaatgcacaaacacctgatggattgaaaagctttggcagtgcactctgcatgacatcaatatcactaggaaactatgtgagtagtttgcttgttgcaattgtgatgaaaatctccacaaaaggtgacatacctgggtggataccagggaacctaaacttgggacatttggataggttttacttcctcttagcagcactaacaacagttgatcttgtggtttatgttgcattggctaagtggtataagtatatcaattttgaaggaaacaatcaagaagatatcaaaaaggaaaatcatgaggttatggtgtag

SEQ ID NO: 64010 - DNA, 687 bp, Glycine max
  Peptide Sequence Number=SeqID_180788
atgccattgcggcactatagtgtgcaattaactactctgccagaagcttatggcttcctgggttgccatctaatcactaaaatggggagggttgtaaatctgggaaattgggctttggctcatgtgccatcaccgtgctttgggaagaatcaacggtacaacatctctgaggatacctggcaacaggttctagctttcagctggtgtacccgtgatagtctggaagcatatgatcctgaaggtgcttggcctgttttaatagatgattttgttgagcatatgtacaggatgcaaggatcgtattatgataattccaacttccattgtaactgtggtgatccagaatctcagtcatgtgtttttgatgaccccctccctggactgagaagtttttctggtctaaagaggaagttacccgaggacttgagcaaaagtgatgatatggattccaatgacatgattctttcaaattgtaaaagaagtagagctcatgatgcggtggatttggaggacaatccaccagggaatacagcagatgactgtatggaaaccagtagacaaaatagtccgttgtgttcatcgatgtccccatgtgcagttgaaggttgtctgtctaagggatttgcaggactactctcaactcgttcctttgtgcagtttggtagggagagaagggcttccttttga

SEQ ID NO: 64011 - DNA, 1572 bp, Glycine max
  Peptide Sequence Number=SeqID_180789
atgggtcaagataatgctgaagcagccaacagtgtgagcaagtggacagggacggtttacctcttctctcttcttggagcctttcttagtgactcttactggggaaggtatatgacctgtgccatcttccaggtcatatttgttattggtttggtgtcattatcactatcatcttacatatttctactgaagcctagtggttgtggaaataaagagttaccatgtggatcacactcatcataccaaacgattttattctatgtttccatatacctaatagctctaggaaatggaggataccaacctaacattgctacatttggggctgatcaatttgatgaaggagatcccagggaacaacattcaaaaattgtatttttcagctatttttatttggctttgaacattgggtcactcttctccaacaccatattgaattattttgaggatgatggactatggactttggggttctgggcttcagctggctctgctgctctggcattgattttgtttctttgtggcacacgaaggtatagatactttaagcctaatggaaaccctcttcctagattttgccaagtttttgtggctgctacaagaaaatggaaggccaaggtgctacaagatgataaactttacgaggttgatgaattctcaaccaatgaagggagaaaaatgctccacaccgaaggattcaggttcttagacaaagcagcatttatcacatcaaagaatttcaaacaaatggaagagagtaaatgcagtccatggtatctatccactgtgacacaagtagaagaagtgaaatgcatactaagactactcccaatttggctatgcaccatattgtactcagttgtttttgctcaaatggcgtcactttttgtggagcaaggtgatgccatggacaccagaatttcaaggttccacattcctccagcaagcatgtccacctttgacattctaagtgtagctgttgtcatcttcatttataggcgagttctcgaccctctcgtggctagaacaatgaaatcaaaaggactcactgagcttcaaaggatgggaattggcctagtcctagcaattatggccatggtctcagcaggattggtagaacactttaggctaaagaatgcaatagaagattgcaatgaatgtgaagggtctagttcgctttccatattttggcaagtgccacaatatgtgcttgtgggagcatcagaggttttcatgtatgtgggtcaattagagttcttcaatgcacaaacacctgatggattaaagagctttggtagtgcactttgcatgacttcaatatcactaggaaactacgttagtagcttgcttgttgcaattgtgatgaagatttctgccactgatgagatgccaggatggatcccaggaaacttgaacaaaggacatttggatatgttttacttcctcttagcagcactcactgcagcagaccttgtaatttatgtactaatggctaggtggtataaatatatcaaatttcaagggaacaatgataatggcatcaacaaagaagaccctgaagtaggactgtag

SEQ ID NO: 64012 - DNA, 898 bp, Glycine max
  Peptide Sequence Number=SeqID_180790
atgtcggaggcaaaagacccggcgatcaagctcttcgggaagacgatcccggtgccggagattctgccgggatccaacggagctccggcttcgtcttccggtgatgttgttgttgatgacagtgttgacgcttcttccaccaactcttcaagggagtctcataccaacacagatgcacaagagaaagattttgataaggacacattgggagaaaaaccaactgatgacaagaaggaagatggagcccccgcccaatcatcagaagaggtcgccaatccagatactgcctctggaacctgtgaagaatccatcatccagtccaccgagagggaggctactacattgaaaactacaaagactgaagaagaacagggcgagacaagtaattcacaggacaagaacctcaaaaaaccagacaaaatactaccttgtcctcgctgtaatagcatggacaccaagttctgctattataataattacaatgtcaaccaaccccgccacttctgcaagaattgccagagatactggactgctggggggaccatgaggaacgttcctgtaggtgctggtcgcaggaagaacaagagcgtggcttctcactatcgccagattactgtttctgaagcagcccttcagaatcctagaacggacttgccaaatggagcatatcatccttccttgaagtgcaatggtacggtccttacatttggaactgatacacccttgtgtgagtcaatggcatctgttttgaaccttgctgataaaaccatgcacaattacacaagaaatggatttcataaacctgaggaactaagaattcctgtttcccatgccagtggagaaaaaggggatgatcaatctaataaatcttcggttacctccacaacatctgtagaag

SEQ ID NO: 64013 - DNA, 1776 bp, Glycine max
  Peptide Sequence Number=SeqID_180791
atggagttgtttgaaatattggaacttgaacatgatggttttgatgtgggtggtagcacttatgatgctctggtgagtgcttgtgttggtttgagatcaattagaggtgtcaagagggtgttcaattacatggttaatagtgggtttgagcctgatttgtatgtgatgaacagggtcttgtttgtgcatgtgaaatgtggcctcatgctcgatgcacgcaagctgtttgatgagatgccggagaaagatatggcttcatggatgaccatgatcggtggattcgtggactctgggaatttctctgaagcttttgggttgtttctgtgtatgtgggaggagtttaatgatggaagatctcgcacgtttaccaccatgattcgggcgtcggctggattgggtcttgttcaggtgggaaggcaaattcattcatgtgctttgaaaagaggggtcggcgatgatacttttgtgtcttgtgcgctgattgacatgtacagcaagtgtggtagcattgaagatgctcattgtgtttttgatcaaatgccagagaagaccactgtgggatggaactccattattgctagctatgcacttcatggttatagtgaggaagctcttagtttctactatgaaatgcgtgatagtggtgctaaaatagatcattttactatttcgattgtgataagaatttgcgcaagattggcatcattagaatatgcaaaacaagctcatgctgctttagttcgtcgcggttatgacacagatatagtggcaaacaccgcgcttgttgacttctatagcaaatggggcaggatggaagatgcctggcatgttttcaacaggatgcgccgcaagaatgtcatatcttggaatgcactgattgccggatatggtaatcacggtcaaggagaagaggctgtagaaatgtttgagcagatgcttcgagaagggatgattcctaaccatgtcacttttcttgctgtcttatctgcttgcagctattcaggattatcagaacgaggttgggagattttttactctatgagtagagatcacaaggttaagcccagagcaatgcattatgcatgtatggttgaactattaggtcgggaaggcttattagatgaggcttatgaactaattagaagtgctcctttcaaaccaacaacaaacatgtgggcaacattgctgacggcatgcagaatgcacgagaatttagaactgggaaagttagcagccgaaaatctttacgggatggagcctgaaaagctgtgtaattatatagtgcttctgaatctatacaacagttctggcaaattgaaggaagctgctggtgttttacagaccttaaagaggaagggtttaagaatgcttccagcttgtacctggattgaagtcaagaaacagtcatatgccttcctttgtggagataaatctcattcccaaacaaaggaaatatatgaaaaagtgaacaacatgatggttgagatatctaggcatggttatgttgaggagaataaagctttgcttcctgatgtggatgaagaggaacagcgcattctcaaataccatagtgaaaaattggctatagcttttggacttatcaacactccacattggacacctttgcaaattactcagggccatcatttcaccattttagagatggtagttgctcttgtggcgattattggtgatgataaaattgtgtcattcaagtcacagtcctttatactgagtagcctgttgttagctcaccttagcctcacatttgattag

SEQ ID NO: 64014 - DNA, 885 bp, Glycine max
  Peptide Sequence Number=SeqID_180792
atgaacaagagtcgcaaccagcgttgtgaaaaggagctattgtcgcgggtggtaggtacatcacgagttgaatggtttctcaaggaggaaggtgttacgattaggcgggttgaatggtttctcaaggagagaagtgttgcggttaggaaagaaggggcgcaccccggatctccgattctctggatcactcccaagttctcatcttttttgtttttggcgaagtgggtcgttgttgaatacgtggtttctgatccagtctccctctgcaactcctccgttgaccaatccatggcaaattccctcgatccgaaatcgaggcacaggaaaacccccaatttcctcccgtctccaccgtgccagcgatcccggtcggctgtggttgacgtcgtgatttttgcagcggttatcgcggcttttgggttcttgttgttcccctatgctcaaattgtggccagtgagagtgtcaaaattggtgttgtgattgtgaatttggtcgaagaggaggcttctgttgccccttggatttacatgtttattggtgtcagtgttacctttgcagcattgactacttgggttctcgtggcttgcacaacaaggaagtgtgggaaccccaattgcaagggtctaaggaaggctgcagagtttgacattcagttggagactgaggattgtgtgaagaattcaccttcattgacaaagggtggtggggttaagaagggactgttcaaggttccttgtgatcatcaccgcgaacttgaggctgagcttaagaagatggcaccccccaatggaagggccattcttgtcctcaggggaaggtgtggttgttctgttggtaggctggaggttccgagaccaaagaagaatagaaagatcaagaagtag

SEQ ID NO: 64015 - DNA, 255 bp, Glycine max
  Peptide Sequence Number=SeqID_180793
atgtttagattcacacggcttaagagaattgctctgaagttcaagctaactaatataatagattttgaaacagttggatgcacaaaagcggactttccagaattctcgcggttctatgattttgttttcttcatgtgtcgcgaaaatggtcaaaagaatattactgtaagcagggcagtaactgcatggaaattagttcttgctgggaggttttcactgcttcatccatggtgtgactttgttgaggtacagtaa

SEQ ID NO: 64016 - DNA, 405 bp, Glycine max
  Peptide Sequence Number=SeqID_180794
acacctaactctggccccaactccccaaccttgggtaaacattcaagagaagactacacattcaaaccaaatgagtcaggtggtgaggatggacacagtaaagaaaacaacaaagaaaagagcctgtgggttccaaaaactttgaggattgatgactcgggagaagcggcaaaaagctctatatgggcgacactggggattaaaaatgacaaggctgactcagttcctgggggaacactctttaaagccttcccttcaaagcatgatgacaaaaaccattcaatgcaatcctcgcgggtcttgctggccaatccagcagcattgtctaggtgcagcaaactgatttggcagtgttcaaccggtcctgagggaaacacaagttgtaaagtcacattggttcactag

SEQ ID NO: 64017 - DNA, 210 bp, Glycine max
  Peptide Sequence Number=SeqID_180795
atggaaaaccagtccccatcattaaaaactgctgaagtagatgtcccccttcatttaattggctttgagattcaagacttgtctccacaaagggtatgggaggtgaaaatttggaagcttgatccttcaaactcagcaaagaaatctctgatatcatcatcaaggcttactctacggaacaacatgcctcaaattgtacaccatgcatga

SEQ ID NO: 64018 - DNA, 2034 bp, Glycine max
  Peptide Sequence Number=SeqID_180796
atggtgtgtgtgttttcaaggtacctgccatcccttgaagagcttggtaagcttttgaaactctgtgctgatgtcaaatggcttccctttggcaaagccatgcatgcccagtttctgatccgcaaccaaacatcaaaccactctcacatcagtcacctcaactccctcgtccatctgtatgtcaaatgtggccaactaggtcttgctcgaaacctgtttgatgcaatgccccttagaaatgtggtttcttggaatgttttgatggcagggtatctgcatggtgggaaccacttggaagtccttgtgctcttcaaaaacatggtttcattgcaaaatgcatgccccaatgagtatgtgttcaccactgctctttctgcttgttctcatggtgggagagtcaaggaagggatgcagtgtcatggacttttgttcaagtttgggttggtgtgtcatcagtatgtgaagagtgcgcttgttcacatgtactcaaggtgctctcatgtggagttagccttgcaggttttggatacagtgcctggtgagcatgtcaatgatatcttttcttataactcagtcttgaatgcacttgtggaatctgggcgtggggaagaggctgtggaagttttgaggaggatggtggatgaatgtgtggcatgggatcatgttacatatgtcggtgtcatggggctttgtgctcagattagagatttgcaattgggtttgcgagtccatgcccggttgttgagaggtggtttgatgtttgatgagtttgttggtagcatgctgatagacatgtatgggaaatgtggtgaagttttgaatgcaaggaatgtttttgacggcttgcaaaacaggaatgtggttgtgtggacagccctcatgactgcgtacttgcaaaatggatactttgaggagagtttgaatctgtttacatgtatggatcgagaaggtatagcagcacttagacatggtgatctattacatgctagggttgagaagttaggctttaagaatcatgtcattgtaaggaatgctctgataaatatgtattccaagagcggcagcattgattcttcatataatgtgttcacagatatgatatatcgagatattatcacttggaatgccatgatatgtgggtattcccatcatgggcttggtaaacaggctttacaagtgttccaagacatggtctctgctgaagaatgtccaaattatgtaacctttatcggggttctttctgcttattctcacttgggtcttgtaaaagaagggttttactatttgaatcatctaatgagaaattttaagattgagccaggattggagcactacacctgtatggttgcacttttgagcagggctggtttgcttgatgaagctgagaacttcatgaagacaactcaggtgaagtgggatgttgttgcctggcgaactttgcttaatgcatgccatgttcatcgaaattatgatttgggaagacgaattgcagaatctgtcttacagatggatcctcatgatgtagggacatatacattgttgtcaaatatgtatgccaaggcaagaaggtgggatggagttgtgacaattcggaaactgatgagggaaagaaacattaagaaggaacctggagcaagttggctggatataagaaatgatatccatgtttttctttcagaaggaagcaatcatccagaatctattcaaatttataagaaggtccaacaattgttggcattgattaaaccactgggatatgtgccaaatattgcctctgtgctgcatgatgtggaagatgagcaaaaagaaggttatcttagttatcacagtgagaagctggccttagcatatggccttatgaaaataccttcgccagcacccattcgtataataaaaaaccttcggatgtgtgatgattgccacactgcagtaaaactaatatcaaaagtcactaacaggctgataattgtcagagatgctaaccgttttcatcattttcgagatggatcctgtacttgtctagaccattggtag

SEQ ID NO: 64019 - DNA, 360 bp, Glycine max
  Peptide Sequence Number=SeqID_180797
atggaatcatcatcatcaaagactactgctgaagtagatgtcacccttcatttttttggctttgagcttcaacacttatctccacaatggacatatccatttaaggagttgcatggaggggtatcagcactgattgcagaatctttgacaagcatgggagcccacatagctagtggataccaaagagtggctgggattcaactcagcatcaaccatttgaaaagtgttgcgcttggtgactttctctatgctgaagctatccctttaaacgttggcagatccattcagaataatctttttatttggcgaggtgtaaattgggagataaattcagtgggggatcttgcccaaagattttga

SEQ ID NO: 64020 - DNA, 324 bp, Glycine max
  Peptide Sequence Number=SeqID_180798
atgactcttctagaaggaaaaatcttacaaaacacctttttcagagaaggagaaggaagaaaagaggaaagaaggaagaaggagacacttaccttcacagaagaaggaggaaggaggatgagggaatgcaagaatgagggggtggggggaaagaggagtcgccctaagaggaatgggtgtcattgttgtgagtatgtcaccgaagaaaggatgctgtcatgggagatgccatcacaagttgagagaaggaaaaagggaggtgttagcattgagaaacgagagatgaaaatttcattaaagatattgttgtactttactgaataa

SEQ ID NO: 64021 - DNA, 393 bp, Glycine max
  Peptide Sequence Number=SeqID_180799
atgttctactaccatgatttggaccttatcatcaaggttttcttactcactttgaccgtaattacggctgcggctatgaccagtaatttaaaagggagaaaaggtggaatcaggttcaccatcaatggccactcttacttcaatttagtccttgtaaccaatgttggaggtgctggtgatgtgcattctgtgtccatcaaaggttcaagaactagatggcaagccatgtcaaggaactgggggcaaaactggcaaagcaattcctacttgaatggtcagagtctttcctttgtagtcaccaccagcaatggacacagtgtggtgtcatacaatgttgccccagctggttggtcctttgggcagacctacactggaaggcagttcaactactaa

SEQ ID NO: 64022 - DNA, 849 bp, Glycine max
  Peptide Sequence Number=SeqID_180800
atgcttcctgttaattataccgctattgagggggcagtacagactgctgtaggccctgatgggaagaggaaagaacctgagagcaatgtgcttttggcttccattgaaaatatgcagtatgctgttactgttgatgtcctccacacggtgttctctgcatttggtactgtccagaaaattgctatatttgaaaagaatggtcaaactcaggcactaattcagtaccctgatatcataacggcatcagctgctagagaagctctagaggggcattgcatatatgatggtggctattgtaagcttcatctatcatactctcgtcatactgatctcaatgtaaaggctttcagtgacaaaagtagagattatacagtgccggatcctagtctgcttgcagcacaaggtccaccaacagcttggcaaaatcctcaggctgcatctatgtaccctggtagtgcccctgcttatcatactcaagttcccggcggacaagtgccatcatgggatccatccctgcaggcagttagaccgagttatgcatcggcacctggtacttttcctgttcaaactggtgcagctcctccaatgccgtcctatgcgccagcatcagctatgcctgttgcttcctcacctcatgcacaaagcagccccatggctcataatgcaaatccaatgggaattgctcagctcggggttccacccaatgtaaatttacagtccagtggtgcttcactttcagcgcctggttcctcacctctcatgcaaaccagtcaggctgctcaaggattgcttcagccaaatgcaagacctggtggtgcttcaccttcaggtcaacattattatggttag

SEQ ID NO: 64023 - DNA, 1206 bp, Glycine max
  Peptide Sequence Number=SeqID_180801
atggcggcaggatcaggtgacggagctgaaatgatgacgttagcgctttataaaagaccccttattatcctgacgctgtttttggccagcgcgctgggcgtctatttcctcgcccctgaacaacgctatgcgcagtggcaatggacccagagcgacgaggccttgccgacgatagcccgttacgatctcatccacagctacccggcgcaggacggcgctctgctgctcatcagcaaaaggagtgagcgcggggcctacaatagcttttacggctgggcggccaactatctcagccaggtgttgttcagcggcccgcagggattgcagatgctgggggaactcgacgagtctatccacgatgcggtttgcggcgggcaagagtgcgtgctttttctgtccaaggggcgccggctggtcgatgtgaaacagggcaccatcggggcactgatcccctggccggagggcgacgacaaccggccttcctttatcggcggcaaactggtggcgctgccgggtaaacgcgcgctgtatctcatcagcaccgaaggcgtattctacagcccggactttggcgcccattggcggcaaacgctcgatctgccggcgctgttggaagcgcgtcagctgctgggttttgagcgcggcgaggaggactcaccgacggcttacgcctccggcaagcgcaaatccatacccgagatctttaccgccgttgacggcgatcgcgtgctgttctggatgaatccggtgctcggctccggcgccttgcacatcgccgttaacggcaaaaccggcgaggtggccgaaccgcattggctcacggtgcgcgtgacggaaagcgcgcaggccccggatggcggcatctacctgatcgcacagacgctggaaagagggctgtatcagctcctgcgttatcaatccgacgggcagttgaaggtactgctggagaccggcgataaatcgctgtatcagctgtgggcaggcaacgacaagctagtcacccaaacggataacggcgatgcgcgcctttcgctgattttcgatctgcgctcatccgacgtgcgctaccgccagccgttggagtatcgctacaacgggcgcgacgacgcacgccaaaccgtgatcgaaccggaaagccactatggcgatgacggggagcccccggcgctgccctacttcgttcgctaccgttccaccacgccgtga

SEQ ID NO: 64024 - DNA, 1273 bp, Glycine max
  Peptide Sequence Number=SeqID_180802
atgccgctgtcgtttatgaatatgccgctggtgagctacgccagcgaaattactatcccgacgcttatcgtgaccggtgaaaaagcccattcacgctattttgccgaagatgcttataaggcggtcggcagtaaagaaaaagagctggtgattgtccccggtgcaaatcatgtggacctccaaacaccatcacagaataatcagcccgcttactggagcggcatttttgccatgaccctgtgcgtctttgtgctgattgcatcggaatttatgcccgtcagcatgcttacgccgattgcccgtgatttagacgtgacggaggggctggcgggacagggaattgccatctccggcgcgctggccgtcctgaccagcctgacgctttcgacgttggctggaaatgtgaatcgcaagtacttactgctggggatgacgattctgatggccgtgtcggggctcgttatcgcactggcttccaactatctgatgtatatggcaggccgcgcgatgataggtattgcgatcggtggattctggtcgatgtctgcggcaacggcaattcgtctggtgccacagcatcaggttacgcgtgcgctggctattttcaacgccggcaatgcgctggcgacggtagtggcagcgccgctgggtagctatcttggagcgaccatcggatggcgaggcgctttcttgtgcctggtccccgtcgcggccgcggcctttatctggcagtgcgtgagtctgccgggtatgaacggcaataataaccctgcgtcacgcggatccgtattgcgcctgttcagtcgccctgttgtctccattggcatgctggcttgtggcctgttctttatggggcagtttgcgttatttacctatgtgcgtccgtttctggagttggtgacgcgggttgatttctctggcttgtcgctaattttactggttatcggtgtggccggttttattggcacgctggttgtcccggcattcctcaataggaaattctatctaacgctgatggccattcctgggctgatggctgtcattgccatcgccctgattcttgccgggcatcacgtttgggctgtctcgttgctgttaggcctctggggcatgctggcaaccgccgcgccaacgggatggtggacatggattacacgcacgctgcccgaggatgcggaagccggaggcggcctgatggttgcggtgattcagctctcgattgcccttggttcaacggcaggtggcatgatgtttgacagcctgggatggcgaa

SEQ ID NO: 64025 - DNA, 749 bp, Glycine max
  Peptide Sequence Number=SeqID_180803
atggagtgtgctaggaggctttttgatgaggctcctatgaaggatgttgttagttggaatgcaatggttggtggttatgtgcttcacaacttgaaccaggaggcattggagctgtttgatgagatgtgtgaagttggggagtgccctgatgaggtgcatgccaagatcatggagttgaacaaggggaagttgagcacacttttggggaatgctcttgttgatatgtacgccaagtgtggaaatattgggaaaggagtttgtgtgttttggttgataagagataaagacatggtctcgtggaactcggtcattggtgggttggcctttcatggccatgctgaggaatcacttggtctgtttagggaaatgcagaggactaaggtttgtccagatgagatcacctttgttggtgttttggcagcttgtagtcatactgggaatgttgatgaggcgcgtgctggacttttgaaggaagcgtttgatttcatagcctccatgaagattgaacctaatgctattgtttggaggagtctgcttggagcttgcaaagtccatggagatgtggagttggcaaaacgagcaactgagcagttgcttagaatgagagttgaccaaagtggggactatgtattgctgtcaaatgtatatgcatcacatggtgaatgggatggggccgagaatgtaaggaagttaatggacgacaatggtgtgaccaaaactcgtggctctagctttgttgaggcatacag

SEQ ID NO: 64026 - DNA, 489 bp, Glycine max
  Peptide Sequence Number=SeqID_180804
atgatcagaaaaagaagaggcagaagcaccattacgaaccttggaaccctcagacagattcacgctttaatgatcgttaacggtttcacttccaacgttggtttcctccgaaaactcgtcctcaccaccgccatgtcaatggtgggccccgctgcaaccaccgccgtgacacaatatgcagtccagatgttcgctcaaattccccaaccagacaccttcatgtggaacacctacatcagaggctcttctcagagccatgatcccgtgcacgcggttgcactgtatgcccagatgacccaccgttctgtgaagcctgataatttcactttccctcttgttctcaaggcttgcaccaagctcttctgggtcaacaccggttccgtggttcatggccgggtttttaggcttggtttcggttcaaatgtggttgtgaggaacacccttttagtttttcatgctaaatgtggagactttgaaggttgcaaatga

SEQ ID NO: 64027 - DNA, 1173 bp, Glycine max
  Peptide Sequence Number=SeqID_180805
atgggaagatcaccatgctgtgacaaggtgggtttaaagaagggaccgtggacgccagaggaagatcagaagctcttggcttatattgaagaacatggccatggaagctggcgtgctttgccagcaaaagctggacttcagaggtgtggcaaaagttgcaggttgagatggactaattatctaaggcctgatattaagaggggaaagttcagcatgcaagaggagcaaaccatcattcaactccatgcactattagggaacaggtggtcttcaatagctacacatttgccaaagagaacagataatgagatcaagaactactggaacactcatcttaagaaaaggttagacaaaatgggcattgaccctgtgacccacaagcccaagaacgatgcccttctctccaccgagggcccttccaagattgctgccaacatcagccacatggctcagtgggagagtgccaggctcgaagcagaagcaagattggccagagaatcaaaactacgtagttcttcacactcatcatcatcatcattacaccacaccctaattggcacttctgcatcatcatcatcatcactttctcttgatcatgcttggaaaaatggtggtagtactattactataactgttaatgcaactagggttagtgaccttgagtcccccacgtctaccttatctgagaacaatgtgccaccaattaataatattactagtactgtgattgagtttgtgggttcttcagagagaaggacggtgaaggaagagggagatcaagagtggaacaaattaggttatcatgaaagctccacccatttgggagagtacaaagatggcatggagaactcaatgcctttcacgtctagtctacatgagttgacaatgaccatggcaaccacgtggggttctagtactagtagtgcacatgaacacgcacatgttgctgaggagggttgtttcaccaatcttttgctgaatactaactctggcggccacctgagtttgtcacccgaggacggtggagagtctaattattgtcacaataatgctggtagtagtgacgctggtagtggtaacaacggtgacttgtaccaagagaacaagaattattggaataacattcttaatttgatgaattattcttccccttcggattcaccaatgttctga

SEQ ID NO: 64028 - DNA, 1131 bp, Glycine max
  Peptide Sequence Number=SeqID_180806
atggagaacgtttccaaaccaaggaaggaaaaccagaagtttgaattgccagcgggttttagatttcatccaagggatgaagaactcataaatcactaccttacaaagaaggttgttgacaactgtttctgtgctgtggccattgctgaggttgatttgaacaagtgtgagccatgggatttgcctgggttggctaaaatgggtgaaactgagtggtattttttctgtgtgagggacagaaaatacccaactggtttaaggactaatagggccactgatgctggttattggaaggccacaggcaaagacagggagatcataatggagaatgcactcattgggatgaagaaaaccttggttttctacaagggaagagctcctaaaggtgaaaagacaaactgggttatgcatgaatataggttggaagggaaacataatcaacccaatcctggaaagaaaaacttagctatgtatcatatggagattgaccgacaccatgatcagagtgaatgggtgatttgtagagtctttgagaagagtccttgtgggaagaaaatgcatgttctaaagtgtggaaggctcaacaactcctctggagaggaaccatcatcatgtgcttctctattgcctcctttgatagattcttctccatacaacagtgaaacaagaaccaccactgctggtgagttgtctcagttgacatgcttctctgatccaaatcaaactgaggatcagaacaacacacatgatgacattgttgatagcatggaaactcctattttgaacttctcaccctcttcaagacctgatgatgcatccactttggccaaagcaaccctttcttcagcttcaaaccaatcagcacagattgcccaccaaattgggaactcacagttcccagattattatcatgtgcctcaagaacagtccatgttgaggatgctgatggaaaaacaaggaccaattgcaaaccaaattcagaaaccagagttttctgagggaagagactttgatgctgatatctcatctatgatctacaacaatgacatgatgcacagaatgtttgggaatcaagaacattcttcagcttctgcagggcccgtggatactgatttcctatggaattactga

SEQ ID NO: 64029 - DNA, 705 bp, Glycine max
  Peptide Sequence Number=SeqID_180807
atggtgttgttattgtctgcttgtgctgagttggggtacttgagcttgggaaggtgggttcattcccaattggttttgagagggatggttcttagtgttcagttgggaactgctcttgttgacatgtatgggaagtctggggctttgggttatgcaagggctgtttttgagagaatggaaaagaggaatgtgtggacatggagtgcaatgatattgggattggctccacatggccgggtttcccatgctggaatggtgaatgaggattacaagtattttcatgacatggaatgtgtccatgggatcaagaccctgatgatgcattatggagccatggttgatgtgttgggtcgcgctgcccgtcttgaagaagcttacgagtttatacagagcatgcctattgagcctgacccggttgtgtggagaacgctgcttagtgcatgcactgttcatgatgtgcatgacatacaggggggaggcaatttagttattgttgctaacatgtttgctgaagtggagatgtgggagaaagcggctaatgtgggccatgagagtggagggatgaagaaggtggctggggagagttgtgctgatttaggtggctccatgcataggttctttgcagggtatgatccttgcccagatttggttcctgtctatcatctgctagatggattcaacctgcacttgaagatggttaactga

SEQ ID NO: 64030 - DNA, 456 bp, Glycine max
  Peptide Sequence Number=SeqID_180808
atgccaatctcccctgcagatgtatcagttggtctgtgccgtcatgacataggtaaggatcgcacccacaaagacactcagtggacccggagaagtccaacaggacccttgggtttccagctctggttacgggcctctgtagtcctacagggtgctcgttccccccggcaaggtcacggatcgcgcctgcaagacacccagtggacccgaagaagtccaacaaggtcttggagttgtcaagctctaattacgagtctctgtcagttctacggagtgtctgtcacctccagcaaggtcatcaggccccttactaatcgagctttcatcaagaagtactgcgtccccaggcaggcgcagggcgaaacaccacagcggcctggggatagccgacagcgggcaacacacgcaccgccatcacctctagagttcacctcagctcatccacaaaaaggttag

SEQ ID NO: 64031 - DNA, 615 bp, Glycine max
  Peptide Sequence Number=SeqID_180809
atgagcggctggtggacggcaaccgcatctgcaatgagctgggttttgagtatcagtatcccgatccggcgcgcatgccggtcagctaacgtccgtcaggccccgcgcatgcggggcttttttttcgccggcgcgcgccaaatcctccagcagcgcgttcaacgcctcgtcgggctggacggggcggctgaccaggctgagcgtggcgcggtaagagagcgccgtgccgcccagctgccgcagcagcccctgttccacccagcgcgccgcgtagtgggtgggcagatagccgagacaagtgccgctcagcaccagatgggcgacgctttccatatggtgggccaccgccgccaggtgaggcggcgcgatcgggcacaactgctgcgccagcaggtagccgcgcttgacccagcgcgcgttttcaatctgctcgcgctccgtagatcgcctgcgtctcctccagccacggctgataacgcaacgcctccaactgctggccaaagtagccgatgcccagatcgagctgccggtgcagcagcccttgctcaatctcgttcggcgaacagatgcggcactgcaattgcacgtcctggtggcggcgctggaagtgtttga

SEQ ID NO: 64032 - DNA, 306 bp, Glycine max
  Peptide Sequence Number=SeqID_180810
atgaccaaattttgtttctgcgtgtcatcgggcccgccgcctgtggatgacaaaagggtgcggatgaccgtaaagtttgtctctgcgtgtcatcgggcccgccgcctctggatgacacaagggtgcagaatgaccgtattttgtctccgcgtgtcattgggcccgccgcctctggatgacacaagggtgcagaatgaccaaattttgtctttgcgtgtcatcgggcccgccgcctctggacgacaaaagggtgcggataaccgtaaggtatctccgcgtgtcatcgggcccgccgcctctggatga

SEQ ID NO: 64033 - DNA, 878 bp, Glycine max
  misc_feature (751)..(751): n is a, c, g, or t
  Peptide Sequence Number=SeqID_180811
gaacaatgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggaggtgagactggacaacatcttcatcaacgattgtaaactatttgtcaaccttcctaggttcgacagaccagttcggaatacagagttgcagaaaaagaaccccattgggaggaagtacaccgacgaagcaagtaagccctgcggggacagacgaggcacaaaaccaactattctgatcaacccagatgaaggcggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctaaactcctcattcaatcagagacggaaagcgacgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgatgacacagaggaccgncgacgattggaccgggctcgagtattggtgcagacaccgcttccgccgttgataaggtcagaggtcatcgtccgtgtgggggagcttgagtatcgggtatggattgtggaagagacagggttcgaag

SEQ ID NO: 64034 - DNA, 522 bp, Glycine max
  Peptide Sequence Number=SeqID_180812
atgaccaccgttacccagatgtggatgacgttgctactcaacaacgtcttgcccagcgatcataactccgacctccctctgccgaagtgtcagctggtgattcgaccgccgatcacccgggccttcattgagaagtattgcacgcctagacaggtgcagggggatgcacctcaggatgcagacgcaccactaccacctcatcaggtcgatcccgctgggtcactaggcatggagcattatctacagcacttggttcgccagcaggcgaccaaccaccgggggcaggtacagatacatgagtgtctctaccgcttcagccttagtcagcaagggcagggtttcgctccttttgcatgccctactctagagcagtttagggctgaggttgcgtggcccggagattggcccgaggcccaggcaggggaggcgcctgcaggatccccgggcgatgcagaggaggcccgcatggatgaggagatgacggatttgctcggtttcttgggagggagcggagccacatga

SEQ ID NO: 64035 - DNA, 183 bp, Glycine max
  Peptide Sequence Number=SeqID_180813
atgattcctccacccgggattgtacctgttgctggagagcataagcttcaggctgttcaattgcttcagattgttgcacagaagggcaaaggtctgtgtggtggtcggcagaggagcataaaccacagagtctggcggcatgtgcagatttttgattcatggccagttgggttaccaggttaa

SEQ ID NO: 64036 - DNA, 402 bp, Glycine max
  Peptide Sequence Number=SeqID_180814
atgaatgccggagccctcatttctgggcagattacttctatggcccagtctaactcctcaagactcaagtttcctgctcttatcacagctttatgcaggaccagaggagttgcctccaatagtcttgtctttgaacgtctgagcccgatcattaatttggcctacataactcctcctccagcgcgtattgcagcagctccttctaccccacctcctacagattttcagcatttcaaagccatgcttcgaagcatacatcaggggaaaattattttgctgcaaagtctccagctgatagcacctccagactccatccctacagtagagcaatttaatgaatgggtagcctggtcagggactcagcctcctcctcacagggacgacgaggatcccgccgctcag

SEQ ID NO: 64037 - DNA, 357 bp, Glycine max
  Peptide Sequence Number=SeqID_180815
atgtcggactcagccaacaagttgcgattggtgcgttgcccaaagtgtcaaaatcttcttctcgaactcgttgattactctgtctatcaatgtggtggctgtggtgccgttcttcgagcgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcaaggtgtttcagaaccaaccagaggatactggtattgtcagcagccaaagttgccaaaaagatgaagctaaaatttactaaagaatga

SEQ ID NO: 64038 - DNA, 243 bp, Glycine max
  Peptide Sequence Number=SeqID_180816
atgggctttattaggcttgtaacgtggttaggggtaagagggctatggaagaacggattagagaggctcaaagagtgtttgagggttatattgagtaagaaccttgagagtctagtggaagcaatgtcttccaaggttattttgatgatgccaaagaatcaagagtcaagaaaattccaaagattcaagaatcaagtttcaagattcaagaatcaagtttcaagaatcaagattcaagaataa

SEQ ID NO: 64039 - DNA, 231 bp, Glycine max
  Peptide Sequence Number=SeqID_180817
atgcaaatagaaattttcaaaattttgaatttgtgccttccagagcattttcgatgcagggttgcttctggagtaagcaacccagctcgcctaggcgagctgggcgaaaatccaagccgaggtgcttccgtaacgcttccgagatgtttcagtgagcaaatccgtgaaggttttccgtcgttcctcaccgttcttcatcgttcttcatcgttcttcggtcttcaaccttaa

SEQ ID NO: 64040 - DNA, 483 bp, Glycine max
  Peptide Sequence Number=SeqID_180818
atggcagacaacacacgcatgaaggagcttacaggggatgtcaaaaggatcctgaagatgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttacgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggacgattaaaacctaatatcagaatggatgtcattgcgcaatcacctacatcactcctcaaaaca

SEQ ID NO: 64041 - DNA, 904 bp, Glycine max
  Peptide Sequence Number=SeqID_180819
caaggttgcggctgtgattggagattcagcaaaagagttggatcgcatgaagcaaattcggaacggcgtagtgggcctgcctcggaaatacttggaagacaaggcaagggatatggcgagccaagagaagtggggcccgtttgcggatgttttagctttgctgatttttggggttgtcctctttccgaacgttgacggcttggtagacttagtcgccattgatgctttcctcacatatcaccatagcaaggaaagtccagtggttgctatcttggcagatttgttcgacacctttgaccggagcacgatcaattggtttcctcgttggaaggaaggcaaggaaggagttcttttctcgtgtggggactatcctaatgttccactgatagggactaggggagcgcaaggtctcaaggttatacaaagaatccacaaggcgtggaggagtccgttgaggaaagacaaggagcttagaagcatccgaaacggcgtcatcggaggttatcatggatggctaagaattcacacgcggggcttagattggctctccaaattgaaagttatcgatgaggagaactacgaagctccggaggaagatgaagaagtccgagatctaaagttagagctagggaaagcgagactcgccaaggagaagttcaaatcagctgctacacacatccggatggagtgcaccgagttacaagaggaaaacgcggccactgcaagagcccttgaacaagaaaccaagagggcccgcaaggaggaatatggtcgagagaaattccgaggagcattgtggggtagtaacaatgagctcaagctccgaagagaggagagagatcggtcgcgggtccaaaaggagtttggctcaacacttggaagcaacggagcaaagcatgctagg

SEQ ID NO: 64042 - DNA, 744 bp, Glycine max
  Peptide Sequence Number=SeqID_180820
atgtttgttcgcgtgagtgtggtggaagttattttcggtgatgcggaggttccaatccctacatcagaaataaagtttgtcaaagaagctttaggtagttttgttccatggccaacacatttggtcaaacccatcttgcctgaggaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacaactatggcttatgtttattcatgattggagtgcgagcattggttatggaccattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctaccatcaagggtgcagtaaacagtgcaatgaaatcagtcaccaaaactgcagagggaaagccacctcagcatgggcctcagtggattgaagcaaag

SEQ ID NO: 64043 - DNA, 300 bp, Glycine max
  Peptide Sequence Number=SeqID_180821
atggaagacgcacccgtgagcctcgcctcgctcgcccgcaaaaagggtaggttgcgacagttggcgactccactagggattgttttgggggtacaaatagcagtcaggcccacttgggccttccagtttcttcctccagaaggaggttgcttctggaagaagcaaccatgctcgcctgggcgagctgggagtaaagaggaaaggggttcagccttcttggcacttctgattctcacgaaattgctgaggaaaattgtttccgtgaagaaaatccaagccaaggcgcttccccttcaactg

SEQ ID NO: 64044 - DNA, 618 bp, Glycine max
  Peptide Sequence Number=SeqID_180822
atgtgtagtcctctgaaggcgaagacatgtagtcctctgaaggcgagggcgtgtagccctctaaaggcgagggcgtgtagccctctgaaggtgagggcgtgtagccctacgaaggggaggacatgtagccctctaaaggcgaggacgtgtagtcctctgaaggtgaggatgtgtagccctctgaaggggatggcgtgtagctctctaaaggcgagggcgtgcagccctccgaaggcgaggatgtatagccctctaaaggcgagggcgtgtagccctctgaaggcgaggacgcatagtcctctgaaggtgatggcgtgtagcactctgaagccgagggcgtgtagtcctcagaaggtgaggatgtgtggtcctctaaaggcgagggcgtgtagccctctgaacgcgagtacgagtattcctctaaaggtgaggacgtgcagtcctctgaaggcaaggacgtgtagtcctttgaaggggaggacgtatagccctctgaaagcgaggacgtgtagtcctcaaaaggcgagggcatgcagtcctctgaaggcgagggcgtatagccctttgatggcgaggacgtgtagtcctctgaaggtgagggcgtgtagccctctgtag

SEQ ID NO: 64045 - DNA, 729 bp, Glycine max
  misc_feature (510)..(510): n is a, c, g, or t
  Peptide Sequence Number=SeqID_180823
atgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaagccagtaacaacatctantcatggatatttgaacccgagtatccaggaaaaagcaaaatctttgatggaagaacagggaattcttttaaacagcctgctataatgggaaaacttatatttgaaattaattcatcaatgttgatgataaaatacatggactgttcccagtggaccattatgcacttgttacacaacaaccacttagaggaagggccaagcagggaggacaacgggtag

SEQ ID NO: 64046 - DNA, 366 bp, Glycine max
  Peptide Sequence Number=SeqID_180824
atggcgatcggcgaactgcaggcgcgcctgcaggcacaggcgggcgaacatgccggcaacctgccggagctgcgcatcgccaccgatccggcggccgagtacgaaggcatggcgcggatgttggctgcggccgaagccactggcatggagcgcattgcgttcgtgcgcgggcgcggtgttctggaagggccagccgctggacgctgccgcgttgcagcggcacctggtgcaggcgcagcagatgccgcagcagcatcgctcctcggtgcatctgcgaccgctgatgacagcgactatgaagatatggcacgcgtgccgctggccgtcagccagcatgagctgcgcttcgaagcgcccggccactag

SEQ ID NO: 64047 - DNA, 195 bp, Glycine max
  Peptide Sequence Number=SeqID_180825
atgacatgcgggggttaccttatggttacccgcacctttcgtcaacaaggggcaaaagagcccattgacgcacaaacactaatatcatcttctgcacgttttatcgtcctgacccgtgaagtcaggggcaaacgagcccgttggcgcgcggagattaacatcgtcctcgacacctttttccgtcttgacccttga

SEQ ID NO: 64048 - DNA, 237 bp, Glycine max
  Peptide Sequence Number=SeqID_180826
atgacaattcacctagcaggagcctttgatttacgctgtagagcatcatcaacaccttttaaagcactgttccaggtagttgatgaagacacaacaaagggcaaggaccatgaagcacttgaagggcccatgaccagaggcatacttaaaaaggcccaacacagtgatgaggacacaactaagggcaaggaccatgaagcacttgaagggcccatgactagaggcagacttaaatag

SEQ ID NO: 64049 - DNA, 252 bp, Glycine max
  Peptide Sequence Number=SeqID_180827
atgcaaagaagatctactgcaggtgatttgattcccattgatttggagattaacgccacctgtagaaggcgtaattcagagagaatcaggaaatttttgcaggatttagaagcagtagcaactcctgaagaagaacctcgatcttccgaggcatcttctagttttcctattgcagggcattctcatatagaacctgttgaagacccaatcatggctaaagagccaagaagagtaaccctggaggattattga

SEQ ID NO: 64050 - DNA, 921 bp, Glycine max
  Peptide Sequence Number=SeqID_180828
atggaggtacttatggcagaacgggccaatctagtctttcacaataaagtgataggtggaactgccattaaacgacttattagcagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatgtacatgcagtagaaaaattacgccaatccattgagatatggtatgctacaagtgaatattttcgacaagaaatgaatcctaattttaggatgaccgacccctttaatccagtccatataatgtccttttcgggagctagaggaaatgcgtctcaaatactgctgtacgaacatcagatgctggatatcttacacgcagacttgttgaagtggttcaacacattggttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacag

SEQ ID NO: 64051 - DNA, 237 bp, Glycine max
  Peptide Sequence Number=SeqID_180829
atgtatattgttgtggtaaagcaggggcaggatcaccttgggctaccttctggagtggagacaaaacacgaacggcagaaaccaatcaaggtacttaaggatgaacgcaatcggggatgggatcacgaccgaccgatcgttgcccttctctgtgcgaagcaagcagggaatgtcgctgcaaggcagccccgtatcctttgtattttgcagctttcttttactatttgtttgttttga

SEQ ID NO: 64052 - DNA, 136 bp, Glycine max
  Peptide Sequence Number=SeqID_180830
ggccctatacccgggttcatgggaacataaggagtggagtccctactgctgcaatatgttcttcgaagaggataatacctctagaaaccatttagagagatatgactaccttgggggggttatcgctaaatgccta

SEQ ID NO: 64053 - DNA, 466 bp, Glycine max
  Peptide Sequence Number=SeqID_180831
atgggatcaagtcaaaagccttcgcttaaaaagaggttctatcaagtcaaaatcaagagcttagaggtcactagtttaggagagttggggcaattaatgggtcaacttcaacgggtagaagtctccatggaaccgattgcatccctttcccagtattatgaccagcccctaaggtgcttcacatttgaggacttccagctagtgctgactgtgaaagagttggaagaaatcctgggatgccaactggggaggaaggaagccatatcttttctttgggttctatccctccacgacaagagttgccaagttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctc

SEQ ID NO: 64054 - DNA, 294 bp, Glycine max
  Peptide Sequence Number=SeqID_180832
atggctccagattcagtgggaaaaatcaaaagtgtagactttggggatcccaatgagtccttggagaacaaacatgtgtggaaccctctaactgccccagaattcacgagtgaaggcaactcttcatcgtccatgttggctagtgatgtaaacccatttgcacaagggttgaagatggatcttcaaaggtttagaaagatgaagaaggagaatgaagaagggggttggaagaatcactcctctggaattggtgtcacagacaaggtggtgttccttgataaaccaatttcttga

SEQ ID NO: 64055 - DNA, 670 bp, Glycine max
  Peptide Sequence Number=SeqID_180833
ggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgaggtcataatcccaacgcacggtagcttcgcgccactggcttttcaaccaagcgcgatgaccaattgtgcgaaggcgggggctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaat

SEQ ID NO: 64056 - DNA, 264 bp, Glycine max
  Peptide Sequence Number=SeqID_180834
atggagagcaggcccgttggtctaatatgttatacccaaacacaagtaggagtaattgggttcaggaatagacgggcacgcaaacgctcagtggtcgcgtgcaaagggatttcgaagcttcggaagaaaaaaatgaaacctgttttctgtggaaacctggatttcgacgcgcgtcaatctgacgtggagaggctcttcagaagatacggcaaagttgatagagttgacatgaaatccggtatatcattcttcatcatcgtctaa

SEQ ID NO: 64057 - DNA, 1002 bp, Glycine max
  Peptide Sequence Number=SeqID_180835
atggctggagctgaagctacaaaatatgcttcttctgctacaagtccaacaaccactgcggcaaacaacatggccaccaaatcgaacaaaccaaccatcagaaggttcattggggtgaggcaaagaccctcaggaaggtgggtggctgagatcaaagactcttctcagcacgtgagattatggcttggaacctatgatactccagaagaggccgcaagggcttatgatgaagcagcacgagctctgagaggtgaaaatgctagaaccaactttgcaccagtgagccaagtcatactgggtcaacaacaatcaggctctaataataacctttcaactgggtctgatattgggaagcatggtttgagctttgcttccttgaaggccaagttgagcaagaatcttcagaacattatggctagggcaagtgatcacaataacaacaacaagtcctcaaagagtagggtgagtgaccacttcacctttgccagcatcttccaccgtaggagctaccaaatccctgaaggggacacgatgaagaacattgacaaagtggtgcagcctagtattattgtgcctcctatggaagctggtggtgttggtgactataattcttctgttgctaattgggaaagtgcttctagtgtctctgattgcagctctgaatgggtaggattcgggaattcgaaactcgggttggagtcggacgggtatgagataggggaggctagtgttggtgatcaagggttcttggagcagttaatggggtggattgaaacccctgatattagtgatcatcaaggtgagggttcaaggagtaagaggttcaaggtgtcttcttctgtgcttgtgccacctactttcactggctcttcttatgattgtggatccccttttagtggttatgcctctccttataataacggttatgcttctccatataacaacggttgtgcctccccttgtaatggttatgcttctccgtattacaataataagaagtga

SEQ ID NO: 64058 - DNA, 219 bp, Glycine max
  Peptide Sequence Number=SeqID_180836
atggctatagagagcaacaactacccaccaacactgcaaaatgtaaatgcaatgcttccaaactcatcaatcaagacacagctggatttatttacttcaaaaccatgcccttcatcgtggaagccagtgtcagcgttgagggagaagtgggagcttatgtttcgtgtgatgaggcttaaaggtctagcaggttcaatgatcgaacggtggagattgtag

SEQ ID NO: 64059 - DNA, 1698 bp, Glycine max
  Peptide Sequence Number=SeqID_180837
atggtggaagcaactcaagttagtaaagataaagatgcggctgcatttgaagcccgttccacagaagactggttgttgcatgcacaggaacttgttcctgttgctcttgctaatgcaagggaggttaaggggtttcctggtaggtggaagatgatcatttcaaaattggagcagattccattacgtttatcggacttgtcgagccacccttgtttctccaggaatgctctttgcaaggagcaattgcaggctgtgtcaaagacacttagagaagccattgaattggctgagttgtgtgtgaaggagaagtacgagggaaagcttcggatgcagagtgatcttgatgcattgattgggaaactggatttgaatttgaaggattgtggtctcttgatcaagacgggggtgcttggtgaagctagtttgccattaaccgtgttaggttctatggcagaatcagatattgcaacacacaacaatataagagaactacttgcacgccttcagattggtcacttggaagcaaagcacaaagccttagacagactctatgatgttatgaaagaggatgagaagaatgttttggctatttttggtaggagcaatgttgctgctttggttcaattgctcacagcaacatctccacggataagggagaagacagttagtgttatatgctctctcgtggagtcgggaagctgtgaaaagtggctagtttctgaaggagttctgccacctcttataaggcttgttgaatctggtagtgctgtgggtaaagagaaggctactgtatctcttcagagattgtcaatgtcagcagaaacaacgcgtgcaattgttggacacggtggtgttcagccattgattgagctttgtcaaaatggtgattctgtgtcacaggctgctgctgcctgtactttgacaaatgtatcagctgttcctgaggtgagacaggctttggctgaagaaggaattgtgagggttatgattaatcttcttaattatggaattttattaggttccaaagagtatgcagcagaatgcttgcagaatctcacttcaagcaatgagcatctgaggaagtctgttgtatcagaaggtggtgttaggagtcttctggcttatcttgatggtccacttccccaagaatccgcagttggagctttgaaaaatctggttggatcagtttccgaggaaactttagtttctcttggtttggttccctgtttggttcacgtgctgaagtctggatcgttgggtgctcaacaagcttctgcgtctatcatctgccgtgtttgcagttcaatggagatgaagaaaatagttggtgaagctgggtgcatccctcttcttataaagatgcttgacgctaaatcaaatactgctagagaggttgctgctcaagcgatttcaagcctaatggttctgtcccagaatcggagagaggttaagaaggatgataaaagtgtgccaaatctggtccagttgctggatccaagtcctcaaaacactgcaaaaaagtatgcagtttcttgccttggatcactttctccgagtaagaaatgtaagaaactgatgatttcttatggagcaatcgggtatctgaagaagcttacagagatggacattgtaggagctaaaaagttacttcagcggttggaaagagggaaattgagaagcttgttcagcagaaagtag

SEQ ID NO: 64060 - DNA, 699 bp, Glycine max
  Peptide Sequence Number=SeqID_180838
atgtttcaacatagaaaccatgatgatttcgcaactgtggcagggtttgcttttgtctacatggaagatgaacgtgatgctgagtatgcaatcagaaggcttgatagaacagaatttggtagaaagggtcgccggattcgtgttgagtggactaagcaagaacgtgacagtagaagatcaggtggtgattccagaaaatcttcatctaattcaagaccatccaaaactttgtttgttataaattttgatcctgttcatgccaggacaagggatctggagagacattttgattcctatgggaaaatattaaatataaggatcagaaggaattttgcttttattcagtttgaatcccaagaggacgctactagagctttggaggccaccaacctgagcaagtttatggaccgtgttatcactgtggagtatgccattagagatgatgatgacagagacagaaggaatggatacagtcctgatagaagaggccatgactctcctgatgggagatatggtcgtggtagatcccctagtccttatcgtagaggtcggggtagcccagattatggtcatggatcaaatccatcttccagaccagatccaagaggaagccccaagtatgaacgagctgaaagcccaataaataatgggagatatgatagccgatctcccccaccccgagaaaggtcgcgatcttga

SEQ ID NO: 64061 - DNA, 3621 bp, Glycine max
  Peptide Sequence Number=SeqID_180839
atgaagagattaacacagatatggcctcccaaaattcctttgcattcctttggcaaactgcatgaattgatcattgacaggtgtaataaacttgaaaatgtttttccttcttatatggtcggaagttttcttagtctatgcgacttgaaggttactaattgcaagtcaatggaaaagatatttgacctcaaaagtgttggaaaacgtcgtgcttggaatatgatcaccagtttgcaaaatgttcatgtaaaagcactgccaaaattggagcatgtatggaatgaagacccaggagggattcttagattcacatatttgaaaaagatatgggttcaagaatgtctcaaattaaaacatatatttccagtttctatagccatgaatcttaaaaatcttgaataccttgaagtctggaattgtgctcagttgaaggaaattgttttcaggggggaaacaatcaaagagagtagcgttctgtttgagtttccaaaactaaccacagccagattctcgaaactgccaaaccttgagagtttctttgggggagcacatgaattacgttgttcaacactgtataacttatccgtggaacattgtcacaagctctggcttttcagaacagaaattgcaaatccagaagaaaagtcagtctttttgcctgaagagttagtgacttcgagaagccttgttaatgacaatttgggggttgttccaatgcttaaaagcttgaaattaatgaacttagcttcacttaagacgataggttttgaagaatacacagtgctatttcgaatgttagaatgcttgattttaaagcactgtccatgtctgaatagcatagcgtcttcctcagtatctttcacttacttgacaaatctggaagtaagtaattgtaataaattaagctatttattgacaccaccaactgcaaaaagcttggttcagctcaccaccatgaaggtaattcaatgtgaatcgatgaagaccattgtgtttgagtcagagcaagaaaagacagaacttaatattattttcagacaattgaaggaaatagagctcgaggctctgcatgaactcaaatgtttctgtggatcctattgttgtgccattgagtttccgtccttggaaaaagttgttgtgagtgcatgtagcaagatggaagggttcacattctctgaacaagccaacaagacaccaaatttacgacaaatatgtgttagacgtggaaaggaggaagaaagattatattgggtacgtgatttaaatgctacgatacgatctttgtacaagattcgggctcttgatccagacatggcagcttccaatccttacatggcactaaagatccatcaattgaagactttgaagctggtgaattgtattgaatctaatgctattccaactgttgttttttcaagtttaaagaacttggaagaattagaagtaagcagcacgaatgtagaggtaatatttggtataatggaggcagatatgaagggatataccttacggttgaagaaaatgactttggataatctgccaaatttgatacaagtatgggataaggatcgcgaaggaattctcagctttcaaaatctgcaggaagtgcttgttgctaattgtgaaaaactgaaaactgtgtttcctacagagctggctaaaagaattgtgaagctcgagaaacttgaaataaggcactgtgaagtgcttcaagaaattgttgaagaggcgaatgcaattacagaagaaccaacagaattttcatttcctcatttaacctcactgaatctgcatatgttgccacaactcagttgcttttatcctggaagatttacgctggaatgcccagccttaaatcatttagaggtgttgtcttgtgataacttggagaaatttcaaaaccaacaagaggcacaatgttctacttcagttactaagctaccccttttctccgaaggaaagactattttcattctggagtcattgaagctctattgggaaattgcaaggatgctatgcaacaaaaaatttctgaaggacatgcttcataaattagttgaacttgagctggattttaatgatgtcagagaggtaccaaatttcgtggttgagtttgctgcattacttgagaggacatcaaatttagagtatcttcaaataagccgatgcagagttcttgaggagttattcccctctcaacctgaacaaggtgacaccaaaacgcttggacacttgacaacctcatcccttgtccgtctgcagaaattatgtgtttcctcgtgtggtcatttgacaactttggtacatttaccaatgtcattctccaatctaaaacatttgtctgtaaaagattgccatggattgaagtgcttatttacatccacaactgcaaaaaagttagtacaccttgaagagatgtacataatgcgatgcaaatccgtggaagaaatattggcaaaagaattagaagacactactacttcagaggcgatacaatttgagcgactcaacacgataattctagattctttatcaagcctgtcatgtttctattcaggcaatgaaattctgttattatcatctctgataaaagtgctcatatgggaatgccccaacatgaagattttctcccaaggagacatagaagcggaatcatttatgggaattcaagtctcgttggatccaaatgaagatttgttcttccaccaagatcttaacaacactgtgaagcggaggttccaacaaaatgagttgtttgaagccttggacaacgagagtatttctgataatcttgagctaaaagtggactggcatggtaaagttggtctggaaaacaaatggttggacaatttgatgactttgaagccggacaattgtactctaccaaatgcaattccatctgctactcttcctcattcagagacaacagaagaatttgaagtgcagaatagcatcaaagtcaaggaagaaggcacagcagcaaatgtaacacaaaagtttgtgtttcctcgtttagagaattggaatatccatgacttgccacagcagttatttccaagtgcacatctcatgaataaggatgaaggtaccagtacttcaattaatagtcatcctcttatcttaagtctaaaggttatttctaacccgaaggaattgagactagattggaaacacaatccagcgttattattcgagaagctccatgagttagatgttttcaattttcctcatttgacaaacttagtatattcaacttctagattgtctttctctcgtctgaaaaaggtgtctacattcaactgtccccacatgcaacatttatttacatattcagaagccaaaaagttaatgaacattgaggagattaccaacaaggaatgtgaatcagtgacagaaataattgctaaagatggagacgaaaatgaacacaaaggagaagggagttccactttgaattccccatccttgaaagaagtggggttcaccaaatgctacagcacgaaacttttccatcttggtggcaaagtgcgaacaatattgaaggtgacaatagagggagccgattgggaaggtgatataaattctgcgcccatgcaacagtttgaggaggaggcagcctga

SEQ ID NO: 64062 - DNA, 2710 bp, Glycine max
  Peptide Sequence Number=SeqID_180840
atgcagtttgttggaatttttgttcaagtgttgccacatctaaaatcggtgtgtctacatctaaagtcggggttgggatatctaaagctgctaccatatgaactttggcgttatgaaagcatagttaaagaattagacagaggttttaataatctgcagagagagagaaaaaggattggacataaagtaaaagaggaagaaaatcgatatgggagagctattgacgatgatgttattaaatggttacaagaggctgataagatcatttctgagtatgacgatttcaggctagatgaagacagtccatatgctgtgttttgcgatggttaccttcctaaaccatcgataaggtttcgtctaagcagaatagcagttgatcttgcaaggagaggtaatgtactgctgcagagcgcaaatcctgattggttgggccgatcttcgactgatgctgatttccaaagctttgcatcaagaaatcaaaccaagaagcgtattgtggatgcattggcagactcgaatgttggagtgattggagtttatgggtggagtggtgtgggcaagactagtttaatcaaagaagttgccaaggaagtaaaaggcaaaatgtttgatgtggtgattatggtgaacgtaagctttcctgaaatacgaaatattcaaggacaaattgctgacaggttggggatgatcttggaagaggaatctgagagtggaagagcagcccgcatacgggagagattgaaaaatcccaaggagaaaacccttataatcctagatgatatggaggtgaaacttgacttcggcatgctaggaattccatttgatgacactgtcggtagccagatgaataacaaaaagaaaaaccctttggcccaccacaaatatgcaatgaaaacagaagaatttgaagcttccagtttgatgaagatagaagaacctattgctagatacacaggatgcaaaattttgatgatttccgacagtgaacaacttttgatcagtcagatgggtgggaaaggaattcaaactttttctgtggaagcattaacagataaggaagcaaagaagatgtttatgaccatggctgaaataataccattaatggaaaagaaagcagagacgatgtttaagaccatggctgaaataatagcattaagagaaatggaagcagagacgatgtctaagatcatgactgagatgataggtgatgaaaattccaagtttgaaaaattggcagctcaaattgccaagaggtgtaaagggttgcccatgacaattgttacaactgcaaaggcattaaaaaataagagcctggtggtatgggagaaagcatatctagaccttggaaagcaaaacttaacagcaatgccagagttttctacaaagttgagttatgatcttctagaaaatgaggagctcaagcacactttcttaatttgtgcacgtatgggtcgcgatgcattaattactgacttggtgagatactgcattggtttgggtttccttcaaggaatttacactgtaagggaagctagagatagagtatatgcattggttggaaagttgaaagaattaagtttgttgtctgatagtttttcaattgatcatttcaccatgcatgatattatacgtgatgtggctttgtcaatagcatcccaggaaatgcatgcatttgcactgacaaagggaagactagatgaatggcccaaaaagcgtgaaaggtacactgcaatttccttacagcattgtgatgtgactgacattatgaagaagtttcctgaaagcatagactgttgtagacttagaatcttccatcttgacaacatgaatccacgtctggaaataccggacaacttttttaatggaatgaaagaactccgggtgttgatattgattggcattcatctattatccttaccttcgtcaattaaatgcttaaaagaactcagaatgttttgtttggagcgatgcaaactagctgagaatttatctattataggagagttggaggaattaagagttcttagtttatcaggatctgatattgaatgtttgcctattgaattgaggaagttagctaagctacaaatttttgacataagtaattgttttgaacttaaaaagattcctgctgatgtattgtcaagtttaactagtttggaagagttgtatgtggggaaaagcccgattcagtggaaggatgaagaaggacaaggaaaccaaaatggagatgtcagtctttctgaactgaggcaattgaatcagttaacggcactagacatacagatcccaaaaatgacccattttcataagaacttgttctttgaccagttgaatagttacaagatcatcattagagatttcaatgcatatccagcgtgggatttcaagatgttagagatgtgtgaagcatcaagatatttggcacttcagctagaaaacggctttgacattcgtaatcgaatggagatcaaattactattcaaaagagttgaaagtttgttgttgggacaactaaatgatgtcaaagatattttcaatgaactgaattatgaaggatttccctatctgaaatatttgtccattctaagtaactcaaaagttaagtccatcatcaattcagagaacccaacatatcctgagaaagcatttcccaaattagagtcattgtttctctatgatgtcagcaacatggaacatatatgccacg

SEQ ID NO: 64063 - DNA, 2688 bp, Glycine max
  Peptide Sequence Number=SeqID_180841
atgcttcagaagggtttgatccaacccagtaccagccccttttcctccccagtcttattggtgaagaagcatgatgggtcatggaggttttgcgttgattaccgggcactgaattcactcaccgtcaaggatagatttccgatacccaccatagacgaattacttgatgaattggggggcgctcaatgcttttcaaagctcgatcttctccaaggttatcatcaaatccgcatgcattcagaggatatccctaaaactgcatttcgaactcatcatggacattatgagttcagagtgatgccctttggcctctgcaatgctccctcttcttttcaagccacaatgaacctcattttcaggcccttcctccgccgcttcgtcattgttttcttcgatgacatacttatctacaacagctcttttgatgatcaactgcatcatctggacttaactttccaggttctgcttgacaatcattttgttcttaagaaatctaaatgttcttttggtcaatcgcaggttgaatatttgggacatttagtttcccagcgcggagttgaacccatgcctgataaggttgtcgccattgttaattggcctcaacctcattccaccagagctgttcaaagtttcttagggcttgccggtttttaccgaagatttattcggggatatgccatgattgctgaccccttggttaaggctacctctgacccctttcgttggacaccacaagctcaacaggccttcaaagccctcaaatcggctttgtcaactgctcctgttctttcacttccagactttcaagagtctttcacagtagagactgatgcttccggcaatggtatgggcgcagtcctatcccagagaggacaccccattgcctatttcagcaagcccttccctaaaaagctcctcagggcctcgacctatgttcgcgaattatttgctattacctctgcagtgaaaaagtggcgccaatatctcttgggccactcattcaccattgtcaccgatcataagagtttaaaggagttgctcactcaagttattcagacacccgaacaacatatgtacctggcacaattaatgggatttgattatcaaatccaatatcgctccggaaagcacaaccaagcagctgatgccctctcacggtcaccggaattcactccttcacttttgctgctcttatctattccatgtttgacctttcttgatgaattacatcagcagctcaccaacaattctcagtattgtcagcgccgacaggacatcctcaactctccggccaccaaccccgatttcactcttagtcagcatttcatcctttacaagggcaaaatttggttaccccgcgagcttcctcttattcggacacttatgctggaataccacgccacaccgatggggggtcacatgggcgttaccaagacaatcgctaggctatcggaaaattttacatggccgggactccgttctgatgttgctacctttgtggccaattgccctgaatgccaattcaccaaatatgagacgaaatgcacggccgagttgctttgtcccttacctgttcccttttggccatgggaggacctctcccttgattttatcactgggctcccttcatatcagggcaaaacggtgttacttgttgttgtagaccgattttctaaagggattcacttgggcgtcttaccaaccgcacatacggcacacatggtcgcctctttgttcattgacattgtggtcaaacttcatgcctaccatccccatagtgatggtcagactgaagtcatgaacagagtgatcgagcaatatttgcgggccttcgtgcaccgccagccggcgacgtggggcagattccttccctgggttgagttatcgcacaatacttcctggaatgccggcacgggctctaaaccatacgagataacgtttgggcgcaaacctttctcttttctagactatatcactggctcctccaaattagacgcggtggatgatattctgaagcaccatgaggaagtttttctctgcattcgtcagaagctcttaaaggcccaggatgctatgaaacgaactgctgatgctaaacggcgtgaggttgagtatgaggttggtaattgggtacttttaaagctcagaccataccgacagcgttcggccaaggatgctcaggccagctccggcaagttagctaagcgcttctacggccccttcaaggttctcgaaagaattggtaaggttgcttatcgtttgaagctaccagagggcgcgcgaattcatcccttatttcactgttcacttttgaaaccttttcatggtgatcccaccctcagtcataccccctcactcccagatcacttattcaatcatcagcccattatctctccattggcaattttggatactcgtcgtgctgcaaccactgagggatcatgggaggttttagttcaatggaaggggttacttcctgatgacacctcatgggaaaactgggatcagctgcagcagacttatcaccttgaggacaaggtgattctccaagggccacgggaagttgatagcaacagagcaataccagaagaagcaacagaggaaacaacagatatgaacgcagggttacaaacagtaaaaccgaaaaggaagattaccaggcccgcgtatctcagagattatgcttga

SEQ ID NO: 64064 - DNA, 234 bp, Glycine max
  Peptide Sequence Number=SeqID_180842
atggcggcaaacagtcactgcagagagcttcaacaatgttggaggagaaaagtccatggaatgagactcacggaacaagaactagtgtctgatttgttgtttgcagatcatatagatcctttgtacagagtgaatggaggtcaaggcatcaagcattcagagatagaaaataggaatatctgcataacggaatttgattctcgatgcttcctagcaagagacattttgatctag

SEQ ID NO: 64065 - DNA, 2187 bp, Glycine max
  Peptide Sequence Number=SeqID_180843
atggactcaagatgcacataccatatgtctcctgtaaaggattacttcgaggatcttgaacaaaaggagtatggaacagtactccttgggaacaacaaggcttgcaaggtgcatggcattgggactgtcagactgagaatgtttgacaatagggaaatgctgctacaagatgtgaggtatgttccaaaactcaagagaaaccttatctctataagcatgtttgatcttatgggatgcactacaaaggttgataatgggatgatgaaggtgtctactggagcctcaatcattgctaagggaaggcgaagcaatggcctatacatcctagaaggatccacagtaattggacaagcatttgttgcaagtcaaacaatggaagataagtctaaattgtggaacttgcggctaggccacatcagtatgcacacctcaacaagaccttttgagtatgctcatgcagatctatggggaccatctaggatccaaacacatgggggtggatcctatttcttgagcattatcgatgactattcaagaagagtatgggtctacatcctaaggaacaaagctgaaacatttcagaagttcaaggaatggcatactcaaattgaaaaccagcaaggaaccaagttgaaggtcctaaggacagacaatgggcttgaatttgtctcagaccaattcaatattttctgcacacatcatggaatcaagaggcacaaaacagttgctggtacccctcaacaaaatggccttgcagaaaggatgaatagaaccatcctggaaagagttagatgcatgcttcttggagcaagtttgcccaaggttttctggggagaagctgcaaacacaactgtatatttgatcaacatgagtccctcatctgcccttgaatacaaaacaccaatggaggacaagttggatgctcgagctataagatgtctatttcttgggtatgctaaaggagtcaagggatacaggctgtggaggttggatctaaaaccttctaagctcatcatcagcaaagatgtgacatttgatgagacaagaatgagaatgtattctgaaaactcagaatgtggaaaggagaaaactcacattgaggtggagccttttactgataaggtgcaagaaaacactcagataaatccaattactgacctagataatatagcagaaaaattggacactcaggaaaggagaattcctaaaccaaacagaaagtttgctcaagctgatctcatttgctatgctttaacaacagctgaggaaattgaaggatcaacagaaccaaggaatttcaaggaggcacatgaaagtgaggagagacaactttggctttatgcaattgaagaagaacttgaggcactcaagaagaacaatacttggaggcttgtggaactacctaagggacaaaaggtagttagctgcaagtggatcttcaaaaggaaaagtgaaattcccggggttcaaaagacaagatacaaggcaagaattttgatgtcaattgccaaccagttcaagctacacctggaacaattggatgtcaagacagccttcttacatggagacttggaggaaaccatttacatgaggcaaccagaaggttttgctctggatgatagggaggattatctatatctcctactgtatgtagatgacattttggtggctagctgcaacaaatgtatgatcaatgacctaaagtcaaggctgaactcagaattcgagacgaaggatcttggggaagctagacaaatccctagtgttgatattaaaagagatcagctgaaaggaactttgctattatcccaacaagcctatatgcagaaggtagtggagaggtttaggatgcatcagtccaaacctgtgagcatacctttggggcagcacataaagctcttaaaaagccaaggcccaatatcagatgatgataagaagatgatggatgcagttccctatactagtggggttggaagcatcatgtatggaatggtctgtacaagaccagacttggctcatgctagaaactctcaaggtggaacagtgattgaagggtttatggatgcagattttacagggtgcttggacacaaggaaatcattggcaggatatgtgtttaccttgtttggaactgcagttagctggaaatcaaacctccaatcaattgtagctctatccaccacttga

SEQ ID NO: 64066 - DNA, 3081 bp, Glycine max
  Peptide Sequence Number=SeqID_180844
atgggttctctaattgttgtgtgtcatctgttcctgacgtcacctcgtttaaaggcatggctaaaggatcaatggattcatctcaagtcatacgaggcaagagttcgtgaactagaatgtgttgttcagaagctcaagaaaaagagagatgtaattcaacatacaattgacgaggaagaacatcgacgtgggagagaaattcatgttgaagttgaagagtggaaagacagggtggataagctttttttcaaatacgaggatttcaagaatgacagataccgtgaacttgcagagtttaacttgttacagagtggttaccttcccaagccagggataaggtatggtcggagcagagaagcatatgccattataagggaggccaatgggttgttgcaaacggcaaagtttgacaccttgtcttattggcctggtccaccttcaatggcagcctttttttctaacgttggctatgaaagctatccatcgagagaagaaacaatgagaaagattatcgaagaattggaagacccaagtgttagaatgattggtcttcatggattgagtggcgtgggaaagaccaccttagtcaaagaagttgttaagaaagccttaaaagataagatgtttgacgtagtgaccatggcaagcctaacaaaaaatcctgacataagaaaaatccaaggacaaattgccgacacgttgggggttacattggacgaggaaagtgacattgccagagctgctagaatacaaaagatattaaagaatgataagaagaacacccttgtaatcctagatgatctttgggacaaaatggacttgaatatgctggggattccatatgaaatagataatggcagtagccaaaggaatgttacagaaggaaaatcctttggcactgatggctttaagaattccaaagaaggaaaagcccttaatgatcttagtgcgacaagggtgaaaaaagaagaaacttttagtcagtacaagggatgcaaaattttgatgatttctgaaagcaaacaagcattattaagacaaatggaagggaaagcaaactgtattttgtctttggaagtcttaaaggagaaggaggcacatatgctgttcaagaaaaaggctggaataggtgacaagaattctgaatttgaaaatttagcagctcaaattgccaataagtgtaacgggttgccaatgtcaatagttacaactgcaagggccttaaaaaatcagagccgctccgtatgggaggatattcatcgaaagcttgaatggcagaatttaactggagcacctgaattgtcaacaaagttgagttatgatcttttagaagatgaggaactcaagtatactttcttactttgtgctcgcatgggtcgtgatgcattatttatggacttggtgaaatattgcattggtttgggttttcttcaagggatctacacagtaagggaaactagagacagagtatatgcattggttgcaaagctaaaagagtcagatgaacggcctgataaacttgaaaggtatgctgctatttccttacattattgtgacttcattgagggttttcttaagaaaagaaactatggaagacttagagtcttccacgttaacaataataatccaaatctcgaaatacccagaaacttttttaaaggaatgaaagaactcaaggtgttgatattgactggcattcatctgtccctctcgaagttgtcgatttcatccttgacagaacttagaatgctttgtttggagcaatgtgtgctagatgaggatttgtccatcataggcaagctgaaaaagttaagaattttgagtttttcaggatctgatattgaaaatttgccagttgaattgcaacagttagaaaagctacaaatttttgacataagtaattgctctaaacttaaagaaattccatctggtgtcatatcaagcttggtaagtttggaggatctgtatatgagaaacaccttgattcaatgggaggttgaaggacaagcacatgaaagtaaaaaagctagtctttctgagttgaaacatttgaatcaattgataactctagacatacaaatcccagatgtttcatatttgccgaagaacttgttctttgaccagttatatagttacaagattgttattggagatttggctgcatatttagaggctgatttcaagatgccagagaagtatgaaacatcaagattcttggcaattcgattgaaaggtgaaaatgacaatattcattctctaaaggggatcaaaatgctgtttgaaagagttgaaaatttgtttctggaagaactcaatgctgtccaagatattttttatagattgaatttaaagggatttccatatctaaagcatttgtcgattgtaaataattctacaattgaatctctcattcatccaaaggacagagaacagtcacagcaccctgaaaaagcttttcctaaattggagtcattgtgtctcaataatctcaaaaagattgttaatatatgctcctgtaaactttcagaaccctcctttggtaaactgaaagtcatcaagatcaatctctgtggtcaattgaagagtgtcttcttaatttctgtggttagccttttatctgttcttgaaacaattgaagttttagaatgtaactctttgaaggagattgtccaggtggaaacgcaaagcactggtgaagtcaagcttatgtttcctgaattacgctctttgaagctacagtttttatctcaatttgttggattttatcccattccatcgagaaagcaaaaagaactcttcaacgaaaagattgatgtttcaaaattagagagaatggagttgtcctcaatcccgattgacataatatggagtgtccaccaatcttcacgaatttcctctttcaaaaatttgacacatttggatgttaatagttgttgggaattaaaagatgtaatatcattttcaatggccaagagtctaacaaatcttcaaagcctttttgtaagtgaatgtgggaaagtgagaagcatctttcccgattgcccgcaaatggaggagattcaagagttcgaagcatcctaa

SEQ ID NO: 64067 - DNA, 846 bp, Glycine max
  Peptide Sequence Number=SeqID_180845
atggcactgggttctgatattgctaatacagtggattcaggcacagaggaaggggtggtggtgggcatgaacgaaggcgggccacgatgtaaactggccattgttagccatccactggaaccatgccaaggcacagccatccatgtagaaggaaacaatggagcaggggaaaattgtggtgggttcgtgtgtggggaggaagatgatggggatgaaggaagacggagcaaaaaagcatggagatcagtaagtttgaggagcgcggcttcaagcgaattgggggaaggatccggcatggtgaggagaacgaacgagagcaccaatgttagggggtggaatactctggtttcgaggaccagaccctcctatgaagaagaaggagaagatagagacaactaccctgcagatggtcctataggcccacacggtgtcctcacacataatcacgcagtgtgtttgctgaattcctcatgtattccttgctgcacccctgttagtctatcaacttctgaaacgaggctaaagcaaatactgctagaggttgctgctcaagccatttcaagcctaatagtcctgtcccagaatcagatagaggttaaaatggatgatacaagtgtgccaaatctggtccagttgcttgattcaagcactcagaacactgcaaaaaagtatgcagtttcttgccttggatcacattctccgagtaagaaatgtaagaaactgatgatttcgtatggagcaatcaggtatctgaagaagcttacagagatggacatcccaggagctaagaagctacttgagcggttggaaagagggaaattgagaagcttgttcagcagaaagtag

SEQ ID NO: 64068 - DNA, 1314 bp, Glycine max
  Peptide Sequence Number=SeqID_180846
atgcaagcaatatttgatatacatgtaaaagttggggatgtagctaatttgcaagatgttcatttggaaagactcccaaaattggagcatgtatggaagttgaatgaagaccgagtaggaattcttaaatggaacaatctgcaaaagatatgtgttgtaaactgttacagcttgaaaaatatttttccattctctgtagccaattgtcttgataatcttgaataccttgaggtgggtcaatgctttgaattgagggaaattgtggccataagtgaagctgccaacactgataaagtatcatttcacttccctaaactaagcaccatcaaattttcaagactaccaaaacttgaagaaccaggagcttatgatttatcatgtccaatgttgaatgacctatctattgaattttgcgacaagctgaaaccattccacaaaaatgcacaaagaaagcctctctttcctgaagaggtaatcaataagttgaagtccatgcaaattgagtctcagcatgcaaactcaccaagcagttatatggagaaatcgaaccatcgaaggcataacttagaagagctttgcttatctagattaacggatactgagactttatattctttccttcatagaaatcctaatctgaaaagcctatcattgagtaattgtttctttgaagagatatcgcctcctactgagattgaaaacttgggagttgttccaaagctgaaaagcttgaagttgataaacttgcctcagctcaaagagataggcttcgaaccagacataattcttaaaagggtagagttcttgattttaaagaattgtcctagaatgaccactttagtgccttcctctgcatctctcagtagtttgacgaacctggaagtggttaattgtgctaaattagaatatctaatgtcaccatctactgcaaaaagcttgggtcaactcaacaccatgaaggtaatgaaatgtgaatctctggtggaaatagtaggaaaagaagaagatggagaaaatgctggcaaagttgttttcaaaaaattgaagaccctggaacttgtttcactgaagaaactcaggagtttttgtggctctgatagttgtgactttgagttcccgtctttggaaaaaacagtagtgagtgcatgttataatatggaaaaattttctgagaaagtcacgagcagcagcacgcccattttacaaagtatatatgtcgtacatgaaaaagagaagaaaagatgctgctggaaaggtgatttaaacgctacaataaaaacaatattcgaggaaaagttttttcttaaaaattaa

SEQ ID NO: 64069 - DNA, 2754 bp, Glycine max
  Peptide Sequence Number=SeqID_180847
atggacaatatgagtttttcagaacatcctgagctacaacaagcctggcaagatggtcaaagcttaaaagaactggaagtgggagattgcaaaaatgtagaggtaatttttgagatggatgtcacagaggatgctggaacaacattccaattgcagaatttgtctttagaaaggctaccaaaacttatgcaggcgtggaaagggaatggtagaggaactcatagctttcaaaatttgcaagaagtgtttgttataggctgtcaaaggctgcaaaatgtgtttcccgctgccgtggccaaaaatcttaagaagcttcactcacttttcattatatcttgtcagaggttggaagaaattgttaaaaaggaagaagacgcagaagcagaagcagcagcagagtttgtgttcccttgtttaactacactgcatctttctaacctaccggaactcatttgcttttaccctgaaccattcactctgggatgccctgtgttagataaattacatgtgctagattgcccaaagttggagctatttgaaagtgctaacagacaacctgttttctcggatctaaaggtcatttccaaccttgagggattggcactcgaatggaaacacagttcggtgttaaattcaaagttagaatctggtgactaccccaacctcctcgagtatttaatttggattagactgtactttgatgttgatgatgatgggaaccctatttttcccattcaaacactccagaaggcatcccccaatttaaaagcaatgattataagttcttgccgttcccttgaggtattccgcactcaaatccctgaaattaataaaaacttgatgcttacacagttgtgtctcatcgatgtatggaagctcaagtctattgggtcaggcgaagcgcagtggttagacgagatttgtaagaagctcaacgaattagatgttagaggttgtcctcattttacagcattgctgcattctccttcttcagtaactttctccaatttgaaagaattgttcatattcaactgtcaaagactgaagtatttattcacatcctcggcagcaaaaaagttaagtcaacttgaggagatcatcgtctattattgtaaatcaataaaagaaatagtggcaaaagaggaagatgaaacagctttaggagatgtcatattaccgcagctacaccgcatatctctagcagacttgtcaagcttggaatgtttttattcgggcaatcaaactttgcagttaccctcgctgataaaagtgcacatagacaagtgccccaagatggaaattttctctcaaggatcgataggtccaaattcttgtagggaaattgtaactcgggtcgacccaaataatagaagtgtcgtcttcgacgatgaacttaactcttctgtcaaaaaggtgtttctacatcagaatcatatagttttcggggattctcatatgttgcaagagatgtggaattcagaaacactcccagattggtatttccgcaatttaacttccatggtcgtggaaggtatgggacctcaaggaagtctcagccatctggaacaacttcaattggaaaactgtgatgagttagcggcaattgttgcaaatgatgaagcagacaatgaagaagcaactaaagagattgttatattctccagcataacgtcgttgaggctatcggatttgccaaaactaagctgcatttatcctggaatgcagagtctagaatggcgtatgctaaaagaattacatgtcaaacattgccaaaagctgaagttttttgcatcagaatttcaaaattctccagatttaaatccagatggtgaagatagattttcaacagaccagcaagctattgtctcacttgaaaaggttactccctgcttggaagtaatgtcgctgggtaaggaagaagccatgatgattgagcaaggaaaacttgatattgagctcccgaaattaaactccctcaaattgcagtgctttcaggatgagcagggggacatatttccatttgtttttggtttgaaggtgtcagtgtcactacccactattgaaaaacttgtgttgctccatagtgcctttaaagagatattcccctctgaaaaaaccagtaacggcatagattatgataaaatcctttcacagcttaaaagattggagcttctgagtctgtttcaacttaaatccataggattagagcactcctggataagccctttcatacaaaatttaaaaaccttactggattgtgatgggttgaagtacttgttcacattttcaactgccaaaacattggttgtactgaaggaaatttacataacaaaatgcaaatcactaaaaacaatagtggctaaggacggagaagaaggaggcgatgatgaagataatgatgtggaggaggaggaccaaggtgaaggaaatgaagacgaagatgaagatgaagatgaagaagaagatgaagatgaagaagaagctaatgctaaaggtgatggagatgaagatgaaaatgaaggtaataacgatgaaaatggaaatcaaggtgaagatgatattacattcaagaagcttgagagtttgactcttagctcgttaccaaaacttagaagcttctacacagggagttcctctttgaattttccatgcttgaaagaaattgttgtctggtgcaagaagcttattgtcattgcgttcgctcatgttacccttgaaaacaggctgtcttcttctcatgcaaccacagagtaa

SEQ ID NO: 64070 - DNA, 834 bp, Glycine max
  Peptide Sequence Number=SeqID_180848
atgacccaagagctggtagcccgcggagacaccttacggttattcgcacctcgtcattcagtgaccccaagtgtgattgacgagcagaggccaatgtggtcatctgcgccctttccggagatgtcagcattttccgatggagacttttcaagtctcacaagttatccagaactacgtagaggcggcggacccgatgatacgcggagataccttacggttatccgcacccttttgtcatccagaggcggcgggcccgatgacaaagcagagaccaagtttggtcattctgcacccttgtatcatccagaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagaccaaagtttggtcattctgcacccttgtatcatccagaggcggcgggcccgatgatacgcggagataccttacggttatccgctcccttttatcatccagaggcggcgggcccgatgacaagcagagaccaagtttggtcattctgcacccttgtatcatccagaggcggcgggcccgatgatacgcggagataccttacggttatccgcatccttttgtcatccagaggcggcgggcccgatgacaagcagagaccaagtttggtcattctgcacccttgtatcatccagaggcggcgggcccgatga

SEQ ID NO: 64071 - DNA, 384 bp, Glycine max
  Peptide Sequence Number=SeqID_180849
atgcacaatttctgtggaatacgaaagtcgatcttatcgttttatactccttggtacacttgccaaaaaaacaacaactcacctgtcatagttgccggcacatacgccaatgagctttgtgccatgttagcaacaggcaaaggtgaaacaatactgtgtgcaactgttgcaagagatgttgctgtcttgatggaattcaaaggtgtttttctcaaggaagctgctaactgtgttgtgcatgaacgcacatcaaaaggccttgttggtttggttgatgtgtctgctgcaggagaagttgctatgccttataacacattgggcatgttccgagcatgtgctactgaagatggatattcagagattgcaatttggccttcttcctag

SEQ ID NO: 64072 - DNA, 1596 bp, Glycine max
  Peptide Sequence Number=SeqID_180850
atgaaggacaagggacacagaaaacctatccatttgtataagtcattcgatgcgattgacattgctatttgctattacaattgtttccttcccccaccccctctgggtagtgggtacttacagagcaagttacttactttgcaggagagaaatgctaaagttgaacattttgccaagagatataattttactgaggaaattttaagtgcaacatccttttcacggcagttagcagagcaaatggttctggccaaggcttatgtgattattgccaaagagcacaataatcttcaccttgcctgggagcttagctcaaagattagaagttgtcagcttttgctttcaaaagctgccatgactggggagcctgtgaccatggaggaagctgagccaattattaaaagcttgtcttctctaattttcaaggcacaagatgttcattatgacattgcaaccactatagcaacaatgaaatcacatattcaagcacttgaagagcgtgcaaatacagcgacaattcaaagtactgtgtttgctcaaatatcagctgaagcactacccaagagtcttcattgcttaaatgtgaaacttatggctgattggctgaagatgccatccctgcaaaaactctcacatgagagtagaatctccccacggctcacagataataatctaaatcatttctgcattttttcagataatgtactggctacatctgtagttgttaactcaactgtcatgaatgctgaccatccaaaacagttagtctttcacattgttactgatggtatcaattatggagcaatgcaagcatggttcttcagtaatgactttaaaggggctaccttagaggttcagaatattgagaagtttcattggttgaatgaatcttattctccaattgtcaaacaactacgcattccagaatcacgagccttttattttggaccttatcaaggtgcaaatgttgagccaaaattgcaaaaccccaagtttttgtctttactaaatcatcttcggttttacatccctgagatttatccactacttgagaaggttgttttcctcgatgatgatgttgttgttcagaaggacctaaccccacttttctcactggatttgcatggaaatgtgaatggagctgttgaaacttgtctagaagcctttcataggtactacaagtatctcaacttctcaaattcaattataagctcaaagtttgatccacaagcatgtggatgggcacttggtatgaatgtttttgacttggttgcatggaggaaagcaaatgtgactgcaaggtatcattattggcaggagcagaatgctgatgggacactctggaaactcggtacgcttccacctgctcttttaagtttttatggtttgacagaaccacttgacagaagatggcatgttttagggttgggttatgacctaaacattgacaaccgcctcattgaaagtgcagcagttattcattttaatgggaacatgaaaccatggctgaagttagctataggcaggtataagccattatggcacaagtacataaaccaaagtcaccctcatctacaagattgtgccgcaggttaa

SEQ ID NO: 64073 - DNA, 333 bp, Glycine max
  Peptide Sequence Number=SeqID_180851
atgcatctcgagaatgaaaccaacactcttgttaaagagcgtgacagactcgttcgcgagacgaagtggctggaggagagcatcaacagagaaaggaagctattggggaaagttatgaaagtgctattagggaaggagcttgtggttgcaacacggacagatacaaaggggcaaacaacacttcacatggcagtgaaaggacaaagtcttgaggtggtggaggagttgataaaagctgatccctcaataataaacatgggaccaatatttagagctccacaaagagggcaagaaccatggccacatcatccacagccattgaacccgctttga

SEQ ID NO: 64074 - DNA, 237 bp, Glycine max
  Peptide Sequence Number=SeqID_180852
atgtggcaggcggtgctgtcattgttagagaagccggaggtgttatatttgatccgctatgaacacttaaatgaatcactgcgtgtttttattgaggttgacttacctgtcaatgttgttgatataaggctgaggcaagcacatgaaatcatagaagaactactcaagcccatggaagcatctagtttgacaatgcaaacttcatgtcactgtgcattttggaggcatgccacataa

SEQ ID NO: 64075 - DNA, 2337 bp, Glycine max
  Peptide Sequence Number=SeqID_180853
atgtctgtggtttgtgaaatctggtttgccttctcctggctgcttgaccagcttcctaagctcttccccgtaaaccgtgttgccgatcttgatgttttgaaagacaagtttgaaactcctaatcccaccaatcctactgggaaatctgatcttccaggaatagatatgtttgtctcaactgctgatccagaaaaagaaccaccacttgttactgcaaataccattctctctattctagctgctgattatcctgttgagaaactctcatgttatgtctctgacgatggaggtgcacttctaacttttgaggccatggcagaggctgcagcttttgccaatatgtgggttcctttttgtcggaagcaccacattgagcccaggaacccagaatcttattttaacctgaagagagatccctacaagaacaaagtgcggtctgattttgtgagggaccgcaggcgagtaaagcgtgagtatgacgagttcaagattcctaaagctacatggatggctgatactaagcactggcctggtacttggacaactgctgcaccggagcattcaaggggtgatcatgcaagtatcatacaggtaatgttacaacccccaagtgatgaaccactgactggaaaagaatcagattcaaatgccttggatttcagtgaagttgatattcgtcttcctatgcttgtctatgtttctcgtgaaaaacgacccggctatgatcacaacaaaaaggcaggggccatgaatgccttggttcgagcctcggccataatgtccaatggccctttcatacttaatcttgactgtgaccattacatatacaactctgaggcactgagagaaggaatgtgcttcatgatggaccgcggtggggacaggctctgctatgttcaatttcctcaaaggtttgaaggaatcgacaccaatgatcgctatgcgaaccataacactgtcttctttgatgtcaatatgcgcgctcttgatggaatccaaggtcctgtatatgttggaacaggatgtctatttcgaagaactgctctctatggctttgatccaccccggattaaagaagagggcggttggtttggtgggaaggagaagaagaagaaatcctcaacggtggcctctgtctctgagtcattgaggaatggcagcatagaggaagaagaaatgagcagtgatcttgttccaaagaaatttggcaactcaagtcttcttgttgattcagtaagggtggctgagttccaaggcctaccccttgctgatgatgattcatctatgaaatatgggcgtccacccggtgctctaactctccctcgtgatcctcttgatgttgctacagttgctgaggccatcaatgtcatctcgtgctggtacgaagacaaaactgaatggggccttagagttgggtggatctatggatcagttactgaggatgttgtgacaggctacagaatgcacaatagaggatggaattctatatattgtgtcaccaaaagggatgccttccgcggcactgctccaatcaatctcacagataggcttcaccaggttcttcgctgggcaaccggctcagttgaaatcttcttttcccgcaacaatgctctttttgccagctctagattgaaacttcttcagaggattgcttaccttaatgttggaatttatccattcacttccatcttccttatcgtgtattgcttcgttcctgctctctcacttttcactggccagttcattgttcaaacccttcaagtcaccttcctagtttacctcttgggcataaccttgacccttgtcatccttgctgctttggaaatcaagtggtccggcattgagctcgaagagtggtggaggaatgagcaattctggttgattggaggcacaagtgcacaccttgctgctgtgctccagggtctgctgaaggtgatggctggcattgagatttcattcactttgacatcaaaatccggcggtgatgacgaaaacgatgaatttgccgatctctatgtcatcaagtggacatctcttatgataccaccaataactatcatgatggttaatctgatagccattgctgttgctgttagcagaactatatacagcgaagatcgcgaatggagcagcttgcttggaggtgtgtttttcagtttttgggtcttgtctcatttgtatccctttgcaaaagggctaatgggtagaaggggtaggacacccactattgtgtttgtttggtcggggctaatttcaattactatctcactcctttgggttgctattgatcctccctctggcagcagccaaattggagggtcattccaattcccttga

SEQ ID NO: 64076 - DNA, 147 bp, Glycine max
  Peptide Sequence Number=SeqID_180854
atggctgcagaagttgaagcagcgtttaagactcagtcctgtttgagagagaagttgacacttgacaacgtcagacacgcgcttaattggttgttgtcctttgagctggtttcttcttcagtgtggtttcattgccatggctactaa

SEQ ID NO: 64077 - DNA, 1227 bp, Glycine max
  Peptide Sequence Number=SeqID_180855
atggggtgcatggtgtctcagctagccgcgaaattcgcattctttccgccgtcgccgccgacgtaccagctcaagaagaacgaggacggcaagctcacggtggtctccgcggcggcgccgattccccacgccgatgacacctccctcgacgttctccttgttgacaccaagcacgggaacaagattgtggcgttttatctgagaaacccctacgcgcgcctcactctgctttattctcatggcaatgccgctgacttgggtcaactctatgatctcttcgtgcaactcaaggtcaatcttagagttaatctcatgggatatgactactctggatatggggcatctactggcaagcctagtgaatccagcacatatgctgacatagaggcaatatatgaatgccttgaaactgagtatggagttagccaagaagatgtaatcttgtatgggcaatcagttggaagtggaccaacactgcacttggctgctaaattgcctaggttgagaggtgtggttcttcacagtggcattctttctggtcttcgagtgctctgccatgtgaagttcacattttgcttggacatttataagaacatcaacaaaataaagaaggtcaagtgtcctgtacttgtaatacatggtacagaagacgatgttgtcaattggttacatggtaatggactttggaagatgtcaagggagtcatatgatcccttgtggatcaaaggaggtggtcactgcaacttggagctttaccccgattacatccgccatctttgcaaattcatccaagaaatggagagcatgacaactgagaagcgcctcaaaaagattcggcaaagtgcgaaccaatccaagtcaaacactggttgcacctgtagtagatgctgtagagtgaagtgttgtagagttaaatgtcctgaatgctctaattgctgttgctgcatgaatgtttcctggtctatcaactgtcctgaatgctgttggagacctagctgcaagtgttgccgcctccccaagttccctagttgtttcagatcaatctgccgcacaaaatggtcgtggcctagctgttgtgcaacaaaatgttcattgtcattgcctagctgctgctgctgctgctacccgaagcgtgcaagaccaagttgctgttgcatgaattgtttctgttggcaatgttgtgtaggaaaacacagtgatggcacaaatggaaaacagaatggctaa

SEQ ID NO: 64078 - DNA, 204 bp, Glycine max
  Peptide Sequence Number=SeqID_180856
atgcttaaggtggacgagacttacttgaataggtatgctaaaattcttaattgtaaagtgatggaggtgcctttcaaatatctaggcgttcctgttggagcaaattcacacaaggaggcaatgtgggagccaattgttacaaagtttaggagcaaattagcgatgcgaaagcaaagaacactttcaatgggcaaacgtggatag

SEQ ID NO: 64079 - DNA, 318 bp, Glycine max
  Peptide Sequence Number=SeqID_180857
atgaacagcaaacccatcaaaccaaagcagaccaggtcaagcttcaattccaatgagcaaagcagagttggggagcaatacaagatgaactgcagcatggcagcatcgcgaaaaacctcaagttcaaataggaatgatcaaattgccgttagtgcttacctgaccagtatgaaggcaccaaaaacaaccagaaactccgaagaacgcaaaagagagaaagaaagaagctttgatgaaaacggtgagacgaaagaaaagcctacagaatccttccttcgctccaatcagttcaaagcattgatatcactttggaaatga

SEQ ID NO: 64080 - DNA, 186 bp, Glycine max
  Peptide Sequence Number=SeqID_180858
atgacggataaattggcaagagctcagtatttgaagaacaaaaatcccaaggattgtgcttcgctgcatattgcgcagaatagagttcacgttttggctagccttttcaaaaccagtaaggatgagaaggataaggttgttgtgggctttctatcattgcaattttcaggtactacagaaaattaa

SEQ ID NO: 64081 - DNA, 1035 bp, Glycine max
  Peptide Sequence Number=SeqID_180859
atgagcaggaccggttcttcagcttactactgggtggcagacgccacccctccgctccgtaatagtaagactactatgtttatgctctccacgccgccaacaaccacattcttcgttacgccaactcctagggttccttttctctcttcatcaaaaccttcttccgtttctctgttgcgatcttctactgcgtcctactcgccgtgttgctcctcctcctcctccatcactcccaaggttaaatccaacgataacaacaactgctacctcgtctccgctaaacattctcccgctaacacgtccgcttcggtttcttcacgcaccttcctcaacgcgaagaacgagcaagagcttctagctggaatcaggaaagaagtagaagctggatctctgcctgctaatgttgctgcaggaatggaagaagtgtacaataactataaaaatgcagggcacaacatcatcttgatgtcaaatcaccaaactgaagctgatccagccatcattgctttgctgcttgaaacacgaatcccatatattgctgaaagcatgacctatgtagccggagatagagttataactgatcctctgtccaaaccattcagtattggcaggaatctcatttgtgtttactctaaaaagcacatgcttgatgatccagctcttatagagatgaaaagaaatgcaaatatacgagctctgaaggaaatggctatgcttttaaggagtggttcacaaatagtctggattgccccaagtggtggtagggatcgcccagatccccacaccggagaatgggcgccggcaccctttgatacttcttcggtagataatatgagaagacttgttgaacattctggtccaccaggtcatgtatatcctttagcgatattgtgccatgatataatgccccctccactgaaggttgagaaagaaattggggagaaaagaattatatcctttcatggggctggcatatcagtggctccagcattaagcttttctgaaaccactgctactagtgaaaatcctgaaaag

SEQ ID NO: 64082 - DNA, 1134 bp, Glycine max
  Peptide Sequence Number=SeqID_180860
atggcgtcgtttttgtcttctctccctgccgtttccgctcgtcccatccccactagtgccttccctctcagaaaacctctctttcaaactccacccaccttgcatttcaaaaatcataggtttgccgttagctgcagttacgcagaagcaggtgtcaacgctgattctagctctaacaccatagatgttgtggctgatgttagaagtgaacggattgtagtcttgggaggaaatggctttgttggttctgccatatgcaaggcagcagtgtccaggggcatagaagtaataagcctaagcagggcgacctacttattcggatgcttgggtagaccaagagatgttttctatgtaaactgggatgaagtacttgttggagctaccgcagttgtttcaacacttggaggttttggtagtgaggaacagatgaaaagaattaatggcgaggctaatgttgtggctgtgaatgctgcaaaggaatacggtgagccatctgcccatctcattgagcatgaattttcagataaattaacctgtgttcagcctttgttcatcatactgaaacatttcttcacatttcagctggttggtttggatgagaaattagaaacgaagctattagagagaggagagaagaccggtagactctgtagtgaggagagtagaccagatggagagaagacaaacaattcgaggcagaggaagacccaaaaagactataagagaggaattcccaaattcatcctgatctctgttcatgattataacttaccatcatttttactttcatctgggtactttacgggaaagaggaaagcagaatccgaggttctctccaaataccccaattcaggtattgtcttaagacctgctttcatatatgggaagaggagagtgaatggttatgagcttcctttggatttggtaggggagccagcagaaaaaattctacgagcaatagagaacttcaccaaacctttaagttctcttcctgcatctgatttactcttagctccacctgttagtgttgacgatgttgcgctggctgttatcaatggtgtcacagatgacgacttctttggtgtttttacaattgaccagatcaaggacgctgccaataaagtacgggtatga

SEQ ID NO: 64083 - DNA, 1594 bp, Glycine max
  Peptide Sequence Number=SeqID_180861
atggaccgccttggtcccaatgaagctctgccactgattacatggaaggggaaacatgcaaggtgttccatgggaaacatgcaaggtgttccattcacatctaagcaagcaagcaaagacgtagttgagtggggtctcgaacttcacatgtcatcttggagagataatagctgggagcttacagataatgttagagataaacatttgcttgtagataaaagggctaggtgttcgctctcttgtggcatggttgacgtggagggtggacatgtgtctttgagtgtcataggttgtccaatgctgaaagagactgtcccgtgtcgaggaagcttgtctgatgtctggggtagtagttttgacaagcaaaggcccccgagcctagacaagtattgtctaggttgcttttgtcaagttgttcgtgatggacatgtctttggcgtgtcaagaaaggcgtgtgcggcgcatgcacaatacttttgcatacgtgtcgctcacagagtgggcccgtactggagtttgtgggcagcacttcagctcttgccagttattgaagagtttgcctcccttttaaatgcagaactcccgtctttcacaatgtatttgatgttgtctaattccgccattggtatgggtggtagcgactctaggggttcgattgagcaatccataatggatcgagaggtcatctcaataggtggttcctcgttagaggatactcatcgaagtgcctccgacaatgagtcctcctctttggagagggtgtgggcctcaggttgtactagtgagggtgcttctcaccctcacggaagggtagcgatagtggagatgttagggcatctccccgcgtgcgacgtagctaaagcgctgggtcatcgtcatccaccccagcggtcattggctttgagtggtgtcattgcaattcagtgccaagtgaagctggcgaaccctgagaactcctacaagttggtcattcaggcttgcgagagttatgatttcccgttcttaagggcgacgcctaatcgtttctttaaggtcctagctactggtgttgtggctaatggatctgttgacccttatagagaaggtcgacaaacctattttggagtagttatcatcctcattggacgcacaggctgttctgtctcttcccttcggccactcgtgaattatgtcgaacttgcatgggagaccgtgacaccatctattgctccagttattggagaaggaggtcaacctgctggtgtggttggccctattgctgtcatggttaagaggcataatggtgctaggccatctagccgtaagaaattgaaaacccctatgagccttcgtgcccttaggcaggctatagggttgacgctcggtgcgggtcgcctttcggctatgcaagatgtgcctctgactccaccggtcgtcgaggctcctgctactacttctccttcgcctcctcgtgttgttgttgttcaggaggttacccctgttgctgttaaagttactgtgccagccactcaggctaactctattgtgacgctgtcatccaccatcacggcacatttgctgagtatcgatgtggcaatgatgcctccccactgca

SEQ ID NO: 64084 - DNA, 384 bp, Glycine max
  Peptide Sequence Number=SeqID_180862
atggacacaagtgggtatcttcctaggaagaatggtttcatgagtaaagaacactccaaaagttggaaactgcacaaactaagcaacgtcggtgtgacggaaaatggttatggccagcaattgcacccgctggttgcggaggtttttcccgaggctttgactttgactactgacttatacgaggcattgctgaaagtcatagacaaaggagaaacaaaacaactagaaaaggatatgctattgataggaggcaatgccaattgctctcctttagagagcaaggcaaaagctgataatggccaaccagaactcagttgtgtttaccagccacatattgagcttgaaataatggtgagcaaaacattggccgaccttgttggttaa

SEQ ID NO: 64085 - DNA, 411 bp, Glycine max
  Peptide Sequence Number=SeqID_180863
ttgcttatcttcaacaaatttggtggcttgaagtggaaggagatgttgattttcaatttcctcctgggtcatacaatgtgttctttagactccagcttggccggtcatccaagagattgggtcgacgagtttgtaagacggacgacgttcatggctgggatataaaacctgtaaaatttcagctaacaacttctgatggtcagcatgctgtatcccaaagtcatttggataatccagggaactggattctctaccatgcaggaaactttgtttccaagaatcctaatgatctgatgaagatcaaaatttcattgactcaaattgattgtacgcacaccaaaggcgggaatctgtatagtggaaatgagtctgaggcacctgagttgacttttgtcatttgggttacaggga

SEQ ID NO: 64086 - DNA, 204 bp, Glycine max
  Peptide Sequence Number=SeqID_180864
atggagaattgcactaagcaatcactacgcatcgctccaagctcgtgggtggaggatgcaagaacgaaaacgcaattcatggggctccgaaaaagggttgaggatggagaatcgcactacgcaatcactatgcatggctccaaattcgtgggaaaaggacgcatgaacaaaaacgcaattcatggagctccgaaaaagggttga

SEQ ID NO: 64087 - DNA, 516 bp, Glycine max
  Peptide Sequence Number=SeqID_180865
atggcatcatcggtgttgaaagttatcaatgaggagaactttgaagctccggaagaggatgaagaagtccaagctctaaaattagagctaggaaaggcaagactcgccaaagaaaaattcaagtcagccgctacaaacatccggaaagagtgcaccgagttacgagaggaaaacgcggccactgcaagagcccttgaacaagaaaccaaaagggcccgcaacgaggaacatggccgggataaataccgaggagctttgtggggcagcaataatgagctcaagctccggagagaggaaagggaccagtcacgggtgcatggcatgatcttaaaggaagagttaactgcttgctctagatctaagaggagtttggctcaacacttggaagcaaatcatgctagctatcatagggcaattaaaggaagagttaaaccagtcgttgacccacgaacaaaaactagtagaggacttcgcacaagcgtacgccgagaaggaagcaagagggagggtgattga

SEQ ID NO: 64088 - DNA, 471 bp, Glycine max
  Peptide Sequence Number=SeqID_180866
atggtgtattggaggtcgtacttgcagatgaggtgtttccaggtgaatttgtccacctcgctagctgtaatttcccgaagtggtcttgcttctatccacttgattgttaggaggaatgcgtggcacgtctgcaaacttttggcatcgtctgcacctcctggtaaagtcaaaggtgtatgccctgagtgttggccagctctgaagttgagcttgagggtttgctctagagtgatattgctatggccttcggggatgatccctacccccgcttccttttacgttggacgcatcgtcaacataaagtttcctaccatggatgttgaactccgaaagttctataggccaggccgttatccttcctgccagttcaagctttctcaaaacctgcttgatgaggtagtttgtcttgactaccacttgatgactctggaagtagggcctgagttgtggggccgaggtggtgagtgctag

SEQ ID NO: 64089 - DNA, 1143 bp, Glycine max
  Peptide Sequence Number=SeqID_180867
atggcgtcaccttctttgtcttctcgccctcgtgtctcccttgatcacttgtacacctctagtgatgctgactcactgtggggtgcaacttacaatctggagaagaagaccccagttggctttgtgttagcctttgatgagaaccatattaggttagtaagggcgtcatccttggaggtggaggtcgccaaatggagggctactgctcgtactcttgtcgccaatggcaccgttgcttttgttaaggctataagacgctacaaggacttacaggtggaaaagaagggcctgggtgagaaggtggaaaaattggcggttaaaagggactggctagccaaggagtctgagttacgggcagccaatgaaagagaggccaacaaggagcttaaggaagagctccttctgtacaagaaggaggcctggagcagcttgaaaaaggatttcagaaggccttcacgcaggctggaacttgacttgggtctcttcgatcccttcaaggatgtgaaggatggtgtcctgattgatgaagaatacattatagtggaggatgaggctgctgatgaagggcagggtgttgcggagcaaggcaatgatgcctatgtctacggcttccttctatcttgtggagcctttcccctgatggttgtgaggagttacgttgacttgcccctggttgaaggtcttgccaaccagtcgaggggagtacgtaccaagggtggaccttgggtttttgtaccaagggcgaaccttgggtttttcctgagtgtgtaccaagagaagaccttgggttttttatgtacttgtattcctgtgcagacaaaagttaggaatagagaagattgtcaagggttaccaagcatggagcttgggtttgacgagtctgttgcgcaagaattatctgacctaggttttgggcaccgtgctcctgcaaacatgccactcaccgtcagtggcacacactggagacgtagtgatatgctccagcatataagtcactcaccgtgggtggcatatactggagttatagcagtgttggtgtgctcttgtatacgagcctcttacaaagtgactcatactagagacatggtggcatactcgtgcgcacatgctactcatcgtgggtggcacgtactagaagcttag

SEQ ID NO: 64090 - DNA, 1704 bp, Glycine max
  Peptide Sequence Number=SeqID_180868
atgacctcagccgccttggccaatctgcgacaagcagacaatgagtccctcagaaaacacatggacagatttgggtgcacagtcgtccaaatccaaaatcttaaccccgaggtagcgttgcattctgtgcttctcgcactacgccctgacaagttcacagacagtctgtacaaaaaaccaactggtagcatggacgacgacaagcacgaaggaaacaccaagaccgacttacacaagtcagacaagaggcacaagctagacaagtgtcagcctttccctaaagggcccaggacaatccagccaatcccgaaaatgtcacctgcatgccatcaaagtctccctcctatcacctttacggataaggacttcaagggcatcaaccccatcaaccaagatgaccccgtggtcatctccatcatcattgcaaatttcatggtgtccaaggtccttatcgaccagggcagttctgctgatatcctagtcgagaccagaggttacatggacttgatgaccaccttcggtcagggcaagctctctaggagcttcaccatcagatatctattggttgacgtagacacatcatactttgccttaatcggcaggaagacacttaacgagcttggagctatagtcttcatgccccatttgaaaatgaaattccctacaccgacaggggagattgtaaccatcaaggctaaccgaaagcaagcacaaaaatgctacgcagagagcctgaaggtagcagtgtatcctcccattcgggaacatgccatacctcaccccccaacgccatctaacatgccgacaatccatcctggtataatctaccacaaacttgctatttgccccgaggctaaaccaatatcacaaaagaaaagaaagatgggagaagaacgacgtaaagctgtcaaagaagaagtcaaaaagatcttcaaggcaaaaatcatcagagaagtcaggttttctacctggctcgctaacatcgtcatggtcaaaaaggccaatggcaaatggcgaatgtcaaccgactacaataatttgaacagggtatgccccaaagacgcataccctctggccagcatcgacaggctagtcggtgcaacatccagggtcatgcctttcggcctaaaaaacataggcacaacataccaacgactgatggatcgagtcttcaaacaacagatcagactaaacattgaggtatatatggacgacatggttgtcaagtctcaaagcataccccaacatgtggcagacctagaagaagtcttcagggaactccgcaaatatgacatgcacctcaaccctaaaaaatgtactttcggggttggcggaggcaagttcctcaacttcatgatcacacaccgagggattgaagccaaacctgacaaatgcactgtcatactggagatgcgcaacccagccaacatccaagaagttcagaatctcaacagtagactagcaaccctatctaggttcctcctaaagctccttgaaaaggaaaagccattttacaaactgcttaagataactgagcctttcctatgggacgagacttgcgaacaagccttcttggctttcaagaccatagccacaccactaattttgagtcaacccaggccaaaagcaccgctactcctgtatctctcagtagctgatgaatccgttagctcagccctcacacaagaggaaggaaaacactag

SEQ ID NO: 64091 - DNA, 192 bp, Glycine max
  Peptide Sequence Number=SeqID_180869
atggggtatattttaccgcagccccacggtaggcgccaaatgttcttaccaaaattcagaactgtgatacgtcaggtggacatggttaagtggggtcctgaactttgcacgtcggcttggagagagtgtgtgatgggatgtgtagaaggtttgatggaatctatatttatagtagttgagcgtgactattga

SEQ ID NO: 64092 - DNA, 297 bp, Glycine max
  Peptide Sequence Number=SeqID_180870
atgttgaccatctccaaatctgattttagacattcatcatcaactaggaaaggtactattaaaatagttgaaacatacagtgtttcaggggtagaaactgaggtgttcgggatctggaagaagatgccatcgtgtaagaagctagagcaatttggtgctgaacttgaaggtgattgggttaaggaggataagattgcaccggattcacagttccatataagtccggatctaggaatatttcaggatggctgcagcttttggattaataggacatcacttttctcagttttgcaatga

SEQ ID NO: 64093 - DNA, 396 bp, Glycine max
  Peptide Sequence Number=SeqID_180871
atgagtgtatgtaagaaactgtgtaggctgaagctctctaagcgcatatacttcgggaaggactgggcggtgtcccagccgaagcacccgccgccgatggcacgctcggccaccgcgttcctcccttcggcgccgatggtctacgcggtcatctccgatccagggatcgtagacaaccccgacatcccgagctaccaaccgcacgtgtacggaaggtgtgatcctccagcgctgattccgcttcaaatgaacgcgagaaatgtacacaacgcagtgaaccaacccgaatggcgctcaccaggcaccgacactggtctcgaagaatcgatgtggcatttgattttggttttgctattttgctgcttgagttatttatctcgtatcactaattgttga

SEQ ID NO: 64094 - DNA, 570 bp, Glycine max
  Peptide Sequence Number=SeqID_180872
atggaaagaattcttgaacggtatgagaggtattcatatgcagagaggcagcttgttgcaagtgatcaaccacaaactgtaggaaaattggactctagaacatgcaaagctcaaagcaaggttggaagtcctacagaaaaatcaaaggtatcaaatcaattcgagaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatag

SEQ ID NO: 64095 - DNA, 483 bp, Glycine max
  Peptide Sequence Number=SeqID_180873
atgattcatgttgatgaattaacagtgggagagaatatggatgtgaaattttcttttggagaaggttctttgttcgggtttgattcttgggagggggtgacacagggtattggagatgcatgcaaacattcgggcattagaaactttattaaggaactaagcaagtggtctggttcaccaggatactgcttagaaattggaaatggatcctgggattcttggactaagcctctattaaaacagttaaagaagatgagtgatctaggtcagggttacagcattgtgggactttctcagggaaacttgattggtagaggaataattgaattttgtgatggagcacctcgtgataagaattttatatcgctaggaggtccacatgctggtaccgcttctattccattatgtggagtatgtgctggttctactactgcgcttagaaagtctctgcaattcctctatattctatttgtcttttgttaa

SEQ ID NO: 64096 - DNA, 288 bp, Glycine max
  Peptide Sequence Number=SeqID_180874
atggctccacctaaagaaatatcggttatcattcaccaccatggtcagattgcagccgacccggatcaagagttgtctcatcacaacaatgaccaaagcgatgacgagggtgttgtcgtaccaacatcacctctgttgcaatatcaccaacctaggctcgaaagacctgtctcccccgacccatcgtctcctccttaccgtgccactcaacttgtcactaaggttttagacacagtcttggctcctggttcttgggttcatgagttagtaggaagggtaatgccatga

SEQ ID NO: 64097 - DNA, 1300 bp, Glycine max
  Peptide Sequence Number=SeqID_180875
gagtatttttccagaaaggaaggttgagatataccacacggagttcgatgacttcaagacagagttggaaaggagtaatcttcacaaatgcctcacctacttggctaatgggactattgatcttgctttggtgaaggaattctatgctaacctctacagctctgagggtccttcaccaaagcaagccagagttaaaggccacctggtgaagatagacgcagacaacctcaacgcatttctagagactcctgtagtcctaagggagggggagacattacccacccactctaggtactacaggttgcccatagactatagagagattgaggctgctctttgcataccagggagggggttcattttgaatgttgagggccatccagggaggattctcaggaaggattttactaccttggcccaggtgtggagtgttctctcttactccaacctggcctttacatctcacacctcagaccttacagtagacagagccaggttgatctttggcctggtctctcgcatggatatgaacatcgacgctttcatatcaagccagatgacctctattacccagtctaactcttccagacttgggtttccagctttgatcactaccttattccgagcccgaggggttgtctctgacagcctcacatttgagtgcctgagcctgatcattaacttggcctacatcaggaagatttgttggaaccctggtgatctgacagttgctttccagggggctaggagggtgagggcgaggccagctgatattccatcttcttctgcagctccagcacctattccagcatctacttctgcagcctcttcagttccagctcatagtctacaggtggtagctccttcaggatccatcctatcagtggagcagtttttagagagggtagcctggcctgggacccaaacttctctttatcgggaaggtaaaggtcccatagcctgggtaccccaacaggtacaagatgcttcctcagagaccaccattccagagccattcactcttcatcctaaggcaggggaagaacaagcaataccagagactgctgctactcctgtgagatcacttgagggcacattagagcctcctactccagtagcaaacctctcctcaccacagcctacaactgacccttccactcctgtacttgacataccagaggaccagaccacaccagtcctggcactgaacacctctcctctagctactctagtacttcacttgacagatgaaaaggatgctcagactcaggttacccaggatctatctcaggacttttaa

SEQ ID NO: 64098 - DNA, 216 bp, Glycine max
  Peptide Sequence Number=SeqID_180876
atgtttgtattcaacagtgctttgaaaggacttgacgatactcaacaaagtaaatccaaggctgctgctagacaaaaagaaagcactgagtgtgggtattacgtcatgcacaatatatcaactataatcttaggaagtttcaagaataattgggaaacgtatttcaatgatgttagaccattgaaacaagagagattgaagacgcttcacatctag

SEQ ID NO: 64099 - DNA, 192 bp, Glycine max
  Peptide Sequence Number=SeqID_180877
atgacttttacaaatggaaattgtgcttctatatttaccacatctggtgtggctgcgaggaaatttcagaccgagaatgagggtagacagtcattgttctgttactctaaaggaaaaaaattagccgaaacatcctattttgtctctttacccgttagtttcacgattctttctcaatcacaaaaggagtga

SEQ ID NO: 64100 - DNA, 279 bp, Glycine max
  Peptide Sequence Number=SeqID_180878
atgggtgcatattctagagacgagaagttattgatgtatttcttccaagatagtttggccggagcggtggtcatctggtatactaacttggaagcttctcacatccgcacatggaaagacttcattactgccttcattacgcaagtggcccttcccatggttgagagggagatgatcatgatgatagtagatacactgccaatattctactatgagaagttggtgggttatatgcccgctagctttgcggatttagtgttcgcgggagagagaattgaa

SEQ ID NO: 64101 - DNA, 597 bp, Glycine max
  Peptide Sequence Number=SeqID_180879
atgcctacatgtcctcgtattcagagcactacacgtcctccccttcagtggagtacacgttctcaccttccgaggactacacatcctcgccttcagaggactacacgtgctcaccatcaggggactacccatcctcgccttcagagggctagatgccctcatcttcagaggagtacacgtcctcacctcaagagggctacacgccctcaccttcagaggactacacgtcctctccttcagagggctaacgtccttgccttcagagggctacacgtcctcaccttcagactacaggtcctcgccttcagagggctacacaccctcgcctttataggtgtacacgcccacgcctttagaggactacatgtcctcacctttagagcactacacgtcctgaccttcagaggccaacacgccctcaccttaaaaggcctacacgccctcgccttcagagcgctacacaccctcaccttcataggactacttgtccctgccttcgaaggactacacgtcctcactttcagaggactacacgtcctcacctttagaaagctacacgtcctcaccttcacaggagtagatgccctcatcttcaga

SEQ ID NO: 64102 - DNA, 174 bp, Glycine max
  Peptide Sequence Number=SeqID_180880
atggggggggtgaaagaaaggtgcaaaattgggctttgggccttcgtagtctcgctgagcatgaagcctcacgctcagcaccacctcgcgctcaacgcgtgtcgtgcgcttagcgtcttgccttcttgcatgctgggcacgtcttatgccttgctggacttgagcttcttctga

SEQ ID NO: 64103 - DNA, 210 bp, Glycine max
  Peptide Sequence Number=SeqID_180881
atgaccatggatgaattaaagcgcctaagcatcccctcagaaatgcttaaattctttaaccactctagtttcccacacaagggacatccgacaaggtcactacacccccctcatgaacatacacaacatgcacatctcaatgcatatccaacatcatcaacattccatttcaatatcattctcaacataaacatcatctcatctcaatga

SEQ ID NO: 64104 - DNA, 1089 bp, Glycine max
  Peptide Sequence Number=SeqID_180882
atggatccaaaaacaataccgggatctcaaggtttattccgacgaattgcactaggtgtgtcaatgggtagtgagtcaggaggagcttcaggaaacctagcaatatggaaaactggtgttggggaagaagacccggagtggtggcgttctcaccctgcaattccacgaagcgcccgtgatgaaagaacatcacgtgtaatggtgttggagcggtccgacaagagaaggctgacggggtgcaaaattctcggtgctaaatcacccgataaggagttcgaacttatttgggccagttccaggtcgggtgtggggtttgggtccgggtcaggtgtgggttttgggtctgggtcaggtgtgggttttgggttaggtccttcggatatgagtgtggctagcttcgggtcaggttgctctatattaggacccaatgggtctgcggcacatcgatggcctctatggaacttctcatcgcatgtgaagcacagcccgtgctcatggcgcgaggctaactcctccggggtgagatgcctgacggtcggagcctatggtggggaaggcagcaaagggggcaaaggcatgatacgagggggaaccaaaggggctggcggtggagctaccaacggtggggtcgcggccgcggtggaggcagacgaagccttgtccacagtcataggctggtggacctggactgtgcggcgcatctccgatgtcaaacccgagatgaagcaaggcaacaggaagggggtcggcaagccgataattctattagccaagtcttcgaactccttcaggcacaggagcaaggcggttgagaagcttgtccatgttgagggtcatagagtgcatggtattgtcaagacggacaagggcttcgtcgaggttgcgggaggccatgaggacaaacgagagaaccaattgttacgaactgaacataaatgcaggaaattaagaactggcttcgaggcaccagaacctccagaggaagaagaagagcagagatgggagaaatcagaaatcgttattcttgtctcccttgcttctagcacagatcattcaacatcattccttaggatcacacgtaatgcttaa

SEQ ID NO: 64105 - DNA, 714 bp, Glycine max
  Peptide Sequence Number=SeqID_180883
atgcgggcgggccttacgcggggcggggcggcccgcttatccatccctaccgcagacccattgggtcctaatatagagcaacctgacccgaagctagccacactcatatccgaaggacctaacccaaaacccacacctgacccagacccaaaacccacacctgacccggacccaaaccccacacccgacctggaactggcccaaataagttcgaactccttatcgggtgatttagcaccgagaattttgcaccccgtcagccttctctccggcaattgtgtggtcctccttgttgatgggggaagtaaccacaacttcctccagcctcaactagctatctctttgggcttaccttgtcggaccgctccaacaccattacacgtgatgttctttcatcacgggcgcttcgtggaattgcagggtgagaacgccaccactccgggtcttcttccccaacaccagttctgccacctctgtcggcacaatgagggtgtttcgcacttccatattgctagtttgaaaaaccaacaccttgaggacaaggtgtttttgatggggcagggagtgatagggaagcgtgatagcatagcagacaaaggaatgtattcaaaagaaatagatgcgaatcaagacatagcaactataggggtgtctacagcaaagaagggtgtaaatcaagcagaaaagaaggtgcaagcagcagtcaatacctaa

SEQ ID NO: 64106 - DNA, 186 bp, Glycine max
  Peptide Sequence Number=SeqID_180884
atggtgtttaatcatcttattcagactgaatggaagcgtgtggcagtcaagtattactcagatgactggccaacaaacaatgcaaagttagcttttgagaagtttgtatttaccaagactgttaagacaaatgctcgtagaagatttttgcttaatgattacgctaggggtggccggagtacgtga

SEQ ID NO: 64107 - DNA, 699 bp, Glycine max
  Peptide Sequence Number=SeqID_180885
atggaaagaaagcctcaagaggctaacattaacctctcatacttccatgggaaggaaaatgtaaaggcttacttagattgggaaataaggaaagaccaaggtcaaggcatcttaggggtgacaccttctaagcctaaagatgataaggggaagacaatagaaaagcaaccccctaagactagtatgcaagagaagactagctctacaaagtgctttaaatgtcttggaagaggacacattacttctcaatgccccaccaagaaaaccattattatgagaggccaagacatttatagtagccatgatgcggctactacttcaccttcctctagtgaaagtgaaaaagcaaaaggggaagaatctagtgaagaaatttactcccaagaagaaggacaaccattaatggttaaggaggagtgtaaagagggaatgatgcaatccgaccccccaagggcattggatagaagacttcaagaagattgggccagagatgcaagagaatgccctaggctcgccatttgggctcagcgcgcatccattgctaagcgcagcatcagcgtgcttagcacgacaaaagaatctagcagagcatcaatatcatggccgcacactaagcgcgagatcagtgcgctaaacgcaagggttgtcttctgccaggctcagcgtatgactggcgctaagctcaaatccacttactag

SEQ ID NO: 64108 - DNA, 234 bp, Glycine max
  Peptide Sequence Number=SeqID_180886
atggggaaagggggctcacgggggaggcttctggaagactcgttaggggttcttccagagcttccgaaagaagttgttccggaaacattccggaagaagtgttcttccggaagaaaccaaaggtcttctagaagaacccttcttccggaaatctcccggaacacctcttccggaaagtttccggaagaagtagttctttcggaagaattccggaagaagggttctttcggatga

SEQ ID NO: 64109 - DNA, 360 bp, Glycine max
  Peptide Sequence Number=SeqID_180887
atggcatcagaattcacgagcgattctcctcctcgaatctcagccagcctgcatcaatcagactttgcaccttatgtttcaaggtcatacaatgctcaatggaatgccccggaactcccctatgataaacacatgtcacgttggggttgtatcctttgggaaatggaggggtggtgcttggcctcggatgtggagcaggcgggtgttgtggctgatttaggggtggcctttgtggatgattgggtggtcttggctaatagggtgctgggaatggtagtcacatcatgggttcctccctccttcttattctctcaattttccccaggcctcatatcaccagaattcatcgaagcagcataa

SEQ ID NO: 64110 - DNA, 423 bp, Glycine max
  Peptide Sequence Number=SeqID_180888
atggtttctagaggtatcatccccttcgacaaacatattgcggcagtaaagactaccagcaacaatatgttatcaaagagaaaaactctagatgagggttcactgttatcaagcaagtcggagactcagcatgaccatagattcacctccactccttatgttcctatggacccgaaacgtaagagaaataaaggggaaccgacaaaagaggaagtcatgatattgcacgagattagaaggcctaactctctaaaaacaatcccaactggagtagccaactgtcgcaacctacccttcggcgggagggcgacacgagggctcacgggtgtgtcttccaagaaaggaaaatgcgcggagttgccaccaacttttattcgaggaaaacgtcggaaaaactggaaaggtgtggtctacgaactttaa

SEQ ID NO: 64111 - DNA, 603 bp, Glycine max
  Peptide Sequence Number=SeqID_180889
atgcaaggggtgtttgggatgatttggggatgtactggaagtagtgctcttgctattggtattggtggggttttgggtattgaagggagggttgttgctatagatttaagccctttggttgatgttggtattacagcttacaatgacaagatgacacaagaaatgagtcaaagtggcaactttacagaaatttcagctaatgacagtgtgggtaaagtactgggaaaggatcacactgggcatgtgtgttgcttaagactaggaggtcttcacagtgttgcatttcagtccaccacaagctttaatggtttagggtctagtttttcaaattttaattcagttgagagctctagattgaaagaggagaatacttgtttaagagacaaattgacaacgtcggaagaaaatgtcaagacattaaaaaatgtcatgcttgcatacatccaaatgaaggaaggatatattccttttgagttaggtgctatgtttggtcataacactagtaatgtagttatttttatttcatacaatgaaggaagtggacaagatgggccaacaccaagaggagactcatcattagatagtaatttccatgcaacttga

SEQ ID NO: 64112 - DNA, 522 bp, Glycine max
  Peptide Sequence Number=SeqID_180890
atggaagaaggatattctaccgataagccacccatgttcagagaaaatggaaattatattccatatgatgatgaactaaatgagatcccaagaagcctatggatggaggagcaaaaactcatattcttgctcaattccaaggctcttaatgttatgatgtgcactttattagaagaaaagtacaccaaagtacatagcttcaggagtgccaagaaaatgttggacaccctagttataacttatgagggaatgtcacagataaagaagaacaaaataagtctcctcacacagctcattgaaactcttaaggttcatgaacaagaactacaacatgatagagggcttaagaaaaataaatctctagcactcaacgtccaaaagaccaaaaaagcctcattgtccaaagagacatcctcaaaatcagcgttcaaaggctcgtcccaagctcttagagtggaaatctgctttaatgaagaatctaaggataagtctgatgaagatgagttcgctttcatctcatga

SEQ ID NO: 64113 - DNA, 428 bp, Glycine max
  Peptide Sequence Number=SeqID_180891
atggctaggaccatgctcaatggtaattcaacccataaacacttatgggctaaaataggacgaaaatccaacatatcatacttccatccatttgggtgtaaatgtttcattcttaacactaaagataacttgggaaagtttaattcaaaaagtgattatggaacatttattggatactctaaaacatctaaggcattcagagtttacaactttataaccttggtagttgaggaagctattcatgtgaagtttaatgacactgagcctaataaagatttatcggagatggatgagtcctttgcaaatctaagactagaggatgagctaccaaaagataagaaagttgttggagccaattgggtcttccataacaagatggatgagaatggtaaggttgtgaggagcaaggcatggttagtggccaaaag

SEQ ID NO: 64114 - DNA, 372 bp, Glycine max
  Peptide Sequence Number=SeqID_180892
atggacttttctttaggtgtggttacagaggacatggaagaggtttcggtgcacatcacaaatgtgcgtccatatgttgaacgatggtgcatgatagagtcattggatgataagccctttgaatgctatttggttctttatccaaaggagttgagcacacaacttgcctccaatgaagtgataacttccacttgtgctcttcctttcaagcttatttctagcatagtcggtgtcgcaacctacccttcggtgggagggcaaggagaaataaaaagggcatcttctcatgaagaaaacgagtggagtcgccaccaatgtttattcgagaaaaacgttagaaaaaccaaaaaggcgaaggtctatggattttga

SEQ ID NO: 64115 - DNA, 510 bp, Glycine max
  Peptide Sequence Number=SeqID_180893
atggatacaccaggctcacttcaacttagtgaagacgcaaccacgttggttggcccctggaacacagtagaatgttcatccatcaataaaggtatcaatagaggtatcaccaaaagtagcttggagaaacttaatgaagtcaaaggagcaaaaaagtacttagaattacactcctttggacctatttgcaaaacacaggacgaatccttctcaagagaagatgttgataggtatgccttcaacaccaggttgaagaaccttttgatcatcttccatgaaactacttatgatcttacggagatggatggaggagactttagaggtcatgagatagcttatgctaaagcacatgttgatattgatgccaaagctatggaggacaacattgttaatgaagtcatcattaatctcactaacatttgtgtcatggatgagaacccagaagcttcaaaagcagctcaagcttacatgaagctacattcagggaaaaggatgtgccttatgcaatga

SEQ ID NO: 64116 - DNA, 702 bp, Glycine max
  Peptide Sequence Number=SeqID_180894
atggagatcaccaccatccacactaacaacaaggcaaccatcatgtcaaacacttcttcgacgtcatggaagaaactctgtgctcctgaacaacaaagtgatagtttccaaagttcttggagtgaagggcctatgattcacgtggctagagcactctacaatgaaaatgctgagaaagttggtgatcagaagacgattgtgtacaacattatgtgtaaaagggctaacatttgggcaaacattctcaataaaagcattctccacaaggccagagtctaccacttgtttgataagatggatgatgactccaagcacaccatcacagtcaaaggttttcttgaagctatcaatagaaggaagcagaaaagactagccaaagccattactaatgaagataaaggtctaaacaactttggtatcactaaaaagattcagaaagaaaacaagaaagcaatcacaaagggaagaagaggacaaagagttgatcgaaaaagaaaacatacaaaaaggaggcatgagctagctagtttgtccaatgctaatcatcaattgaaagacttgagggaaactgattatgacaatgatgacaatgttcaacttgctctaaggaaaagtaaggtcactcaaagacaagcatctcctgcttctaagacggctagagtaaccaaagcagcacatacggccaagaaaccaattggatag

SEQ ID NO: 64117 - DNA, 1265 bp, Glycine max
  Peptide Sequence Number=SeqID_180895
gaatgtattggtgttgttcagagcagaaaggtggatgatgttgttgactgcagaatcactagtcctagtcctctttcgaactctcttggggactccaatggtggcaattcactcattgatctgaagcttggtaggtttgatgaccatggagatgccatggttccaacattttccaagggagcccccattttgtctttgttggagtcgtccacgccgccgaagagggtgagagctttgggggcacattctcagactgcttactgccaagtctatggctgtaacaaggatctgagtggctgcaaagactaccacaaggggcacaaagtttgtgaggttcactccaagacttacaaagttatagtgaatggcattgaacaaaggttttgccagcaatgtagtagcactgctgtaatgtttagcatactatccaggtttcatttgctggctgaatttgatgatggtaagcgtagctgtcgtaaatgccttgcaggccacaatgagcgtcgaagaaaaccacaagtgggtattcactctggaaaagctgggaggttgcttcagctatatcctgtggagtcttgtcttatgagaaatacgaagcgagtgactggagacctatcaaagcctgaagacaacaccagttttacttttaggcccctttcttctattcctattaccaatggacatcctcagtcaagatctttgtttccttcgtatagtgaaaaacaagttccattgcttcacaaaaatggtgctacgtctgccacaggaaacgtcttctctgaaaacaataatcaatatcatccaccttcccttggtggccaaagttccgggtcacaatcactattccaggacacctccttaggaagcgaggacttcaatgttttcaacacagaatcagcggttcaaggactatcccaatcatcagggattcccatggctcgcccgatggttattccaagcagccatagccattacagcatgaatcaggtttctgaaaagatgatgggaataagttctcaggcttcaaataaagtgtttgataggtttccacctgaattcaatcctgtagatggacgtcatcttagacccatattgatatcagacaataatgaaattttcaattttgaaatggcagatgggatcttccaagggtcggattttgtgaatgtgaaagatcatctttcctgtgaagacggcctcacctttgactcgtttcaactatcatctccactgcagcgcgtcagcaacagaggcagttcttgcag

SEQ ID NO: 64118 - DNA, 388 bp, Glycine max
  Peptide Sequence Number=SeqID_180896
tcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaaggtgacactctaccgctga

SEQ ID NO: 64119 - DNA, 399 bp, Glycine max
  Peptide Sequence Number=SeqID_180897
atgggtgtagaaggtctagtagaaattgatgtgaaaaaatcagcactcatcactcatgtgataagtgatcatctaggattgggggtgaagacaggattgccttacatctggcacagcaaagccagcaacccatttgtaaacctaaagaaggagtacaaaggaatttactggcaagaagagctgatcccatttttccaatctgtttctcttccaaaggaatgcacgactgctcagaaatgttacattgaactctccaagcaagtgaaggcaaaacttggcaaggttgatgagtatttcaacaagcttgcagatgctatggtgacatggattgaagcttgggatgaactaaacccatctgggccaaaatctgaagcattgcccaatggttcagcaaagtaa

SEQ ID NO: 64120 - DNA, 261 bp, Glycine max
  Peptide Sequence Number=SeqID_180898
atggttcagcccactaatccaagatcaagtcaaagattctccactaagattgcatcacctatgaaagataaaggcgaggactttgagtcgtatagaaacataaaggcgaggacgttgagtcctgtgaaagataaaggcgaggactttgagtcctatggaaacataaaggtgaagacgttgagtcctatgaaagataaaggcgaggactttaagtcctatgaaaacatgaaggcaaggactttgagtcttatggaaacataa

SEQ ID NO: 64121 - DNA, 549 bp, Glycine max
  Peptide Sequence Number=SeqID_180899
atgttatcagaccttacaaagaatcacttactagggaaagtcgttgcattagagataccttcacaagaagatgatccagaactctataaattagtgcaaaatcacatggttcatggtccatgtggaattttgaggcctgcatctccacgcatgaaggaaggtaaatgcagtcgattttatccaaaaaaatttcagctcacaactcttatagatggagatggttatcctgtggatcgtagaagaaacactggtcagacaataaccaagaatgagattataattgataatagatgtattgtaccctacaatccaaaattgctgaaaaaataccaagcacatataaatattgaatggtgtaaccaaaacacttctatcaaatatttattcaagtacatcaataaaggatatgataaagttacggctgtcatggttcatgatgacactagaacagttccccatgcaaacactctgaatgatgaaatcaaggaatatctggattgcatgtatgagccaagtttaatatgtaaatcatcttataattgtatttaa

SEQ ID NO: 64122 - DNA, 375 bp, Glycine max
  Peptide Sequence Number=SeqID_180900
atgccaaacatccttcaacacctaaccacaagtccggctcttcccatgactagtagcaaggtcatccaatcatatggtgccacgtggcggatgaatattcgtagtaccagccagtcaacgccttcccgtgttgtgctctatatacagatgatagttgcacgaatgataagatacatgtcagttactgattcatggtcgtaccttacatgccgatcggacgggagccgctgttccagattcagaatcaggattcacgcggttgtgaaactcagttcgatcactgaccaaatcaaaatagttggtcgggctggtccaaccgggatctggtggctaattgtccaagtttggctgggtcctcccgtgtcaattgtatga

SEQ ID NO: 64123 - DNA, 180 bp, Glycine max
  Peptide Sequence Number=SeqID_180901
atgaggccagaaaacccctgctcgttgtgtatccaggtggtctcacacatcactgctgctattaaagattggattgagggtgttgtgattcccgtggatggaaaggagggccctgcagatgtttgtgtgattgaactgggaggcactgtggagattgttgagcacaagagccttgtctaa

SEQ ID NO: 64124 - DNA, 981 bp, Glycine max
  Peptide Sequence Number=SeqID_180902
atgaagaatgggcgacttttcttcgtgtccgacgtcgcatctggcttggagtgcaagtgtgtgtgcccggagtgtggacaagcgcttgttgcacgtaatcgggactttcctggcagacgtcgcgtccggcacttccagcacgctcgagcatcctcatgcccagggggatatgagacagctgtgcaccggatggctaaggatgtgctgggcactgcagatgctgtcgtgctgccgcgttgggctagcggcgatgttgttatagagccggaaccgatgttaatcgtgaacgcttcgcttgaggtgcctctgctggacggggccactaggccggacgtcctcgtgcaaggaatggcgtcggagatcgagttcaatttgctctgcttcgaagtcagagttcgacatgctgtggacgagccgaagcgtggcctattggccaccaacggtatcgacgcggttgaaatcgatctttcgaacctggacgaagaggtcgtcgttgatcccgcagcatttcggcgcgaggttctagaaaattcacggaacaggcgctggattcatttgtcgaacgcgtcttacgtctcccatcgcgctgataaagcgcttatcgaaattgaggacttgactatcgccgaacgcacgctgatcacgaaagccgggcgacccttcaccatccgcgagcagggggcgtttctggtgaaacctggatcccgcgatccggtgcgtattcaaatcccggatgagacggttggtgagcacgttcaaccctacccacgcggtatgcacacagtgtcgactcgctcgctcatgatcgatgagtggggccgcttgcgactgcgctacaagatgtatctagatcagattcagatgaacccttccaaacttgagctgcctcaaggcgctctctttgaagcgtccgaagacgaggtagcagggccgggcttcagagtgcggatgcgtgattggaaaggaagccctggccactaa

SEQ ID NO: 64125 - DNA, 282 bp, Glycine max
  Peptide Sequence Number=SeqID_180903
atgggccagtgcctcgccctgtacttccagtgcggccagcggccgacccaacaggcgccggacgctgacgcccagccagcgggcgaaagccggattgcagccggcaatgcagccatcggccccggcccaggccagcggcgtgccgagggcatcaagggacggcgggggtgcggggtcggacattgcaccaatctagtgcaaaacgtgggctctgacccctgccgcaggtcgagcaggtggacggattggcaaagtccgtgttgtttgtaccgactttggtga

SEQ ID NO: 64126 - DNA, 630 bp, Glycine max
  Peptide Sequence Number=SeqID_180904
atgacctcccgcaacctcgatgaggcccttattcgtcttgacaataccatgcactctatgaccctcaacatggacaagcttctcaaccgccttgctcttgtgccttcctccaccacacccaaccccacaccagtccctcaccactccacctttgttcctgtacaaatccggtatgccccatcaccgtatgaggaccctgttggtgtcctgttcaaactcactcagacggaattatcggcttgtcggccccctttcctgttgccttgcttcatctcgggttttgacgctggagatccgctgcgcagtccaggcccatcagcctatgactgtggaccaggtcgccggcctcgcgaagatccaggagcagaagttgttagaccttcgtcttcctccaccgcggtcgcgaccccaccgccagcccctttggttccccctcgtatcacgcctttgccccctttgctgccttccccaccacaggctccaaccatcaagcgtctcaccccggaggagttagcctcacgccatgagcacgggctgtgcttcacatgcgatgagaagttccatagaggccatcaatgtgcctctagggttcatctcttaatcgcagaggatgaggaacctgcagactag

SEQ ID NO: 64127 - DNA, 477 bp, Glycine max
  Peptide Sequence Number=SeqID_180905
atgttaggaggtttacaagaatttatgctacttgaaccgcatcacgcagaagagcttgaccctgaaaaactggaggagcaagctgctttggatagtaccaaaaggcttgtggagaatttgaaatcaaaggtacaaaaagaagaatctgaagcaaatttgaattttcagacgagtgtgtgcgaaaatatatcgtctgttaaggaggatgagagagaagataagaaaaaccgagtgcgagaggccgaggaacaatcgaagaagagagttgtagatgctatgcatctagttgatgaagcaaatgtatctaaaatggacattttgagaaaggtagaggaagccacagaagaagttaaaaccagcaagaaggcccttgaggaagctcttgaaagggtagaggctgcgaatcaaggaaagctagcagttgaagaagaagccaacactgaacttgaggtgaataatggcttgcttttgtgctga

SEQ ID NO: 64128 - DNA, 453 bp, Glycine max
  Peptide Sequence Number=SeqID_180906
atgagtccatggcagatgctatcgcacaggacaccggtgcagagactgacgcacaggatactggaacgtcctgagttgaagttatcctcccatgggaggaaggtgcataacttaggcaaacctgttcctgcaattgaggatatgattgttgggataggattaagtcctttgatctcgtgttcgattgacactgacgatcagggacttatatcctcctttatcgagaggtggcaccgggagacttctagtttccaccttcccgtgggggagattacgatcacgttggacgatgtcgcgtctcttctccatctgtcgatcgttggcgcattgcatgacttccagcctctgcgcagcgacgaggcagtgctgctcttggttgaactattgatggtctcaccagaggtggccatggccgagacaggccaatgtggtagaccacacgtacgcctgtag

SEQ ID NO: 64129 - DNA, 201 bp, Glycine max
  Peptide Sequence Number=SeqID_180907
atgactggtacccgtcgcctgtgtgccgatgcggtcggccttcaacgttggggagcacccatgtggtttagtgttggaactttcactcagcattttgatggtggaaaggctcaaacacaattgatccgcatgaagctcgcggatcaacttgatccacaggaagcatgcggatcaaccttttcttcttgtggatcaacctga

SEQ ID NO: 64130 - DNA, 411 bp, Glycine max
  Peptide Sequence Number=SeqID_180908
atggaagcaacaatggaagcaataacaaacaagaaaaggggcaatagaccttacctcgatgaagaacagaagagcaacacctcgcggaagaatggaagaagaagacgcactcgaagggagaagaagaacaaccacctcgcgctggggaagcaaacgggctcgcggaagaaggaggaaggaggaagaaaggtccaccggcggaagaaagaaggagaagaggctcgcggaacaaagaaggagaagaagaaaggctcgcagaataggataagaaaagttgtggaaaaaggaagaagaaagggtcgttggttgtctcactccgcacactcttacactgactctcaaccgacttggtaccctctcacttcatctgttcattctgccactggcaacgccgccattgttgctctgtga

SEQ ID NO: 64131 - DNA, 357 bp, Glycine max
  Peptide Sequence Number=SeqID_180909
atggtaggcttctctaacccccttttgaaccaagaactttccatgattttggccattgatatccttgtctttgggtttggatccaagattttcgacagcaatctgcgtacatctggtgcacaatggctgagatttcttcgcacctcagtcgctcgagcgaaaaatagatatggacagtggactaaacatccaatgtcatcaaggttgaacaaggattgctcagatggaggcacgaactcattagcctcggtgaaggaattcttaactgtcaagcgcatctttcagcattccttgattttggtgatgacgctagagaacaatgaagaatatggacttcttggaaagtttgaagaataa

SEQ ID NO: 64132 - DNA, 438 bp, Glycine max
  Peptide Sequence Number=SeqID_180910
gggaaaacatcggcaccggtttcgctcaacggcgggctggtccaggcggtgaaaatcacgacgctgaatgcgcgtctgccggaaaacctgccggtcgtgacggggcatcgcgaccgctatgacctcgtgttcaacgcgcaggggaaagcgccgtacgtgctcgcctggggcaacggagcagcaaagcctgccagcgtggagcccgacatgctgatccctgccgacctgcgcaaaacctatgatctggcaaatctgccgcaggctgacattcaggataatgtcgcattaggcggcgaggggcgtttaaccgccacgtccgcagccgagcgggaaagcaggatgaacacgctactggtctggggcgtgctgattgcgggtgtcgttctgctggcgggcatggcctggcgcatctggcgagagacgcagcgtaaggcataa

SEQ ID NO: 64133 - DNA, 1998 bp, Glycine max
  Peptide Sequence Number=SeqID_180911
atgactggcgaagatgaagtcatggaagtagctttggataggaaattgaatcaacaaatttgcaatgccatagatactcgcttccttttgcaactgacaaatatattatttggagatttttcatctgccaatagttcagatcatgagccagatgacaaggaggttgcagctgttggtgcagtttgtgggtttttatatgttatcttcaatactttgccactcgaaaagattatgactgtgcttgcctaccgaactgaacttgttcctatactttggaattttatgaaacggtgccatgagaatgaaaaatggtcatctttgtctgaacggttatcatacctctcaggtgatgcacctggttggctgttgcctcttgctgtattctgtcctgtctacaagcacatgctcatgatagttgataatgaagaatattatgagcaggagaaaccgctatcactgaaggatattagaagccttatcattctgttaaggcaggctctgtggcagctaatgtgggtgaatcataccacgtctgctaattcagtaaaatctgttccagttagcccagctattaaaaagcagtcggaagcgattcaacagagggttagcattgtagtgtcagagcttctgtcccagctgcaagattggaacaacagacgacaatttacatcccctactgacttccatgctgatggggtgaatgacttctttatctcacaggctgttatggaaaatacacaagcaaatgaaattttgaagcaggctgctttcttgataccatttactagcagggttaaaattttgacttctcaactagctgctgcaaggcaaagacatgggtctcaggctgtttatactagaaaccggttcagaatacggcggaatcatattttggaagatgcttataatcaaatgagtcagttgtcagaagatgaccttcgaggattgattcgtgtggcttttgtcaatgaattgggagttgaagaggctggaatagatggaggtggaatattcaaagatttcatggagaacatcacacgtgctgcctttgatgtgcagtatggattatttaaggaaacagcagattacctgctttatcccaatcctggatcaggaatgatacatgaacaacatctccaatttttccattttcttggtactcttcttgcaaaggctatgtttgaagggattctggttgatttaccttttgctacattctttttgagcaaattgaaacaaaagcacaactatttgaatgacttgccttccctggacccagaattatatcgtcatcttatctttctaaagcattatgagcgtgacatttcggagttggaactatattttgttatagtaaacaacgaatatggagagcaaacagaagaggagctgcttccagggggaaagaaccttcgtgtcaccaatgagaatgtcattacttttatccatcttgtagccaatcaccgcttgaattttcagatacgtcaacaaagttctcatttcctgagaggatttcagcaacttattcagaaggattggattgatatgtttaatgagcatgaacttcagcttctgatatcaggttcacttgacagcttggatgttgatgatttgcggcagcatacaaactatgcaggaggttatcatagtgaccatcatgttattgagatgttctgggaagttctcaaaggcttttcattagaaaacaagaagaaatttttgaagtttgtgacaggttgctcgcggggaccattgcttggattccaatatcttgaacctttgttttgcatccaaagacaaaaggatcacagaatggaattgtctgatgtctcttcttgtagggctggtagtaatgatccagacgaagctcttgatcgattacctacatcagctacttgcatgaacttactaaagcttccaccttataaaagtaaagagcagctggaaaccaaattactctatgccataaacgctgatgctggctttgatttgagttaa

SEQ ID NO: 64134 - DNA, 369 bp, Glycine max
  Peptide Sequence Number=SeqID_180912
atggatggaagcctcgtggagttcaatgattggattgacgagatggaggtagaagaaatgccttgggtgaaagagtttcacatggaaagtgaaaatgagatttgtttcaaaatcaaggggagacataggcaagggagtctagatggagctccgagggatagtatcgaatccatatggtggagggatctgaagatggtatctcaacaccctcaacagggacaacagttgaacagatcgacattatggaaggttgggtgtggaaataagtttaaattttgggaggataagtggacatgtagagacaatcaattatcagagaaatacccaaggttgtacatcatatcatctcaacaacatcatctcatctag

SEQ ID NO: 64135 - DNA, 2886 bp, Glycine max
  Peptide Sequence Number=SeqID_180913
atggtgaaggtgcgcatgaacacagccgatgtcgccgccgaggtcaaatgcctccgccgcctcatcggaatgcgatgctccaacgtctacgatctctctcccaagacctacgtgttcaagctgatgaacagcagtggagtatcggaatcgggcgagagcgagaaggttcttctgctgatggaaagtggcgtgagattgcacactactctctacatgcgtgacaagagcaacactccttctggtttcactctcaaattgaggaagcacattcggactcgaaggctcgaggatgtgcgtcaacttgggtacgatcggattattctctttcaatttggacttggagagaatgcaaactatgtcatattggagctgtatgctcaggggaacatcctcctcacagattctacttttactgtcatgactctgctacggtctcacagggatgatgataaagggcttgcaattatgtcacgccatcgttatcctgtggaaagttgcagagtttttgaacgaactactattgaaaagttgcgtacatccctagtgtcttccaaggaagatgatgctgatgaggctgttaaggccaatggaaatggaagtaatgcttccaacgtagcaaaagagaagcaggaaacccgcaaaggtgggaagtcgtctgccacattgaaaattgtccttggggaggcccttggttatggacctgcactttctgaacatataatattagatgctggcctaatccctagtacaaaagttcccaaagatagaacgtgggatgatgctactgttcaagcgctggtccaagctgttgtgaagtttgaggattggatgcaggatgttatttcaggtgaaatagtccctgaaggatacattttgatgcagaacaaaaatctggggaaggattcatccatatctcaaccaggaagtgttagccagatgtatgatgagttctgccccatcttactcaaccagtttaagtcaagggattatacaaagtttgagacatttgatgcagccttggatgagttctatagcaaaattgagtctcaaagggctgaacaacagcagaaatccaaagaaaactcagctgctcagaaacttaataagattcgtcaagatcaggaaaatcgagtacatgttttgaggaaagaggctgatcactgtgttaagatggcagaattgatagaatacaacttggaagatgtggatgctgctatattagctgttcgtgtagctcttgcaaagggtatgaactgggatgaccttgctcggatggtgaaggaagaaaagaaagctggaaacccagtagctggtctcattgacaagctccatcttgagaggaactgcatgaatttactgttaagcaacaatcttgatgaaatggatgatgatgagaagacactccctgtggataaggttgaagttgatttagctctctcagcacatgccaatgctcggaggtggtatgaacagaagaaaaagcaggagagcaaacaggaaaaaactgtaactgcccatgaaaaggcttttaaagctgcagagagaaagactcgcctacagcttaatcaggtggaaaaaactgttgcctcaatttcacatatgcgcaaagtccactggtttgagaaatttaattggttcattagcagtgagaactatttggttatcagtggacgtgatgcacagcaaaatgagctgatagtgaagcgatatatgtcaaaaggagatctatatgtacatgctgatctgcacggagcttctagtacagttattaagaatcacaagcctgcacaaccagttccacctctgaccctaaaccaagcaggatgcttcacagtctgccatagccaggcatgggattcgaaaattgttactagtgcctggtgggtttatcctcatcaagttagtaaaactgctcctacaggcgaatatttgacagtagggagtttcatgatccgtggaaagaaaaattttcttccaccacaccctcttatcatgggttttggcctactatttcgcttggatgagagttccttgggatctcatttaaatgaaagaagagtaagaggagaggaggaagcagcagatgattatgaagaaactggtcctcttgaaggcaaatctgattcagagtttgagaaggatgtcactgatataaaatctgccactgactcagaaaggaatgataatttgtcggcagattcacacaaacccctaccagaagacttccctgcagatgcatctcaaactagtttggccactatcaatgctgaaactgcaatttcacaagattttcctgcgaaagagacaagtacgttgaatgtggttgatagggagatattatcagatgttagtggaaatggcttagcatctgtgacccctcaacttgaggaacttcttgatcaagttctggaacttggacccattgctaaatcaaataaaaaatatggaattgagaagtctcaaattgatttagacactgaacaatatcttgaacaaagcaaaactgcagtaagggataaaccttatatatcaaaagctgagagacgaaagcttaaaaaagaacagaaacatggagaagaagatttgaatgttgaacatggaaagtatgaatcaaagctaaaagatatttctgctaatctacaagcgaaagaagatcaaaatttgaaaaaaggtggtggtcaaaaaatcagccgtggacagaagggaaagcttaagaagataaaggagaagtatgctgaccaggacgaggaagaaaggagcatccgaatggcattgttagctgtgagttcagtagcttacatgtccttgcatttctatccacagaccacagaaataattgatgtttttgccttatgcacgatagatgcaatatattttctaaattga

SEQ ID NO: 64136 - DNA, 177 bp, Glycine max
  Peptide Sequence Number=SeqID_180914
atgattgtggtggtggttggcttgattgttaacagagtggtggagacggtctcaaaggcgaccatggaagcaacaaacggtggtggcacgacacaaaacaaagaagacaaaggaagaaggcaaagtgcagtggcatacggacacatgaaacaggaaggatttttaatatttaagtga

SEQ ID NO: 64137 - DNA, 1260 bp, Glycine max
  Peptide Sequence Number=SeqID_180915
atggcgatgacggcgtcgcagttgcggtgggggtggagaccgacgccgaagcagcagcaacgacgccgtatggttccggtggtgtgttccatcgctataaagaacgctcagaacaaagagagagcgaaactgaagaagctcttcgaagaagcgtacgagaggtgccgcactgctcccaccgaaggcgtttccttcactatccaacaattcaccgacgctctcgacaagtacgacttcgacgccgaaatgggcaccaaggcacccttgtgttttggggttttggaatggattggtgatggttgctggttgtgttttcaggttaagggcactgtttttgccacagataacagcggagcttatgttgacattactgctaagtccacggcctacttgcctctgcatgaggcttgcatccacagaattaagaatgtggaagaagcaggcataattcctggcatgagagaggaatttatgatcattgatgagaatcaagcggatgataccttgatcttgagtttgaggtctatccaatatgacattgcatgggaacgctgccgacaacttaaggctgaagatgctgttgtcaagggtaaggttattaatgcaaacaaaggaggtctggtggctcaagtggaaggccttaaggggtttgttccattttcacagatatcatcgaaatcagctggagaagaacttcttgagcaggtgattccttttaagtttgtggaggtggatgaggaacagtctagacttgttctcagtcaccgcaaagctgtggctgagagccaaggacagctaggaattggatcagtagtcactggctctgttcaaagcataaaaccatatggtgccttcattgacattggtggaatcagtggcctccttcatgtcagtcagatcagtcatgaccgtataactgatattgaaactgttcttcaacctggtgatgttctgaaggtgatgatcttaagtcatgaccgagagagaggacgagtaagtctttccacaaagaagttggaacccacgcctggtgacatgattcgcaatccaaagcttgtctttgagaaggcggaggagatggctcagacattcagacagagaattgctcaagcagaagctatggctcgtgctgatatgcttagattccagccagagagtggattaactctcagtggtgaaggaatcttaggaccactagcttcagacttgcctccagagggagtggatctgagtgaggtacccccagctgaagattcatga

SEQ ID NO: 64138 - DNA, 282 bp, Glycine max
  Peptide Sequence Number=SeqID_180916
atggccttggtcttccaacacatgtttgaggtaagactcggttatgaggcttctatagcgcttttgaaaggtttggatggcattgtaagcctcacttttcatgaggcgttcaccggtgaattcgtggaacgtgattctgatgtaagggtacacaaagctggtgaatttgttggtgtaccttcgaacacgggcttgaagaggaggggggggaacaagcgcatgaacatgtcatatatgaacatggttgaggccatgagtgaccctgcctgtgtccacatctga

SEQ ID NO: 64139 - DNA, 168 bp, Glycine max
  Peptide Sequence Number=SeqID_180917
atgtcttccaccaatgtgaaaggtgaaacctcaaatgtgatatctgtggatgaaaaatacaaaaagtccagcttcagaaatgttatattgataaagataaatggaggagaaaatgctacaagcctattactgacagcaattagagctcaggttaaaacacaagattaa

SEQ ID NO: 64140 - DNA, 2502 bp, Glycine max
  Peptide Sequence Number=SeqID_180918
atgctattctcacatgccattttcgttcctactacgaccgctccaaccatcatctcgaattccattgtcggtggagaaacccaaggcccgcattggacagtgacgacagtgagggtaacgctatcagaatgcgtgcgcatcaagcagccaaaacgacggcgttggcatttacgaagtggcgttttggttgtatccgaagcggcagaggggcgtttaggtaaattcgggaagcgaaaagcaatgagaaatagcgaaacgcttcgtatctcttcactactactactactactacacttggtttctggtagtagtgttttttgttacgcacacaccaaaacggctctctcgcagcccaaaagcttcgccgtttcggttcgcgctttagggtttcgcgaaatgtcgtacgaatccgctacttcttcttcttcgcttatttgtggtttaattcagtcctcttggcatgtttctgtttgtggctcatttgtattgttaggcttcacagtatcaatcctcagtggtggcagttctggtatggaagtgtatgatgtttctgaaactagaaaccatgatgcagacatgattgaaggtgctgatttaaattcacacttcacgagcccaaatattgaacgaactgaggtcatgattaacgaaggagcccctgagttttttgttgaccagaacttgtattaccctgctgccaccaattatgggtattactgctcaggatttggaacacccggggaacaggaggaccagcataggatttttggtgtagatggtcccaatattcagttcacgggtgcacaaaatgaaagttttccgtatgtatattatagctatggatatgcacagtctccatacaatccatacaatccttacattcctggtgctatgattggagctgatggctcatttggaggaggacaacattattataccctccccaattatcaaagtccagtttctgcacctggttatattccccttgttcaacctgacaatttttctgatagttctgcggattccttttttggagccagtgcttctgtcagtaaacctgatggaagaggtttgaaacctaagttcaattcagcttctggtaacttttctaggaactcttcaatttttttatcgaatcagacaagttccttggccagggcatcagaaaggccgagagctaatgatgggaggaagcaaggtttgacacatgcaagtgtttctgggagtagttttctcaatttagcttcaccagctgttcatcagtctgcagttgctaaacttaggccgaagcttcacattggcaaagcagtgccaaatggtggaaatgggagctctgatgtattgggtgagcaaaatcgaggccctagagttggtagatcaaaacatcagctgtctgtgaaagcctatacaaccatggcaggagatggtaatgaacagggaaacattgtcatttatcctgatcaatataatatggaggactttccccttggctatgaaaatgccaagttttttgttataaaatcatatagtgaggatgatgtgcacaaaagcattaaatataatgtgtggtcgtcaacacctcatggaaacaagaagttggagaatgcttatgaggatgcaaagaaaatagcagctgaaaagtctgaagtgtgccctattttcctattgttttctgttaatgcaagtggacagttctgtggggttgcagagatggttggtacagttgactttagcaagaatatggacttttggcagcaagataaatggagtggaagctttcctgtgaagtggcacattataaaagatgtaccaaatccaaattttaggcacattatactggagaacaatgaaaataagccagtaactaatagcagagacgcacaagagataatgtatttgaaaggtttggaaatgctgaaaatattcaaaaatcatacattgaagacatctttgcttgatgactttatgtactatgaaaaccgtcaaaagatcatgcaggatgagaaagccaagtttctagtcaagagttttgatagtccaatatttgtaccagtattagaagctccccaaaagttgaatttttttgttgatgtaccaacagacaattatgagaagaatttgaagcccaaggatgattctgatggcttgaaacatatttcattttcaagtcctgagcagattgttggtaattctgatgtcactggcatcaagcatgcgcatgatgaaaaagatgagaaaattgctgttgataaagaacatatttcttctatcttaaagattggttcagtcactattgcccccaaacaagttgaggctaagcaatccgtcagcaatggtaataaagaaccagttgatgttcttacagtaggctcaatgcaggtcaaagttaatgggtttccttcgtcttctggtttcttgaaggttggcagtaccccatttgatgcaagagcattacaaccgggaaaaggagatgctgccgttaaaagtggatcacaacgttaa

SEQ ID NO: 64141 - DNA, 1440 bp, Glycine max
  Peptide Sequence Number=SeqID_180919
atgagtctcattcactggtctttaatcttatggatcaccatgatgcttttcatccataatttggataatgtggaaggaagataccactatcacaaggggcagaagaaaaattccccagctcctaatccacctgctgagtcccctacaccaccagaggaccctccttcacccccttctaattccccaagtgttccctctgacccttatcccaatgatcctcctggggactccccttcaggctgcattttcgatgtcaggtcctttggtgcagttggagatggttcagctgatgacaccgatgcattcgtggcagcatggaaagaagcttgtgcagtggagtcaggggttgttcttgttccagaagattactgcttcaaaattacttcaactatctttacaggtccatgcaagccaggactagtatttcaagtggatggtactctaatggcaccagatggaccagaatgttggcctaaggaagatagccacagtcaatggcttgtgttctatcgacttgatcaaatgactcttactgggaaaggaaccatagaaggcaatggagaacagtggtgggatcttccttgcaaacctcacaggggtcccgatggaaaaactgtatcaggaccatgtgatagccctacaatgatacggttcttcatgagctccaatttggtgctgagtggggtgaaaattcagaacagtcccatgttccacgtcaaattcgatggttgccaaggagtactcatcgataagttgtcaatttcttcgcctaaactcagtcccaatactgatggaatccacctaggaaatacaagaggtgttgggatatataactccatgataagcaatggtgatgattgcatttcaattggacccgggtgctccgatgtggacatagagggtgttacttgtgctcctacccatggtattagcattggaagccttggagtgcacaactcccaggcatgtgtctcaaacttaacggttcgcaacaccatcataaaggaatcagacaatggcctcaggatcaagacatggcaaggtggaacgggctcagtgacaggcctaagatttgagaacatccaaatggagaatgtgaggaactgcatcatcattgaccaatactattgcatgtccaaggagtgtctcaaccaaacttcagctgtgcatgtaaacgatgtgacgtataggaacataaagggtacttatgatgtgagaacacctcctatacactttgcatgcagtgacactgtggcttgcactaacataacactctctgagattgagcttttgccatacgaaggggagctactagatgaccctttttgctggaatgcttatggaactcaagagaccatgactattcccccacttgattgcttaagagaaggtgaacctgatacagttgtggagctctcagcatatgattgtaggagttaa

SEQ ID NO: 64142 - DNA, 336 bp, Glycine max
  Peptide Sequence Number=SeqID_180920
agccgcagccccagttatgataggcgtaataggtcagatcaacaacttcctgatcaaaaggatctcagggcacaggaagtaggaacttcagatccaagaatgcttcccgtgtcttctggttctggctcacaagggaattcctttttgggaactgaacaagtagagcagcaacctgttgttagtagcactgatgcagattggctttacatggcgattaccttatggcaagaggttcattcggggggtagtggtgtggttaattttgatcattttgtgaattgtgatggctcatcaagcttatttgccaagggaacatgcaaatgtttggttggttga

SEQ ID NO: 64143 - DNA, 531 bp, Glycine max
  Peptide Sequence Number=SeqID_180921
atgtgggtagtgtcagtagcaacacccattttgtatcgtaaaaacgccgagtcgtttcgcacggatcgcaaacgcagaagagtctctctgctcctttgctttgctcgtagtcgtagagacaccgcggtggactcagaactagttgatcctcataatcagtgtcaggcaagtgcccaccatcccaatttgttcactaaactctatcccgtcgttttgaacatgccgtcccttcaaactgcacttcctcctgagctcgccaacaatgccattaggctttaccgtgaatgcctgcgaagagctaagtatattggtcatcggaaacataacacggagcttcttgttgatatggtgagacaacagtttaagaaacacatgcatgagacagatcccgagaagattcagaagttaaaggatggtgctgcaagggggcttatcaatcacatattgtatgagtcagagcaaatgacagtgtctctatcaattcaagatttggcagcttatgaatccagaaccctgcctcctcttggatga

SEQ ID NO: 64144 - DNA, 399 bp, Glycine max
  Peptide Sequence Number=SeqID_180922
atggaagagacatttgttccgttttgtgaaattaaaaatgatcttcaagggagattgatgtgttacaagcaagactggattggtggtctcacggcaggcttcagggtatgcatgtggactgccatcttgttgttcctactggctatcttaggagcttgttccatcatcaacaggttcactcgcctagcaggggaactgtttggccttcttattgcaatgcttttcatgcaagaggctattagaggactcattcatgagtttcacatacctgagagggcaaacctaacatcacctgagtttcaatcttcgtggagatttggaaatggcatgttttctttggttctgtactttggcctcctgcatacagcattgagaagccgaaaagcaaggtctcggtga

SEQ ID NO: 64145 - DNA, 1077 bp, Glycine max
  Peptide Sequence Number=SeqID_180923
atgctgaatgtgccagttctctatattattggagcctttattccagcaacaatgattgctgtgctttattattttgaccatagtgtggcatctcagcttgctcagcagaaagagttcaacttaagaaagcccccttccttccattatgatttgcttctattgggatttatggttataatatgtggtctaattggaattcctccgtcaaatggtgtcattccacaatctccagtgcataccaaaagtttagctacattgaagcaccagttacttagaaaccggcttgttgcaacagcacgaagttctatgaaaaagctagaaagcttgggacaagtatatggaagtatgcaagattcttactggcagatgcaaacccctctagttcaccaggaaccttccgcgaagggacttaaagagttgaaagagtcaactattcatttggcgtcaagcatggggagtataaatgccccagttgatgagtcagtatttgacattgtgaaggaaattgatgacttattgcctgttgaggtcaaagaagaacgtgagtgccatgcaacttatgtggaaaccgtaccattcaagacaattgcagtattcacagccttccagactgcttacttgcttgtttgtttcggtatcacttgggtgccaatagctggggttctattcccattgatgatcatgcttctggttcctgtaaggcaatacattctgcccaagtttttcaaaggagcacaccttcaagatttagatgctgcagaatatgaagtacctgctttaccattcaacttagtggctgaaagggacttgagcaggacagcttcctttgcagattatggagaggttttagatggaatagttactagaagctggggcgaggttaaacgtgtttgcagtccaaaggtgatgaaatccactccaaacatatcccaagagttaacaagtgcaaggttcccagataaaatatacagccctcggatgagccatctcagaggaaaccaaagccctcgaggtgttggcagaggaccatttagccctgcagaagttaggccatccaatttgaggaaaggtggttga

SEQ ID NO: 64146 - DNA, 462 bp, Glycine max
  Peptide Sequence Number=SeqID_180924
atgtgggtcaaaactggagaaagtaaggtcgttagtcatagcaaaagagcaagcattgtaatgaggaaaggaaaggggaataggaatatgcctggaaaaggaaaagctaagaaaacggctaattgccctaataaggctggttttacaaacaaattaccaggatgggtctgttctaaaagtatttccaggatgaaggcaacccgccagcagcaatggcgagtcctccatggatggtccacgtggcagtggactcgccagcaccaatggcgatttcgtgccagctggtcacgagttggccaggccagggtcagccttgcagagcagcagcgtagcagagcagcagaacagcatagcagcagcgggagcagcggcttttcagagcaaattgcaacagtgaaaagctttcctcctccttgtgcttcctcttacttgtgtgtagttcctcttgtgagaaatatgtaa

SEQ ID NO: 64147 - DNA, 156 bp, Glycine max
  Peptide Sequence Number=SeqID_180925
atggtgttagctgaatcaagatttgggttgatggctcctatgttggcactctctcaccggcatccatcacccctctccagctggagcggattgcttgatacatgtcaaagagtttggatgacgccactttcagagagaaaagataagtcaggatag

SEQ ID NO: 64148 - DNA, 1797 bp, Glycine max
  Peptide Sequence Number=SeqID_180926
atgacatttgatgctactgggttccctccagagatattgagagaggcattggatttgtgcaccattcattggtctgattgctgccatatactctcgtttcagatatattctgctggcttctcaagtccaacaccaatacaggctcaaacatggcctgttgcactacaaggtagagacatagtcgcaattgccaaaacaggctctggaaaaacattaggctacttaatgcctgccttcattcttcttagacagcgatgtaacaattctctgaatggccccactgtcttggttttggctccaacacgtgaacttgcgacacagatccaagatgaggtcgtcaaatttggtcgatcatcacgagtctcttgcacgtgcttgtatggtggagcacctaaagcccttcaactaaaagagttggaccggggagcagacattgttgttgccacacccggtcggctcaacgatatacttgaaatgaagaaaattgactttgggcaagtttcgctccttgtgcttgatgaggctgaccgaatgcttgacatgggttttgagcctcaaattcgtaagattgtgaatgagattccaccacgcagacaaactctcatgtacacagcaacctggccaaaagaagtaagaaagattgctagcgatcttcttgttaatcctgtccaggttaacattggaagtgtagacgagcttgctgcaaataaagctatcacacagtatgttgaagttgttccacaaatggagaaacagaggcgtttggagcaaatcctcagatcccaagaacggggttctaaggtcataatattttgttccacaaagaggttatgtgaccagcttgctcgtagtattggccggacttttggggctgctgcaattcatggtgacaagtctcaaggtgagagagactgggttttaagtcagttccggactgggaagtcaccaattctggttgctactgatgttgcagctcgtgggcttgatattaaggatataagggtggtaataaattatgatttccccactggaattgaggactatgtgcaccgtataggaagaactggaagggcaggtgctactggagtgtcatatacctttttttctgagcaggactggaaacatgcaggtgatttaatcaaagttttggagggtgctaatcagcacgtgcttccagagttaaggcagatggctttgcgtgggccatcgaactttggaaaggatcggggtggggtgagccggtttgactctggtggtggtggtgggcgttgggatactggtggtcgtggtggcatgagggatggtggctttggcggtcgtggaggtggcatgagggatggtggttttggtggacgtggcggtgggtttgggggacgtggtggtggcatgagggatggcagttttggtggacgtggcggtggctttggtggtcgtggtggcataagggatggaggtagcgggcaaggtgggagaggtgatttctttcctggtaggggcaacaggggtagaggatctggtggccctcgtggtgggcatgttggttggggtaggggtgaacgtggtatggatgaccggtacaacatggatgggcgtggacaagaggcagaagttatagtcgtagccctgaaagagtcagaacatgggattatagcagaagtagcagcagaagtcgtagcagaagtagaagcaggagttggagcaggggccgtagtcgaagccgcagctggtctcgtggtcgtagtcgtagctatagccgtagtattagtccacgtcgtaaccgcagtcgtagccgtggtc

SEQ ID NO: 64149 - DNA, 3150 bp, Glycine max
  Peptide Sequence Number=SeqID_180927
atgttcagttcttaccaccatcgtgcaacgcaaattagaagaccgagcaatgcaattcctgcgagccttgaatcaaaagaaaatgtttccattaatgccgtgaaggttacttgtgaattctgcggacgagttggtcacaccgaaagtgtttgctacaaaaaacacggagtacccaccagttatgaaggaagaagcaaaacctacagcaggagtgtgaaaacatgcactcattgtggaaaaataggacacaccattgatgtgtgttacaagaaacatggctaccccccaggatacaagtttggtaacagcaaagtagtcaataatatcatggaaggaaaagctgtgaatgatcaaatgcaaagacaagagtctcatgatttggatatcaacaccaaagcgaagattggtacagttgaagtgagtcatgggctttatcagcttaccttgaaaccatcacactcaagaaccatatgctccaccattacacatccaaaatgtaatgtcatccctatagatttgtggcattttcatatgggtcacccctctatagaaagattgcaagtcatgaaagcttattacccttcattgcataataacaacaagaattttgtatgtaatacgtgtcattacgcaaagcataaacgatcaccctttccatcaagcatttctcatgcattcagcatttttgatctcatacatatagatatttggggaccttgttccaaaatttctatgcatgggcaccgttatttcttaactattgtggatgatcattctcgttttacatgggtttatctaatgaaaaccaaagttgagactcgagaactcattatcaattttgttacatatgttcaaacgcagtttaataaaaccattaaaaccatacgcagtgacaatggtgttgagtttcttatgaatgatttttatgctcaaaggggaatcatacatcaaaccacttgtatagagacccctgagcaaaacggcatcgttgaacgaaagcatcaacaccttttgcatgttactcgatctttattatttcaagccaatctccctcttaatttttggtgttttgcattgcttcatgccacatatctgatcaactgcattcctactcccttacttcataacaaatctccatacgaacagctctatacacacccttgtgacatcttaaaccttcgggtctttggttgcttgtgctacataagcattctccaatctcacagacaaaagctcgaccatcgtgctcacccatgcatttttataggattcaaaccaaacactaaagggtatctagtatatgaccttcattcccatagcataaacacatcccgtaacgttgttttttatgaagatcatttccctatcctccctgatacctcagaatcatcatcctcttctacttccatatcacctctacctttctctaacaataccgacaactttgaacaccccactccacccagtgcccatctttcttccccacatacatccttcactcccaaacggcgttccacgagacttaaaaaggcacctacctatcttcaagactaccaccatgcactcacttcacaagatgataccaatacgcatggggttcgatatcctctacactccgtattgtcttactctagactttccccttcccataaacactttgtaatgtctatctcagttaacactgaacacaaaacttataatgaagcttccaaatttgactgttggattaaggctatgcaggcagaattacaggctctacagcagaatcaaacatggactcttacaccattaccaccacacaaaacaactatcggatgccgctgggtctataagatcaagtataaagcggatggtactgttgaaaggtacaaagcgcgtctcgtggccaaaggatacacccaactcaaaggattagattttcttgacacattttctccggtagctaaactcacaactgtaaggctgcttcttgctcttgcttcccttcacaattggcatctccgacagctcgacgtgaacaatgcatttcttcacggtgaccttgacgaagaggtatacatgactcttcctccaggtcttcatgtgcaggatcgtaatctagtgccgccttcaacgttcactatatggtctgaaacaagccagccgtcagtggttcacacgactttcttcatttctcatttcccacgacttccttcaatcaggaacaatcttgacaccatcaagcatatcacaaacctcctcgatacagctttcagcattaaggaccttggcaccttaaaattttttctcggtctagaagttgcccgcaatgacaaaggcattcatttatctcaacggaaatatgtcttggatatattgtctgactccggcatgctcgcttctcgccccgcctccactcccatggactactccactcgcttaacagcttcactgggtactcctctatcagaagcttcttcctcatcataccgccggttaatcggtagacttatttacctgacaaacactcgtcctgatataacctatgttgttcaacaactcagccaatatatggctcatcctacctcagctcactcccaagccgcctttcgtgtcttacgatacctcaaaagctctccaggtttcggaatatttcttgctgccaacggacctctacaactcaaagctttcagcgactccgactgggccggctgtcgggatacgaggcgttccatcacagggttctcgatatatctcggatcttccctcatttcttggcgttcgaagaaacaacctactgttttgaagagctcttcggaagccgaatatcgggctttggcgtctacaacgtgtgagcttcaatggctcacgtatctcctacgagacttcaaggttcctttcattgagccagcaactttgtactgcgataacaagtcagccatccaaatcgcctgtaaccccgttttccacgagcgaaccaaacacatagaaatcgattgcaacattgtgcgtgaaaaggtcaatcaaggatgcatcaaactgcttcctatctcctcgcaactacagatagcagatgtctttacgaagcctctcccaacttctttgtttcaaggcctttgttccaagctgggaatgttgaatatccattcccagcttgaggggggctcttag

SEQ ID NO: 64150 - DNA, 2556 bp, Glycine max
  Peptide Sequence Number=SeqID_180928
atggaatttgaaagtggtacacagaagcaaaagggcacatttgcatgcttgaagatggttgccttaatagctctatgtctcattctaatttctccagcagaatcatttgatccgttggatccaaccgggaacgtgacaataagatgggatatcatgtcctggacatcagatggttatttggccactgtgacattgtttaactttcaactgtaccgcaatatcatgaatcctgggtggacactaggatggacatgggcaaagaaggaaataatctgggccgtgatgggagctcaagccacagaacaaggagactgtgcaaagttcaagttgaagattcctcatagctgcaagaggaaccctcaagtggttgacttgctaccaggagctcctttcaacatgcagttcaccaactgctgcaggggtggtgtgcttacatcttgggggcagaacccttctggtgcagtctcagcatttcagataggtgttgggctctctggcacctctaacaagactgtcaaattgcctaagaacttcaaattgctcggaccaggaccaggatattcatgtggccctgccaagattgttccatccactgccatcctcacagatgatcgcaggcgaaaaatgcaggcattgatgtcctggaatgtgacatgcacttactcacagtttcttgcctccaagaatccaagctgttgtgtttctttgtcatctttctacagtgacaaagtcacaggttgcccaccttgtgcttgtggttgccagaataacaatacctgtgtcacgaaagattcaaagatcctgcaagagaatgccacctcacctcaccgaaaatcagacatcacactcacaccaaaacctttgttacaatgcactcaccacctgtgtcatgtccgggtgcactggcatttgaaagacaactataaggactattggcgcgtcaagattgccatcatcaatttcaactatcggttgaatttcaccgattggtctcttgttgtgcagcaccctaatctcaataatgtcacccaagtctatagctttgaatacatgccgcttcttccctatgaatccataaatgacacaggcatgttctatggtttaaaatattacaatgatctgttgatggaagccgggcctaaagggaatgtgcagtctgaggtgctcatgaagaaggacaagaacacatttactctcaagcagggatgggcatttccaaggagggtctacttcaatggtgatgaatgtatgcttccacctcctgattcatatcctatgttgccaaactctggccataaactaccaacaactattacattgatggcaacctatgtgtggagggatgcaccggatatcctttcactctatttcacaaggttcccagaaaacatgggagaaaaggagctatggatagccttcaagaaatggggagatgtcagggaggtcttcattgcaaggaataagaatagaagtggtcgtagatatggatttgtgagattcaaaggggtggataatgcaaagaaactagaatggcaattggataatctggttttgggaggcttgaagctgcacgtgaacttaactaaacatgaaagggaacgaaaaacgcctcagacaatccacaagaaacaccaaccaaaggaggaggtagccacaatgatggtgaatggcaaagacaaagataaaggaaaggagttcgcagaacagaggacagtgattataggagtacaacagcataaccacaaacaaatgaaagatagtagatcctatgaaaatgtggttgcaacatgtagtaagagtgtagcaaagcgatggacactaaagcttgtacagacagccaatgtgccatcttgcttgtctgtccaattaatgataccaatggagaagacgacatggctgacaaaaacctgggttggaagactaagaaacttagcgatgtttgataggctggaagaagaattcatgtgggaaggaggagaagagattaaactaaagtatatcggtggagacatggttggtatgggtgatatgttgggggattccgctctaaccaagggatgtggaaaacatcacgaagattgtgaaagtgattgggtaagtgttgggttgctcaccatgaacgagccaacaccaaacatagagagctatctctatctacatccaagcgagaatctggcagtagctctcgtatcaccagctttagactcaagtaactatcactcatggagcaagtctatgatcacagcactaagcgccaaaaacaaggtggagttcataaatgggaacgcaccagagcctctgagaatcgataggacctacagtgcgtggagtcgctgcaataatatggtagtgtcatggatagtgcactcggtatcaatcgcgatcaggcagagcatcttgtggatgaacaaagctgaagaaatatgggatgatttaaagtcacaatacgcgcaaggagacctcttgagagtctcggatcttcaacaagaagcctcatctatgaaacaaggaactcttacagtcacggagtacttcaccaagcttcgtatcatctag

SEQ ID NO: 64151 - DNA, 270 bp, Glycine max
  Peptide Sequence Number=SeqID_180929
atggcagccatcttgcctattgagattgctcacttaaagggttggagaaagttgtggctagagtgtggttcggttttggtggttcaagcttttaaatatgcattgatggccccttggcgtatcagaaacaagtggaagagttgtatcaagcttaccaaaggcattagcttcctcgttggacacatttttcgtgaagggaatacatgtgcaaatattttagtcactcacactcacagtacttctgtgaataggcaaactttacctaattag

SEQ ID NO: 64152 - DNA, 162 bp, Glycine max
  Peptide Sequence Number=SeqID_180930
atggtggtggtggtggtggtggtggtggtggtgctggttgaagagaatgaagatgtagatggaggagtggaatttaagctgattgggaaatcacggctaagggacggctgtgatcgtcgcatgtccttgtgggtccgcttaatattatttggacgctcctga

SEQ ID NO: 64153 - DNA, 1299 bp, Glycine max
  Peptide Sequence Number=SeqID_180931
atggcgacagcggaggcagcttctgctgggcttggtcccagatatgcacctgatgatcctacccttccacaaccgtggaaggggttgattgatggcagcactggtcttttatactattggaatcctgaaaccaatgttacgcaatacgaaaaaccgacaccaccagtgccttcaggccctgcgccgagcttggcacctataccaggggctcatacagtgcagcctggtggaaaggtgcagcagcatgggcagcagatgcagcaggtgcaatcctcgcaacagcagatgggtcaccttacccaacagcatggccaatctatgccaccgcagcagcagagtccccatatggcacaggtcactcagcagcagtcctctcacggtgctcaggcagcacagcaacagaaccaacatgggcagaaaatgatgcagcagcctcaagggcagcaaatgatgcagcagccccaagggcagcaaatgatgcagcagccccaagggcagcaaatgatgcagcagccccaagggcagcaaatgatgcagcctcaaggacatcaagccaggcagcaaatgatgcagcctcaaggacagcaaatgcatcgtcagatgccgccacaggcgatccattcccagcattttgtgcaaggaatgcctcaggatcatggttcacacattgtacaaccacaaacacatcaattcactccccaaaacatgcattatatgtcgtatcagcaaaatgcaattacatccaggcaaccaaactcccagcacagtcagccaaacatggtatcacctgggcaacctaactcccagcaggttcagcataacatgcacggtcagccctttgaaaaccaacaaacaacatatccaaaggtagaggaagtggattctaaaaatggaagccaggttggacattcgccatcccagtatccacaaaggagtgccttgcccgttcagaacaaccagaacattcctgccgaagttggttctggtcaagtacctaatgtaggtgtcaatgctggccaaccacaacaattcagggccttatctaacagtatgcaacaatcgccctctggatctgatttatattaccaacatggtcctaactttcatagccagatgagcccaggaatgatgcatggtcatccatccaatgtccttccttctggccaaaagatgggtcccgaggatagcttacgtgttagagcagggaatgaatattactataattctaacaaagatatggcaacaatgggtcgtcagcagccagatataactccaatacccattccaagaaatcagcag

SEQ ID NO: 64154 - DNA, 447 bp, Glycine max
  Peptide Sequence Number=SeqID_180932
atggcatttgatggggtgatttgctgtttaggaaaattgtgtgtggtgaaaatgtttctgtggtttatacaggatgccagggatccagaaactctagccaatctagttgtatgctgtcttcatctcggcaaaccatctaacaaatcattcagccagctgaaactttctcacccagagcatgtattggtcaaacgggtatcatcagctgaagaaatctctcaagatgagagctgtgtcatagagcttccgaatctgcagaccatttatttctgcagtgttcgtttgctgccagaatttgggaatggattgagggaaagttacaaacttcttttgacagtgagtcagaaaacctttacattgcggaaaaatgtgaccacagatattgttgcggtgagtcgaaataccttgatgttgtgggcgcaattgcggttgcagaccgatatttaa

SEQ ID NO: 64155 - DNA, 1047 bp, Glycine max
  Peptide Sequence Number=SeqID_180933
gctgttgtcacaatgtacaactttcaacaatatcgccacattcaggcccccggatggtcattagggtggacatgggctaaaaaggaagtgatttggaacatgatgggagcccaaaccacagagcaaggggactgttcaaagttcaaagcaggcattccacattgttgtaagaaggaccctacagttgtggatttactgccagggactccttacaaccagcagattgcaaattgttgcaaagggggtgtcctaaattcatggggtcaggaccccagcaatgcagtaagttctttccagattagtgttggttctgccggaacaacaaacaaaaccgtcaaaatgcctaaaaattttaccctcaaagcaccgggacctggctatacttgtggtcctgccaaagttgtgaaaccaactgtatttattaccaatgacaagaggagaaccacccaagccatgagtaatccaaattcgccacatttagcttcagttgtatcagcatcaggcaaaacggcaaacacgccactagtccagtgtaccagccatatgtgtcctattcgagtgcattggcatgtgaagctcaattacaaagagtactggagggtcaagatcacaatcacaaatttcaattacagaatgaactactctcaatggaaccttgttgtgcagcatcctaatttagataatattacccagctcttcagttttaattacaagtcactaaatccctatgagggcttgaatgatacaagtatgctgtggggagtcaagttctacaatgattttctttcttcagctggatctcttggtaatgttcagtcagaaatcttacttagaaaagacaaatcaaccttcacatttgataagggatgggccttccctagaagaatttatttcaatggggataactgtgttatgcctcctccagatgcctacccctggcttccaaatgcaagttctaaactagttttctctttactcatattgtacctttctcttctgcaccagcttgttaaagctgaagtcaaccccattgtcaagaatgcatag

SEQ ID NO: 64156 - DNA, 444 bp, Glycine max
  Peptide Sequence Number=SeqID_180934
atggtggattggctggggagtgcaacaggaacaagttgggaatggcagctagagtggagaaggcattttagtgaatcaaagattgacatagttgcaaaattcatggagggcattgaggctgtgacagtgcaacctaatcagcaagacagatggggttggaagctggatcctagcgagtatacacagagagaagtgcttacaatctgttatccactcactttgcagggggaaatattgatgaagtgttcaaggaaatttggaagatcaaaattccaagtgtcacatttcagttggagattgattagggataggctcccaacaaagatgaatttgaaaagaaggaatgtggattcaaatgatttttcttgccttttctttagatctagtgatgaggatgcatctcactcattcttcaattgtgataaaatcttgcctctatggtga

SEQ ID NO: 64157 - DNA, 663 bp, Glycine max
  Peptide Sequence Number=SeqID_180935
atggagaaggtgaagggaaatgtttatatttatttggaaggagatttcaatttcatccaaaggtcatctgaaagagttggaagaaaaattcaagaaactaaagcagagactaaagaatggaatataaatcagtttggagatgctcatcaaaaactgaagaaagtagagtcgaagctcaataaactagaaaaagaaagagatgatagacatctgaatgaagaagaagaaaaattaagaaagcaattacaggaggacttgtggtcggcaattcaagatccaaataaagttaaagaggaaactagattgtttttcaaaaggagatttcaggaatctgattgggagaccaaggttggacggggttactttcaaatccattgtcagcagcataacaatctgttggtagcacctttcaaagaggatgaagtgaggacaacgatttgggattgtggtagtattcgatttttgaacgagtttcatgctaacacggtttttcccaaaggaagcaatgcttcttttctagcattaatttccaaagttcatgatccgcaaggtctcaacgactatagacctatctccctaataggttgtacttataaaattgtggcaaaagtgttatcttctaggcttaagaagcttccgccttatatcatagacaagtgctaa

SEQ ID NO: 64158 - DNA, 636 bp, Glycine max
  Peptide Sequence Number=SeqID_180936
tcctctgaaggcgaggacctgtagtcctctgaaggcgagggcatgcagccctctaaaggcgaagacgtgtagccgtctgaaggtgaggtcgtgcagccctctgaaggcgaggacatgtagtcctctaaaggcgagggcgtgtacccctctgaaggtgaggacgtatagtcctctgaagatgagggcttgtagccctctgaaggtgaggatgtgtagtcctctgaaggcgagggtgtataaccttctgaaggtgagggcgtgtagccctctgaaagggaggacgtgtagtcctctcaaggggaggatgtatagtcctctcaaggggaggatgtatagtcctctgaaggtgaggacatatagtcctctgaaggtgagggtgtgtagccctctgaaggtgaggacgtccagtcctctaaaggcgaggacatgtagtcctctgaaggtgagggcgtgcagccatctgatggcgaggacgtgtagtcctctgaaggtgagggcgtgcagccctctgaaggtgagggcatgtagccctctgaaggagaggatgtgtagtcctctgaaggtgagggcgtgtagccctctgaaggctaggacgtgtagtcctctgaaggcgaggacgtgtagtcctctgaagat

SEQ ID NO: 64159 - DNA, 323 bp, Glycine max
  Peptide Sequence Number=SeqID_180937
atgaaggataaatcgcaagtttggcgatcacggttgtatggctccgcctcctccatggaagtgaactctagaggtggtggcggtgcgcctattgcccgttactgtgatgcctcgccctgcgcctgtatggggtcgcagtacttcttgatgaaagcctggctcataatcagagctggaaaccctagggccttgttggactcctctgggtccactgggtgtcttgtgggcgcgatccctagaaatagtggatggcatcagaaattagttgaaccacgtgcatacttacctatgtcacaatggcatgaccttgctcgggggaacag

SEQ ID NO: 64160 - DNA, 300 bp, Glycine max
  Peptide Sequence Number=SeqID_180938
atgaggtgcatcaagagtgataccggttgggctgatgcacttgtttattccatcttccatcattctaataagggagttcctattggcacttgtttgatccaaggagacacaggaagaacacaaatacttgaaaggagtcaaggtagatgtgcagccatatttttaatgttgactttgcacatggcagtcagggtgagacataggaatgtgaaatgccaccttggagtcaacattaaaattggtcaaagagagttaatacaaggattaacttggagtgagattcataaattagaaacctaa

SEQ ID NO: 64161 - DNA, 249 bp, Glycine max
  Peptide Sequence Number=SeqID_180939
atggggtccagctgttgtcatacactcaccagagagggttgtgcagcagtttggatatcctcagtatccggtggtggcatcaactatggaggaaacacctgcaaatacaccttctcatgtagagtagcctcgacatgcagtagtaacatatatattcatcttactccgatattcattttatttaaacatgcaatgcgtataacccttttcggttgttgtcaatttcataagaggtttgccaagaaataa

SEQ ID NO: 64162 - DNA, 264 bp, Glycine max
  Peptide Sequence Number=SeqID_180940
atgtcataccctaatttcatccgagaactattgcttgatggcatgcaacctgtgattgaccgctttaagaaggcggttgcttctggaggaagcaacctggctcgcctgggcgagctgggtggcaagctcctcccctattttgctataaatagggggaggagtgaagaaggaaagggttctgccttcttgacacttcgtattcacttgaaattgctgaggaaaattgtttccgtgaagaaaattcaagctgagacgcttccgtaa

SEQ ID NO: 64163 - DNA, 321 bp, Glycine max
  Peptide Sequence Number=SeqID_180941
atggcgagtaacccatcaagagctcagaaaagattcattgactatttcaaagttgatgcctctaatgagattatggatttcacaaaagcctttagtgagataattgaaaggcatctcaagaagcttagtataaggtatgttgatcataaatggataatggttggagagcctactgttggaaacattaaagaaatggaagaagatgatgaagttgaagctcaacatgagcatgcacctcaatggaatctttttgagtctcatgattcaaaagatggatggtatgcttcacctccatcaagagcactcagtcgaagttcatag

SEQ ID NO: 64164 - DNA, 960 bp, Glycine max
  Peptide Sequence Number=SeqID_180942
atgactccactgaatgtagaagcccctcctaacaggcttctcgacctggtcgctaagggtcttgcagtggaaaagggcgacatcacaagaggcactggtttcactgctacactgcctctgcctcacacaacagctattgatttcaggcaaacttcagaaacgacatttctatttattatcaaacataatttgttctctgtgcctgatgtgaaaggttcatcaaagagcttcccaaagcatgaaacgcgacacctttcagaacacaaggtttcgaagatcaagcagatgttgctgccagaggcaaaggatggtcctgtgcggcctgtcatacgaacatattatgatcatatacaaccaataaatgatctggattttcatccacaaggtactatcctgatatctggagctaaagatcaaacaataaagacacacacaatgttcgatctgtatcttttcatccatctggagactttctgctggcagatcagatattcttgtacaggttccatgtatgttacagcatctaaagatggtgctattcggttgtgggatggcatcactgccaattgtgtgcgctcaataactgcagcacatggaacagctgaggctaccagtgcaatttttacaaaagatcaaaggtttgttctctcttgcgggaaggattctaccttaaagctttgggaagttggctctggaagattagtcaaacaatatctgggtgctatacatacccagctaaggtgccaggctatttttaatgagacagaagaatttattctatccatagatgaactgagcaatgagatcgttatctgggatgcgatgacaacagaaaaagtagcaaagtggccttctaatcatgttggtgcaccccgctggcttgaacactcaccaatagagtctgcttttatttcctgtggaactgataggtcagttcggttctggaaggaaactgtataa

SEQ ID NO: 64165 - DNA, 786 bp, Glycine max
  Peptide Sequence Number=SeqID_180943
atgcagattcttcaatggatctccaaagggacaaatgatcatgaaataggccggagttctcccaacgactggaaagcaattagagataaaaaagctgaaggacaagatataattacagttaggcatcatagggcgcatcaaggaacaaagacaatcgaagggaggaagcttggcagcaagaacttgaaactgtttatttttatatgcggaaaagacattccgaaggcttgtttttacagaaccctcgacttaaacagaataagaaacttgaatagaagaaggcattttatccactctatgaatatgaagagagaagaattatcaggagtaggaaagaaggttttgcctataagtgaagcatcattgtccaaaacaactgaaagaaatagtgaacaatattgtgtcaccgctgaaacaaaggatcgaactaaaggtgatagaaataagctaatttcaagaatgaaagagctacttagaagggttgctgcaacaaaaacagacgaaagagaaagtttctatgatcaaaaggttttacattttagaagacaaggaaacatagaagcatttcctgaagatgatcaacgcatcagtgaatcacccaagatcagtttgacgtgggatgtggaaacctcttctgtccactcactggctacttggtctgaaaatgttcaaaccaagatttcacattcacatacttacatccctcgtagagagagtagtggcatcacttgtagaaaagaaaactggatcaccacagattctgaatttgtggtgctggaactatga

SEQ ID NO: 64166 - DNA, 339 bp, Glycine max
  Peptide Sequence Number=SeqID_180944
atgaaggagttcaatattcacttaggatcaacatttcagccagcaattcaatcaccaaaactcaaattcacaatagacacaatcataaggaaacctaaaagttcaagaaaaggctcatacttagcccatgggctcaaaatctaccctaaggctcatgagaaccctagggccttcccttggatctctggcccaatctacttggagtcttctatccaatgcccttgcgggaaaattctgcttctgcataatcggcttagcaagcggctgcccgctaagcctaatgattaccgcaatagatgtgcgctaagttcagcagggctgcgcttagcggcaccatga

SEQ ID NO: 64167 - DNA, 261 bp, Glycine max
  Peptide Sequence Number=SeqID_180945
atgtttgatcaacaggcagctgtgtcttcagcaaaacctccagaaaggccggatcctgaggtcgatgatccgttgtatttgatgacattgaccatcccacagctatttttgaagcctcttcgggttatgtgggatgctactgtgtttggggtgtttaatcaaaacttcctattgcatatgactgagacaagtatgcaagcggggaattccgatgtgtatggattcctcgagccagagtccattcagagagctgggcaataa

SEQ ID NO: 64168 - DNA, 345 bp, Glycine max
  Peptide Sequence Number=SeqID_180946
atggttcatcatcaagcagaatttgaaaatgacgcaaaaacagagttatcaattgagggtaaggaagaggtgcattggcccataatgccttatgcattcggtaccgaaccaagtgagcctagtcgatctgacgaccgtgctaaactaattgcttcttcagctatgaccaagtataggtacaatgtttctcttagatccagctttgtcaatattggtgaagtggataataattttgaaaaagacaaggctctttcggctgacttggccatgaaccttgccaatgttgttagagatagagtgatcaacatgagcaacatggtgaacaacctaaaggctaaagcttga

SEQ ID NO: 64169 - DNA, 557 bp, Glycine max
  Peptide Sequence Number=SeqID_180947
atgccaccttcggttataaacataggcggtttcaaggcccggctaccctgggcaattgcccaggctctggcccaaaatgggttggggtgaagtgcaaccctagatccaatagagtggtggaggttaaccttgatgggttctcgctctctgggagaataggtagagggttgcaaagcttgcagtttctaagaaagctttcactggcgaataataacctcactggtgggataaaccccaacattgctcggattgataaccttagggtcattgacttgagtgggaatagtctctcaggggaggtttctgatgatgttttccgacaatgtgggtctctcaggactgtttccttggccaggaacaggttttctgggagcattccctctactttgggggcatgttctgctcttgcttctatcgacttttctaataaccagttttctggttctgttccctccggggtttggtccttgaatgctctcaggtctctggatttgtctgataacttgttggagggtgagattcctaagggggtggaggcgatgaagaatttgaggagt

SEQ ID NO: 64170 - DNA, 477 bp, Glycine max
  Peptide Sequence Number=SeqID_180948
gtttcggtggttccttcctaccacaagctggccaaacgtttttacggacccttcgaggtcgtcgaacgcattggcgccgtggcctaccgattactgttgccggcgtcctctcgaatccatcccgttttccatatatctctcctgaaaccccacaaaggtcctttaccggcgattccggcgaccctccccgctgcgtctctagatcatcaccctcttccggcgcccttacacatccttgattggaaattggatcattcggttgacccccccgtgactttggtgcttgtccagtgggatggtatggctcctgaggagtccacttgggaacgatgggatgagctccgtcaagctcacaaccttgaggacaaggttgctttcggggatgggtgtattgatagcaatatcgatagcagcaataacagaccaaggaggattagtagaagacccaattacctgaaggagtatgttcaagcctag

SEQ ID NO: 64171 - DNA, 450 bp, Glycine max
  Peptide Sequence Number=SeqID_180949
atgcgaaacgatgctttgaaggtgttatggaaggagctgagggtgttttgttatgagaatggagacattgagaggaaggttgagtttttggtgcagagaatgaggtgtggtgtggagtgtgtggttgatatgccgaagttattaggtgtgagctttgagaagcaaattgtgccgaggtacagtgtggtggagtgcttcagagggaagggtgcaattgggtttgaggttgggttgaaggatttggtcatgccttctagaccattttcttctcttcttcctcagaccgttttcttcttcttcttcctcacctcagccattttcgtattcttctttctcaccacaccggcgtttctatttgtcaccattgttgccgttaagaggaggttgtcgggaagaggttcttcttcttcttcagccaccattgttgtcgtgaagaggagcttgtcgtga

SEQ ID NO: 64172 - DNA, 257 bp, Glycine max
  Peptide Sequence Number=SeqID_180950
ggggtcgaggagggggaggaggtgaggagcgagacgagggcgttttaagggaggcagagggagaggaggagagtagagagggagtggcggaggttagggagggaggaggggaagccgtgtttttggaagagggcgataagggagatttgttttctgtagtggaagtgggagtgaatgttgaggagagaacgcgcgtttgcagaagcggcgcgcaacgccattggaattttaaattgttccataaaaaataccaataa

SEQ ID NO: 64173 - DNA, 231 bp, Glycine max
  Peptide Sequence Number=SeqID_180951
atggttaggtggatgactttaaagaacctcgtgctagaggacattgggacacaacactttgatagaaagtgtcacaaaggtggtattgttggtgacagtggtgataatgacagtggaggtgacactaatggtggtgggggtggtggtagcaatgctgatgatgatggtgatggtggtggtggtgggcaaaaactaacgagtgtgtccttgaagtatcgattaatgaattaa

SEQ ID NO: 64174 - DNA, 432 bp, Glycine max
  Peptide Sequence Number=SeqID_180952
atggacgaagatcaatggacgtatgacaatataatgtctgaagaagttgatatggattatgaaaatgaacaagaatgtggtgtgaatgaaccacatgttgattgttcggatgcttttaatacttctcagtctttggtacctaagataatgttttgcagtgagctcgatcagttgtccatgaaaatgaatttgtggagtggtcagtataagtataggaagaaagaatttgttagaagagacattgggagtcggaaatgtggttgtcccttcaagcttcttgggaaaccaattattagaaggcaaggttggatggtcaagttgatttgtgggattcataatcatgaattggccaagtcattagttgaacatctatacgctgggcgattgactaaggatgagaagacaattattgctgatatgacaaagttgatg

SEQ ID NO: 64175 - DNA, 723 bp, Glycine max
  Peptide Sequence Number=SeqID_180953
atggctaattctattttaaaacttgagaaaattaaaaataatagaaaaggtcttgttgaaggtatcatactgaatgtttatctttcaaaactggtggaagagaaaggattaactgctgagacagctgacaaaactgaaacttttgtcaaagaaaaaggacctcctctagcattgttgtttaaatttagagaaggcagtactttcttaaaagatgatggattcgttgctgcattgaatgacctggaaattttatttaaacttatggataaatcaaaaggccctgataaagtggtttttgacttgagtcttgcccgaggtcttgactattatactggagttatatttgaagttgtctctaaaggggatactcaacttccacttctagagagcccaaaattgcttcaatctgcttctgccataacccctattaataatcccatggaagcatatgttctagaccatttaaaccactcaacttctctgcttcccccattactcatacaacaagaaaatgttggtcagcaaaactttcaggcaacctatggcaacattaacaattccaatgaacaagcagtggatccggtaactaattggcgagtgcttgacaagtttgttgcttcacaacttagtcaagatgcttcaaaagacaatatctttcaaggcacggccaatagcagtggacagtttagacatttggacaaacaaagagctagtggtgcctga

SEQ ID NO: 64176 - DNA, 138 bp, Glycine max
  Peptide Sequence Number=SeqID_180954
atggtgaaggtgggtgttgaagaagttcgagatgctgatgcttatgtccctatacccactaaagaggataaacaggtatcgaagggaccgaaaaagcttgttgatagggcgaaacctgatgattatcccatctactag

SEQ ID NO: 64177 - DNA, 363 bp, Glycine max
  Peptide Sequence Number=SeqID_180955
atgactaatataagcatagctttaaaaattggcttggtgactgacccagtcatggaactaggtgagggcgaccttgacggcatcgtgcaaggacaacccgatgttgatgtggcagaggtagaaggtgaggccgtgaaggcgacctcgacggtgttgtgcaagaacgacctgacattggtgtggcaagatgacacagcagcaacaacgggggtagagatagaatgtgaggttgtgagggcagacgacacagactcattggactcagagagactaaggcaccgcgagattgcaagaggaaagagactcaagagaggccaacactcaagagggtttctaaaatggcttgaaacaatgtcgttttga

SEQ ID NO: 64178 - DNA, 573 bp, Glycine max
  Peptide Sequence Number=SeqID_180956
atgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcttattgtagagaagatggtggaaaatagacttaggtggtttgggcatgtagagagaagaccggtagactctgtagtgaggagagtagaccagatggagaaaagacaaacaattcgaggcagaggaagacccaaaaagactataagagaggttataaaaaaggatctcgaaattaatggtttggatagaagtatgacacctaaaaggcatacatacctattagtattacataggaataagaagcatcagagtggcaacaatgtgaagaagaaaaccagagtgcctaaacctctgaagtctgaaactgaggaattaaacatggtatcttaa

SEQ ID NO: 64179 - DNA, 180 bp, Glycine max
  Peptide Sequence Number=SeqID_180957
atggatgcagaattcaaagagaaatgtctacctaggagtctttttgaatgggacaatgttgtcgcttggttctattccttgcacaataagcctgacaactatatcaaaggaatagttaacatagaattttactcatctaacaacattggaaccattgagaataaagacaattcacattaa

SEQ ID NO: 64180 - DNA, 2109 bp, Glycine max
  Peptide Sequence Number=SeqID_180958
atggaggacagtgaaaggtttgaagaaaggtccttttcaaatggggatgtctacattggtaaaatcaagggcatgcttccccatggcaaaggaaagtacacatggtcagatggaacagtatatgaaggtgattgggtaaatgggaaaatgacggggaaaggactgattacatggccaacaggagcaaagtatgagggtgaattctctgggggttaccttcatggtcatggcacctttacacattctactgggtgcatttatagtggtggttggaggatggatgctcatcatgggattggacgaaaggagtattccaattcagatatatatgaaggtttatggaaagaaggaattcgtgaaggctgcggaaggtattcttgggagaatggaaatacgtatattgggaattggaaaagtgggaaaatagatggcagaggggttatgaagtgggctaatgatgatatttttgacggctgttggataaatggacttaaacaaggatctggagtttatagatttgctgatggggggctttatattgggacatggagtaagggactaaaggatggaagaggaacattctatcctgctgagaaacatacagctacaaaacaaaaatttactcgtagtttttctgaaaagatttctgtcagtggtagatcaaaaagttcacgtcaaatatctcacaggacttcatcattagatgcaaattgtatcattcaagatcctgctggagattgcatatgtcgtgactcttcacccacattatcgcagacttttaatgaaagtcaatctgaggcatctggtgtgaactctttgctttacgaaagggaatatatgcaaggagttctaattatggagagaattagaaactattcagaaataccacataaaaacaaacgtcaaaatacgtttagtgtgaagcaagctaagaagagttcatggattgatatttttggaggcagccgaagctattatttgaagctaaatttgcagcttggcatcagcaatactgaccgatatatttgggcatgggtagagaatgtaaagacatttaagtacactgttggaaaaattacaccagtgcctgcacgtgaagttcggtcatctgattttggagatcgagctaggataaggatgtacttccccaaggagggttcccagttgactcctccacattgttctatagacttctactggaaggattattgccctatggtattccggaatttgagagagatgttcaaattagatgctgcagagtacatgatgtccatttgtggtgattctggtctaagggacatatcttcacctggaaaaagtggcagcatcttctttctttctcaagatgatagattcgtgataaagacactgaaaaaatatgaactaaaggttatgctcaatatgcttcctaaatactatcatcatgtaggaagttatgagaatactcttattacaaaattctttggtctccatcgaataacactaagaggtggtaaaaaggttcgctttgtggtcatgggaaatatgttctgcacagaacttcatattcaccgtcgttatgatctgaaggggtctactcaaggaagatatacagacaaagataaaattaatagcaatacaacattgaaagatcttgatctaaaatatgaatttcatatggataaaaaattacgagaatccctattcaaacaaatttctctagactgcatgttcttggagtctcagcacataattgattacagccttctgttgggattacattttagagctccggagaatctaaaggccttagtggaacctcccagactaccgcagcctcaacatggcttaccctctgaagatgatgcacaaaaacaaggggagcagttgattattcctaaaggcttgttattagttgctcatgaacctagctttgtcaacactgcacctggaccccacattagaggaaatacattgagggcatactccataggtgacaagcaagttgatcttttacttcctggtactgcaaggttgagagtgcaattaggagtaaacatgccagctcaagcaacacgcaaacttcaggaggataaggtggaagaatcagaagtagagctttttgag

SEQ ID NO: 64181 - DNA, 390 bp, Glycine max
  Peptide Sequence Number=SeqID_180959
atgtacaatgtggaagatgcctcgatcttggttcccggtgacataatcaacatcaaacttggagatattattcctacagatgctcgacttcttgaaggggatcctttgaaaattgatcaatctgtacttaccggtgagtcactgccagtgaaaaagggtcctgatgatggagtatattctagttctacctgcaaacaaggagagattgaagttgtggtcattgctactggtgttcataccttctttgggaaagctgctcatcttgtggatactactaatcaagtgggacactttcaaaaggtcttgactgcaattgggaacttctgcatatgttcaattgcattagggatggttgttgaaattattgttatgtatcccatccaagattga

SEQ ID NO: 64182 - DNA, 219 bp, Glycine max
  Peptide Sequence Number=SeqID_180960
atgagggctggaagaattaccgaatacggtgttgatggggttcatggcgacctggttcttagtggcatcttcgatgagtctttcggtattgatgaaggcgacataaaagggtgtggtacggttgccctgatcgttggtgatgatttcaacgcagtcgtgctgccagactccaacagatgcaaagtgaatgagagctacaacggtgttgaaggagaatga

SEQ ID NO: 64183 - DNA, 165 bp, Glycine max
  Peptide Sequence Number=SeqID_180961
atggccattggttcgcataggctatctcaacagggggctatcacaaagaggatgacatccattgaagagatggcaggcatggatgtgctttgcaatgataaaactgggactctgacattaaataagcttactgttgacaaaaatcttgttgaggttggatgctga

SEQ ID NO: 64184 - DNA, 429 bp, Glycine max
  Peptide Sequence Number=SeqID_180962
atgctgcatactgcggatggagaagaaccaaagaaggaagaagaagaattgaacaagcttgtaaccaccgtggaagaaaaattgaagaagggagaaaaaccaaagaaggttgcaaccgcaactgcggtggaagaagaatcgaacaaggttgttgtagccaccctgaaagaaaaattgaagaagattgcgtttgcggagggagagaaattgaagaatgatacactaccctcagagggaggagaagaattgaagaagctggttacgcagaaaacgatagatgaagttatcttcgaagtggaaccttgtactgttaaagagatggaggtggtgcaatccttcattgatgctcatggtggcgacgagttcgaccagcccttcgtggctgcgctaagcaacgaggcgcacctgcaatccttcatgatgctcaag

SEQ ID NO: 64185 - DNA, 648 bp, Glycine max
  Peptide Sequence Number=SeqID_180963
atgagtggtgttcttgtgtttgttggtggttgtaatagaaatctggaggccctggatgatatgtattacctatacacagggattgcacgggaaaatgaacagcgaccagagaagttatccttaaagaagcaattgaagcggaaatgtctagaacaaaatcccaatcttgtccgaaacccagttatgtgtggatatggagtgggtgctgccagtaaccagcctatggaaatcttgaactgtagccaaccaagcagactaaatatcccagtaaatcagtccctgcttcctggaaagaaaatgtttcaagcccaagttaaggaaaaaaactcagcaggatatactattgaaaccgttattgatggaaagcctcttcatggagttctgtttaaaaaccagcctaacactcttattccagttcctaatacttccagtaggaaaaggcctgtcagtgaaattttaagtcctgcttcaaatggtatacattcacaaaatgtaacggcttataaagtgctcgggcaggacagaatgcaagataaacgggaattacggggagagagttcagaatctcatgaatgccataaggatgctgatactattgttgtatcaagtaacccgacaactgttgctgagtcctttaaggtcaattag

SEQ ID NO: 64186 - DNA, 285 bp, Glycine max
  Peptide Sequence Number=SeqID_180964
atgacagaaatcgcaaaagggtgtcgtaatggaagggaaaaagagtaccttgacggcgatggtggggttgtgggtgtgatcactggggataacgacgtaatcggccaaaacgacaatgttgtgttggatttcttcagagacgcacttggtgccagtggtgggttcaagtcgatcatcgctctcccagtggtggtggttgtcgttcttcgtcacccttcattgttcattgacgcaatcagtgcttttgtgtgtttcacatcgatcatcatcactctccagtgttga

SEQ ID NO: 64187 - DNA, 594 bp, Glycine max
  Peptide Sequence Number=SeqID_180965
atgacagagttggagactttaatactgatgggaacaaattatagctctcatgagaagttatgtatcattagatacacaagtaataataactgtcatgttggaagatgtaattctggttggctcttgaatgacaaccttctgatacagcttgttataaaggtgacatcaccatatggaaacaatcttcatcacaaggagaacacaacacatggtaatattgcatttacgactcaagaggctgggaactaccttgcatgcttctgggtggatagccatagtcaaggagttgttgaggttaatgtaaaccttgattggaaaattggaattgcagccaaggattgggattcagttgctagaaaagagaagattgagggagtcgagcttgagctgagaaagctagaaggagcagtagaggccatccatgagaacttgctctatcttaagggaagggaagctgatatgaggactgtgagtgaaaaaacaaatggcagagtggcatggtttagcattatgtccttggctatgtgcattgcagtttctggtttgcaattgtggtatttgaagcggtacttccagaagaagaagcttatatag

SEQ ID NO: 64188 - DNA, 270 bp, Glycine max
  Peptide Sequence Number=SeqID_180966
gttactgaggctcttgcatgtgcaggccttgagtcttctaatcttattgttggtgttgatttcaccaagagtaatgagtggacaggcaagaattcgttcaataggcaaagcttgcatcacattgggagtggtctgaatccttatgagcaagcaatatcaattattgggaaaagcttggcagcattcgataaggataacttgatcccctactttggatttggagatggtatctctttaaacaaatttaacttatggagtgcattattttga

SEQ ID NO: 64189 - DNA, 270 bp, Glycine max
  Peptide Sequence Number=SeqID_180967
atggacagagcaaaagcaaacaaggcctttcatggaaaccttaccttaacaaagtcgtggaacggtggaagggaagaggccgagaggggcagtggtggcgacagtgcacgacgcaatggaagaagaggcgtagttcaccgtttagcattcagatttcagaggaaaaggaaccctagccacactctgcctcaacatgggtctgcccctgcttgtggatcatgccctgttgtagctagtctgctctacctatttcggttgatgagcacttga

SEQ ID NO: 64190 - DNA, 1512 bp, Glycine max
  Peptide Sequence Number=SeqID_180968
atgggtttcttcaaacaaaggaaaatttactccagattttcaagttttcagcaatacacgagttcatataacatcacaaagacatctgttggacgaaaaaggtggttggatgacaccctttgtaccgtccaatccagtcctctaaaatatttgttcaagaaactggtcaacacaatcaagattgacaaatttacaggaaagaacttcaacctctggcacatcaagatgcattccttgttgaaagaacaaggaatttgggcacctctctctggcctaccgtcaaagattgataaatctgtgctaagctcattcgataattctcttgtttctattgatgaagttctttatgaagtttctgaagaacaaactacatatgagttgactcaagctagcgaaactcttcattacgaaattaatatgctacaagttgctgtagaaacaatgtctatttgccctctaaatgaaaggagtgtctctaaaagagcacttgggcaagttaaactccttatggagctttatgacattgatgccaaaatagaagataaagatcttgcaatgattttcaagttcagtctttattcgagagagcttcgactcaaagcatctggaaatagtgatgaagctgctgcatctagattatcaatgaacaacactgctaaaggggaaaaaaagaagaaagacaaaggaaacaagaagggcatgatttatccaaaggatatctgtaattactgcaaagaacctagtcattggaagaaagattgtcccaagaaaacaaagaaagaatatgttgcaaccattgttcaaaatgattcctcatcagaaaacgatttggtactctttgttgttgatcaacaacaacaacattctgaacaatggataatggacttaggttggtcttattatatgtgtccacacagaaactggttcgtgacatatgagaagaaatttgctggtaatgtcttgatgggtaacagtgccccttgtaaaacagttgagataggttctatacaaatcagaaagcatgatgaaatcgttagaactttaaccaatgttcatcatgcttcagagcttaagaaaaatctagtctttgtgggtgtcatagattcaaaaggttcaacctcaactgtttcacaagttggaagtcatgcgtctaatgataattctttgtggcacatgttgcttcgtcacatgagtgaaaaaagaatgaaaattctgagcaagcaagacttaattggaaaccacaagatgaaacctcttcagttttgtgagcactgcgtctatggaaagcggcataggacaaaattttcaaaggcaatgcacactataaaggctgcaatggactgcattcactcttactaccaggggccttcaagagtttcatccctaagaggagcaaagtacttcctctttgtcattgatgattactcaaggatgacatggatattcacgatgaagcagaaatcagaagccttcaaattcttcaagcattggacaattctcatgcagaattaa

SEQ ID NO: 64191 - DNA, 858 bp, Glycine max
  Peptide Sequence Number=SeqID_180969
atggattctatgcctgatgccattctccaatgcatcttgtcccgaatcaccaatgctcgtgacgtgtcatcttgcaattgtgtttccaagagatggaaggactccactccctacatcagaaccctctactttcctcgcagctcatttgaaaccccttcttcttcttctgagggtgctgacaatatcatcaaaagaatggtgtcaagagtggtgaagttagaggagctaattgtgtatagccccttttcccctgatggccttgcatcatggctctcactggcggggcaaactcttcttcaactcgagctccgaatggacaaccttgctgacaatcggggcttccatgaaagcccttccaaattggactatattggtgctgctaagaatttggagtctctgaaactgtggggtgtgttgatggtgcgttcccccaaatgggatgtgtttcctaacctcaagaaccttgaaattatcggtgtaaggttggaggaccctgtgttgagtgtggtgcttcgctcatgcccggttctcaccaggttgttgctgcttggatgtgaaggggttaggtcggtctctattgagttgccatgtttggaggagtgtaagctggatttttatgggatggggaactcttctctcactttgacttccccgcaaattgagtcccttgaggtacaaggctgtagctggattagggtccctgaaaccaagcatttgaggaatctttccatatccaacagtgcagggagagtgtatatggttgattttggaaatctttcagctctggagtatctgtgtatgagaggaatccagtggtgctgggatgccatttgcaaaatgctgagattggcaagtaag

SEQ ID NO: 64192 - DNA, 210 bp, Glycine max
  Peptide Sequence Number=SeqID_180970
atgaagaagaagacagagagaaggagaagacaacgcgaaggagacgaaacatacctaggtatggtggcgaaggagaagaagcagagacttgtgacgatgctcgagtgcgatgaagacgatgctcgagtgcgacgaacacgatgctcaaatgtagacagagaccttgaagttagacggagattagaagaagaagagagcgcgaaagcttag

SEQ ID NO: 64193 - DNA, 234 bp, Glycine max
  Peptide Sequence Number=SeqID_180971
ctgaggtggctccaaatcaggtccaaccctgtctcagcctcactccttcaagcagttttaacaaagttttttttatcggctgaggaggacttccaccaggaattagccagacatttgggtctgtcctttgatgagcacaagccctcttctgataacacgaagtttgtcaaggatatcagtgagaatgcagcaacttcaccaactatgatgggaaaggataatattgcctcatga

SEQ ID NO: 64194 - DNA, 272 bp, Glycine max
  Peptide Sequence Number=SeqID_180972
atggatgcaacagttgttttccatggtgagctagtaatagcccgctctcagaatcttcttggccatggcatgtccattggcatgcgtcccgaaggagctcttcgcacttaccgtgaaagagaatctggcagagcatcaggatcaaggccgcgcgctaagcgcgagatcagtgtgctaagtgcagcagacttgtgcacactattccaaagtgcctatttcgggaaaagagccctagaagtagcaagaagagcagcttgtgcattgaagcctag

SEQ ID NO: 64195 - DNA, 253 bp, Glycine max
  Peptide Sequence Number=SeqID_180973
cgagaattcgctaagcgtaaccttcagtggctaagcgcgaggaagaatccaaaagaagatgagctgtcaagtttgctaagcgcaccgctccaagtcaacaagcacatcgcttcagctcatccgctaagcgaaataagcgcgctaagcgatccagatctgcggcacgagcatgaacaaggccacctatttaagcctgaaatcagatttgcaaaaggagtttggacatttcttgagaagctctgcatgcacgaag

SEQ ID NO: 64196 - DNA, 129 bp, Glycine max
  Peptide Sequence Number=SeqID_180974
atggatttggtccctgagctcatccctttcgaattcagtctgatacaccatctagagaaagagcttggaagaactaaaaacaagaaactcttcatggcaatggctggagtttgtaatatcacacgttaa

SEQ ID NO: 64197 - DNA, 788 bp, Glycine max
  Peptide Sequence Number=SeqID_180975
atgtatcacacagagctggatgaattcaagggcgagctggagaggtgtaactttcacaagcgcctcaccaacttagctgatagtagcattgacctagcattgggtgaatctttgcccacctactcaagatactgcaggatgcctactgacattagagaaattgagctggacatgaatgtcgaagccctcatttctgggaagattacttctatggcccagtccaactcctcaagactcgggtttcctgctcttatcacaactttatgtaggaccataggagttgcctccgatagtcttgtctttgaatgtctgagcctgatcattattttggcctacataaggaagaattgttggaaccctgatgatccaacaattattattagggcggccagaagaccaagggcaaggctagttgaggctccttctacattagcagctcctcatctaggttctacatcagtagctcctcctctagctcgtattgcactggtagcacctccaaacttcatccctacagtagagcaatttaatgaatgggtagcctggcccgggactcagcctcctcttcacagggacgacgaggatcccgccgctcaggtaccacatcagccagcggatgagtcatcagagtcttccactcctgagcccttgatcaggaagaggagggtagttgtaactcaggaagccgcagccactcctgaaaagtctcatgaggccactccagagcctccggcaccagtggcagataccacttctccacagcagtcctgtctccaaacacctctcct

SEQ ID NO: 64198 - DNA, 336 bp, Glycine max
  Peptide Sequence Number=SeqID_180976
atggttacaaccatcccaaggatcatcattgtttgtcagtattctcttgggtcagtgcggtcagtgtttgtagaaacaacgaccttgctgcatctggggctgacaatggttctgttcgattatggtaaatttaaagtgataccaaagacatttagtctctttatagtgtgccattggtccaaattttgctgcactcagttaggtctcaatctttccacaggttgtggaagcaatgtcttccaaggttattttgatgatgccaaagaatcaagagttaagcaaagtttcaagaaaatattcaagaatcaagtttcaagattcaagattcaagaataa

SEQ ID NO: 64199 - DNA, 480 bp, Glycine max
  Peptide Sequence Number=SeqID_180977
atgccactcccccaaggggatgtcgactcctacccccttttcaccactgaggggtcggcgcccaatgcgttgcctcagcccaacatcgcggaagtctctcaaccccgcccaatgcaaccgctactcttctccatgggaggactaccttcggcggttgaaggaagagaaaaacttgatttcattgaagagagattaaaggcggttgaagggttttgtgattaccccttcacacggatttatgcttggtacccaatgttgtcatctctccaaaattcaagagacgagaagctattgatgcatttcttccaagatagtttggtcggagcggcgatcatctggtataccaatttggaagcttctcgcatccgcacacggaaagacttgattattgctttcattaggcagtatcagtacaataccgacatggctcctaatagaacccaactgcagaatatacactacaagaaattgtccatgtag

SEQ ID NO: 64200 - DNA, 309 bp, Glycine max
  Peptide Sequence Number=SeqID_180978
atggttaagactagaggattagaccgtgcgttaggtagggttggtgccagaggtctggggagaggaggggatggtgatgatattgatggtgctccccagctccaaaggccgaccgcatcggcatgcaggcgacgggtacctgtcattcttgacgatgatgtacctgtggtacctgcggactcacctgcgataccagaggcagaggctgctgtagctggggatgagcccatggtagatgttgccacacaggacaccggtgcagagactgacgcacaggataccggtgcagagattgacggggacgagtga

SEQ ID NO: 64201 - DNA, 1038 bp, Glycine max
  Peptide Sequence Number=SeqID_180979
atggtgcaaaaaggggacccatcagtgcttacagagtgtgctgaccatgttgcgggcagtgtatggtctggacatgaacgtcctgagttgaagttatgctcccatgggagaaaggtgcataacttgggcaggcatgttcctgcaattgaggacatgaggtggcaacgggagacttctagtttccatcttcctgtgggggaggtgtcgatcacgctggacaacgtcgcgtctcttctccatttgcctatcgttggcgcattccatgacttccagcctctgtgcactgacgaggcagtggtgctgttggttgagttactgatggtctcaacagaggtggccatggccgagacaggacaatgtggtggacatgtacgcctgcagtggctgcgagacgtataccagcgcagatgtcagatgcagcactggacagctgccgctcgcacttatcttctacatcttttgggttgcactctttttgctaataaaagtgcaacccatgttcatgtctcacacttacaggcgttccgtgacctcactattgctgggtggtatgcatggggagctgctggcctcgtccatatgtacgatcaacttaatgatgccattgcggagtgcaatgctgatccggactacgacgaggtgtcaccacatgcgtgtcggtggattgtgacgaagaagactgtgaagaagacgcactactcagaccatctgacagcagtaggtgatctatgtgctgtgtcaagtcagtgtgcgtctgactatatggactggttcttcgtcatatcgcatccattcatgactgcgccacagatggatcctcctcgagatgcatatgcaatgcagcccagtcatatccctcatgaggcagcaccggcatcgacacatacgaatcctgatgcggacgagcccagacatgcagtagaggcttgccatgtgatcgcggaggtgttggagcagcatctaaatgcgccaggcacatccacacatgaagaggtcatccaaaaatgtctcaggattgccatgggtgtcacagaagac

SEQ ID NO: 64202 - DNA, 423 bp, Glycine max
  Peptide Sequence Number=SeqID_180980
atgaagctttgcttctacagaacacttgggttttcaaagagaacaagggaggggacatcccttgtggatctttggcttgtaaaggattttacaaggttgaaagaaatctcaagaaccctttatcacccttcagctctgaacacctttgaacaaatagtatatagtgccaaaggaaagcaaattgtagtttttcttgactatggtggaactctctctccaattgttgcagatccagataaggctttcatgactagaaagatgagagcaacactaaagggtatagcaagacattttcccacagcaatcgtgaccggaaggtgcagagataaggtatataactttgtaaaattggcagaactttacaatgcgggaagccatggcatggacatcactggtccaacaaaaagtccaaaagcaaggtaa

SEQ ID NO: 64203 - DNA, 189 bp, Glycine max
  Peptide Sequence Number=SeqID_180981
atgatgggtgttaaacattttgaggtggtcaagcgaaagtcgcatgccaacaaacaatggtcaccggatgaaattagggttgatctctgcatttggacgtcatgtgtccaatcttaccacaaaaataatagacaatggtgtattcatcttgagcatagatctctgaaaaaagatgatggaactcaataa

SEQ ID NO: 64204 - DNA, 484 bp, Glycine max
  Peptide Sequence Number=SeqID_180982
atgacaatcaattcatggggcttcagacttgatggtggaggatgcacgaacaacactaggcaatcaattcgtggggctccggactcgatggtggaaggatgcatgaatgaaaatcaattcatgggggctcccggacttgatggtggagggatgcatggaatgacaatcaattcatggggctccggattaagattcaattggtggaggatgcacgaaacagcgctagggcaaatcaaattcgtggggctcccagactcgatggggaaacgtcgggtcaagctgaaactgggaataaaatcactcatagtgtataaaaaaactcacacaggggaagctgggagtttcggtcttttcctcatttttatgtggggcgggatatcgccagtcgagagtgactttgaatggcaatcccaaaggaagaactacttcaaaaaaatgggttttccattgccggcagtcatttaccctgccgaaaatttatctg

SEQ ID NO: 64205 - DNA, 128 bp, Glycine max
  Peptide Sequence Number=SeqID_180983
gtgtacaagaacaaatgttggatgtaagaagaaaaagtctctcctggggtataaaatacttctcaacccaactcaacgatcggaagccagaattcaaccatcacatcgattatcatcgtcaaagctga

SEQ ID NO: 64206 - DNA, 198 bp, Glycine max
  Peptide Sequence Number=SeqID_180984
atgccctcctttcgcgatttagagcagaaatgggcaccaaaggttggagctttgtttggagcttcaatggagaatgaaggagaagagaatggcaaccaatgccacatgtctccatttgagtggagccaaaagggcccactttctcttttgattgtgactcatactcagccacaaaaagtgagaaaatttgacctttga

SEQ ID NO: 64207 - DNA, 708 bp, Glycine max
  Peptide Sequence Number=SeqID_180985
atgtgctatgctttacgtgagagcaagcctgtgatcaatgcggagactgcacctaggtctaataggttgagtctgattgccatcaagaggatagtctttgaacatcttccaagttgtttgccaaagaaagtgacaaccaaggagtttcttgacgctctaggagagaggaaacctacttctggcaaaggacattggaaaaataccaagagtacatctaatgcttctcataaatatcaaggttcttggaaaccagacaaaggggttcagatatctaagggagcccagtctgagggaaagcaaactaaggattatgataatgtttctgcatccgtggttgttgagagttttgttgctaaaaggtctaaaattgaggaaaaatgttttgtgttgtggcacaagcgcttaggtcatatttctagggaaagggttgagagattgacaaaaacaaatattctaccttccttgaattttgatgacttgggcacttgtgcggattgtataaagagaaggttcactaaaaccaaaaagaaagaaaaatctgaagcacttgaaaagtttaaaatttttaaaactgaagtagaaaaacaattgggaaaaattatcaaggttgtgaggtttgatcatggtggagagtattatggtaaatatggtgtcactgggaaacatatgggagaccattcactttatatttggaagactgtggaatag

SEQ ID NO: 64208 - DNA, 270 bp, Glycine max
  Peptide Sequence Number=SeqID_180986
atggaggccccaagcaaaccgccagtggaattggcgagtttggtgttttcgaaggaactgtcactgccactggcgatatcagcatcaaggggaaccgccagtcaaactggcgaagaaaggaaagttgcaactgtcattggcgagttaagggcaagttgcaactcccactggcgagttagggcagtaggaatagccattccagatggcgatttagggtctttatatacgcgaaaattgtttcagtgttgctgtgtgtacacaataaaataa

SEQ ID NO: 64209 - DNA, 393 bp, Glycine max
  Peptide Sequence Number=SeqID_180987
atgaaccctactgattttcggtttctgcttgctccttcttccattgaagctccttcacctgttcttccattgaagcttctaccccttcttccattgaagctccttcagctcttcgacttcatcgctccaacttctccgctcgaagcttcgttaattggttcgtgtactgttgaagaaaggcttgaggtctttgaccgcgagaagtttaacaattgggtggagaagggtgtaactccagccattgaacccagtttaaagctctatgaagatgttttgaatctgggattcaaggttattctactgacaggacggagtgaaaggcgcaggagtgtcactgttgataatttgatcaatgctgggtttaaggaatgggaccagctcatactaaggtaa

SEQ ID NO: 64210 - DNA, 474 bp, Glycine max
  Peptide Sequence Number=SeqID_180988
atggcggtggtgaatgttctgcttattatgtctatgtatgccctcttatttctgattattttcctttccgttgtaattttatttaatttgggagatgaagtatcaataatagtgataaacctgggttcccacacttgcaaagtcggttatgctggcaaagatgctcccaagagatatctggaacatacattgtcacatacttatgttgttggtgctattgatcacatggacattgatggaattgctggtattaatgatgagaactctgacaaaaccaagggaaaatgtaaactttatgtaggatctcaatcattaggataccgcagagaccatatggaggtgatgtcacccttgaagaatggagttgttgttgactataatgttgtatacaacatatgggatcatgctttgaggttcctacctcttaggaagctcatgacggttcttttaatatgcagcactcccaaaaattag

SEQ ID NO: 64211 - DNA, 282 bp, Glycine max
  Peptide Sequence Number=SeqID_180989
atgttgagtccaattgtgaatgttactggacatgcactaaacaaggattctagcacttttgattctaatataatcattaaggatgaagaaaaagaactccatggaacctttaaatgctttggaagcttaaaacttattttggagcttcatgaaatgagatcagataatcctgaaaagattgaggtagagaaagctttgttggactcccctgactctaaagtttcagcaaagatagtagcaacacttgcacctcttcaattgtatatagaaaatatcatatag

SEQ ID NO: 64212 - DNA, 631 bp, Glycine max
  Peptide Sequence Number=SeqID_180990
atggatgttgtaaatgatttgcatatggggcctccagcaacaaccaatttgggaggttccactagtacagatgatgtaaattcatcgcagaagcagaaaatagtgagaaagaagacacaaggtaaatctgttgagtgtgaaggtcctgatttttcactggataagtcttcaccgaagacagatgctactataaagcacccattacatgagtcccctgctttacctaatttcttaagttgccaaataattgtagaatattcaacagagaatgaaaagagcaaacggcagaagacaacacataatgctattgaaggcaatgttaatggttgcggcactcctgagggtattttttcaccaaaagcttccacacctgcattggatatgccttcagaacatcccattcaatgtttttccaatgatctaataacaagtcaatcttgtgtggaagtgggtatttgtcagggacataatgaagaaaagaagcaaaatatgatcaatacaactgcagaaaatagcaattcacagcaaggcattccagaagaaagctgcaatcacatttcatttgcagcaagtcatgagccttttgcaaaagagtgtgtttcagaagttgtaaaattgaacacagagcatg

SEQ ID NO: 64213 - DNA, 228 bp, Glycine max
  Peptide Sequence Number=SeqID_180991
atgtgggatcaacacaggcttaaaagagcactgaaaccagggtttccaagcattagagagaaggagaagggattgaagccttcactccactgtctgcatgcgatgagtatttctccctccacagactttaatttaaaaatcccaacgatgaacatgtgcgaaaatgaatttttaacctggggtccaaatttcacaatgatccaacggttaacaagtccgggatcatag

SEQ ID NO: 64214 - DNA, 489 bp, Glycine max
  Peptide Sequence Number=SeqID_180992
atgcaaaacgaaaaggaaagaacatacctgaaacatggcacgaagcatactagatttcaagtttcaaacaaaaatttcgttataacctttggtgttgccactttgacttctagcgtcctattaccaagaatatgctcacttgatagtacttcttgtagccacaatgtcatcaaaatcaccaggagaacgagaagaaaaaggaaccattttgaccatcaaaattcggatttttcactctttgctacaatctctgtcgtcgtcactatcggttctagaaacttccgcaaaagaaggtggaatctctggagtctcaaatcagatctcttgtatgacacagtgggggcacgtgacaactgccccttcatccagggtccgaaacccgacccgattcgatttgggtcctccatgagaggtgcgagcgtctccctaagggggcggaggttggcgaatctcacaacggaggagtgtggacaagagttgcacttctag

SEQ ID NO: 64215 - DNA, 159 bp, Glycine max
  Peptide Sequence Number=SeqID_180993
atggttgctcaagttaaggctttcatagatgcaactggagatctagggaaagtagaacagcttgctgacaagcctactggaatcttcatcaccacccgttgccaaggtggcggaaaagagacaatcaaaaaagaggttgagcaagattttagaggttga

SEQ ID NO: 64216 - DNA, 201 bp, Glycine max
  Peptide Sequence Number=SeqID_180994
atggggtgtgatgaaggcatccctgtcgacgccgctagggccgctgatgatgatgatgagggcgtaaccgaaatggaatctaaggggttggtggtggcatgggcagagatgatggggttgaagggctttatggaggttgttgttgtgtgcatggacggagatgatggtgttccaaatgatgatgtttcaatgccacgatga

SEQ ID NO: 64217 - DNA, 1461 bp, Glycine max
  Peptide Sequence Number=SeqID_180995
atggttaattccagttgctggagaaacagtggttccccaagtcctgaaaattgtaacaaggaaccaactattcaggatcatcaaaaggatgattcacacaaattttctgatggaccattgagagtgtgcttgatggatggagaaacaaaactttcaattgatcaagttacctcacaaagtggagctgcagctgaggaaataaagttgagcactgacaacattaacgagcaaagatttatgactacatcttctgcagtagacattccttcagagcatctcaaaacagatggcagaccactagatcatactgagattacaagaaatgatctgtgttgtgcagatgaggaaatagagttgagcactgacaacattaaggagcaaagatttatggctacctcttctgccgtagacattcctgttgagcaactcaaaacaagttgtagaaagctagataatacggagattacaagaaatgatctgtgttgtgcaggtgatgtttctgatttaagcttagacacagtaagagacggtcatttaaagatttcacaattctcactagacagaaattttgctggcaaccaaaagaacaaacttctcatccttgatctgaatggactgcttgctgattttgtcagtatcagtgacactgacactcctttccgaagatatagacgagaaccagagccagattttgtgcttagagggaagaaaggtgacatggtcaaatgtcttgtttcctcattccagatttcatatcttgctctagctcaaatttggctgatatgctactctttccttttgcagtctacaagaggcccttttgtgacgattttctacagttttgctttgacacatttcatgtgggagtatggtcgtctagatccaagagcaatgttgatgcatcaatcaaatttcttatggggaaatctgcaaccaaactgctcttttgttggatataaggttggcctagtggttgggaagggggggcttaagggtgaagggagagaggggagggggaggtcacggaatcagtcccactgtactaaaacaaagtttagtactgttgagaatatagacaagccacttgtgttgaaggaaataaggaagttgtgggaaaaggcagaacctgatctaccatgggagaagggagagtttaatgagtcaaacacattgttattggatgactcgccttacaaggcactaatgaatcctaggcattcagcaatatttccttattcttaccggtactaccacaccagagactcagaattaggacgagaaggtgatcttcgggtttatctaaaagggctggctaaggccgagaatgtgcaaaactatgtgtcagaaaatccgtttggccaacggcccataagagaagcaaatccatcttggggttactatcgtagagttatagaatcacttcaaagaagccaaaatgatgggccctcattacccaggtag

SEQ ID NO: 64218 - DNA, 375 bp, Glycine max
  Peptide Sequence Number=SeqID_180996
atggtgatcaacaggaatacaatatttggtgaccaattcatgatgccacaaacagttgagacccatgtgctagtgctagatggagcttcccctagctctgtggaggttcaaatagattttgagcctctgtcggtgattcttgataaggaaaatccatgtgttatggtggaggtgatggagtctttgcaaaagaatcaaacatgggagctagttaagcttcttctaggcaagagagtcatagggtgcaaatgggtgtacaaaagggaacctctagtatcgaaacaagaattggagaagttcaaggattgcttagtaggaaaagggtattcacaacaaaagggaattgacttctctccgagatatgcacttggataa

SEQ ID NO: 64219 - DNA, 249 bp, Glycine max
  Peptide Sequence Number=SeqID_180997
atgagacaagggccggtgcttctgggacatagacaagagacagtgcgactggtacaaagacaagggtcagggcatctaggacaaagacaaggccagtgcattaggacagagataggccagtggaagccattggtagctggaagaagggcgacaaatggaggacaaacaaagaagtccactggggacaatatgtccccgatggagcacgatttttcattatccctcaaccacactctaatatcaacttga

SEQ ID NO: 64220 - DNA, 144 bp, Glycine max
  Peptide Sequence Number=SeqID_180998
atggtggttgctggcaggataaagcagctaacatcactgcttgcaaggatacattccatgggagagtatgtgaatgccctctggttgatggtgtataattcaaaggagatggctatacgacttgtgaaggttaaaaggctttaa

SEQ ID NO: 64221 - DNA, 420 bp, Glycine max
  Peptide Sequence Number=SeqID_180999
atggcctctagaaagagaaaggcaacaacctcccgacctcaggagccctacgacacgactagattcgtctcggaggtcgcttgggagcgatatgagcagaatgttcactcccgaaacatccttctggagacgaacgttaatttatatgtcatagagtatgatgagttctgtcgagagcttgagaggcgaagatggcataaagccttgaccagacagcctgacggtcgcattgatgtggccctggtcaaggagttttatgcaaatttatttgatctagaggacaagtctcctaggcaggagcccggggagcgctacaccacctacaccaagttctgcagcacgcacccagatcctcaagagcttgcttccaagctctgtattccaagcggttttgctctgaatgctgagggagcaccctag

SEQ ID NO: 64222 - DNA, 435 bp, Glycine max
  Peptide Sequence Number=SeqID_181000
atggaccggaggatccttccggaaaggaatgttaggatttatcatactgaatttgatgagtttaaggcagatttggagaggtgtaaccttcataaacacctcgccaaccttcaagagggaagcatagatgtggcgatggttaaagaattctatgccatcctgtacagctcagaagaccaagttcccaagtgttccaaagtaagaggtcgtatgatcaagatagatgcagacaacctgaatgaatttcttcataccccaatgttgttagaggagggggaattgttacccacttactctagattttgcagattgaggtctgatcccagagagatggaggttatcctgtacattcctggcaagggctttgttctgaacgttgagggccaaccatggaagctcctcagaaaggatcttactaccttggcccagaaatga

SEQ ID NO: 64223 - DNA, 641 bp, Glycine max
  Peptide Sequence Number=SeqID_181001
atgggcagagctaggttggtttatggcttagtcacagggatggacatgaacattggcggcttgatctctggacagataaccattatggctcagtccaactcttctcgcctaggcttcccagctttaatcacagccttgtgcaggtcaaggggagttggatctgatgctcttacttcttacaggagcctgaggccgaacttgcaagaattggcccaccagaggccaatcatgattgttgagaagttcattgagcagcaaaagccagagctagaagacgaccaatcctctgaagccattgttcctggagcttttgatgttgcaaaagtaccagtaccagctgatccaccatctccagtggtggatccatcttctcctacgccaaaagcagctctcccatctacacctattattatatttgatgaccctacacctaaattactaaaccctcgatccctcgtcaggctgaatatccaagctttgtccgtagatccctcatttaagactacacctgatttagacagtcctcttagtgatgcaatcctccctaggaagggaccagtcactagagccatgagcaagaggctcaaagaggattgggctagagctgctgaagaaggctctagggttctcatgagtctcag

SEQ ID NO: 64224 - DNA, 948 bp, Glycine max
  Peptide Sequence Number=SeqID_181002
atggagcttacatcactcggtcttaccgttttatatattacttgtggactcgggaatttagctccattagatttggagatagaagccacttgcaggagaaacaacgcagagagaaggagaaaatttttgcaggaaaggacagcacaaccaagtttggaggaagctcaatcatcggaatcatcttcagcattcccagagttaagagaatccaaagtaggtgcgttcgaagttcatatcatggctgaagataaaccacagagggtgactcttgaagattattctagctctactgtgtcgcaattcttcacaagcatcgcgtggccggaagttcaagctcacaacatcacatatcctcattccttgattcaactgattcaaggaaatttgtttcatggtgtgccagaggatgcagtgaggcttagcttgttctcattttccttggctagagaagccaagaggcggctgcattcgttcaaaggaaatagtttgaagacttgggaagagcttgttgcgaaagacactaactcatggattcttcaagctgattcagctgaacatttttataaatggtttgagaccacagtccaagcaaagcctgctagagctttcttcacaagatgcactgttggaacaaacaagctactagctaagcagctagaatcactgacagagacacttagtaagctgccaacccaattgcaagcaactcaaccttcacattcagcagttatgcaggttgaaggttgtagcatatgtggaggagcacatgagtctggctactgtatacctcttgatgatgctgcaaaggaggtgaattatatgggaaatcagcacagaccagggtttaatgcatgtggatttgtaggttaccagcaaggtgtcaattttaatcagaatcaagggcaatggaggtctcttcctgggaatcaattcaacaaggaccaatga

SEQ ID NO: 64225 - DNA, 417 bp, Glycine max
  Peptide Sequence Number=SeqID_181003
atgaagttcaacaccaagcacctccaacacacatccaaccatatgcgcatggtgcaaatcttgcatccgacaaagatctacacattcaatgattggcagatgtgcttcctaaggcaagaaggagatgatgagttttataagcgccttattaatgacatccctcctattttcactcgcttcatttttaacttacaccagtatcctgaggctatgatgcaaagagctaaccatccatcctctcctgatcaaaacccttgggttcccagtgaaggaatgattgcaaaagtaaaaaggaaacaggataagctcaattgtcaactcacagagatgcaaaaggaggccgaggcaaagcaacaacaggagaagctcaaatttgaggagttgttcaacaacttacatgctcatcttggaccttag

SEQ ID NO: 64226 - DNA, 501 bp, Glycine max
  Peptide Sequence Number=SeqID_181004
atggcacacagagacaaattatggtcatccacaccctttttgtcatccagagataagaaagtccgatggcacgtagagacaaatcatggtcatccgcatcctttgccatccagagacaagcgagcccgatggcacgcagagacaaattatggtcatccgtacccttttcgccatccaaagacaagcaagtccgatggcaggcgaagacaaatcatggtcatccgcacctgttctatccaaagacaagcgagtctgatggcacgcagagacaaatcatggtcatccgcacctttgccatctagagacaagcgagtccgatgctacgcagagacgaatcatggtcatccgcatctttgccatccaaagacaatcaagtccgatggcacaaagagacaaattatggtcattcacacccttttcgccatccagagacaagcgagtccaatggcacgcgaagacaaatcatggtcatccgcaccttttccatccagagacaagtga

SEQ ID NO: 64227 - DNA, 513 bp, Glycine max
  Peptide Sequence Number=SeqID_181005
atgccacatggagacaaattatggtcatctgctccttttcgaagacctcagggtccttcgattgagactattgaagtctcccctatcaaccagagacaagcgagttcgttggcatgcggagaccatcatggtcattcgctttattgttttccgagactattgcaatctccctctgtcatccagagacaatcaagtccgatggcaggcagagaccatcatggtcatccattttcattgctttgtagtcttcgtcgttatctagagacaatcaagttcgatggcatgtggagaccatcatggtcatcatttacatttgaagatgacaatgtcttcagtcattgcatgccttcaaaaggcaacaatgtgctcatcatacatttcaaagacgacaatgtctttagtcattgtatgccttcaaaaggcgacaatatcctaatctacatttcgaagacgacaatgtcttcagtcattgcatgccttcaaaaggcgataatgaccatcatttgcttttga

SEQ ID NO: 64228 - DNA, 303 bp, Glycine max
  Peptide Sequence Number=SeqID_181006
atgttgcatcttcaacaggctagcctagaaaaaaccatggaaaagaggttccttgttgaacacatggaacctaatctgctgatcaaaaacacactggaagcttcgctcaaatccttcaatgattttgtgttgtttaatatgaatatgcttatgcaacaaaggctgcctccctatgtcgaaccacctccaccaccttcaactatagttcttgcatctatctccattgaaaattctattcctgggcctctgccttcaccattaaagtcaccaccatccaatccacctccattcactgcgagttga

SEQ ID NO: 64229 - DNA, 171 bp, Glycine max
  Peptide Sequence Number=SeqID_181007
atgaagactcatcctcttgctgaactagctgtggctaagcgaggccgaatcactaagcccagttgcacgctaagccgagctttcctgggccaagcgcgattcgttgcggcatccgctgagctaacctttgaggagcttagcgcatacccttgcggcagatgtttagcttag

SEQ ID NO: 64230 - DNA, 618 bp, Glycine max
  Peptide Sequence Number=SeqID_181008
atggagggtcttccccaaggttaccgtcccaacgttggtgtctgtctcatcaactccgatgatcagatttttgtggcttctaggttgaatgtcccaggagcatggcaaatgcctcaggggggaattgaagatggtgaagaacccaaatctgctgccattagggaacttcgagaagaaactggaatagtatctgctgagataattgctgaggttcagaaatggttgacatatgacttccctcctgctgtgaaggctaaagtcaatcgtctgtggggaggtgaatggcatggacaggcgcaaaagtggataagtgtccaaagaagccccctcacaacttacatggttgctaaaatattagcttggcagtatagaaagcaagatggatggttgctgaagcagatgtttcttatgagattaacaaaagatgacagtgaggtcaacttaactaatggggaagcagaacctgaatttgcagaatggaaatgggcagaccctgaagaagttattgagcaggcagtggactacaagagaccaacttatgaagaggttataagaaccttcaagccttactttcaagggagtggaatatctgccaaatgtaaatcaacaaagtggtga

SEQ ID NO: 64231 - DNA, 183 bp, Glycine max
  Peptide Sequence Number=SeqID_181009
atgaagccacatcgagaggaaggaaggaaaggttggttgttggcaagtgacagcgcaaagggtgagattatgagagaccgagagcgagactgtgagagaccaagagtgagactgcgagcaagaggaaggaatgagactgcgagcggagacgtagaaggccgctcgggtcgatctgagtcttaa

SEQ ID NO: 64232 - DNA, 258 bp, Glycine max
  Peptide Sequence Number=SeqID_181010
atgaagaacgaacgaagaacgtcaaagaacgttcgcggaattgatcatggaaacgtggccccaggggctaaaaggaatgttccagaatggaccattttccccctacctttagttccttgcccatttcttttcgaaacgtcgcgaaaccctacggatagcatagtgatcgccgttaagcagcttaactcggctggaaaaaatccctatgttgacaaaaattgcccccattctgagtatcttgctcatttcttttcgtaa

SEQ ID NO: 64233 - DNA, 112 bp, Glycine max
  Peptide Sequence Number=SeqID_181011
atggcgagtttactgcggaatggatgcgtggcacgtaaaccgcctgcatggctggcgactttgtctaacgaggatctcgccactctctactacgagacagcacaaaccgctg

SEQ ID NO: 64234 - DNA, 687 bp, Glycine max
  Peptide Sequence Number=SeqID_181012
atgtccaaaaagatgggcttgctgagaataggttctaaaaagagacaaggtgacatcaaaagatcaaaacccagatgtagaaatagcaagaaaatggcaactctagttgaacctcccaacagaattaagccaaagggcaagcattattatacaatatggcaaacattgtttgagattgatacgaagtatgttccaattaaacctataggccgaggagcgtatggcgtggtgtgctcttcgatcaacagggagaccaatgagaaagttgcaattaagaagattggtaatatatttgagaattctattgatgcattgagaactttaagggagctgaagctgcttagacatattcggcatgagaatgtcattgctttgaaagatgttatgatgccaatccacaaaacaagttttaaggatgtctacctggtctacgaactcatggatacagatcttcatcaaattattaagtcctctcagccactttccaatgatcattgcaaatatttcttgtttcagcgtttaaatgacattggcatgcttcgaagtgaattcccattttctattattaacatacaacttaaaagtgaattaactattaaatatcctctttcatgcattcttatacacaatcatcaggctgcttttgaggagttgggacaatttgagttgtggctttacattttctag

SEQ ID NO: 64235 - DNA, 1158 bp, Glycine max
  Peptide Sequence Number=SeqID_181013
atgggtttccttgtgttgcttcttatctccctcttaggtctctcttctagttccagcatatcaactcatcgctccatattggaccttgacctatccaagtttaccacacagaaacaggtgtcttcactgttccaactatggaagagtgagcatggacgtgtctaccataaccacgaagaagaggcaaagagacttgagattttcaagaataacttgaactatatcagggacatgaatgcaaacagaaaatcaccccattctcatcgtttaggattgaacaagtttgctgacatcactcctcaagagttcagcaaaaagtacttacaagctcccaaggatgtgtcgcagcaaatcaaaatggccaacaagaaaatgaagaaggaacaacattcttgtgaccatccacctgcatcatgggattggaggtatcatttaaaatgtgttaaggatgtacaaaaaataaaaagatactatagggaaaaaagaaatggttgggcattttctgccacgggagctattgaagcaaaaaatgcaatagtgacaggaaaccttgttagcctttctgaacaagaaatcacagattgtgtctataaagccaacagttgtaacggtggatatcactttcatgcatttgaatgggttatagaaaatcgtggaattgccactgaagttgactatccttacacagctgaagatcatggtacatgcaaagccaataagacacagaacagtgttacaattgacaattttggaggtctaataatatcagaacatagtacacaaccagagacagacaaagcactgttgagcgccacccttgagcaaccaattagtgtggccatggacgcaagagattttcatttctacactggcggaatttatgatggaggaaactgttcaagtccgtatgggatcaaccactttgttttaatagtgggttatggatcgttagatggtgtagattattggatagtaaaaaattcatttggaaaagattggggaatggatggatacatttggatccaaagaaatattgctaatccaattggagtatgtgcgattaattttttcgcttcttggccaatcaaagagaaatcagaaacactggtgtctgctcgcgttaaagctgatcaaagagtggattactctcctctttga

SEQ ID NO: 64236 - DNA, 3303 bp, Glycine max
  Peptide Sequence Number=SeqID_181014
atggcagcaaagctcctacattctttagcagatgacaacccagatctgcagaagcagataggatgcatgactgggattttccaactctttgatcgccaccaagttctcacggctcgccgcatcagccagaagaggcttccttctggtaattcgcccttcagtgatggcagcttggaaagagattctgataatatactccatcgacaaacagcaactgatactgacaagggtgtaaatgaaaggcaaagaatttctactgaatcatcaagagcatcgttctcttcttgttcatcatcggtgtcctctctggactgcaaggctgaagcagaggctacatatgaccggattctttttcctgaaactccttcaagggatgcagctatgaaccaatcaaccacctctccccattttggatataactcccttgacctgagggatgtggtgaaagattcaatgtatagggaagcccgtggactgtcagtgaagactacagccaaagaggaatctgccattaatgccgcaaagcacagggattcaccacgacctattcagttgtccaaatctgttgatggatcttacagagttggaatagatgggaaacaaagtgtgcctattgatctaaaggagtccatccgagtccttgctaaacttagagaagcaccttggtattatgtagaaactaaagaacttccgagatcatcacatgaatcaaaagatggacactggaattccatctcaaaggatgctccttggtttccttatgaaggtaaagaaacaagccgtttatcttttgaatcacgagagaccatcaaatccacaccaaaactaaaagagcttcctagacattcactggatagtaaggaaggttcattgcacagttacagcactgactcaaaagccactcaccactcaagaaacatttacagtggcacctccacctcaaatgacaaatttcctaccctacaacagccttcggcgaccccaagtcgtccacctagtattgtggcaaaattaatgggcttggaaggtttaccggattcctctttggctggtgatgctcagtcaagttcaactgaaacttactcagctcaagataatggtcaatttcgaagaccatctaaaaatggactcatgaggccactccgactttctaattctccaaagatctctttgaaagacccaacttccccaaggcgaaagaatcctgatctggttatgaaacccatctcaagttcaagggttcccattgaaccagcaccatggaagcagcaagatggaaatcaaagctcccagaaacctaatttaaggggcataaaagctccagcgagagcaccggattcctttccttctgtttatagtgagatagagaagagattgaaggatcttgagttcaaacaatctggaagggatcttcgagcattaaaacagatacttgaggcaatgcaagaaaagggactattagagagcagaaaagtagaacaagctccaaatgttgttggaagtcaaagtgactatgaaccaaaagctaccaatcaaaatcagaataccaggtcagtaaggcaacaaaacactcagagaaacaattttctatcttccacagtcaagggatctgactcagcaagggcttttgaatccccaatagtgataatgaaaccggcaaaacttgttgagaaaactgtgattcctgcttcttcagtcattccaattggtggcctttctggttcccagaaataccagattggtggtgtatatgtagataataataaaactggtacatctactactcgggtagcaaacgatcagtctcccagaaacattcatcgggatgcttctgccagttccattgataagaaagcaagtagtagtaagactacaagacctgtacaatctcaatccaggcctcaacaacttccaaaagaaaatagccaaagttcagtgaagcactcaagatctgtgagcccaagattgcaacagaagaagttggagttagagaagcggtctcgtccgcctgccccaccatcggattcaaacaaacccagaagacaatctggtaagaaggcaacggaattgggttcaccaggtggaagacaaagacccaaatccctcaacttaccgcatggtgatgagcaactgagtgagatcagcaatgaatcaaggagtttaagttgccagggggatggagtttctctgcaatcagacagtttaactgtcaactcaaagatggatatggaagtcacaagtagtttacgaactgttgaaattgatgacagccgaagcccatccttgaaggctgcaaagcgattgatttcagagacagtgcagaaaaaatcaactccaaggttggatgaggaggagacagttgcagaacttgcaacagatgccccggaacatcctagtcctatctcagttcttgatggctcagtgtacagagatgatgtgccatccccagtaaagcagatatctgaagattcaaaaggtgaggatgctcaagaatccaaagaaaatgagattaaagatcagtggaaccctgaagatagcctttcatttaacagcactggacccctagagatcaatcgcaagaaattacagaacataaatcaccttgttcagaagcttcgacgactgaactccagtcacgatgaagctagaatcgattacatcgcttccctgtgtgaaaacacaaatccagaccacagatacatctccgaaatattattagcttcaggtctcttactcagagatctgagttccgagttgctgacatttcaacttcactcgtctgttcatcccattaaccccgagctattccttgtcttggaacagaccaaggcaagtagtctgctttcaaaagaagaaagcatcccaggaaaagacgctaattcgaagctgaacaaagagaaatttcacaggaaactcatctttgattctgtgaatgagattcttggcgcaaaattcagctcctcccccgagccatggattcaacctaacagtaacagactcaccaagaaaaccttgagtgctcaaaagcttcttaaagaactatgctttgagattgaaaagattcaagccaagaagacagaatgctccttagaagaggaagatgatggtctgaaaaatattctgtgtgaagatgttttgcatggctcagaaagttggacagattttcatggttacttacctggggttgttttggatgttgagagactgatatttaaggacttggtagatgaggttgtgattggtgaatcaacaggtttgcgagtcaagtcattggttaggcgcaggaagctatttggaaagtag

SEQ ID NO: 64237 - DNA, 201 bp, Glycine max
  Peptide Sequence Number=SeqID_181015
atggtgttgttagctgaagctgctttaggacttttgggtttcgagaataatggcctccatgctggcattggaaaaatacagaaatccagagagagagagagagaatcacgttacaacaagcatgattttgacgtgggtaatacttcatcttcggtattccctattgtacaaacccagcttctaaccttatatgggaaataa

SEQ ID NO: 64238 - DNA, 426 bp, Glycine max
  Peptide Sequence Number=SeqID_181016
atggttagaaccatatgttttggtcgggctttaggcagagttctaggaaaagccttagggagagaagtgacttgtgatgctgatgatgcccccaacggcgaaggcccacaacatctgcacgatgttcaccatgtggatgatgcagctgatgaggtccatgaacaacatcaagaaacagcttctaatgatgtagttcctgatgtcgagggttttccaggcgagccccacgacacatcagttctaactgactatgctcattatgttgcagtgactgtttggaatgaatatgaacgtcctgaattgaagttatactcccatggaagaaaggttgagaaatttggtaggcctactctagagattgaaatcttagtggatgccataggattaagtcctttgatcgcatgttcattggacactggcgattag

SEQ ID NO: 64239 - DNA, 186 bp, Glycine max
  Peptide Sequence Number=SeqID_181017
atgaaaatcatatccaagaggtttaaagaacttgatgtttgtggcaaagttactctaaagaataaacttcaaaaaattgtctaccctaatctaaactctatgtgtcctcctctagaaaaggttaccatggataaatggatgaatataaccgacatgagatatgtgattacatcaaggtatttctaa

SEQ ID NO: 64240 - DNA, 381 bp, Glycine max
  Peptide Sequence Number=SeqID_181018
atgccgctgaagggcaagcagttggtggtgtacccctgcaaaacactttggagggccctcagtatcatccacaaccacaaccctcacgttccacaacaagtaaaaaccctcgtgctatggcagaaatggaaaagcttggatcatctaaaggaaaggctcagggccattgaaggaggtgaagattatgcctttgctaacctagaagagttgttcctagtacccaatatcatcacctctcccaagttcaaggggttggactttgacaagtacaaggggactacttgccccaagaaccatctaaagatgtattatcgaaagatggaggcatacgcaaaagatgaggaattgctgatacattccttccaagaaagtcttactggg

SEQ ID NO: 64241 - DNA, 324 bp, Glycine max
  Peptide Sequence Number=SeqID_181019
atgccagagcgagttttctatgtgctcctaattgaggaatctaatgtaattgatagacaagcacacccaacacaacaacatagcaaagtccacagtagagttgccaactatcacaacctacctttcagcgggagggcgacgcggggttcatgggtgcgtcttccaagggaggggaacacatggagtcaccaccaatgtttattcgagggaaacgttggaaaaaccggaatgtgtggtctacaaactttaagtgtgaaaggtttgagagttgtttttacgcacggggaaggtattagcaccctacgtgtccatcacatgggatga

SEQ ID NO: 64242 - DNA, 1062 bp, Glycine max
  Peptide Sequence Number=SeqID_181020
atggtggaaagaaacgaagaaagaattagagttccattaaagagaaaggactttgtgagtattgagttgaaagaaagaatgggagagaacaacaacaacgagtttcatggttgtggtggcaacactacctctcaaggtggtgatgatggctttgacgagccactgtattggaagtacccgacgctgcaagatctggagtgggaaggcaccgttatttgccttcctcccaagttaacatctctgtcaaatatcttcgcccctaaggttcttcccctattgatgtttctgccatccgagaccaccaccactctggttcctcctatgttgtcgacgccacctacattcaaccgaacctccaagatcaattgccatcgttacagaacatcaatagcgggaacaacactcatgattacccgcatacacagtttattaacagcgcagcgaaccaggttgctccaatgtggccagattcccaaagcaatcactcactgtcacggaaggccagttcttggaagtccaatgagtgcaggagatggagtgaagaagaccacaggttgtttatgcttgggcttcagaaatatggaaaggaagattggaaaaacatttcaagaatcatcaaaacaagaaacccaactcaagttgcttctcatgcccaaaagtatttcctttgtcaggcctcaagtaataaaggcaaaagaagaagcattcatgacatggtcctaccagataatggtcctgtccctcatcgcatttaccaggagaatgaagtttcttttccaaatcttgatggccctatcactcaccatattgatcatcagaatggggttccttttcaaaatcatacaatgcaggagttatatgaaattcatctggcagtccctcactacattaatcagcaaaattgggttcttagaccaatgcgataaatatatcaaaagtaccgcaagacatcacattgatgattgttcagtgacaacgttggaagcccatcttagaaacttttttgtgtttgaaggttgtatagcatgcttagtttactctaggaaattgtcaaattgttaa

SEQ ID NO: 64243 - DNA, 432 bp, Glycine max
  Peptide Sequence Number=SeqID_181021
atgtgcatagactatactgacttgaatcgtgcttgtccaaaggatgcataccccctccccaagatcgatcgcttagtagatgggataccaggatatcgaatgttgagtttccttgatgcctatttaggctacaaccaaatcaagatggacttggcagatgataataaaatcacttttatcaccgaatcgacaaactattgttacaaagttatgccattcgggttgaaaaatgttagagtcacatttcaacgactaatggataagataaggagtcctaggaacatgaaggaagcacaaaggttggttactagaatagcctccttgtctaggttcttgccaagaaacgtcgagaaggccaaatcgataatgaatcttcataaaaaggaaaagaacttccagtggaatgatgagtgtgaagaaaactttcgataa

SEQ ID NO: 64244 - DNA, 381 bp, Glycine max
  Peptide Sequence Number=SeqID_181022
atgggtttggcgtctcagcatatggataatttatggcaatggaaggctagatctatgtctggcatgttagtcatggaccatgcaaatagggaacttcatggccaagtaggggggtggacactatggcacctagagtatttagagacgggcgaccgagaaagagaatttgctaagcataaccttcagtggctaagcgcgaggaagaatccagaagaagatgagctgtcaagttcgctaagcgcaccgctccaggtcatcaagcgcaccgcttcagctcatttgctaagcgaaacaagagcgctaagccaaaatccacttatgcacgctaagcgatccagatctgcgttaagtgaacgagcacgaacaaggccacctatttaa

SEQ ID NO: 64245 - DNA, 360 bp, Glycine max
  Peptide Sequence Number=SeqID_181023
atggtggcgtggcctttttacacaaagcagaaaatgaatgcgtttatgctgtcagaagagcttggggtggtagtgcgcgtggtggagaaggaaggaggagttgaccagatcaaaatcattcatgattcaagggatgcaaaggacgaagatttcaagaggatgcaacaggaggaacatgagaaggtaaagcagtcaagtactactggtcaagtgaatgccgaggaatatagacttaaggtggaagagtatatgaaatttgttgaggtccaagataaagaaatggagaactttgttgctgaaaaggagaagttgttacatgctcatggcacgggttatgctgcaatgaagcggatgcattag

SEQ ID NO: 64246 - DNA, 408 bp, Glycine max
  Peptide Sequence Number=SeqID_181024
atgagcgatgacgatgacatcaatgatgacaacattgacaacaatgatggtagtaatgccaatggtggtagtgttgttcgtgccaattgcgatgataatgctagtgatggtgataatgacgacaatagtggtgatagtcttggcgatgatgatgttgatggtactggcaccagcggtagtattggtgatgacagcatgctagtaccaatggttgtgatgatggttcccatggtggttgtgattatgttttttagttttggtcccacaagcttaacatttccgtttctacaagcggcattcttagaaagtttcaaactttcctggaaaatatccattttcactaaccccagtaaccctgttgctagtttcagcttcaatattgctgaaaatcgttgttgtactgattga

SEQ ID NO: 64247 - DNA, 432 bp, Glycine max
  Peptide Sequence Number=SeqID_181025
atgaggcttttgatattctgtttgcggctaaaagagccatactcgctaagccactatgcctctgattgctatgagcaaaacgtgcactccaggaacatcctccctgagaggaatgttgccctttatgtgacggagtatgatgagttccatagggagctcaagaggaggcgatggcatagggccttgaccaggcaacctgacgaacatattgatgtggccttgtttgatgctgagacgttgaatgcattcctagagatccccgtggttttggagccaggggaaagctacaccacttacaccagattctaccgcacacgtctggacccacaggagcttgcatccaagctctgcatcgctaggcgaggatttgttctaaatgcagaaggcgcaccatggaagcttcttaggaaggacctcaccactcttgcatag

SEQ ID NO: 64248 - DNA, 633 bp, Glycine max
  Peptide Sequence Number=SeqID_181026
atggcccaatccaactcctctcggcttggttttcctgcactcatcactgccttgtgcatagccagaggagtggtcccagactctctcacctttgagtccctgagccatgccattaatttggcatacatccgaaagaactgctggaacccggataatcccacaatcacatttccaaggacccacaaagctaaggcttggggaccttcaaatgcttccacttcagctccttcttcttatgctccccccagctccagcagctccaccaccatctacaccagtcttagaaccctccggcccttccgctcagagcacagagattttagtgccaatgctgcagagccttcaccatggcttatgcctggtgaggctcttatagcccaggagtcacaaccagagccggaggctacgcccgaggtcacaccagaggagactccagagattgcccctgctgccacaccatctgaggcacctgaggagggagacggcgctgcagacatagattatgttgcagacatggcagcagcgcagagctcctgggacccctggcccactccagcactagacacacccgtgctagcccaggataccccctccgtacctcaggatgatcatacactggcgcaagatgattga

SEQ ID NO: 64249 - DNA, 201 bp, Glycine max
  Peptide Sequence Number=SeqID_181027
atggctaagtctcagcttgcctgggtgagctgcagggggctgagtaaagggttccaaggttcagcattgaaggacattgagagaattgagagagaagaagaagaaagaagagaaaatgaagccgaggcgctactgaatcacgaccgtgatcgacccctacattgttccttgttcagtgttcttcgtgtggccgtcgattag

SEQ ID NO: 64250 - DNA, 1175 bp, Glycine max
  Peptide Sequence Number=SeqID_181028
atgtggcatcacctgatcggcgaccactcgaccctggcggtgatgcaggaggagatcaacctgatcctggccgggcgcggggacgaactggccaaggcaccgccgttccgcaacgcggtggcgcaggcaaggctcggcgtcagcaaggcagaacacgaacggttcttccgcactatgctggcggatatcgatgaaccgtcgctgccgttcggcctgagcgacgtgcatggcgaagggcgggatatctcgacggcgcacctggccttaccgcctgcgctcaaccaacagctgcggcggcaggcgcggcggctgggcgtcagcctggccagcctgtgccacctggcctgggcgcaggtgttggcgcgcgctaccggccgcgatgaggtggtattcggcaccgtattgttgggccgcatgcaggccggagacggggcggaacgggcgctcggattgtttatcaatacgttgccgctgcggctggatgtcaacgaggtcggcgcggaatcggcggtgttgcaggcgcacatccggctgagcgggctgttggcccatgagcatgcgccgctggcgttggcgcagcgctgcagcggcgtcgccgcgggcacgccgctgttcagtgccctgctgaactaccggcataacagtggcgaggacaccgcattgccgaccggcgtgacgctgctcgatagccaggaacgcaccaactatccgttcgtgctgtcagtcgaggacggcggtgattcgctgggcctgacggcgcaggtcaggcagccgattgaagcgcagcgcgtgtgtggctatatggcgcaggcgttgagcgcattggcgcaggcattggagcaggcgcctcagacaccggtctgtgaactggaggtgatgccggatgaagagtatgcgctgcagctgtgccgctggaatcatacggcggaagcttacccggcggatacctgcgtgcacgaactgtttgaacagcaggcgcggctgacgccgcaggccatcgctttgatccaggatgcgcaacggctcagctacgcacagttgaatgcgcgcgccaaccggttggcgcatcggctgattgagcgcggcgtacaaccgggcgaccgggtcgcggtgcggctggcgcgcagcatcgaactggtctgcgcccaattggcggtaatcaaggccggggcggc

SEQ ID NO: 64251 - DNA, 294 bp, Glycine max
  Peptide Sequence Number=SeqID_181029
atgagtgcctcgtactctacctgtttgtttgaggctttgaagttgagcttgagggcttgctctagagtgatattgttagggctttcgaggatgatccctgccccgcttccttttacgttggacgcaccgtcaacggttgcgtgcttcatactaaatgtcgaactctggcagttcgacaaactagtctaccatccttcctacaagttcaggctttctcaaaacctgcttgatagggtagttcatcttgactaccacttgatgactctggaagtaggacctaagtcgtcgcgctaa

SEQ ID NO: 64252 - DNA, 414 bp, Glycine max
  Peptide Sequence Number=SeqID_181030
atgggtgcaagggatatgacattcatgcacaaggctggccatgaggtgaagaaggagtatcctgggctggttgaggtgtctccaatgtgctgtaggccagggatcccaggaggaagtggtggtgctgaagtagaaggggctggagctggagaaggagcaagtgcaaaggaagcaggagcaggaagagcagctgaagatggaccctcagatcctcaagctcgtgccttgcgggtccctggaaatttgatcgtgggatcgtccaggttccaacagttcttctttatgtatgccaaattaatggcaaggttgagggactcgaaggttagagaatctgacactactccttgggccacgcagagtgcggaaatgagggctggaaagttgagcctcgaggagttggactgggccatctga

SEQ ID NO: 64253 - DNA, 99 bp, Glycine max
  Peptide Sequence Number=SeqID_181031
atggcatgggtgacaagagatcctctagggttcatcagtgaatttactgctcagacaaataaattcatccttatcaccatctgcttcaagaggaaatag

SEQ ID NO: 64254 - DNA, 255 bp, Glycine max
  Peptide Sequence Number=SeqID_181032
atgattgttgaaagtatcaagagagaattggaacgatgtgaagcagaaaagaaggcactggaaaaaaggagactgcttgcaaggaattactggctagagcataggatgagtctaccaagatatctgaaactatcacaaatgctaaatctaaattcgaatagatgtacgtcttccatggtggcatcaacgaatgattctaccagaaaatgcagaagaactgtcacttgcagacatggagaaatcaaagcccactag

SEQ ID NO: 64255 - DNA, 270 bp, Glycine max
  Peptide Sequence Number=SeqID_181033
atgtctcctccacctctaggacctcacaatcactcacactcatctcaagctctcgggacggcttcctcttccagctctggtctctgcatatcttcacacacaaattctctcaaacactctggaacttggacctttctctctctagaaaaccatcacatgcaaaagctccttgggaaaaatagccaaacttccttctcaaaatctgatttcaggcttaaatatgtggctttgttcgtgctcgtgcgcttagcgcaattcttaaccgcttag

SEQ ID NO: 64256 - DNA, 336 bp, Glycine max
  Peptide Sequence Number=SeqID_181034
atggggggaaagaggaagaagagcaatgatgatgatgatgtggaagcaaaagctttagaacaaggagaagcgattagagctacaagcaaaactaaagcaccagaagaagctcgagaagtatgccaaggccaaggcttgagacactgctctcaagagagctctcaagtttggggtgcctccccacacctgccttcttctttgttgatgctagcactaaacgatgtcgttgtggctacggtatttctagggattccatgcataagaggcgtgccactagtggtaagaagaaggcttggagaaagagaaagtaatgccactttcttagcactattttga

SEQ ID NO: 64257 - DNA, 168 bp, Glycine max
  Peptide Sequence Number=SeqID_181035
atggcaattccggtggtggagcatgacagtgatgagaagatcacacggtggggtaatgggattagagttaaggttaaaagaaaggaaaaaatggtcattttccaagatttcatacaatcattcgcccaggctagcaaccagctcacctgggctaatcaagttttttag

SEQ ID NO: 64258 - DNA, 660 bp, Glycine max
  Peptide Sequence Number=SeqID_181036
atgggcttcaaccttacatggagaaaatggatcaaggcttgtttgcaatctgccacaatatcaatcctagtaaatgccagccctacaaaggaatttgttcccactagaggtttgagacaaggggatcctttagcccccttgctctttaatatagtggctgaaggtttgacaggaatgatgtgggtagcaacagccaagaacctgtacagaagtttcatggtagggaagcataagacataccttcgatggaagcgcagacacgaactccacaaacgcgaactcgacaatgtggttgcagtcacagaagcgcaacccggtttgcgacaaacacgaactcagacagaaggagaaacaataataacgccctgggagtaccctttccgggactctttcgtttcctacttttcttcgacctgcgaaagtgagcaaatgttaaaactacgaacgcctaatgttaaaacaaaaggatgtacctcaatggataagtggcaaagacgatctccacagtgtggttgcagtcatggaagcgcaggccagtttgacacaaagacgatctcaggcagaagaagaaagaagaagaacgatagggttcaagcgcgcgggttgtgcaatttcagaagtttactatctcatgataacaacatcggttttttaaaataa

SEQ ID NO: 64259 - DNA, 669 bp, Glycine max
  Peptide Sequence Number=SeqID_181037
atgattttgtattgcacacagagcacaaaatccagcaacgaggcctacaatgattgtaaaatacatatactcaacgccaacgatccccgaacccaccacgttcacccacacgccaatgagcaccaatcccatgagtgtcgctgccacaagaatcaccaccaccactccatcatccaccctggtgccgaacaccaccatagactcgtcgtggaagaagtagaggaagaaccatgccaccaagtacacgatgatcgagactgggtgctagagaaggctcgggaacaaaaccatgatgaagtagttcacgcaaaagtggttgaggttgcttctcacatgcatcatcgtttcttccatcgagtaagggtgcgtgaaggagtggagcgcgaacacctcttccaatggtcagcgcgtggcgaaagaagaacacgtggatgtcgcggcgcgtgtgaccaaataggagtattttatcagtcacatagatggacatgctttagatactctgcaagcgagaaggaacaagtaatgaaatgcttagaagcagctatagaatgtcagggggttaggctagaattgtgtgcagacaacagagttggattgctctctgacataaacccaagttctccaagagaacaacctcgtcatcgttcgagcagacatcgaaacacatag

SEQ ID NO: 64260 - DNA, 738 bp, Glycine max
  Peptide Sequence Number=SeqID_181038
atgctctcgccttcagagggctacacgccctcgccttcagaggactactggtcctcgccttcagagggctacacgtcctcccctttagaggactacacgtcctttccttcagagggctacacgccctcgccttcagaggattacacgtcttcgccttcaaagggctacacgtcctcctctttagaggactacacgtcctctccttcagagggctacacgccctcgccttcagaggactacacgtcctcgccttctgagggttgcacgttctcaccttgggtactagtaccctcaccttcagagggctacacgtcctcaccttcagagggctgcaagccctcgcctttagagggctacacgccctcacctttagagggctacacgccctcgccttttggagggctggacgttctcaccttgggtactagtaccctcaccttaagagggctacacgccctcgccttccgaggactacacgtccttgcctttagagggctgcatgccctcgcctttaaagaactacacgccctcgccttcagagggctacacatcctcaccttcagagggctacaagccctcgtctttagaggactacattcctcgccttcagagaactacacgccctcgccttcagaggactacacgtcctcgccttcaaagggctgcacgtcttcactttcagagggctccacatctgcccctttagagaactcaaggtcttctgcccttaatgcttaa

SEQ ID NO: 64261 - DNA, 135 bp, Glycine max
  Peptide Sequence Number=SeqID_181039
atggggtttgctggtggtagtggtagcaaacccactactttcctaacacagataacttgttacaagtgttacagaaggggcatattcagagagattgcccatatccctagaaggagcaaaatggtgggggtctga

SEQ ID NO: 64262 - DNA, 594 bp, Glycine max
  Peptide Sequence Number=SeqID_181040
atgtcctcaacgagccaaggcacggtggtggaacacgtcgtcctcgtgaaggtaaaagacgacacggaaccgaccaaggtcaacgcgatggtcaacgccatgaactctttggctaccatcgacggcgtcaagcacctcacggtgggcccactcctccgcaacgggcccaccaccaccacctcgggtctccgtttcacgcacatgctccacaaccgctacaactccaaggaagcccttgagggattcctttttcctgtctgcgatgaccttatggtcgtcgattgggtcgcgggaggagtgaaccttccgccgctagcgaaaggttcggccctccgcgtgagctttttaaagctgaaggagagcatctatgaggaggttaaggacgaggctttgagtgttgtacgaggaatggagcacggtgtcgcaggagttctttggcaattctcctacgacgagaacttctcgccggagagagccaagggcttcacgctcgcttcgctcgcggtttttcctgagcgggaggagttacagagtgtggagttggacgaggggttgggggtggttgtggaggatgtggtggttgttgactatgtg

SEQ ID NO: 64263 - DNA, 1011 bp, Glycine max
  Peptide Sequence Number=SeqID_181041
atggagaaaatattcaaggtgtacgtatacccagacggtgacctaccaatcgctcacgatggcccgtgcaaggacatatactccattgaagggaggttcctccatgagatggaacacggtgctggaaggtttaggaccaacgaccccaacgctgctcacgttttcttcttgccattcagtgtcacttggatggtcaagtacctttatactccactctcattcaacgtcacccctttaaagaagtttgtctctgactatgtaagagtcgtttctacaaggcaccccttctggaatataactcatggtgccgaccacttcatgcttgcctgtcatgattggggtcctcatgcatcacagggcaaccccttcctctacaacacctcaatccgtgtcttgtgcaacgccaacacttcagagggcttcaaccctcgaaaagacgtatccttaccagaaatccacctctacggaggtgaagtgtcccccaagctcctctcaccaccaccggacactgccccccgccgctacctcgccttcttctccggtggtttgcatggtccaatccgccccgccctcctcggccactggaaaaaccacgacgaaaacgacgtcattcgtgtctacgagtacctccccaaagacctagactattactccttcatgctcacctccaagttctgtctctgtccaagtgggcacgaagtggctagccccagaatcgtggaggcaatctacgccgaatgcgtgcccgtgatcctgtctgagtactatgtgttgcccttcagtgatgtgctgcaatgggaggcattttcagtgcaggtggatgtttcggatattcctaggttgaaagagattcttagtgcaatttcggaagataagtataggaagctcaaggaaggagtgaaggctgtgaggagacattttacactgaatcgccctgccaagagatttgatgtatttcacatgatcttgcactctatatggttaaggagactaaacatagaactcagatag

SEQ ID NO: 64264 - DNA, 429 bp, Glycine max
  Peptide Sequence Number=SeqID_181042
atggagattccacgtaaatatctcctctctccaattttgtcgctgattctactttcgttcatcatcgtcgtggtgctgcgtccatgtcagttactcgaattcgcgccaattattgccggttcaaaacctgcgtattccgttcctctggatagtctccgaacgaagctctccagtgagaatcaactccacgccgtcggaaactccggcgaacttcgccggaacaagttccgcaaccgaacagctaccaggaaggtaggaaaactcgaacaaagactcgcggcagcgagagctgcgatgcggaaggttgcgtcggaatcagaaggtgagagaagcaatcttagtgtggcaaccaccgcgcgtgatgacagctaccaccgctacgttcccgccggagctatctatcgtaacgcccgcttgttttatcggtaa

SEQ ID NO: 64265 - DNA, 258 bp, Glycine max
  Peptide Sequence Number=SeqID_181043
atggaaagcaaggccagttgtgaaaaggaaaggccttggtcttatgaggaagacaaaattcctatgaaatatgttcaagtccatggagaaagaaattggagaaatcttttcgaaagagctagtttgaaacgatgtggtgaaagttgcaaacacccatggttaaactatcttaagccaactactacccacaacccacagaggaaacatttctttagaagaagagctcataatcaaacttcaccagctcttggagaatag

SEQ ID NO: 64266 - DNA, 363 bp, Glycine max
  Peptide Sequence Number=SeqID_181044
atgtttcagtgttttgttctcgtggtcattgtgactcaaccaaaccctctgggacttcaaggaacctctcgaggcaaaccctatgtgacttcaatccttcacaacagtgcatttgaatccctccacgacttgaaatcctccatggcagcacttatgaattcctccacaatggtgcttcaagtgaaggctttaacaaagatcgtggggctagacatggtgcttaacgcgagggaggtgttggttgggctatacagcaagacgctgaaggagttccggaaggttctcaaagacgaagggtaccataatgccatggagagcttcaccaagcacagactcagcgtgtgcaaggaggaggaggactag

SEQ ID NO: 64267 - DNA, 306 bp, Glycine max
  Peptide Sequence Number=SeqID_181045
atggaagaggaaggagttgttatactgaacaaaaactgtgaagaggtaaccctcggtgagatcgaaagggatgccaccgacaaagacataagcgaaatccttgcacttgaagatccatggcagcgtctgctccaccctgcggaagtgctcattgttagaggagaagtcaaaggtccagtcagggaagtaagggaaggaagggttgtgggattggaagagagggttgatgccgcaatcagagtggtgacaaagggaggaagcgacggtggcgatggccatgctagggaactggttgtcatctggtga

SEQ ID NO: 64268 - DNA, 1043 bp, Glycine max
  Peptide Sequence Number=SeqID_181046
atgaagaacgcaatggacttagaagatcatgagcatgatctcactctcgcactcaggtgtggtagtccagagagaaccacacactcttcttccccttcccttcctcaaataaacatctccttgatggaactgcaaatgccttaccctaattatttggtgccattttctaaccacaacatcgaccctttattagtgtcatgttctaaactcaacattaacccttcattggtgtcatcttccaacaataacaccgatcaccctttgttggcgatgtcaccttccaaccctgcaggtgctgctgctcctacacccgttttgagacgtcgccctcgtcgtgcctcgtctcaacgccggcgccggagccaaggaaagagcgaaaccatccctgcaccttttccttgggcgacggatcgccgggccaccgtccacaaccgcgaatatctattgcaaaacaatgttatcgccatcaccggaagggttcagtgcgggaggtgcgggtatgagttcgagatgacgcttgatctggaggagaaagtgaacgagttgagcaaattcattcggaaaaaaagaaggtccatgcatgatcgagccccggcggcgtgggtgaatccggtgatgctcaaatgtgtgtattgcggacgagaaaattgcaccaaaccaacccttttgtacactaagaaaagggaaattaattggttgttcttgttgctgggacaaatgttgggtttctgcacaattgagcaactcagatatttctgcaagcacaccaataaccatcgaactggtgccaaagatcgccttctttatgctgcctacatgaccctcagcaaacagcttgttcccgagtgttttgagggtctttctacatcgattttgatacgtggtggtaacatagcgggagtcgttgaaaattctaggtcccacaacatcggttcattgaccgtcttagaagggcatggctacaaagacggacatcgttccagatccgacttagaatcaggagggttctacatcggttatgatagtataactgatgtagaatg

SEQ ID NO: 64269 - DNA, 606 bp, Glycine max
  Peptide Sequence Number=SeqID_181047
atgttgaatctagagtttgaggtgaaagatcttggaagggctaagaagatccttggcatagaaattaccaagaataggaataaaaaggagcaagaaccaaagtctgatgaagaagtaacctatatgctaaaagtgtcatacataagtgcaattggaagtattatgtactccatggtttgttgcaagccaaatctgtcatattctatgagtgtggtgagaaaatttatggccaatctaggcaagaggcattggaaagctactaaatgggttctgaaatacatatctagaacaactgatgttagattgaaatatgttaatcatggtgaagttcctatgattgaaaggtatgttgattctgattttgctagaagcatcaactctagaaagtcaattgttggctatgtcttcaaggtttttcaaaacataggtagttggcatgctaatttacagtcagtagtggctttctccactactgaggcaaaatatatgtcagctagtaaagttgtaaaagaaccattgtggttgaaaggcttggttttagaatgtaatgacccgcctcgtcgctacgatatcaccactctaaatcgcaagaatttcaatttttaa

SEQ ID NO: 64270 - DNA, 308 bp, Glycine max
  Peptide Sequence Number=SeqID_181048
atggtttatccaagtggtactagacacgaatcccttaagcatgtagtaaagggtttgaatcctgacgaatgcatatatggagaaaatcttgttgagagggagatcccacttatgagtgccaacagaatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcag

SEQ ID NO: 64271 - DNA, 306 bp, Glycine max
  Peptide Sequence Number=SeqID_181049
atggagaagatacgcatccagagagtgtgtgtgaaaagagagattgtgaaacaaaatttggagaaagatgaggtttcaaaaaacaaggcaaaacaaacagacataaacgaggttcaagaagcattaaaaacaagttctaagaagactacttcggtaaaaaagaaagagacagtagcgggagagagttcaacatctacaacgaagaaaagaaaaactttactaattagagcttctaatgacattaatgtcattatggagctgcgtaagaaacggcgtacgacaaataaaagctctcgaactaattaa

SEQ ID NO: 64272 - DNA, 177 bp, Glycine max
  Peptide Sequence Number=SeqID_181050
atggaggggcgaggatgttgtgagatgtatgtagcttccatgcgcaagtctttcaaggactccttgaaagtccttgaagctgatatccaacacgccaataccctggtgatcactgttgctaaaggttggtggcctgtcaatggctcttacccttcttccctttttatttttttatga

SEQ ID NO: 64273 - DNA, 378 bp, Glycine max
  Peptide Sequence Number=SeqID_181051
atggctcgtggcggtcaccggtggtcagtggtggtggaggaggagcttggggtgttggaggaggatttaggggaagaggaggaggaagaagatggatggtgttacataaaactactccaagtgaaagagttggaaaccacaacagttcattgtaatagtcaaagtgtggtaagtttgagcaagaaccaagtgcatcaagacagaacaaagcatgtgggtgttaagtatcacttcatcaaagatgtgatcaaaggtggagttgtagctattaagaagatagcaacatgggagaacattgcagacatgctcacaaaggctttactctctaaaaagttcaattattgtttacaattgctaagtgttatcagtttaaagtaa

SEQ ID NO: 64274 - DNA, 387 bp, Glycine max
  Peptide Sequence Number=SeqID_181052
atgtgtggtaagactcggcaggatagaattagaaacgaagctattagagagagggttggagtagcgcctattgtagagaagatgatggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaacttaatgatttggatagaagtatgtgtcatcaggaggaacaagcttattttaccttttactttataggtttactcttgtcgagccttcacaggctttacccaatacttctctctcaaacaaactcagcccaccttgttagtttgagataa

SEQ ID NO: 64275 - DNA, 324 bp, Glycine max
  Peptide Sequence Number=SeqID_181053
atggggtgtacccatgggcccgaaatctaccctaaggctcataagaaccctagggccttctcttgcatatctggcccaatctacttggagttttctatccaatgcccttgcggggtaggattgcatcaccagcacaccagtgtgaaagctcaacttaagaaactagaggttgatatgcctgagttattcctggaactagaaaggcttgtaatggagatgggtaagagtgcattgctgacaactgcttgtgggaataacaaagctactaagtctcaagctaatcagaaagggaatgatagaataccacctcaagctgatatttag

SEQ ID NO: 64276 - DNA, 213 bp, Glycine max
  Peptide Sequence Number=SeqID_181054
atgcggtttttacgaagaagctatctagctggcactgtcgcaagaggtgaaatagaggttttcgagataggtaaccgcatgcaacacacagcaagagcattgaacattggtgaggttgtcgcgatactgaaagagactattgacggcatcgaaggaggtagggacgatgaagttgttgtggttgacaaaggcgacgaaggagatgaggagtga

SEQ ID NO: 64277 - DNA, 1038 bp, Glycine max
  Peptide Sequence Number=SeqID_181055
gatatttttgtagattacaagcagccatttgcagtgacgtatcttggagcttctcttatggtagtttacctcccagtagcattcattaaggactggttgtgtaagttatttgaacaccgctcttctagaagtggaaaaagtgcaaaagttggggatgagttttctgtcaggtgtacctctcctctgaagggcaatggagtgcaaaaaaacattgaagtagaattggggggcatgactcgaaaagatagtgatgcaaacctttcagcacatgaagaagtaaagccattgatggctaaatataatgatgctactgctataaaggtcgagaaagaacatactacaagggaaattgctacttatggattttacattgcacctatctggtttataacagagtatctatcaaatgctgcccttgcgcgaacaagtgttgcaagtacaacagtattatcatctacttcaggactcttcactctcttcattggtgtgcttatgggccaagacactttaaatgtatcaaaagtagttgctgtcttggtcagcatagccggggttgtgatgacaactctggggaaaacatgggctgcagatgacgcgatatcaagtgcttccaatggacaacgctctcttgttggagatctttttggccttctctctgccatgtcatatggtctatttacagtgcttctcaaaaaaatttctggtgaagaaggagaacgagttgatgtgcaaaagttgtttggatatgttggattgtttacacttgtagcactatggtggcttatttggccattgtcagccttaggaattgaaccgaagtttacaattccccattcagccagagtggacgaagtggttcttgccaacggatttgttggtagtgttctctcagactacttctgggcactttgtgttgtatggacaactccccttgtggccactttgggcatgtcacttaccattcctcttgctatgatggctgacatggtgatccatggtcggcattattcggcattgtacattcttggctcaatccag

SEQ ID NO: 64278 - DNA, 339 bp, Glycine max
  Peptide Sequence Number=SeqID_181056
atggtggaaccatcaaaaaagcgcaagggttcttcgagtcgaagccaacggcactccgaggctcaggaaacacagattccctcctccatttcctcttccttgttgttctcatcagaagaacaacagatacggtacacaaaccttttctcctctcgttccattaccaatcctaagtttatagacatggatttcttttccaatgagaattttgaatgcattcaggcatttgagaactcaaatctcattccttttatgtctttgaaattgcctgtttattcggaattagttaaatttttttattctaacctcgaaattcaagaaagcactttgatttctgag

SEQ ID NO: 64279 - DNA, 261 bp, Glycine max
  Peptide Sequence Number=SeqID_181057
atgggattacttttagccaaatgtgggacttggattatttccaacacaccccctcatgacaagcacttcctgggcttggggcgtgaacaacaaatggtgggtgtttgtcaccacaaagcgaggactagcgaaagcgtggtcccaggatcagaattggctctgataccataccccacatattacttggcaaaccagaacttacaagcatatcattcaccatatcaagcaagatgtgtattctccacctctatcagaacgtaa

SEQ ID NO: 64280 - DNA, 321 bp, Glycine max
  Peptide Sequence Number=SeqID_181058
atgctctcagctcaagcagcgaatatgacaataaacacgaaagctcaagcgtcaaagatgatggacacgacagctaaagcggcgatgatgatgaacaaatattattcaagtgcatggtggcacttggatacggctttgcgcatcatgatgcagaggcgtgtgaccatgcaatccttttcgtcaacgatgccattgaggtctggtgaagggatgttgatgatgcggcaaagggagggtgtgaggactgagttaagaatctgcatatcagtgcgtgaggtttgggaagtaacggcaaggatggtgactttgaagctgtggtga

SEQ ID NO: 64281 - DNA, 212 bp, Glycine max
  Peptide Sequence Number=SeqID_181059
gttgtagcctcccaggctggccaggagtaacaaaatatgtaggattggtatgtgctcagcctcatcgtgaggaactcaatcaagacctttttaaatgttggaaggatcctcatcatggtataatttatggtggcatgatcaggaatgaaaactcaagcatgtctgaggaccagacatcggaccatgtcatggaaaccttggttgtagtttga

SEQ ID NO: 64282 - DNA, 2694 bp, Glycine max
  Peptide Sequence Number=SeqID_181060
atggagagggaggccaataaggagcttgaaaaggagttgataatgtacaagaaggaggctatggagcagcatgaaaagggttttcaaaaggccgttaggcaggctgggttctttgccaaggaccttatttgggtcttttcgatcgttccaaggactatgaataggccgttgtggcaagagtggaattttttatggcgtaggaagaaaaaccttggtgatgtaggaagtaaggccttggtgatgtcttgtcattcatgcaatgatgcttcctcttcgctttgtggagcttctcctttgatagtatgcatgactttcaccctgattgaaggtcttactgaccattctgatggtagtttatcttatggaaccttgacctttgactatggtgttgtggttcttgagggggtgaaccttgggtttaacgagccttggaccagggatgtgtttgctctgagttttgataagcctgtaaagctgcatcgaggcttgccaaggacggaccttgggttttgcgaacctgtgaaagtcttggatttgacgagcctttggagaatcaatcagctacacgtccatcctggattttggagacactcaccaagggtggaccttaggtttgacgagcttggtgtgtccagtgcacgtgatatgctcttgcaaacgtgtcacttcttggagtggcacatactggagacatggtgcctaagccctggcacatactggagactcgaccaaggaattgtctgtcttgggttttggagagactcactaaggacgtgggtccctactcttgcatacatgtcacgcgtggagtggtatgtactggagacgtggggatgtgctcttacatacatgtcacccatggagtggcacatactggagaagtcgggtcgtgttcttgcatacgtgtcacccgtggagtggcatgtactggagccgcgtggttgtgctcttgcatacatggtggaccttgggtttgataagcctacagcgcatgtgtcatgctcttacatacagggtcgtgctcttacatacgtgtcacctgtggagtggcacacactagagatgtggggtcgtgctcttgcatacgtgttactcgtggagtggcacatactggagacgtgggctcatcctcttgcacttgggtcacttatggagtggcatgtactaaagactcgaccagggaattttccatcctacgttttggcgagactcaccaagagtgaacccttggatgactgtgttggttgcctatgcctgaccattagtctggggatgttcgatagaggtgaaaaagagggcatacctacatatgaggtgtttctaggtgaacttctccaccttgttggttgtgatttcttagagtggtctttccttaatccacttggtgaagtagtcgataggccacaagaagatcaaactatagagattgtcaggaggggtgcttggaatgtctacaaactcttggcatcatctgcatctctttgtgaaatcaagggtgctatccctgagtgtcggctagtagtagctgatgcgcaccacattggttgcgagagagtgtcccccgggggtcatctagccacgttcctcctattctctagtcataaattcttcggtgtctatggtaggagtttggagcatctcatggattatagtgttgaggattatttccttggtctggtatctggttgcaacctgcccttggataagctacaagatgattcctgccccactccccttcatgttggacgtgccgtcaatgtagaggcttcaccagtctgggtggtttggtcattcctagagaatttttccaggaagtctaccatgacctgtgtcttcatagggtcgtggggttcatattggatatcaaactctggaaagttctacggagggtactcttggcctggatcgactcaaaattggcggtgtggcaatggtcttcttgaaggccgacaaggcttgttcgcaagtctcatcccaaaggaatgggtcagttttcttgagaaatttgtagaacggcttcgctttttcaacgagcttggggataaacctagacagggatgctattcttccattcagcttttggagtttcaggacgttagtaggactgcgcatctccaaaataattgtgcatttgtcaaggcatctaagaagcttaacacttggaatctagacactccatcaacttgtctgtcgatgatgggaaaaggttattctctgaccgctttgcgttgttcttctcccatcttcctcttcttctgtgatatcagctatgcgtttatgctcatggctattgaggtccctactaagctgcatgagttgtccggacctttcgtctatgcttatgacatgagtggtactatccactatgggacaaaggctccctgtgtgaggatagggtgccactttcaggctttcctcttaacactgttgtgcctgcttttgatctgccttgatagtcacaatttctcctgccaagatatcaatggagctactttggtcgataagtaccttagacactatgaagttggcaattatgatggagacaaccatggggtcgtcctagttgacgaggttaataccttgaagtctctatcagtgaaagttatagcgagtagacttcatggtgatggagaatccactcgcgatggagttgattacttctctgatttgctaggcaggctcctattcttatga

SEQ ID NO: 64283 - DNA, 567 bp, Glycine max
  Peptide Sequence Number=SeqID_181061
atgtcacgctctagacgttggatcgacattaaccccgaactggaacacctcctggcgaatgcacccattaatcatgatactgcggctccacccgatgctattttcgtcaccgttagcgtcagagaccaggacatgctggaaggtttatggcatttggttgatagagatggtacttatcataccgttgtctacaaccgcgatctggaccaactagccattgtggctgggtggacagcactacgccatttttaccacctaaccgcaaatcatctcgtttcgttgaatcattttggtaagagtgtattttttattaaaattttgagggttccttgcctgccaaagtcattccctaagtggcactctttgtatcatcaagtgtcaggttctgtgaccttcaaggtttttcttactgagcagaaaatttcctgcagcaatctacataatgatgcaatcctccctaggaagggaccaatcactagagccatgagatggaggctccaagaggattgggctagagctgttgaagaaggccttaggattctcatgaacctcagggtagattgctga

SEQ ID NO: 64284 - DNA, 315 bp, Glycine max
  Peptide Sequence Number=SeqID_181062
atgaagaaaagcactaatggcactcttgtgaagacaaaaactaagcatgctaatgaggctaaagctgaggcttccattcgctgttcaagcaggctgacaaactgtgaagttaactcaaaggaggaaaaaacaaacgctggaaattctaaccaaaggacttctttgacatccatcactagccctaccttgcttgcatcaggtgttgctctgttgtccaaactagagcttattcatgattcattcggattttggttaacatgcatgtatataggattgtgggatggtcttttcacgttgtctgtaaaactgaagtaa

SEQ ID NO: 64285 - DNA, 114 bp, Glycine max
  Peptide Sequence Number=SeqID_181063
atggttgctagcggtggcatcggggttgttcacggtggtagcatggtcatccatggtgaggaagcattcctccataacaaccttggtcaaggttggtcgaaagcagcattgtag

SEQ ID NO: 64286 - DNA, 276 bp, Glycine max
  Peptide Sequence Number=SeqID_181064
atgacgacttccctaaccggaacaactcctccgacagtgacgagtctttcaattttcgttgggttgagccaccatgaagaaaccctttgggggggttcagtaggagaaagagggacaaaagagggttttttgattcacggtcacacgctgatgaatctgacaacttggtttcaaataagagctttgtgttgtctaaagggtggagattcagctacaatgaccgtgggtttgagcgagagagaagggttgttgggttcagctccaatgacggggtag

SEQ ID NO: 64287 - DNA, 402 bp, Glycine max
  Peptide Sequence Number=SeqID_181065
atgacaagaacaaaaagtgagaaaaagataatcagtgtgattgtcgatatcttacgagtatattcccaaggtcctcgtaaggagtttgccaacctaatgttagaagaggaaaaagaagtagaagctttgataaatgccaaggactttagatttttaggtttcattgtaggcaaagaaaaggatttgatgatttttggaaaaatagcatttggaagatcaagccacacctatggaagcaagttttcaaggtcaattttcacttatttttcttcggccatcttaaggctaagccttgaaaagttgaagcttagcctgaaagcatcaaaaagctcctttgttgctgtcagtctaaggctatgtgtggaaaactcgaggctaagtgataaaccactttttgagtga

SEQ ID NO: 64288 - DNA, 333 bp, Glycine max
  Peptide Sequence Number=SeqID_181066
atgaagaagatcccaggcctacaagctccaatggagcttacaccacataaatttttaatataccatttctttatttgtcaggacgttccaagtacaatgtattattttttgaaagacaaaggatggtataatttgcacttgggaaatgtagcagaatgtcagttggtgttcaatcatcataggaagtcactcaaaactggagccggatggaaacaattctgccagatcttgtctttggatgctgggatggaaatagtgttcgagttcattaatccctgtgttaaccgcattctgtactggctctgctctattgatgaaatgtgttacgattaa

SEQ ID NO: 64289 - DNA, 360 bp, Glycine max
  Peptide Sequence Number=SeqID_181067
atgcaaggttctacatttcgcgataggggaaactggagcgttcttcctcattacaacctgttaccctaccctcaacagatcccaacaaggctttctggaaattccacactagataatttcggatgccacaaaatatacagacagagcaaaattgatctagaggaaagagtgaacggtagttgcagatctgcccccgtagcaccaccaaccagggctttctttcatcctctgcttcaattgctaaatcacgacctctactggggtaaggtaaagcgaaaagggagggcgacgaagacaatggggccgaagcttacaccagagggctctgctagggtatgcgagggtaagcttcaatcgtga

SEQ ID NO: 64290 - DNA, 270 bp, Glycine max
  Peptide Sequence Number=SeqID_181068
atggaggacaaaatcatgtgggttggaggagaagacatcacgcctaaatacctaggtggggatatagtgttattgatgcggctgactgacacaagagctaaagaaatatgcagggaaagtgctgtgaatggaatgacactattctactcgctggaaaaacgacatccaaaaaatattaagaagattgtgtccgaggtaggggaaatagttgaggtggacgaagaggttattgatcttcgaagactggacaaggctcgggtgctgatctaa

SEQ ID NO: 64291 - DNA, 318 bp, Glycine max
  Peptide Sequence Number=SeqID_181069
atggcactgtttggacttgttcagattgtaatgtcattcataccggatctccataacatggcatgggtttcagttgttgcggtacttatgtcctttacatactcatttattggactaggactaggcatagcaacagtcataatcttccaagcacttggtgacattgcctttgcctatccgtactccattctccttcttgagatccaggacactttacagtctcctccaccagaaaatcaaaccatgcaatcttctacctgtgctgtggatgctttggatatgcagcttttgaaaatgatacaccaagaaacctcttga

SEQ ID NO: 64292 - DNA, 324 bp, Glycine max
  Peptide Sequence Number=SeqID_181070
atgggtcaaaaccgttataaaatatcctacataaccgacgtagaaaactgcttttgtagtagtgattgcatattgcgcattgaagcgcttgacaagagtgtcaaagctattgatagaccttggagaaagtcaactatatcaggcactcaggcaatgtgtgagtggagtattggtcgccctaaggtcgtctcacatgagcctttagctgattgtgtgtttgacatggctgctggaagtggattgaagctttcaaaagaggtcttgcatttgagtctaaaccgggtgctaaccatgggtgaaagagagatatcgagagatcgtgag

SEQ ID NO: 64293 - DNA, 327 bp, Glycine max
  Peptide Sequence Number=SeqID_181071
atgtcgggcactgggacagtatctttagtcactctgcgacagcctacttctaccaatgccagtgtaactttcaagggacaattccaaatactatgcttgtctgcttcttacttggttgccgaagatggtggacccttgaatagaactggtggcattagtgttttactctctagccctgatggtcatgttattggtggtggtgttgttgtgcttattgctggaagcccagtgcaagtgatgttgtgcaattttgattactgtgactcaaagaccaagtctaaacaagcaaccactctcaaagatgaaagttcagagcaacctccttag

SEQ ID NO: 64294 - DNA, 633 bp, Glycine max
  Peptide Sequence Number=SeqID_181072
atgaaaggttttatgaagactcctcctagtaagatcttatttgctgatttgactgctaataaagatcaatctaggagaaatcaagccaatgcaatgaagagttgtgaaccagaaacggctaggaggaggagagactcacttgaccagactgttttagatgcttctgcagaagtagtcactcgaccaaatgaaccttcaaatggttcatctgaattgaagcttggaccctcaagaaattttggtgctactattgaacaaccttccaacagtacaagttctgatcttaatattgtcttagtttctcaagttgcacagccttctgatgctcctttgcagttttcaacttctttcctttcttttgctagtgtttcaaatggaaaaaatgagggtttggatgttggaatctcacgtgaggatgagatggaggaagaagctcctgagacaagtaacaacacaactgaacttagtttaggaagctttggcgggtttgcgattaactcaagccctaacccatcaatgcctaagacaaatccttttgggggttcatttaataatttagcaacaagtttatcaagctctacagttacattctctgttcctagtggagagatgtttaaaccagcatctttttaa

SEQ ID NO: 64295 - DNA, 165 bp, Glycine max
  Peptide Sequence Number=SeqID_181073
atgatcagaaaggcgacgagtgaaaaagctcacccggggataatgggtcgtcataaaactgagaaagggtcgtcgaaaagcggatgcagggcattcacgaatttgattgccaaagattggcctaaatctttcactttgcttccttattgtgctcctttaaattaa

SEQ ID NO: 64296 - DNA, 225 bp, Glycine max
  Peptide Sequence Number=SeqID_181074
atgtggtattggggggtagagggtgtgataggggctgctgcccctgggggtggtgttgtccctggtggtggttttggtactgtttcttctaccggtggatttgcaggagctggttcacgtggtggttttggagcatttagcagcaaaggaagcggtggttttggtgcttttggttcaggtggaggcagtaaaccacctgagctgttcacaaagatgcgaaagtag

SEQ ID NO: 64297 - DNA, 222 bp, Glycine max
  Peptide Sequence Number=SeqID_181075
atgatgatcatcgtcagaaaaaaggtaccatcaatagagaaagcacgttggtggtcgttggaaaataggtgtcatccttccttggagagaatgggttttgagagtccttcctcagagagagtgcattttgagggtgcgagaagaagaaaagggaaggaagagaaaatgcattctgagaggctaagaagaaaaggcaatgaaaaaaatgagtccaacaagtaa

SEQ ID NO: 64298 - DNA, 240 bp, Glycine max
  Peptide Sequence Number=SeqID_181076
atggagaacaaagagagcaagaaagcatggatggagaagaagacagagagaaggagaagacaacgcgaaggagacgaaacatacctaggtatggtggcgaaggagaagaagcagagacttgtgacgatgcttgagtgcgatgaagacgatgctcgagtgcaacgaacacgatgctcagatgcagacaaggacggtttcgctagacggagattagaagaagaagagagcgcgaaagcttag

SEQ ID NO: 64299 - DNA, 435 bp, Glycine max
  Peptide Sequence Number=SeqID_181077
atgaccaataatgatgagatatattggggacaacacacaactcaagcacagaaacgcaaacaaatacccataacaagagagagaaaagaaaccaagcagagtgggtttcattggatcgtaaccggggggcacttgtccaaattggaaatttcccgagtgattaggggtagtaaacgttggtggtttccacaatttgtgtttgtagtaagaggcttatggaggaatattaaagctggaaatgaatgcggtgacatggtgcatggacaggagcatagttgctggttcgttccctttctggaacagggctactggaaactaattcaagcactctcaaatttagaagaattttacactaggcgtatttggattttgtgcaatgtcgcgctgttttccatttccaccaccaggatatggaaagaaggctataacagatga

SEQ ID NO: 64300 - DNA, 1851 bp, Glycine max
  Peptide Sequence Number=SeqID_181078
atgggtgttcaaaaactaaatggggataatttcacacaagaggaagatcctagagtctcatctgttttgcttaggatgctcctatacaaggagtatcctaatgaagctcagtattgttatgactttggtcctgtttggaataaaatgatcaaggaaaagcagaaagaaaaaaaacataagaaagataagaaggacaaagagaagagggaaagcaaggaaaagagagagaaagaaggaagagatggaaagcataaggaaaagaaggacaaaaaagaaaaacacagagagaaaaagaaagataaggataaggacaaggacaagagcaaagatagagataaaagtaaaagcagttctgcagatgacaaagggttcccaagacaagccgagggtctcaacgcaggtaaaccccatcaaaaggaaattaagcaagatgataagaagggtatcttgtttgagaacagactcaccaaacagtatgctggtaacaatggggagaaggcaagagagaaaaatcatctggctgaagagaacaaggattcaaagttcctcctggagttggaccggaggattagggatgatgatggaggagctgacaatcaattggttcataaatttaccaatacaaaccatagaaaagatgaggggactgttaggttggtggctaaaggtccaggtggcaccaggtctgatggtaatgaaaaactcaaggatatgggtcttcatgttaagaagatggatgggcgaggaatacaggatgaggtccggccaattggaaacacaccaccagttcagaatcatgttggaaattttcatcctggagttggtggaatacccaaacttttgggaaagtattttgaaaggaatttggaagcaacagttgaaggtaaagaaaaggttaaggaaaagaaagatgaaaaaaaaaaggccaaggaaaagacagaagaaaggaaggttaaggaaaataaagatgaaggaaaggaaaaggttaaggaaaaaaaagatgataaacgaagagataaaaggaaagatagagagaaggagaagaaagggcatgggaaggacaaagacagggataaagagaagaaaaaggaggataaagctaaggagcatagtgaacttaaaacaacagagcaaaataaattaaaagaaagcaacaaagttggaattataaattcaaattctttcacacagccttttaggaacagccatgggaacgctgtcagtggagaaaatctcaagaagcggaaggacattgagtcaaatggagttccacatgtcaatgacagtttgcccaataagtttccgaaactgtcttcctctcatccattcactgaaaacggaagggtattggaaccttgccaggtttccattccaaatgcttcagataggccacgagaagccaccagtgttaaggtagaaaagaaagaaagcaagatgaatggcatcattgaaagtcagccatttgcagcttcttcaaacaagactcaaactgccaatgtgtcagctgatttggtaactgaagcatctgcaaagccccttcatccagataccaagtacctaggccaggtatattcagtacctaaggtggagcagtggtctgattttgacgatcaagagtggctatttggcagcaatgtttcacaagaaagaaaatctgtggtgaaatcttcagaggtttgggagacacctcaggggaacatctgttggtactgccagattgggggtgcagctctcaccttgtgcgtcgtagtaattcatttagacaacagagaatttgtacaggttgtggagagggggaggggagaggtacaagcttgtgcaacttgtttttctttttttgctgaaagctga

SEQ ID NO: 64301 - DNA, 222 bp, Glycine max
  Peptide Sequence Number=SeqID_181079
atggccactagccagtctctccagatagtcaaatatcaatgggttggtggaagtccagtccagcaaggaaaagagaggcattgtgggggaacaggagataaagcatggatcaaagagacagagtcactacccatgaagaggcccagagtagcacttcatgaaacttgcaatacaatagtggagaagaagtatcttgagagcaccatagctggctcattataa

SEQ ID NO: 64302 - DNA, 282 bp, Glycine max
  Peptide Sequence Number=SeqID_181080
atggcgaggcgggagccgaaccaaagagaaaagatgtcgttgtgtgtttttgatgtgcaggttaagaaatggtggaagggacgtttgaggaggttgaggtttccaattatgggaagaggaggtggacctggtggcagctttcttgttcttaacaatgatgactctccccctttgaagcccgcaagctcatcgagtgcttcacccctgactagctcctcgacatcctctacgacgcggtggtgcgccacctcgacgtccttgccgccatgcgcgccgttgtaa

SEQ ID NO: 64303 - DNA, 501 bp, Glycine max
  Peptide Sequence Number=SeqID_181081
atgggctcgaaatctaccctaaggctcacgagaaccctagggcctttccttggatctctagcccaatctacttggagtcttctagccaatgcccttgcggggataccccaaaggattacgccaacaccagaagcgaaatacatgcatgtgggttacgccaacagcactggcgagaaatacccatgcatgcatcattcacccatgcaccctaccccatgcttgccacgccacagcatgggttatgccaatatgggtggcggaatacccatgcttgtgattacgctagtccctctggcgggacaccagtatgactggcggaaacaatggaaaaagtacaaagtccatcccgctacctcgaatggcggaaccaatggaagggatcttgccagtttgactggcggaaccaagcatggatggatggcgttgatggatgatgggatgaatggcatggggtatctcactagtgggattggcgaaaccctttgggttgatttacgctaa

SEQ ID NO: 64304 - DNA, 348 bp, Glycine max
  Peptide Sequence Number=SeqID_181082
atgtggcttcatggtatttatttcgcggcgaaatcgggtcgcgtgtgcggaaacggtgtcgtaaaggcttcggagggtggggataagatgattggtgagtgtgatctcaggagggagtacctgaagccgtgggacgcggaggttttctatggtagtaacgcgtgcagagaggctctggtggagctgtgtggtgatgagtatgttcaacgcatgacgtttgagagctatttgtataagaagttggcccgtgggagagtgttggatcatgctaagcttttgatgaataccgttgggagcttggtcaggtctaaagttgttcaaacaagcatggagaatttcatactatga

SEQ ID NO: 64305 - DNA, 901 bp, Glycine max
  Peptide Sequence Number=SeqID_181083
atgccggttctcgttagggttccatcctctggttacttttggaaggatgtttgcggtggtggttgtggattagccatgactatctctgacgacaatgatgaatcaattgctactgggagtgaaataagtgatgttgcaagctgggaaactgttaatgacgatgaaatggaagtccttgaggattccagagaggtatgctacaacacttgcaagaaaccaatcaaggacagtcaatttgctgctcatgcagaactttgtaggtcattacagctcacaaaacagactatgttggagcttgatgacaacattgggaatcggaaacctcctaggaaggaaaagaaaaagttaggagcttcttccgcaaaccaagcttctgcacgtagggagcagagaaggtccgagtctctggataatattgactttgctttgtcacaatcctacttgaatagtcaagtcagagtggttccctttcccaatgaggtaacaggaaagcttttcagctccaacacttccttcgaatataaaaccgtgttctacatgtctagcgagggaaaaaatttgctccatgagggggtctgtccctacgaggatcccgccagcagcacaagcgagaaaggagtaccgccattagcagtggcgagagagctcagagggtgccgccaagcagattggcgagatagcttacgtgagcgctgtctcgctgctcccactggcgagaaggcttccactgtaggcttgcagtgtttagggttagggtttgcagttctgaaaaggctagtatttgcagttctctttctgtttcttcttgagtgtgagcttgttgtgcctgtgtttgttgtgcttccttggttcaaatttcgttcaaatttggtgcttgttgtgcttccttccttcaagtttg

SEQ ID NO: 64306 - DNA, 177 bp, Glycine max
  Peptide Sequence Number=SeqID_181084
atggatgaggagtacgatgtgatcgtgttgggcacggccaagcttctactacacgctgaggagaggcgaaacgacgcgttattgaaatcggagagctgcaagggcgacaaggtgacgctgctggcgagaatcggcgagttggacgacataattgagattgaagacacaagagattga

SEQ ID NO: 64307 - DNA, 558 bp, Glycine max
  Peptide Sequence Number=SeqID_181085
atgcatagcaaaacacttaacatgaaaggagattctcgagggtctataacaactttaagatacttcatatactccaacctaactcgaaacacactaaagcgtcaatcaccaaaatcactacaagagctagctcaagggacatcgatcttgtgtaggcatgaccaagtacacatagaggccacaaaaggtactaaggtagtcatcggagcatcctcaaacttttcccatataaaggtggtaactaagcacatcctcaaggaacacagtgatctcgtcaatgaagttgaggagttgaaaggccatgaaggatcttctgcctccttcgccagagtggtcataggaggagaaactgctgccaaggcggttgaactgcatttcctcggtgaccgcagtggagttggagttcacaacctccttgaggctggcgacccaggctctgaagttgttaacgggaaaggaagcagacgaaggggaggtatgtggggtgggaatgtgtgtggatatgttcagagatgggagcgagctgggtgtgggaagggtgagagaactatgctatga

SEQ ID NO: 64308 - DNA, 357 bp, Glycine max
  Peptide Sequence Number=SeqID_181086
atgagatgttacaattccaccccccttaaaagaagtttcgtccccaaaactttaccgaaagaccgaaaaggatattacgcatctggttcccaataccaagatgtgtgtccaattgaagctcctttcagtgacttcaaccaaaagactcctctgcacttagtgactaaatctgacaattctcgtttcatcagtgaaacctatacctcaatgtcagagcatggtgtcctatcagagcatggtgtcccaacgtcattcagcataaggttccttaaagcaattcacctagtcttctgctctcccgaacacaaagttcaagatcatcacaggatccaaacacaaacaacacacagggagtga

SEQ ID NO: 64309 - DNA, 618 bp, Glycine max
  Peptide Sequence Number=SeqID_181087
atgtcttcatttctgtctaattccaccatcggcatgggtggcagcgattttaggggttcaattcagcaaccactcatggactggaaggtcattttcattagcggtttgtcctcagaggatactcatcgtggtgcctccgatagcgaatcctcttcctcagataggttgaaagtttcatgtcgtactggtggaggcacttcaggcctgcacgggagggtgtggccttccactgcatccccagccaaggagcttatcctggtcaccgtgatttccccccttttgcttctgggggatcaaggagaagtgagggatgatgttatgaagtataagtctcccctcacctctatggtgagtgtcgctgctttacaatgccaggtgaagctagcaaaccctaaggactctagcaagatagtcgtccaggcttgcgagagtgataacttccctttcttgagggtagcatcagccaattcgcccttcttctttatgtatagatgtcagattgaggtcttgggtcttgttcttcccttgatcgcttttaagtgtgctcttcttgagcacttgaacttggcccccttcccaaatccacccaaacagttgggccatggtgaaagcctttaa

SEQ ID NO: 64310 - DNA, 822 bp, Glycine max
  Peptide Sequence Number=SeqID_181088
atggctggcaagattggttgggtctccttgaacaacatgtccaagaatctatttgagttcaactcaagcctcttttgctgcttcaaggtccttgctactgatgtcgtggctgatggtattataggtgacttcgcttggaggccccttgtgaagggtcaacctgctggtgaggttggccttgttgttagtgttattgagtcgagggcccccttgagccttcgagccccaaggcatgttgcaaggttgacgcccagtttgagtcatccttcgagtttggaagatgggcctctagctctaacgactgtcgaggttcctggttccactattgttattgttgctactcctgctcctccacctcctcctaccattcatgctgctgcagttggtgtgctggctacttcagctggttttattatggcgtcttcgtccactgtggctacacccttgctaagtgttggtgtggcgaccatgaatgctcttgtgatgctgcctcctccttcttcggctccaccgattccaccatctgttgtgttggtggtggcatcgctttccttgtcttttcatccccatgtctctttggatcacttatacacctctagcaatgctgattcactgtgtggtgcaaattacaagctggagcagaagaccctgggtgcaaaacactacggactctgccaaagtcttcctccacagaagtttggtgattctggaggagaatggacaacgacaccaaaaggctctacacaaggtgtcgtccttgtggatagaccaaaaggagggctactacttgcacagtttggaaataggagtgccctaaggtag

SEQ ID NO: 64311 - DNA, 526 bp, Glycine max
  Peptide Sequence Number=SeqID_181089
atgccgcctataaccttcataatcaatgacttcaaggcaattgactcaatgcaggatgacccaatggttattagtgtggagatagccaactacatcgtcaagaaaaaccttatagatcaggggagctcagctgatatcttgttttggaaaactttcaaacaattgtatatacctgagtttgagatcctcccacatgatgaccccctattcggttggggaataggtagggacaaagggttgcatctagctctacaccaagttcggacatggggggccactatagaaaagaaccattataaccgtgcttgcagaccaaaggacgaacaggaaatgttacatggccagccttatgttaggccctcacatgagggagggaacccagaagttgtccactgcatagaggctagaatcgaggccgaaaaggtagaagaattggagctttaccccataactaatgataataatcgggtgaccctggttgaagagatgactgttcagcttctggcaagtgcaccggatcgcacta

SEQ ID NO: 64312 - DNA, 186 bp, Glycine max
  Peptide Sequence Number=SeqID_181090
atgtctaggaagcaaatgaaggagagaaagaatagagctaagaagattcgcggagtaaagaagattttagttggaaatttggatcctgatgtcactaatgatcacatgaagcaagtttttggcccatatggagaattagttgttgtggcaattccaataggcaatttttttatatttgatgtataa

SEQ ID NO: 64313 - DNA, 1002 bp, Glycine max
  Peptide Sequence Number=SeqID_181091
atgaagcagatattaagattggcttactgtaatatgggagattccattgtggcattagcatccaatggtatccatctagtttggcgctggccacgtaatggctttaacttggatggcaaggctagtgcacaattttgctctcaattgtggcacccaaaggacggcccgcaattcatgatcaacgaacttttaagtatcaaatgtgtaaacccagcttcctgttttgcttattcaaatggatatatcatttcaacatcaggagggatggtttccttgtttaatactgtgacatttaagactctgacaactataatgtcaccaccacctatggtaacatctcttgcctactatcccaaagataacaacatatttggtattggctttgatgactccactatacttatataccatgtccgtcaagctgaggttctattcaagcttgagggtcactctacaagagttactgctatagccttctcatattcttcaaatattcttgtatctggagatgcaaatgcccagattattctatggaatacagatgggtggaaaaagctgaaagataagcaattacaaatacaaggaaaccaggtgtcagtatgtgaaactcaaattcaatttcaccctgatcagataaacttccttgttgtacaccgtagtcatcttgcaatttatgaagcaacagaactaaaatgtgtcaaccagtggcttccagaagttccaatccttatctctcaagcaacattctcatctgatggtcacactgtgtattccatttttggtgatggggctgtggcaatatttgatgcttcaaattttgaaattcgttgtagggtctatcggtcttgttatcttcctacaatttcaagatggggagtctacccaatttctgtagctgcacatccacaaaaaccagcccagtttgctgtggggctctcagatgggagtgtttatgtgtttgagcctcaaatgcctgggggtgattggatcaaaaatcattga

SEQ ID NO: 64314 - DNA, 207 bp, Glycine max
  Peptide Sequence Number=SeqID_181092
atggaattttccttacacctctctttgagccatttgtcattcctctgcttcttgagaaactttcttcttcattgcattcagcaaagaatatttttgaagaagcttcaagggcttctccatcgattccctggaatactttcaactgaaagaggccaaagtgctttagagtcatttgattcatatcagaggtctgtgattgagagataa

SEQ ID NO: 64315 - DNA, 387 bp, Glycine max
  Peptide Sequence Number=SeqID_181093
atgtcccgccagatcatcaacaccgaaaaggcccccgccgccatcggcccgtactcgcaggccgtgcgcgccggcaacaccgtgtatttctccggccagatcccgctcgacccggccaccggcgacatcgtcggcgccggtgacgtcgaagcgcaggcccgccgcgccttcgacaacctcaaggccgtggccgaagccgctggcggctcgctggacaaggtcgtgcgcctgggcctgtacctgaccgacctgggcgagttcgccaaggtcaacgcggtcatgcaggactacttccaggccccgtacccggcccgttccaccatcgaagtctccggcctgccgaagggcgccaacttcgaggtcgacgcggtgatggtcatcgactga

SEQ ID NO: 64316 - DNA, 378 bp, Glycine max
  Peptide Sequence Number=SeqID_181094
atggccgtcggctcaacgcttgccggatatggcgagtggaagatattgtcgccggccttgtggcggttgggcagtatcgtattcggtattgcaggttatgcgcttatctggcttggtctgaaagcgttgagcgacggccgttttgtatcgccgaaaactctgcttgggacttgtcttgtcgtggttctcgggattgtcctcgcgtatgaggtggcggagaacaatgcgttgcgcgctgcgctgttcaatggctgtgcggcgctcgcctatctcggcgcagccgtggtgctgtttagcggctggcgcaaggagccgcttctttcccgcatcgcgatgggcgcgatcaccaccgtctcggggctgatttcacttctggtg

SEQ ID NO: 64317 - DNA, 675 bp, Glycine max
  Peptide Sequence Number=SeqID_181095
atggcggcgaaggaggcgagccaaccgaagccgtttcaccatcgcctccaggcagcggcttccgcacgggaagagcagccacctttgccggatggcacgcttgcttcgctggcgcatgaagcgcgccactgcacacggtgtgccctgcattgcaaggcgacgcagaccgtttttggtgacgggccggaaaacgcgaagatcatggtcgtcggtgagcagccgggcgatcacgaggatctggccggaaaaccttttgtcggccccgcaggccagctgttcgacaggacgctcagagagatcggtgtggaccgcggcgggctttacgttaccaatgccgtgaaacacttcaaatacgaaacgcgcggcaaacggcgcatccaccagcggccgaatgcgggggaagtggagcaatgccgctggtggctcaaccaggaaatcgcgcttgttcagccgaagctgatcgttgcgatgggtgcaacggcgctatatgcgctgaccggcggcaaagaaaaggtctcggagattcgcggccggcccttgccaatgcaagaagggcggacgctttttgtcaccgtgcacccatcctacctgcttcgcctccctgatgagcaggctaaagagatggaaatcaagaaattcaaacaggacatgctttatgtaagaaattttgaatag

SEQ ID NO: 64318 - DNA, 301 bp, Glycine max
  Peptide Sequence Number=SeqID_181096
aatgaccaaacttggtctctgcttgtcatcgggcccgccgcctctggatgacaaaagggtgcggataaccgtaagaatgaccaaacttggtctctgcttgccatcgggcccgccgcctctggatgacaaaagggtgcgaataaccataagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 64319 - DNA, 475 bp, Glycine max
  Peptide Sequence Number=SeqID_181097
atgacattgctacttagcaacattctgcccagcgaccgcaatgccaatctccccctgcggaagtatcagttggtctgtgtcgtcccgacatggggatcgcacccacaaagacacccagtgaacctgaagaagtccaacagggccctggggtttccagctctggttacgggcctctatcagtcctacagggtgctcgtacccccccgacaaggtcacatcatcatagggatcgcgcctgcaagacacccagtggacccgaagaagtccaacagggtcttggagttgtcaagctctaatcacgggtctctgtcagttctacggaggcgaaacaccacagtagcctggggatggtcggtagcgggcaatagacacaccgccaccacctctagagttaacctcagctcatccgcaaaaaggttagagcgttgcctacgacacatggccgaccagcaggcgaccaaatccaaagccaaag

SEQ ID NO: 64320 - DNA, 288 bp, Glycine max
  Peptide Sequence Number=SeqID_181098
atggtccccagtggagtcgccaactgtcgcaacgtgcccttttgcgggcgagcgaaggcgaggctcacgggtgcgctttccaaaggaggaaagatgcgcggagtcgccaccaacgtttatttgtgggaaacgtcggaaaaaccgaaggaaaccggtcgaaatgaaaattctaagttcgggagttgtgatcattttaaggcgttggaccttaaaaatgatccattttacttgcgtggttacggtacgaccgaacggtcggaattcattttaaccgaaattaacgaatga

SEQ ID NO: 64321 - DNA, 242 bp, Glycine max
  Peptide Sequence Number=SeqID_181099
gacaggctaacggcagttctgaaggtgacggtgctttgccatgcaagggccttctttgttcgatttttttcgctttggttttaatattgctttggacgggaaaaaggtgtgacctttgtctgattttgatgaggttccacgcaaaaaaggctaacagcagtgctgaaggtgacggcgctttgccatgcaagggctttctttgttcgatttttttcgccttggttttaatattgctttggacg

SEQ ID NO: 64322 - DNA, 291 bp, Glycine max
  Peptide Sequence Number=SeqID_181100
atgtctctatcacatactaagtctctccggctctatcatggaactcgtcatatgatgactcacgtgaaacaaaatgacaatcagtccaaatacaaaaacaaatcgggagtgagttatcacattctcaggtcactctcactaagtgaaatcataaggagaccaatcagggtcactctgttttgcgagaatgctccaatcatgtgggatcaacacaggcttaaaggagcactcaaactggatgacccccaaggcctacactccgaagagttcgttagggcctctccctcctga

SEQ ID NO: 64323 - DNA, 374 bp, Glycine max
  Peptide Sequence Number=SeqID_181101
atggaggaacaggcctcacaggattccatggaggaacaggcctcacaggattcctttgtcgcccatggacaacaccctggtcgtgtgcgtgctgctggagccaatgtcacgatcaaacaatactttggaccgactccaagaacctcccacacatcttcgtccattgctccgaaagacatggagcagttgacgcaaaaaatcagggaccagctggaggagtcgatcacagaaaaagtgactcgacaagtactcgcactacctcctgagcctgtggatggtcgttcagctactcatgtcagcccaaaggaaaatgttgtcatctggttttgttcgttgcataataggctagacttcctgaaaggaattattatcag

SEQ ID NO: 64324 - DNA, 123 bp, Glycine max
  Peptide Sequence Number=SeqID_181102
gcccaagcaggagaggcaccagtaggggcaccagcagaggcccccgacgaggtagatgaggcccgcgagtacgaggagacgaccgatttacttgatttcttacgaggaaacggggccacatga

SEQ ID NO: 64325 - DNA, 946 bp, Glycine max
  Peptide Sequence Number=SeqID_181103
tccagcaaaccatcgccagctgccgcataaactatcgtcaactcaccatggcggaacagccggggctggtgctggatattgccgcgctgtcggacaaagatctggcgttttattgcctggacgtaacgcgtgccggcgacaacggcgtgctggctgcattattgctcagagcactgttcaacggtttattgcaggagcaactgtccgggcaaaagcagcgtctgccggaactcaatggtctgctgcgccaggtgaatatgctgttgcgtcaggccaacctgaacggtcagttcccgctgctgccggtctgaatgccacgctgcacatcaatactcagcaaatccagctcagtaacggtgtgccgcttggcactatgggcagcacccatcttaatcaaatcagccagcgcgccgatgcctggcaatgtcacggccaaagcttagctttacacttgggtctgggtacgcgtatgctgcctgccaccaaagctattccaaaagagatgttaccgctggtcgataagccgttgatccagtatgtcgtgaacgagtgtattgctgcgggtattaatgagatcgtgctggttacgcactcctctaaaaactccatcgaaaaccattttgataccagtttcgaactggaagcgatgctggaaaaacgcgtgaagcgtcagctgctggatgaaatccagtcaatctgcccgccacacgtcaccatcatgcaggtacgtcagggtatcgccaagggcctcggtcacgccgtgatgtgtgctcatccgctggtcggtgatgagccagtcgcggtgattctgccagacgtgatcattgatgagtacgaatctaacccaaccaaagataacctggcagaaatgctgacgcgcttcgaagagagcggtcgcagccagatcatggttgagccagtcgccgatgtcaccgcttacggcgtg

SEQ ID NO: 64326 - DNA, 584 bp, Glycine max
  Peptide Sequence Number=SeqID_181104
cgcagaactcgagcaagcccaaacagtcaaagaaaggttcaaatcagcaactcttaagattcgaaaggagaacgccgaactgagagatgtaaatatagctaccaccaaggccttggaacaagagaccaaaagggctcgtagggaagaacatgaccggaacaaattccaaggggctctgtggggcagtaacagggaacttaagctccggagagaggaaagggaccaatcacgagtagacagtttgatcttgaaggatgagttgaaggtttacctaaggtccaagggaagcttgtctcagcgtttatgcgagacagagaccaacatgttagccatcgtcagcaagtaccaagaagaattaaatctagccacggcccacgagcacaaagtggcggacgagtatgcccgagtgtacacggaaaaggaggctagaggaagggtgatcgactcattacatcaagaggcaacaatgtggatggaccgatttgctcttactttgatagacttcccaactacgccaagtccaaagcaatggcggacacctactccgcccacgaggagatccatggacttctcagctattatca

SEQ ID NO: 64327 - DNA, 816 bp, Glycine max
  Peptide Sequence Number=SeqID_181105
atggttttccacgaactgggagctgaccttggcatcggaggcttcggtcttgaccccatcggggatcatcggctggtccgagaccagcagcagcgcgccactggggatgtggttggcgaagccggcggcgaacaccgtggccgtttccatgtcgatggccatgcagcgcatcgcccgcagccgttccttgaaggcctcgtcgtgttcccagacccggcggttggtggtgtagaccgtgccggtccagtagtcgtggccgaggtcgcggatcatggtcgaaaccgcacgctgcagcgcgaaggccggcagggccgggacttccggcggcaggtaatcgcccgaggtaccctcgccacggatcgcagcgatcggcagcaccaggtcacccagctggttcttgcgcttgaggccaccgcacttgcccaggaacagcaccgccttgggcatcaccgccgacagcaggtccatgatgatcgcggcattggggctgcccatgccgaagttgatcatggtgatgccatcaatggtggcactggccatcggccggtccaggccgatgaccggcgcgccggtcagctcggagaacgtatgcaggtagcccccgaagttggtcagcaggatgtgctggccgaactggtccaagggcacgccggtataccggggcagccagttgtcgacgatttcctgcttgctcttcatgggcggtccggtacggcgggggaccgggtattttcagccacccggccggtgccgtcgagctaccgtcggcaggcctgtgaagaaggtcacttggcaagcccgccgcctccgggctag

SEQ ID NO: 64328 - DNA, 408 bp, Glycine max
  Peptide Sequence Number=SeqID_181106
atggagttggcatgggacggggcgaaatttgggttacctaatgcctcaaatggttttttcatcacacatgcagatgtgactgaaataattttaggtgacaaatgtttaaacatatctgtactgcagctgtggatgatgtttatgaatgattggagtacaagcattggtttttctccagtgtacggtttccttgagccccagtctatacgctgcacaaaggacacatgtgaagaatgtcaaaaaaaatatgcagtaatcttccaaggcaaggacaatgcacctccacctccacctcaatggattgaggctaagtatttttcagatggaacaacattagacactgacaccatgacgacaatacgcaagaaatgggcagcctattttctagaagttggaaaatggatgtaa

SEQ ID NO: 64329 - DNA, 306 bp, Glycine max
  Peptide Sequence Number=SeqID_181107
atggatgtcaaagaacggttgaaaaccttcgccaaaataggggaggagcttgccacccagctcgcccaggcgagcaaggttgcttcctccagaagcaacagccttctgcaggaagaatctggaaggcccaactttcgaagaagttacaaaaactcacggattgcgaaaaacacctcatttcgatttccgtcacattacggaattttcacggatcgctggtcgaggcttggtcttgagagggttgaactcgggatggggaagcctctgcatgtgggggggtccacgatagaaagtgccttagtataa

SEQ ID NO: 64330 - DNA, 2622 bp, Glycine max
  Peptide Sequence Number=SeqID_181108
atggttgagtttgtcctcgaaactttgcttgggaatttgaactcacttgttcaaaaggagttgctactatttctgggttttgatcaaaacttggaaaagctttccagcttgttgactacaatcaaggcaacacttgaagatgctgaggagaaacaattctcaaacagagctataaaagattggctggaaaagctaaaacatgcagctcacatcctggatgaaatcattgacaagtgttcctatgaaggtttggggttggagtaccaaggggtcaagtgtggtccatcagacaaggatttatccgtctatccaatagttggtctaggtggacttggaaaaacaacacttgtccaattcatcttcaatcaagagaaggtagtcaaccactttgagttaagaatttgggtatgtgtttcaggagattttagtttggagagaatgacgaaagctatcatcgaagcagcatctgggcgtgcctgcaaaaatttggatctaggttcaaaaagaaaaagacttcaagatattcttcaaagaaaaaggtatttgcttgttttagatgacatctgggatgataaccaagagaattggaagatgttgaaatctgtactggcttgtggggccaagggtgcttgcattttagtcaccactcgtcaatcaaaggttgcaacaaccatgggaacaatacctactcaccagttaccggttctacccgacaaatattgttgggaattgtttaagcaccaagcctttggactgaatgaacaagaacaagtagagcttgaagacatagggaaggagatagtacagaagtgtcgcggagtgcctcttgctgcaaaagcactaggaggtactttacgcttcaagagaaacaagaatgagtggctcaatgttaaggaaagcaaccttttggagttatcacacaatgaaaactccattattcctgtcctaagattgagttacttgaacctaccaattgagcacaggcaatgttttgcttattgcgcaatatttcccaaagatgaaaacatagggaagcaatatttaattgaactttggatggctaacggattcatttcatctgatgaaagattagatgctgaagatgttggtgatggagtgtggaatgaattatattggagatcattttttcaagatgttgagacagatgaatttggcaacgttacaaggtttaagatgcatgatcttgttcatgatcttgcacaatctattacagaagatgtttgttgcattacagaaaacaaatttataactactttgcctgaaagaatacttcatctctcagatcataggtcaatgtggaatgtacataaggaatcgactgattcaatgcagttgcgtctattcaaatctctgaggacctatatattgccagatcactatggtgaccaactttctcctcatcctgatgtgttgaaatgtcattctttgcgggtgcttgattttgtaaaaagtgaaacgttgtcatcttcaattggtcttttaaaacatctaaagtacttgaatctttctggtggtggctttgaaactttgccagaattcctatgtaaattgtggaatttgcagatattgaaattagatcgttgcagtcgtctcaaaatgttgcctaaaagtttgatatgcttaaaagctctacggcaactatcttttagtgattgccaagaactatcaagcttgcctcctcaaatagggatgctgacttccctaaggattttgaccaagttctttgttggcaaagaaagagggttctgtttggaagaattgggaccaatgaagcttaaaggaaatcttgacatcaagcatctaggaaatgtaaaaagtttaatggatgctaaagaagccaatatgtcaagtaagcaattgaataagttgcggttgtcatgggatagaaatgaagactctgaattacaggaaaatgttgaggagattcttgaagtgctccaacctgatatccaacacctttggagattagatgtggaagaattcaaaggtgctcatttcccacaatggatgtctactccttctctcaagtatttaacccttttaaatctgctgaattgtgaaaactgtttacaacttccactattggggaaactgccttctttaaagattttgggtacaataaataataattacgtagaatacctctatgaggagtcctgtgatggggaaatagttttcagggctctagaagatctgaccatccgtcatcatccaaactttaaaaggttatcaagggagtatggggaaaacatgttcccatgcctttccaatcttgaaattactgaatgtgctcaatttttgggagaggaagtattgctgaaagggttggactctctcacggtatttagttgtgataagtttaatgtgtcaccaggttttcaacgcctttggaaattgtggatttctaattgcagagaggtggaagatttgcaagctttacaagatatgacttccctcaaggtgttaagattaagggatcttccaaagctagaatccttgcctgattgctttggaaacctacccttgctttgcgaattaattttttactgttccaagttgacgtgtcttccaatgagcctaagacttaccagtttgcaatag

SEQ ID NO: 64331 - DNA, 1290 bp, Glycine max
  Peptide Sequence Number=SeqID_181109
atgaaggcaccccgacagagcgaccacgaagagaagtctcacgccctaaacaccttgaagactacgtgtgagctggtagttgctgccattgtaagccatagcaatctggtccgacttgctaccatggcagaacacggaacccgttgtaccaccacggatcgactcgaagaagccatctccaccctcgccgagaaacactccgagctggccagcaaagttgatgccatgtgtgagcatttttctaacatggctccacctccatccccatcttttcgtcctcaccaatgtcccccagtcaagcttgacgtcccacggttcaacgactacgatccattagggaatgactttatcacgtcatggccggcgttacttcaggctatcgagactcgcttcgcaccgtcgttctacgatgagccccgcgacacattgttcaaattaatacagagaacctcagtcacggagtacctaacggagtttgaaatgttagcaaatcgcatcgttggactctctccccccatgttattgagttgtttcatttctggcctaaatcctaagattcgatgtgaggtgcaagcgtttcaaccagtatccttgcctcaggccatggcccttgctcatctccaagaggacaagtgcattggcaaaattgcatatcgtctgcaacttcctcaagaatccaggatacaccctatgttccattgcttgatgctccgtccacatcatgggcccttcgagttaccaacttcatctcttccaccagaagctcttcacaatcaacctgtccttgaactgctaaccatccttgactcacgagttgactcgtccacctccttaccaactcgtttggtgcttgtacaatgggttggtttacctccagaagattctacttgggaaaagtgggaagatgtttgcagtgcccatcaccttgaggacaaggcacccccacagagcgaccatgaagagaagtctcgcgccctaaacaccttgaagactacgtgtgagctgaactgcattatttacaacaaatcaagcatcttcaaaagtggcgaatccatcaagggctatcttgcagtctatgtcaatgagaaaatgaagcagttctttatcctagtatcacacttgaatcaaccttcattccaagaattgttgagtagagctgagtgccctctcattgctggcagggacatcctcatacccagtagtagtagtagaagtagggttggcttcttcatttgcattgcaatttccatcaatacccttataagggtaattggggtcttgggtccatga

SEQ ID NO: 64332 - DNA, 294 bp, Glycine max
  Peptide Sequence Number=SeqID_181110
atgaagatacacaaaacaatcaagagaacccctaagggtccatacatcatgttcaaatccttaaagacaaacaccaaccggatgaagaacgaagaaagagtgaagaacgatgtagaagttgatcacggtcacaattcggctgaaccccttacttcagccccctcacgcctatttataggaaataaggggacttggttaatcaacagcttgcccaggcgagctagttacttcacccctaagttatttgagggcccaggcgagccaaaggctagcctgggagatcgaggggtctga

SEQ ID NO: 64333 - DNA, 2023 bp, Glycine max
  Peptide Sequence Number=SeqID_181111
atggctcctctgtatcttaaggaggctgaggttgtgggctttgacggccctagagatacattggaaaaatggttgaaagaggggcgaaaaaagcgcactgtaatctctgtggtaggaatgggaggactcggaaaaactactcttgccaagaaagtttttgacaaagtccgaaatcatttcactctccatgcatggatcacagtgtctcaatcctacaccatagaaggactgttgagggatatgttgctcaactttgtagaagaagaaaaaagagtggatcatgcttcaatggataaaaaatcattgatagatcaagtgagaaagcacttgcaccacaagaggtatgttgttgtgtttgatgacgtgtggaatactcttttttggcaagaaatggagtttgctttaattgatgatgaaaatggaagtaggatattaatgacaaccagaaatcaggatgttgttaattcctgtaagagatctgctgttattaaagtgcatgagctgcaacctttaactcttgaaaaatcattggaattgttttatacaaaggcatttggatctgactttgatggacattgtccaagcaatcttaaggacatatccacagaaattgttaaaaagtgtcaaggtttaccactagcaattgtggtcattggtggtcttttattcaacgaaaaaagagaaattcttaaatggcagaggttttatcagaatctaagttctgaactagggaaaaatctcagtttatctcccgtgaaaaagattttggatttcagttatcatgatttgccttacaatctcaaaccatgcttcttgtatttcggaatatatccagaagattataaagttgaacgcgggagattgattccacaattgatagctgaggggtttgtcaaatctgaagcaacaaaaactttagaggaagtggcagaaaaatatttaaatgagttgatccaaagaagtttggttcaagtatcttcatttactaagggtggcaaaattaaaagctgtggtgttcatgacctagtacatgaaattatccgtgagaaaaatcaagatttaagcttttgtcattctgcaagtgagcgtgagaacttgccaagaagtgggatgattcgtcgcctaacaatagcatccggttccaacaatttgatgggaagtgttgtaaactcaaacattcgatcacttcatgtttttagtgatgaagaattatcagaatcctcggttgagagaatgcctacaaactacaggttattaagggtacttcattttgaaggcgattcactgcataattatgttcggctcacagaaaattttggggatttatcccttttgacgtacttaagcttcagaaattcaaagatagtaaatcttccaaaatcagtaggcgtgttgcacaacctagaaacattggatctaagagaatcaggggtgcgtaggatgccaagagagatctacaagcttaaaaagttaagacatctcctagtttatgataagttgtttggtttcttgggtgggcttcaaatggagggtggcattggagatctaacgtcgctacaaacactacgtgatatggatgcagaccatgttacagaagaagtaatgaaagggttggaaagacttacacaattaagggtgttgggcttgacctgtgttcggggacaattcaaaagttctctgtgctccttgataaacaagatgcaacgcctggacaagttatacattactgtatcaacatttaggtccattaatttgcaatttgatgtatgtgcacctgtacttcagaaggttcgcattgtaggggggttaaaggagttcccaaactgggttgccaagctccaaaatcttgttacgttgtccttgacacgcacccgtttgactgatgatccattgccactacttaaagacctaccatatttgtcgtccctctttattaatcatagtgcatacaagggtgaggttttgcagttcccaaacagggggtttcagaacctaaagcaaatactactgagacgcttgtatg

SEQ ID NO: 64334 - DNA, 116 bp, Glycine max
  Peptide Sequence Number=SeqID_181112
atggctgttacactttcaaattcatcattcaaaatcttggagtcaagatgccaattgggtgttgatggaaagtgcaatgcaaatgaagaagtcaaccctgctactactattactgg

SEQ ID NO: 64335 - DNA, 222 bp, Glycine max
  Peptide Sequence Number=SeqID_181113
atgcagaattcaaagaggaatgtgtacctaggagcctacttgaatggtactttgaaaggatttgacgatactccacaaagtaaatccacgactgttgttaggtggattgttgttaaatatttcaatgctgctagaccattggaaccagagatattgaaggcattccacattcagtgggcaagctactatttgaaagttaaaaatgaaacaattagtgtttaa

SEQ ID NO: 64336 - DNA, 411 bp, Glycine max
  Peptide Sequence Number=SeqID_181114
atggataggtcaaagcgtttgtgtccaagggagaaaacgagcggattcgtcttcgaggaaaacatcaaaaaaaccaaaaaggacgaaggtctgtgtattttgaaaatgagggttcgggagttgtttgcgcacggggaagaaaagcgattaccgatgataagagaaggagataaagatacacaaaacattaaagagacccctaagtgtccatacatcaagttcaaatccttaaggacatacactaaccggatgaagaacgaagaaagaacgaagaacgatgtagaagtcgatcacggaaatgaggggacttggttgatcagcaggtcgcccaggcaagctggttacttcacccctaagttatttgagggcccaggcgagccagaggctagcctgggcgagccaggggtatga

SEQ ID NO: 64337 - DNA, 166 bp, Glycine max
  Peptide Sequence Number=SeqID_181115
atggcattgggtattgggcaaaagcatcaacggaacggggaaataacagaggcgagagagaaaactcagaaacatggaggcgatggagcagatgagatcatgagaaaactcagaaaagaaagaaggacttacctgcaaaggtggaaacagaggcggcgacgtggag

SEQ ID NO: 64338 - DNA, 255 bp, Glycine max
  Peptide Sequence Number=SeqID_181116
atgagtagctcatcaaggccgatgccgaggagagagagtccatggggagtcaccagagagtatcatcctaagctcaaagctcaccgctgcaatgaccatgtcgaggatgttaagggtgttgcccttgctcctacgtatcttcagatgatttatggcactaatgatcggttgaaatttactttacaagaagaaaagagattaccaatgatagaagaaggagatacagatgcacaaaacaacaaagagggaccctaa

SEQ ID NO: 64339 - DNA, 324 bp, Glycine max
  Peptide Sequence Number=SeqID_181117
atgagagagcacaaaaaaaactgttcaaaaggtaaagaatttgtaatcaaaaaagaaggagagaggaaatacaagatcacattacacatagagaattgcaaagaatcaaaggttgaaggagaaaataatgcaaaggttgaagattccaagtacgagaaatttagaatacgaagaatggcagagaatcaaacaaaaataaaagctctaatattgtccaaattggccatcattttcaaggatagaattcaaaaggtcaagacaaaggataaaaagaaggtcaatgatgatgatgaagaagactatgtacctgaatatgaaggatga

SEQ ID NO: 64340 - DNA, 1275 bp, Glycine max
  Peptide Sequence Number=SeqID_181118
atgtcacaccactcccttctttccactccacaacttcatcaggaggaggacttgcaaaggattaaggactgttataacagccttggtcctgaattcaaacgtatcttctcatctctcttgcagtttcctgaaaatgctgttttcaagagaagggaaatcgctctctggttctctcagtatggtgattatcgttggaattcagtttgggttgattctattttgaaaagtaaagtaattgtaccccatggtaatggcaagtctcccattgcgagtaaatttaaaattaatccgttgctccgtcacaagtcactaagtccattgtttcaaaatgaggaagtgccgatttgtggttattattcacaaataaagacctcatcttcatctcgtgccagtgatattgggtatcaacgtttagtacttgaccaacgtaaaattaaaataagtgatggttttggttttaaatcgttccgtgctgtttataattttggtgcaagttatcttaattttggacccggatggatggccaaaatgaaggatttgtgggtgcttcaactgggtcgtttcatgcaagattcaccaaaacatcatattgaagtggacagtgaagaattcctcaaggagttgagtggtcacgaggatttgctctgtcttagccttcgagggatatcaagaatattcgagcttccaccttccatcgtaaaaattgagagcctaggaattctagatctcaaggcctgtcacaatctacaaacgctacctagtgatatttcatcattgcgatggctctggtatttgaatttgtctgagtgctacttgttggacggaatgccaaaggggattgagaacctgacttggcttgggggatttgtattaagtagtcctagcaagactccctgcagaatatcagatattgctgcaaaattggaaagactagtgcgacttagcatacgtataggaagtggggccgtgatccaagatggcgagtttgaaagcttgaaaatgttgtcaattcttaagcatctaaaaatatcatggggtgtatttgacacaagtttgaaaaagttgcatcttgaaggctttcctggccaaaatattccagaatggttgaagcctagcaaactacctcaagaattggaattgagacagctacatataacaggaggaaaactcaaaagtttggatcatggtgaaaataatgattggggtgtggagatcgtgtatctcaagtacctaaaagatttggatgttgacttgggacatttgcgaaagttgtga

SEQ ID NO: 64341 - DNA, 351 bp, Glycine max
  Peptide Sequence Number=SeqID_181119
atggctagccaacatagtgatggtaaagaagtcaatgagaagtggagaatgtgcattaactacatatatttgaataaggcatgccccatggattcgtatccacttccgagcattgatcgtttgattgatagatcgaccaggttccccatcttatgctttttggatgcatattctggatacaatcagatcgtcatgtttaagcaagacgaggagaaaatcgcattcatgaccaacacaactaactattgttattcggttatgcttttcagactcaagaattccaaagccacttaccaaaggcttatggacaagaaatatcaattagttaaggaaaaacttggaggtctataa

SEQ ID NO: 64342 - DNA, 436 bp, Glycine max
  Peptide Sequence Number=SeqID_181120
ggtcaccctaagggctgaatctcaacacttcgctagtgtacatgatgacaatccccgtgtagctttcatcccttactttggtttcattaaagaaatttgggagcttaactatgtcaaatttattgtttgtgttttcaaatgtaaatgggttgacaacaacaccgacccttgtgatgaaaagtggtcagtggttctacacgggaaaacaattggtgttaatgttgaagatgataattcatacattgatacttatgttagtcctttgtccacacaaatgtcgcctaacatcgttggagaagaagaagttgatgacgcaaatggctacaccacccagctctcttcctcctcctccttctcctactggtgtagcatcatagtcgccatctaccttgaagcggacaagaaaatccacatggctaacatcattggcgactag

SEQ ID NO: 64343 - DNA, 195 bp, Glycine max
  Peptide Sequence Number=SeqID_181121
atggacgccaaatgttcttaccaagttttaaagaaccttctcacagcgatgatcctctgtgaactccttcacgaacaaaggtgggggtacctgcaaagacacttcgaggctcaaggtagaagtgtagagataaacaagttatgtgacttgcatgtaaaagattcgtttatcactgttaccagcttgatagaataa

SEQ ID NO: 64344 - DNA, 507 bp, Glycine max
  Peptide Sequence Number=SeqID_181122
atggaagagatgatcgcgtttcgagaacaaatgcacaaagaatcctcaaggaagcaagtagagagaaaggaaaaaactgagagtggacaggatcggggaagatccagaaggcacaacactaaagaatgtaatacattgaaggataaaatagaaaggcttatccaaaagggcatctttagaagttcgtcaaagacaaagaccgttcacaaaaccatgaacaaacaagagaaagaagtcgagaacattggaggattcgtaggagggtatccttcgctcaatgagttaggagctatcatcttaacaccctacctcactatgaagtttccaagtaaagatggaaggattattgttttctgggctgaccaaatgatagcaagagagtgctacaccacaagtcttagagtcagtaaagggaagaagggagctgagcccaaggcacaactgatggcatgcacctcccttaacaatctaagggatattgatcctgatccgagagaagtagaataa

SEQ ID NO: 64345 - DNA, 350 bp, Glycine max
  Peptide Sequence Number=SeqID_181123
atggaggccatgaaagagcaaatgaccacaatgatggaagctatgatgagtatgagaaaaatgatggaggtcaacacagctacaatcgttgccgcaagtaccgccactaaggtggacccaactcacccattcggcctcaataaagtaaatcatccagtctcagatatggtaggtcagggaggcgaagcattgggaagtatgggtggcccctattttgtgcagtctggtcatgcacatgtcgctcaacccatgggggagacatatgaagtaccccaagaccacactttagctgactttgagcctcacctcggatatgccattgaggggcaagcatttggtggtgtacccat

SEQ ID NO: 64346 - DNA, 273 bp, Glycine max
  Peptide Sequence Number=SeqID_181124
atgtcctggaagacaagacacataactataccacgaagctcccttcctcctcctaagttagcaccttcgtcgaagaagtctagaaaagcaacacggctcaaatcattggctaccagactcgttatgatggagaaaccagtggtttatgtggatcctgccactaggaaatctaatggccctcacaaaaagaaattaaggacatatttggggatcatcgctcgagacaaggttgacgttacatttgtttacgaaaaagaagttcttacagcttag

SEQ ID NO: 64347 - DNA, 228 bp, Glycine max
  Peptide Sequence Number=SeqID_181125
atggtgttttcaataacaaccaaccttgactggcatcatttctacggaggtgttaaggggctcctttccaggaaaccagctgagggtggttcgaaaatagtgaccgagggtacatggtgcgaatggggttcacgaacaaactggaaaggggttcgattaagcacagtgggtgcttttgatcttcaacaaagtggacaatcagttgcaagtaatcaaaaaatcgattga

SEQ ID NO: 64348 - DNA, 168 bp, Glycine max
  Peptide Sequence Number=SeqID_181126
atgggggaggatgagaagatagttactagtggggtatttggagggaaagcaagggaatggagaattatggagataggggtttgggttcatagtggagaggttgcgatagaggcgaggtggtggtggtttaggttcatggtggagggaaggtggtggggaagggtttag

SEQ ID NO: 64349 - DNA, 456 bp, Glycine max
  Peptide Sequence Number=SeqID_181127
atggctaacgtggatggtgggaacaaatggttgatgacaacacatgattccttaagagaagtgttggagttcaaaaccgtgggtgctagtggttttggaagggtgagggttgggttggtttcttgtggtcgactaagagagagtcaagagttgtgggagagttttggggtttatggtcattggaggtggtcagagggaggtggtcattggaggtggccagcttctgtgaggatcgacaatggaatgaagattgacaatagggttgaaggtggatctatacccaatccccttcaacaaagattcccctttaatgaatctgagatgtctttacgctggtgtaaattaagatctaatgccagaattggaactgaagctaaaccagggacatattctggaagagcaaggggagggagaccagaaagggatttaaagggtgtcatccctatgacagaatga

SEQ ID NO: 64350 - DNA, 234 bp, Glycine max
  Peptide Sequence Number=SeqID_181128
atgtcttttgtcatgccatcaaagtatggtgctaacttgctactgcctaaagattcctctatgaggattaaagaggtgcctagaataatagttgttgtagtttccttttcaggtttaaagaggagtttaggacagataatggcttatgttggcatagatctaagctcccctactcttgccacacttaatctcattccaactttcacttttatacttgctctcatatttaggtaa

SEQ ID NO: 64351 - DNA, 186 bp, Glycine max
  Peptide Sequence Number=SeqID_181129
atgtcctccttggtcaccaccatcacttgccatcaactctcattgtcgtcaccactgtcagttgctgtcattgccatcacctgtcaccactgttaccaccgtcactctcattgttcaccgacgcttctttcagtttgtgttttaacgtattcaaaaacaaccgcgaaagctgagctcggtacctag

SEQ ID NO: 64352 - DNA, 348 bp, Glycine max
  Peptide Sequence Number=SeqID_181130
atggaggatgcggtgacgagtgagaatgcccaggagctgtttgacattgcggcggataggtttcaggagatggccgctttggcgttgtttaattgggggagtgtgcatatgtcaagggcgaggaagatggtgagtattccagacgatggatcgagggagtcatcgtttgagtttgttaaggtggggtatgagtgggctctgaaggactacatgaatgcagagaagaggtttgaagaggctgtgaagattaaatcggatttttatgaagggctgcttgctcttgggcatcagcagtttgagcaagcaaggctctgctggtctcatttgattgcaaaaaataagggttag

SEQ ID NO: 64353 - DNA, 216 bp, Glycine max
  Peptide Sequence Number=SeqID_181131
atggcattagcgtgtgacttttgtaaggagacaacccatggggtattttgggttagaataggtagcgaaatacctttggcaatttacactttgggtatgatggcaaaatacttggatgtattagaaataccaagatgtgcacatgtgcaatttttggtaccccaaaatgcttggagtatgcatgtatgtgaatttagccaaggagatgtgtgggat

SEQ ID NO: 64354 - DNA, 369 bp, Glycine max
  Peptide Sequence Number=SeqID_181132
atggagaagaagaaagagtcgcgaactatacctaggataaagggtgttacacaagagaggtgcaaacaaatgaaggagaactcaaagaaattaagagatatgaacaaagatggtgtcaactccaaagctaatgcagtaaaaagggttgaagatgaagatgacttgtttttggcaacaaacgatgaggttgctaaaacaaaatgggtaatcgattcggctacctcaaaacatatttgtagagatcaagagatgtttgacactttgaaaactgatggagaattcgcctatttcaagttagggaatggtggaaaaatgaaggttgaaggtataaggagcgtgaggattaagcttcatgatggtgctatttga

SEQ ID NO: 64355 - DNA, 405 bp, Glycine max
  Peptide Sequence Number=SeqID_181133
atggagaatgaaattttgcttgcacaagaaaattttgaaaaactaaatagagaaattgagaaaggggctgaaaaacttaagactggtgaagaacattgtgatatgttggagaaatcaaatcaatcactttggctagtggctgaaaatctactgcaaaggatggctatgaaggatcaagcacttttagagaagcatgctgagatagagaggctccagactctaatgcctgaggagcattctgacttttgggagatattaggacatgaaattggcctccttaagtcagaagatggacaacttgtaaaattagcacaattactagtattagaacgccaaaccaaaaaagttgtccaactctactggtatcagaggaatcacacgactagggtccaggagaaccgataa

SEQ ID NO: 64356 - DNA, 1356 bp, Glycine max
  Peptide Sequence Number=SeqID_181134
atggaagataaagctgcgataaaagaattgctggaagacgaggaaaacccatatgataatactatgggatctactcttctaagcttgagcctgaataactcagggcaaccccttaaccaaatggggatgctgcgaatcaagcttgaggaagcaaagaaagagaatgagattttgaaggctatgctgaatcaggttaatcaacactgcactgctcttcagaatcgcatactttttgagatgcagcagcatcaactattttcatcatcacctcgcaatgataataataatcatgacttgcagggaaacaaacaagatgcggagaaattaccaatgctacacacccggcagtttttgaatatgggcgagtcttcatcaattttagacggcaacacaaaagcatgtgcaatagcagaaaacgctgaaaagaaaatgttaggcaaaaaccttgcatgtgatgataataagtacaatgttgaaggtgaaatcaacagtcaaataacatcgcatgaagcaaaaagcacagaagatcaagtatctgaggttacttgcaggagagctagagtgtccataagagcaagatcagatttttcttcgatgtttgatgggtgtcaatggagaaagtacggacaaaagacagcgaaaggcaacccttgtcctcgagcctactaccgttgtagcatgggaactgcatgtccggttcgtaagcaggtgcaaaggtgtttcaaggatgagactgttctcatcacaacctatgaagggaaccacaaccatcccctcccaccagcagcaagacctttggcaagctcaacatcagccgcattgaacatgttcctttctggctcaatcacaagctcacattccagcaccattctacctaactcacccctatccactatttccccaagtactgctgtggccactttctcccaaaatgcaacatgccccacagtaacactggacttaacccagccaaataacaacaactatctccaattccaaagtgccaccacttcttcacaagaccatacacaatcatttttccctctgccattgcatggaaaccctcaaaattattctgaggggttgatgcacttgtggtctaaggttccaattccaaccatgttagccccagagaaaaaccttgccctggtggatgttgtcagtgaggccataaacaaagatccttctctcaaggcagcattgttttcagccatttcctcactcactggagatcctgatcagaaggacaacatcaataacataagccaattacatagtaagagtagtggtggttatgacccttgttctaagatgcctgcaataccacctattcagccttacactaagttgatttag

SEQ ID NO: 64357 - DNA, 1134 bp, Glycine max
  Peptide Sequence Number=SeqID_181135
atggatttcaagtatctgctggttggtatgtgtgtttgggcttggtttggatcaataacttttgcaacttctaatgatgggaggttgatgaggattggtctaaaaaggaggactttagaccttcagtgtcttaaagctgcaagaatcaaagaggctggtcatcacagggatttagggggtgttaatagaaactgttgtgatgaagatatagtatatcttaagaattatcttgatgcacaatattttggggagattagcattggttcacccccacaatacttcaatgttgtgtttgacacgggaagctcgaatctttgggttccgtcttctaaatgcatcttctctaaacagaaatatgttcgtttcaatgtacataaattgcatttgggaaaatatgcaggaataccttgtaaaatcccttacggccaaggatcaatttttggattcttcagccaagataatgtacaagttggggatatcatcatcaaagatcaagaatttgctgagattacaagggaaggatccttggcacttccagcacttccatttgatggcatacttggactcggattccaggatacttcgggtggctgtgctgcagttgttgactcgggcacatcattaattgctggtccaactactgttgtgactcaaattaaccatgccattggagcagaaggatataccagttttgagtgtaaaagcattctccataactatggggattcaatatgggaatccttgattgctgggtatgtccttcgagttgaagaaggctgttctactgtctgctatggcggttttgttgctatagatgtgcctcccccacaggaaatgcgacaaatgcatgcttctccctctctattcaacctctaccttgtatatgacaatactggtgcgctaggtcatgttgaagatgatgtgcaaaaggagaagcaaaaggtgaatagggaacttctaggtttgttggaattttgtggcgttgaattagagattggagaggaagtggaaagcattaaagagtgtggatggttcaagatcgtagagcaaggattgaaggagttgaaggtggcattgtggattggtgacgaggatgatagagagcctttggtgtatggcttgttgagtaattag

SEQ ID NO: 64358 - DNA, 243 bp, Glycine max
  Peptide Sequence Number=SeqID_181136
atggagttgcagcagaagataaaggagaaaaggctaaaaccctatactactagaatggccaaaatacaaggccaaaaagaaggaaaacatattctaatatttacaaagaagagtggacccaaccttggtccatgggctcaaaaatctaccatgagattcatgagaaccctaaggccttctttagtcgctctagtccaatcctcttggagtcttgtatccaatacccttggacataggatttga

SEQ ID NO: 64359 - DNA, 267 bp, Glycine max
  Peptide Sequence Number=SeqID_181137
atgaattacctgactaaaactacagtgtggaatgctgaagtcggactccaacggaccctagtgatcatgaaccccaataacgacgatggtgtggaggagaccatagtgacaggtcttcgcggttattttgatgatgccaaagaatcaagagtcaagaaaaatccaaagattcaagaatcaagtttcaagaatcaagattcaagaataatcaagatcaagattcaagactcaagattcaagaaacaagggaagactcaatcaagataa

SEQ ID NO: 64360 - DNA, 693 bp, Glycine max
  Peptide Sequence Number=SeqID_181138
atgtatcattcacaaacatccatgcttatttttcttttcacatttggatgcgttgctctttgcattctttccttgaaaatccgaactgtaatcattgtaatcaaaaggaaagaactcgctttacgatgcccttaccaaacgcgtgccaaagctagagtaatgggtgaaatgatggaagccatgaaagagcaaatgaccataatgatggaagccatgatgattatgagaaggatgatgaaggtcaatgcggctatagttgttgccgcatgtaccgccacagaagtggacccgactcacccatctagcttcaatcaagtaaatcatccaacctcggatatggtaggtcagggaggcaaagcattgggaagtacgggcggcccccattttgtgcaggttgagaacaagcattccttcccaccatatggtttgtctcctaactatacaccactcaatgttacacacactcccaataagaatgtcgacaactctgcacctatacctattgagagccaacaaccccaatcagatcatgcacatgtctctcaacccatgggggagacacatgaagcaccacgagaccacaatcttgctgactttgaaccccacctcagatatgccactgaggggcaagcagctggtagtgtacccctaccaaacactttgggaggccctcagtatcacccagaaccataa

SEQ ID NO: 64361 - DNA, 226 bp, Glycine max
  Peptide Sequence Number=SeqID_181139
atccgatgacgagtccctcgaaggtactaatacctgggacccgcctatcaacttcgagcaagaaacgaatcaaacggaagatgaagggaacgaggatgtgggacttcccccagaattagaaaggatggtcgcccatgagcaccaagaaatggggcctcatcaagaagaaacagaactagttgatggaagcttgcttgtggagcttctatggaggctggatctttga

SEQ ID NO: 64362 - DNA, 171 bp, Glycine max
  Peptide Sequence Number=SeqID_181140
atggaggaggacaaattcattcatgagtgtctaatctatgcagtgcaaagccatgttgtacttcaccccactgcaaacaagttattaacacaggagagcttgacgtctgggattggctggatggcatgggccttgagcaaagactctattctagtttatttctggttctga

SEQ ID NO: 64363 - DNA, 672 bp, Glycine max
  Peptide Sequence Number=SeqID_181141
atgcaaaaaacagagaaaggagcaaagataataaatctcaagtctgaaaagaaagagccaaatccgtttcctcccccacagtatattatttactctctcctcaagacagacaccaatgctaaaaaagggaagggagaaaaagccatgagaaattgcataaggtgctgcatctcttgcatcttcccatgtggggctctcgacgtgatccgcatagtgcactccaatggcagagtagaagaaatcagcggcaccgtcaaggccagtgatgtcatgaaggcacaccccaaacatgtcctcaagaagccatgctcttcccccgccgatgccgccggcatcagcggcggggtccacaagatcgtggtggtgccacccgacgctgagctccaacgtggcaagatttacttcctcatgccactccctcctactcctcctacacaagagaagaagaaccggcagagaaagaagaagaggaaggaacatagagagagaactatgaacaacaccaacaacgcgtccatgattacgtctatgactagcttgcttgtctctgatcgctacttgaatgatatactctcagagaaggtgtcaagtcaaagagacagaagaagagggcgtgttgctgtgtggaggcctcacttggagagcatttatgagtcaccttctgatccgtaa

SEQ ID NO: 64364 - DNA, 504 bp, Glycine max
  Peptide Sequence Number=SeqID_181142
atgtctactcaaattcaaaatggttcttcctcctcatcacaacaaccactgagtcgctatgagtcacaaaagcggcgagactggaacacctttggacagtacctgaggaatcagagtcccccagttccactctctcagtgcaacttcaaccatgtgttggatttccttcggtacctcgatcaatttgggaaaaccaaggtccacttgcacggttgcatcttctttggccagcccacccctcctgcaccctgtgcctgccctctcaggcaagcatggggtagcctcgatgccctcataggccggcttcgcgctgcctatgaggagcatggcggatcgccagagactaatccctttggaggaggagccattcgggtgtacctgcgtgaggtcaaggagtgtcaggcaaaggctagagggatcccatataagaagaagaagaagaagagaaacccaattctcaaggggactcaaagagctaaagatatcgagcaacaagcttcttga

SEQ ID NO: 64365 - DNA, 234 bp, Glycine max
  Peptide Sequence Number=SeqID_181143
atggatgtatatggagttttgggaagaaataagagggtgagtgagagaaggaatgaggcgaaagaatgtgttggtgcagtggagaaagatgaaaatcacgtcttgtggtcttttgagaggacagaatgtggggcctttgaagatgggaaaagagatgctgcttggtgggagccgactagaaataccctactcattagtcggcgacctggtgcttatagtccaaatgctgcttga

SEQ ID NO: 64366 - DNA, 309 bp, Glycine max
  Peptide Sequence Number=SeqID_181144
atggctcaagtacaaagtggccaagctagtgaaggaattattaagctgtttgggacaacgattaggttgtatggtagagaaagaaaagaagataaaaaccatagagaagatgggacagatgaggacataaagagagctgataagatcattccatgcccaagatgcaagagcatggaaaccaagttttgctacttcaataactacaacgttaatcagcccaggcatttctgcaaaaaacttcaatatgcatggaactccgaaatttcccaacttccagaatactcacgagtcatgacccaagcaaagtga

SEQ ID NO: 64367 - DNA, 3543 bp, Glycine max
  Peptide Sequence Number=SeqID_181145
atgtgcccatcagatttgatactggtggcccaggatcttgtttcaggagatattcagatccaaccttctttcaaagagtatctacagattcagacaaatcttactctgggaaaactgaaaaagcaagggaatctcataaaagcaagaatgaaatctatttcttctgctatcaatgggcgaacttcttcctcacaaacaacctccaccatagatatgacaatgaaatcagatctggaacattattcaaattcttttgattcaaaatctggtgctggctacattgaatgtgttttccatccaagtaattctaagcaatctgatgagccagattataaagcaccatcctctacaaaattgaaacggaaaaatgatactctgtcatcagtatctcatcatatagatgatagtatttcacatgatacattggaaaagcaagttgcctctagttcatctggtgttacttgggatgaaaaggaagagatagtggaatctaagagtcaagcatgtgatatagataaaactcctgagaggcttgtggagaaccatgacttagatatgcatgtaaatgaggctgttaccataaccagcattgactacaatcatatcctatttaatgaagaaagcaacctgaaaccagtctccaacagggttcaaactgatgatattgatagtgaacctgataattacgtggatgctctcaacaccattgaatcagaatctgaaaatgatattgattatataacaaaacgagaggtgcagcagttatcttcacgtgtcactcgtggaacaattgaaaatggagttactgaagctcctcccaatttattggacaataatttatctgatgtcgtttctcagactgattatactgttcccttaaatgaagaaaaagggaatttagccgactcactgcaagaaaatcgtgttcttgatcttgtatcaaagccaaatgcatctaatttgggatatgttagtccatctgatgatcttgatagagaaaatatgaccagagacacagcttccttaaacaaagaaccattcagggatttgtctgactcactgcaagatattcctcctctcacatcagagccacatgcatctaatttgggacctgaaaatccatcagatgttccttatagtgaagaaatgaccagagacaccgtttgcttcaataaagaaatgtttgggaatttgcctgacttgttgcaagaaatttctcctctcacatcagagccacatgcatctaatttgggacctgggcatccatcagatgttccttatggtgaagaaatgaccagagacactgtttgcttcaacaaagaaacattcaggtatttgcccgactcaatgcaagaaattcctcctctcacaatagagccacgtacatcaaatttgggacctgtgaatccatcaaatgctccttatagtcaagaaacgaccactgatactatttccttaaacaaagaaatgtttggaaatttgcccaactcattgcaagaaactcctgctctaacattagagccacatgcatctaatttggcatctgtgagtccatcagatatttctgttagcaaagggatagccaagaatatagctgattctcatcaccccaagactcctgcctgtgagcaggttccttgcacaattgaaaattctgttttggataactcagtatgcactgatacctacattggttcttctactgttaatgatacagtgtcagcaccaattgagactgatatatcattttctggttccaataactctaatttaccagatgaggaagcaggtaagatcaacaacaatatctgcaaatctgaagagactcgtagagagtctttggctgatcattcagttaggttctggactaatggtggattattaggacttgagccatcaaaacctcctgactttaacaagtcaacttctttaagtcaagggtctttgagcactaaaagtgaaacagatggtggttcacatcataattcaatgcaaaagagcaatggttataaagaggaacgggaatcatcagaagacgttgctgagcagattctaaaggaaccaagttctagattcttaacatcaggccataatgatgaccaagcttgtatctctgaaaaggccactggcaattctcagcagagtaatggattttgtcagattgagaggaacagtttaggggaaatcagggtagctgcacctgaaagtgttctcccatcgatccttgacacaaaggacattactgaacccaaccagggaaatggtgaaaactcatcccgtgtgtttggacttagtcgtagattactaataaatagctttcagcggaaagtttcttttgatgaaaaattggaacgttataattctctgaaatctgttatattggaccagagtggacaaaatggcattgtaggacagtcacttcctgagacaacaacctccaaagagaaagttggttctggatatcctataaagtcacttcctccttcacctccacttgaacatatgaaaatatccttccatcctgtcagtggacttgagatctcgaaactaaaattgaaatttcctgatggcagtaatcgtcatgaaagcttaaaggatgtgtttccttctttccagttggtccctgaagcttcccttcctctggatggtttagtttctcactcagatgatgatgacactttctgtagatcatctccatatatatcagatgatggccgaagccctcgctctgactataattctgagcagtgggaatctgatgaaactcctgaaaacagtgaccaaggggtacatgattctcctcgcagaaggtcatcagctgaatctgtgtccattgatgataccaatgtaagaagtggacaaggtacatgtactacaaatggtgtggaacattctctatctaggcctttacttgattttccaagttatgataatgttaatcctgcacttgagaaagaaagtaaaagacactccaaatgcaataatgttatgtcacatagtcatgcagagcctacacaaccaccacctcctcctccacctcttcctccaacgcaatggcgagtctcaaaaccacagttggatatgacaaatgggacacaccatttgtctgaagatgctgaacatattgatgatcacggtattccacattctactatcttccagcagcctaggctcacccaggttgagcaattacaaattaatcacgatgatcatgaatcttataacaacattatatatagattgaaggacaagtgtattaatctcattgagcatttcctgcagctggatccgcagaagttgaagggtcagaaggaagcaaaccagttgaaaatgggaaaggagacggatgaaagagaagatttcctatatcaaatcagaacaaaagccttcaacctgaggcccacagtaacaggaaagtcaaatgataccactggtcccaccgcaaacgtcaaagttacagcaattttggagaaggcaaatgcaatccgtcaggttgttgcgagtgatgatggtgaagatgatgataactggagtgatacatga

SEQ ID NO: 64368 - DNA, 318 bp, Glycine max
  Peptide Sequence Number=SeqID_181146
atggagggcatcccagagccagaaaaagcgactaatcatcagacaccttcgggacagacaaagccattgtacggtaccatggaaataggaggttaccccacaaattcctgtcctcctaaagccagtgccattggtaaatcaaatcttaattctgagaaaatggttgagtttgttgcacaagctgaatttcagaaatatatttatttgaaggttgaagatcctcaacttgcatcaatgaatcaggctgttcatcatgttccatcgcgtcgatttgtggctcatgtagcagcaccattgtgtccaaggggaagttggtga

SEQ ID NO: 64369 - DNA, 594 bp, Glycine max
  Peptide Sequence Number=SeqID_181147
atgttattcgaggactctcgtaacaatttcctccaatgcttttcttcatcttcatcttcctctccctcttttcgtagggctaaaagcagaccagaaacatcaaatgttgatgatgatatgtggctttcttcaaaagcttactacagtccaattgttgaattgtgtggaggcactgagctcgcatctagctacattgcaggaagtcccttgcagcctcaagcttttggagcatttagcacagcatcaatgacaactggttttgtcatttttgacgaaaatggagttccttatccagatgatgttgcttgtgttggggaagtgggcttatttcctctctctctgggagcatctgacagattgcttaatgctgaccatgagaagacaagttctgtagaaattgagagtgtctgtgatggagcggatgaatgcattttggtgacagctgcagttggtgttgcaactgcaaatggaggcccagaacaactggttatatttgtagttttaaaggaaggatacaattccagtgcagaaactctaaagatgaaattcactaaagctattcaaagcaaccttaaccctttgcttaaggtctga

SEQ ID NO: 64370 - DNA, 900 bp, Glycine max
  Peptide Sequence Number=SeqID_181148
atgggagacgagaataagaccaagtcccctgcttccggcgtgtggtccaccatcaagcctttcgtcaatggcggagcctccggcatgctcgccacctgcgtcattcaacccatcgatatgatcaaggtgaggattcaacttgggcaaggatcagctgcgcaggtcacttccaccatgcttaagaatgagggtgttgctgccttctataagggtctatctgctggattactcaggcaggctacatacaccactgcccgtcttggatcatttaaaatcttgacggccaaagctattgaggctaatgatgggaagcccctgccactgtatcagaaagctctgtgtgggctgactgctggtgctatcggagcaagtgttggtagtccagcagacttggcactcattcggatgcaggctgatgcaacattacctgctgctcagcgccgaaattacacaaatgccttccatgcactctatcgaattactgcagatgaaggggttttggcgctttggaaaggtgctgggcctactgttgtaagagccatggcattgaacatgggcatgcttgcatcttatgatcaaagtgttgagttcttcagggattctgttggtcttggtgaaggtgctactgtgctaggtgcaagttctgtttctggatttttcgcagcagcttgcagtttaccatttgactatgtcaagacccagatccagaagatgcaacctgatgctgatgggaaatatccatacactggctccgttgattgtgctgtcaaaaccttcaaagcaggaggaccattcaaattttacaccggattccctgtctattatgacatggattttcctgaaccagatacagaaattgcagaaatcctacgggttgtagtttgtagttctccgtggtaa

SEQ ID NO: 64371 - DNA, 915 bp, Glycine max
  Peptide Sequence Number=SeqID_181149
atggcctccaccaaggaacgcgaaaactttgtctacaccgccaagctcgccgaacaagccgaacgctatgaagaaatggtggaagcaatgaagaatgtggcgaagctgaacgtggaattgacggtcgaggagcggaaccttctgtcggtagggtacaagaacgtggtgggtgctcgtagggcttcgtggaggattctatcgtcgattgaacagaaagaagaagctaaagggaacgatgtgagtgtgaagaggataaaggagtataggcagaaggtggagtctgagttgtccaatatctgcagtgatatcatgactgttattgatgaacaccttattccctctagctctgctggtgaacctagtgtctttttctacaaaatgaagggggactattaccggtacctcgcggagttcaagtccggtgatgagagaaaagaggctgctgatcattccatgaaggcgtatcagtcggcttccactactgcagaggctgagttaccacccacacatcccatccgtttgggcctggctttgaacttctctgtcttttattatgaaattttgaactctcctgaaagggcctgtcaccttgctaagcaggcatttgatgaagccatctctgagttggatactctgagcgaggagtcttacaaagacagcaccctaattatgcagcttctgagggacaatctcaccctgtggacttctgacatccctgaagaaggagaaaaaactaaaagggtttccaaaataaaaattgcaaaagcatgcataccatgcagcacacattccagtattggacattgttacagactacagtggcctgaaggccataccactgctttagtatttttagggtcagctgaggaacaaaaggtggattctgccagagctgctggaggtgacaatgcatag

SEQ ID NO: 64372 - DNA, 1116 bp, Glycine max
  Peptide Sequence Number=SeqID_181150
atgctgtttctccaaaccactgtcttaactagacgcttctcacctttttgtgatgctactttgcatccattgtcattacttaatgttcaaaatcctatgttggaatgtgctcacagtttttctcattattcccctgtacctagcaaccgcactgtaaagtctatatcatgctctgtttctagaaagtcccattcaaaacctgagcctgaaccacccgaacctgaagctaattcgaaccaaagagcagggcctaaggcgagaagcagaagtcaccaacctaaagatgtggaatccagtaacgacgataaaagttcagcagagacattccccacaacgattcccaggaagccgaggcgtggtcgtagaagtgaagcagtggcagtggaagattttgtacgcgattcgctcgagcgcacgtttgctgcaattcgggaacaaaacaaggatgctttggagagtcatgaaaatataatgaaggagagggatggtgacagttctaaatctgaaagcagcgataaggacgatgacaatgatgatgaagaggaagatggcggagaaggcgtaagaaataagatggtgattgaggaagagagtaaaaactggccattggatgcagatgttgggtggggaataagagcttctgagtattttgagaagcatccaatcaagaatgtggtgggagaagatgggtatgaaattgactgggaaggggagattgatgacaactgggtgcaagagatcaactgtttggaatgggagagttttgctttccatcccagccctttaattgtccttgtctttgaacgctataacagggcatctgataactggaaaaatttgaaagagctggagaaagcagtaaaggtattttggagtgcaaaagatcggttgcctccccgggcggttaagatagatatctatatcgagagagatttggcatacgccctgaaagttagagaatgtcctcaaattttatttttacggggtaacagggtcgtgtacagggaaaaagaactcagaactgcggatgagctggttcagatgattgcatttttctattataatgcaaaaaagcctgcgtggatagatgataaggccctgtattttcgtttttaa

SEQ ID NO: 64373 - DNA, 453 bp, Glycine max
  Peptide Sequence Number=SeqID_181151
atgaagaactggtacatccatagtgacagaattgtggtagaaggcaattatagtgttgtgattcaacacagtcttccacctaagcacaaagatcctggagttgtcatgataccgtgttccattggtgaggtttttgtaggaaaagctctcatagacttgggagctagtatcaacttaatgcctctctccatgtgccagcgacttggagagatagagataatgcttacatgcatgacccttcagttggcagatcgctccataacaagaccgtatggagtgattgaacatgttttggtgaaggtgaaacaccttatatttccaactaattttgtggtgatagacatagaagaggatgctgatattcctctcattcatggtcgcccattcatgtctactgcaagctgtgtagtagatatgggaaagaagatgttgcaaatgggaatagaagattag

SEQ ID NO: 64374 - DNA, 381 bp, Glycine max
  Peptide Sequence Number=SeqID_181152
atgacagatcttgtgagcgcggaagatgacaaccaaaaagtttatacggataaccactcaggtatttccgccagtcagcgtgactcaaaagtcagtatgacagatcttgtgaccgcggaagatgacgttaatcttcgccaaaaagtttatacggataaccactcgggtatttccgcccgtcagcgtgactcaaaagtcagtatgatagatcttgtgagcgcggaagatgaccgtgactcaaaagtcagtatgacagatcttgtgagcgcggaagatgacatagcaaaaaagaatgttcatacggaaaagcactcgggtatttccgcccgtcagcgtgactcaaaattcagtatgacagatcttgtgagcgcggaagatgac

SEQ ID NO: 64375 - DNA, 387 bp, Glycine max
  Peptide Sequence Number=SeqID_181153
atgcctcaatactcatttcaagttctttctacctcaaatgttttttatggaccctcacaaaggtttgacatcactttcaaaactccactatctgcagatgatctaccaccatcgagcttttattatcgtgacatgggtcatgaaaatgaggaggaagataatgataacaacaataataatgatgatgacaacggttgtgatcatgttcctcaacaacaatacacaatcattttagaacaagaggaggtagaggtcatagaacaggaggacaacaagcacatgcaaatccaatccaaaaagaagagagacatcaacacatatcaagaagagctcgttatgggacatcatctcattattaaatttttaaaaaatgtaattttcatataa

SEQ ID NO: 64376 - DNA, 111 bp, Glycine max
  Peptide Sequence Number=SeqID_181154
ctcaaaatgcaaagtattcaagccatggaggaattaagaacacagtgtgccaaaactgacatcaaccagaatttcaacctagaaatcaagagtagtgtttatgttgcttaa

SEQ ID NO: 64377 - DNA, 639 bp, Glycine max
  Peptide Sequence Number=SeqID_181155
atgaaggaaggcataggtcacatcttagacctcactcccataggagagaaaatgaaagaaagcctcaagaggttaacattaaactccccatacttccatgggaaggacaatgtagaggccaatttagattgggaaataagggtagagcaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtgttgaggaaaaaagcctagagtttcaagaacctcaggatttgaggtcaaatccttttcaagggggagggaatgatgcaatcctaccccgcaagggcattggatag

SEQ ID NO: 64378 - DNA, 360 bp, Glycine max
  Peptide Sequence Number=SeqID_181156
atggatgagtttgacttgcaggtggcctggctaggagcccagccttctccttctggagggggtggggcctccacagcccaagagcctactcttgaggagccagaagcagtagcagagggggaggatgagctcacccctcctaagccattttattttgatgcagatgcacgcatggctcagaaggaggggacttccacagatcagatacatgagccatctcctacacctattcctgatgatgccataccatctgcaccagcatctgagttagagcatcctatctctcaggattcaccagctgctcaggtgttggaccttgatgagcatgcacaggagcaaccacaggagcaagacatttaa

SEQ ID NO: 64379 - DNA, 387 bp, Glycine max
  Peptide Sequence Number=SeqID_181157
gactccttagaagagcaggtaacgcagggctcgtttgtaccccatggtcggcaagacattctgaacactgcgattggccgacctgagcatgggggtcgcgttcgggcagcaggctcaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttcttaaggatggtacaacaaggtttgtag

SEQ ID NO: 64380 - DNA, 416 bp, Glycine max
  Peptide Sequence Number=SeqID_181158
cacgggattaactttggtcgaactcagaaatatgattcaatatcattcctatgttctttccgcagcacctgatgtgtggaattacaatacttcttcatcggattcagttttgataaagaaaatcattcaaataagggactttattatctccaaagagctaagtacggaagaggccaacaagaggattcaatcttggagcaccaatgaacaattgcttgttggcaaagcctatgaatacattagaggtgttaagcctactgttagttggtgttctgctatatggaactcagcaatcccccctaagatgaaatctctccaagtttgggctcacattcgtgatttggctcttttctgtaggcgtttcacttctttacagtgcattactgactctttaatttggggcagatccaaatcag

SEQ ID NO: 64381 - DNA, 1021 bp, Glycine max
  Peptide Sequence Number=SeqID_181159
atgcgccatgccgttggccagcagtgtttcttccagcgcattggcaactgtgttggtggtgcccacgtcgctgccggtcagcaggaacggcaccacgcgcaggccaccgcccaccaggctggcatcggcctggaacggcagcggcacatcaccctcggcatcggtgccgaacgccagcaggcgcgggccctggttgcggcccggggcacgcatctgcagttcttccaggcggcgatggatcggccagcccgggcgcagtacttcggcggggtcgaaatgggcggcggcgaacaccaggtccagctcggccacctgcggcaccagcttggaaaggtcgcggccgacgcgttcggccagttcaccggcccgttcagcgctgagcaccgcttggcgggggatttcgccgccggccagttccagggccagcacgccaagggcattcatcgcggggtcgggtttgctcatggttccacggttggcccatcacagggcggcagctacacttggctccattatgcctgctccgtcgtgcaggccatgttgcagacaccctcatccatgccaggtatctccatgcccaacgctcgtcccgtcgccatcctcggtggcgtccgcattccgttctgccgccagaacaccgcgtattcggatgtcggcaacctcggcatgtcggtccgtacgctgggcgcgctggtcgaacgtttcggcctgcatggccagcagctgggtgaagtggcgatgggtgcggtgatcaagcactccagcgactggaacctgggccgcgaagccacgctgtcttccggcctgtcgccgttgaccccgggcatcaccctgcagcgcgcctgtggcacctcgctggacagcatcatcaccgtcgccaacaagatcgcggtgggccagatcgaatcgggcatcggcggtggttcggacaccacctccgacgtgccgatcgtgtacggcaagaagctgcgcgcgcgcctgctggccgccaaccgtgccaagagcaccggcgacaagatcc

SEQ ID NO: 64382 - DNA, 204 bp, Glycine max
  Peptide Sequence Number=SeqID_181160
atgcagaggggggctcaatctaaaccatttgatggagaaatgggagattgcttagaggatacgatttgtgatcttggacaagagtcttttcagcaagcacatgctcctatgtatgatacattgcaaactgattcaaagaagcctttgtatcccggggtgcaagaattccttgacgctgttgtcggtggtgttaagtctggttaa

SEQ ID NO: 64383 - DNA, 366 bp, Glycine max
  Peptide Sequence Number=SeqID_181161
gcagctgtgtctccagcaaaacctccagaaaggccggatcctgaggtcgatgatcccctatatctgatgacattgaccatcccacaactttttttgaagcctctccaggttatgtggaatgctaccgtgttcagggtgtttaatcaaaacttctcgttgtacataaagcatgaagatctctatgaaattgtacacggtggtcaatgtctcagcatatctgttatacagttgtggattctgcatctgactaagacaagcatgcgagcggggaatttcgatgtgtatggattcctcgagccacagtccattcagatatctgggcaatcacaatttgaatctgaaagttacatcaagagttggatgtag

SEQ ID NO: 64384 - DNA, 216 bp, Glycine max
  Peptide Sequence Number=SeqID_181162
atgtatactactacaataacccatattcgtctccactgcaacgaacactggcaaatggtcatctttttgcctaaggaaaaccttgttgtctggttttgttccttgcataacatgccagacaactaccttaagggaataattaacggtgctttgaaaggacttgatgatactccacaacctaaatccaaggctgctgctaggtggattgttgttaag

SEQ ID NO: 64385 - DNA, 830 bp, Glycine max
  Peptide Sequence Number=SeqID_181163
ttagaggactgcacatcctctcctttagagggcttcacgccctcaccttcagaggattgcacatcctcgtctttagaagagtgcacgtcctcacatttagcagagtgcacgtcctagtctttagagggctgcatgccctcaacttcagagggctacaccccctcacctacagagggatacatgccctcaccttcagaggacagcatgccctcgcctttagagggcttcatgtcctcgccttcagaggactacacgtcatcgccatcagagggctacacgcccttgcctttagaggactacatgtccacacctttagagggctacacgcccttgccttaagtagactgcacgtccttgccttcagtggactacacgtcatcgcctttagagggctgcacgtcatcgcttttagggggctacacggcctcaccttgagagggctacacgctctcaccttcagagggcttcacgtccttgccttcagaggattgcacgtcctcgactttaaagggatacatgccctcaccttcagaggattgcacgtcctagccttcagatggcttcacgtccttgccttcaaagggctacacgccctcgccttcggtgggcttcatgtcctcgcttttagaggactgcatgtcctcaccatcagcggagtacatgtcctctccttcagagtactacatgcccttgccttcagaggagtgcacgtctacaccttcagaggaccgcacgtccttgcctttagagggctacacgccctcgcattcagtgggcttcatgtcctcgcttttagaggactgcatgtcctcaccttcagcggagtgcat

SEQ ID NO: 64386 - DNA, 471 bp, Glycine max
  Peptide Sequence Number=SeqID_181164
atggtagcattattccatgatttgatgcacaaagaaattgaaatctacgtggatgatatgatcgccaagtctaaaaccgaggaggagcatctcgtcaacttgcggaaactattcaaaagacattataagtactggctaagattgaatcctgccaagtgtacttttggggtcaagtccagaaaactgctcggctttatcataagccagaaaggaatagaggtggaccccgacaaggtgaaggccatccttgagatgcccgagccacgcactgagaaacaagtccaagtgcttgtgccacccgtgccccgaagacccctcattctatacatgaatgtgttggatgagtcgatgggatgtatgctggggcaacatgacgagtctgggaagaaagaaagggtcgtctacaacaactactctttgcttgaaaggacatgttgtgccttggtgtgggcaacccatcgtctaaggtag

SEQ ID NO: 64387 - DNA, 309 bp, Glycine max
  Peptide Sequence Number=SeqID_181165
atggattacgcaatcaccccttctttggcttccggaatgttacagaactttacggattgcgccttaacacgtcctttcaactcccgacatgccgcagaacttcacggattgcctaacgatgggtgtcaaatgatcgaggagatgaaagggagggaggaattggtgctgttgggtctctggcggttccttggcggcgatgaccaacagcagcggtggtggaggaagaaccctttcgcttcttggatggttctaccatttgaaggtgtttcagcttttgtaatcgattatagccttgctgttctagtgtaa

SEQ ID NO: 64388 - DNA, 402 bp, Glycine max
  Peptide Sequence Number=SeqID_181166
atggcggaaaggaacttcgagtcggagtcatcggcattctgggtcataggaagctccaattcctccctccaatccctctgggtcattattctcataagaggaacagcgtatatgatggtcattgaccaatccctattttatgatttaacaaaattgcctagtgaaggtgtgccttttgagggtgcactaattgatgaatggaaattcgatttctctgtgcatgatgcccaccggttggtttgcaccaaccaagcggatatgaccggaagacttcttgccggttcattggcttttgaaagccgcatcctccattatcatatagtttgcattttgcttcctagatcttcaaaccttgcccaggtttctgaagaagacctcattgtcatgtggggcctttcataa

SEQ ID NO: 64389 - DNA, 150 bp, Glycine max
  Peptide Sequence Number=SeqID_181167
atgtctggaagcacaggagaacgttcttttgctgatattattaccagtatccgatactggattattcatagcattactataccctccctattcattgcaggaaagtgggataaatggccgatactactggaaggattcctctttggataa

SEQ ID NO: 64390 - DNA, 378 bp, Glycine max
  Peptide Sequence Number=SeqID_181168
atggatctcatcacaatactcgttgcccttaaagggtcttacaattgtgtaattgcacaattcatagttcacaactcaatacacacttctcatctcaatacacatttttaccgagacagttttggatttctgcgggaaaataaaaggctacaatgcgaagggttttcttctaagctcagacataatatcaaaatttccaacggtgggaatgctcggaattgggttgcaaaagtggtgttcaaatttcacgacgatccaacggtgaatgagcccgagatcgtcgtttttctaagacaggtttggtgggctgcgggaaaaagaaagggttttgagaggagaagggaaaaaacgaaaatgaggccaaaaagaggcatctga

SEQ ID NO: 64391 - DNA, 315 bp, Glycine max
  Peptide Sequence Number=SeqID_181169
atggctacagccagatgggcactcaagcatctcgtttatggcattgtgatactacggttgggaatttacacagacagacccaacgtttccaagttatgttctttcatcagttcaatgaattcatccatccttatctcggacgacgttcctaaatggaaaactccacacgactccggaatttcaaaaatcactattgacaacaatgaagtaaatactaacgtaacagttcaaacgacatgtaagcacaaaacaaaagtcaatcaaaacgaagcaaacgttagtccctcagttaaagaaaagatagcatacaaatga

SEQ ID NO: 64392 - DNA, 1480 bp, Glycine max
  Peptide Sequence Number=SeqID_181170
tgacgttattctccctttcactcactcactcgctcccaaacctcgtacgccgtaccgtgtttcctcgtccgaccaacaaacctcacgctctggtgtggttttctccgattctgcagtagcggcacacatgccacaaccaaaagagcttccagggttttattatgaccctgagaagaacaggtattttcccatcaaaggccccattcctggctcttcttctaagcccaagacccctgctcttaactcaccccaaacctcttccaatcaggaaagtggtgggagttgttgtaggaagcttagaaacagaaccctgtctaagctgcttcaggctagggagttggatggtcacagtgtcgtcatctctcggtattgcagaagtaacttcactgaggaattccggaaaatgcaagcatctagacctgtggtctggaaatatcggggaactgatgggatgcgtattactgctttggaacacttgcgcgttgatgtgcagacatccgaggggcaaactgaaactgatgttttgttgacgggcagcacaaatggctcgatgagaggtggtgtgctgcaaatagagcatgttgcattgcagtttactgtcatgcctggagcaggtttttctcaagttggaggggttgggcgtaattatgatggtgggacaaaatggagggcagattgtgtgaagaattatgttaaagggagaacagatgagcataatgaggtgcttaagccggttttcaaacctaatcgagctgcactgcttatgtcctctagaatatctagtataagattgggtcctaagtgctcttctcacgctgtcaatgatggtcatattgttggacgtggatcagtttatactcttgatcttgttgaaccattaaatcttggaccaggtatactgaacacatggagcggactagaggaaattgcttctttcaggtacaaatttgggaggtgcttcagtggatctggaaactgggacgatatcatgggaaatgtgattttatgtgggctaagaaatggagcaattgtcactgtagattctcgtgagagtcgagaaagcctttctggtagacttattacccatcggataccatatacatcttcagacaagaaagttggaggttctaataaagaatggttcaagatgagactttatgatcttcgtctacttcagaggggtgctgttcaatgttatgaagggcatgtgaattctcatacccgtatacagattggtgttgatccatctgagagatttgttatgtcaggtggagaggattgcaagctaaggttatggagtatcaagtctggtgaactgctttttgaggacaagttctctgattcagttatctccactgtgtgctataaaacatatggacatagttttaaagcagaagaggaaaaccaatacaagcgtgactcgtctcagggtgcatggcttggatcacttgaaggactgttttatatgtgctggttatga

SEQ ID NO: 64393 - DNA, 228 bp, Glycine max
  Peptide Sequence Number=SeqID_181171
atgtctccgccaaaaaacctgatccaacaaaagaaaaggatatggttcgattccttcgcgcgtcacagtcacttgccacttctatcgcactgtgtgagtgcaacctcgggtggagcgagatgcattatggcgtttggtggaaggaaaaatggtggtcagtatccaaaatatttatcaaaacttgaacatgggacatgcatatactcaaatctccattcttcaacctga

SEQ ID NO: 64394 - DNA, 402 bp, Glycine max
  Peptide Sequence Number=SeqID_181172
atggctggtgatgcagcttttccctctaccacttgcatgatgaccctcttcttctctttgcttttagcccttcacttcgccatggctgtcccagaacgaagtttgtcctctttagcttctataaaagaaagtggtacaaagaagaggaacaccatggtagctgcttcggctagagaagcaggaagcacacaaaacatcaaggctgaagaaatcacaccaaaacaaaccatcaaagatgaccatgttcctgatcatctcttgaacggtactaataaagaaggcagttctcaatctcaacggcctccattggagtggcaaaacaaaatcttcaatgctagtgaacatgaagtccctagtggtccaaaccccatttcaaacaggaagattgaattgaaggaataa

SEQ ID NO: 64395 - DNA, 342 bp, Glycine max
  Peptide Sequence Number=SeqID_181173
atgggaaaaattgaagcactccctttctcagaactagacaaaaatacattcatcagcaggtacaaaactccctttcttcgatttggaaccaccgaagcaataggtccagtcgccgtagcgtctctgcgtatgcgcctcgtcattgacgagcaggcacaaaaatctaggttcgtcatgcacgagtatcggcggtgcgtgcggtggctggaaattgttgtcgaaggaggatcaccggagggcgagaaatctaatgaggaagaaaaaggtatatggtgtggtatatccttaacatggtacaacaacaacgaacaactcaaatcctcaactcggtacatgcaataa

SEQ ID NO: 64396 - DNA, 699 bp, Glycine max
  Peptide Sequence Number=SeqID_181174
atgtcggagactaatgaagataaaacttcaggagacttcagagaaatgggtcatcggctggctcaggaagtaatttcttttgttagaaagaaaatggacaaggcctcaagatatgggaatttaggagatattaggctaagtttcgttggacattctattggtaaccttattataagaacagcactagcagagagcatgatggagccatttctaagatatctatatacatatgtttcggtatctggtccacacttggggtatctttacagttcaaactctttgtttaattctggattgtggcttttgaagaaactaaaaggcacacagtgtattcatcaactcaccttcacagatgatcaggatattcaaaatacattcatctataaactgtgtaaggatggttatgtgccttaccattctgctagaatagaattatgccaggctgcttcacgtgacaaatcaaagaagggtagagtgttccttgagatgctgaatgattgtttggaccaaatccgtgccaatccctctgaacatcgagttttcatgcgttgtgatgtcaattttgatgccacttcctacggcaagaatttaaactctttcattgggcgtgctgcacatattgagtttctggagtctgacatttttgcaaggttttccaagggattcagactaacaagtagggatgctgaaaaaaactag

SEQ ID NO: 64397 - DNA, 1686 bp, Glycine max
  Peptide Sequence Number=SeqID_181175
atggaggagcaaaaacttagattcctactcaactccaaggctccaaatgcaatgttgtgcatgctatccgaagaacaatgcaccaaggtacatagtttcagaagtgccaaacaaatgtgggacaccttggctgtaacatacgaaggaacatcacaggccaatgattcatctgatgatgaatctgaggaagattctgatgaagatgagttcgccttcatttcacgaaaaatccaaaaaatgcctggacagttcaaatctgaatgtctagaactggagaaagcttgtatgactcttaaagaaaaagtgcctgagctatgtcttgagattgagacaagtgctagggagaaagctaatctttgcaagaactttcaggagttggaaaacaaactaaaagatcttcaaaatgatctgaaggagctaaatgaacttcatgattatcaaaaggaagaaagatatgatttgcagagagaatgtgcacaagcacacaaagattatgaagatctcaaaatgagtaaacataatctttgggtggaatgtaaagaactcaaaagatttgtgaaattcttgaatgataagcttttgaagaatcaagaagttaagggtcaacctcaagatgttgtcaaacttcatgaggaaattagaaccttgaaaactacattagccaaatttgtcaatggaacgaataatcttaacaaactgttaggatattgtagatgttccttagacaaatttggaaatggatatgatggaaaggtatatgttcatgataaggataccattgtttgctacttctatggaaaaactggtcatatgacattcaagtgtaaagatcgacttaagaaagatgtccttgataataagaagcagacacttatcatggtacttggacagtggttgctcatgacacatgatacaagaaaggtgtatgttccaatgcttgactccctatcatggtggaacaatcactttcggaggaaatcaaaagggaaagataaccacagtggtggatataatgtctccttcaacaaagatgagtgtgccatcctatgtaaagatgggtctcctctattcaatgccaagagaaaaggtaacctctacaaaattagactgggtgatctcacagatcaaaagaatctaccttttgatcttccgcacaccatctacatcaaaatcttgagaaacctaaaaggcgtgggtggtctagacgacatctattacgctgctctcatcaacaagatgttgtgggatcaaggcgtgtatcatgtcttcaacaagatggatgatgattctaagcacaccttaatagacaagggtttagccattgctaaacaaaaaaaatttagccaaactaacctaaaatctaggaaggttgctttagaacaaagccaaaagaaggctcctcagctcagaaaaaagaagaaggctgaagaagaagaagatgaagttgttgttgctgcaatgaaagaaaatgatgcctccatccaagctaaagtgtctgctaaagctatggatgacaccattgtatccagtgaagctatagctgatgaagttgaaccgaacactttagagcttgcatccaagaattcaacaacttcaaatgaggctacttctagagacaagggagaaccacttgtcatcatcatctactccaccaactcaggtcctactcatctgaactatgcataa

SEQ ID NO: 64398 - DNA, 507 bp, Glycine max
  Peptide Sequence Number=SeqID_181176
atgccacactctcttaaggtcagagcggtggctatgtttgaagctgtacaggagattgccatatacattcataggtttcacaatcttgacctttttcagcagggatggtatcagattaaaattactatgagatgggaagatgatgaagatgtatcttttggaatcccagctagagttgttcaatacgaaggggtcctcaccccagaaatcaccatgtcattggtaacttgcatatgtaacaagtttcatgtgtatgacattgacttggcaaaggtggaactcattggttgtgtacttgtagaagtgcttttggagttgttattagtgtgtttggcaatgatggcagagaggtgtctgaggatgttggcagtagggaatctcttcagtttgtgcagtagtgtgaaggtgagggatgacaggggaaaacgaaacgtcttctattggatgaaggtggaggacgaggaatttaaaaatcccacctattttagtgcaattttaaattcttaa

SEQ ID NO: 64399 - DNA, 348 bp, Glycine max
  Peptide Sequence Number=SeqID_181177
atgccaaacaagttaagttctcaattggatcctgaaagttggtttggttttagaggtggttctatgcacaatagctataataagggtggcaacaacgacgatcaacatggcaacagtaatggtggctatggttgcaccaatgcagttgacaagggtgttgcccttgctcctacgtatcatcagaccttggaaccctttactcagcctccctcacgcctatttatagcaaaagatggcattaggggtcatggcagatcgcccaagcgagttggagctcgcccaggcgagttgttgcttcatcttgaagtaaccttgtcagcccaggcgagctggttacttcacccctaa

SEQ ID NO: 64400 - DNA, 918 bp, Glycine max
  Peptide Sequence Number=SeqID_181178
atgccttatgtgactaaccagggtttgagtgatgctgcctctgtaaagttgaaagccttcatgattgttaaagcattattaacagctcatggtatattacttgaagaactacaaaaacttagcaaagcagttgatcaggctattgatattccagagtttgtgtcaaaaaggaacgatatgaaattaataaattctgttccgcaagctaatcagtttactacagaagttgaaatttcaggtcaacgcatgccacaaaatggtctcgagggagcagacagagctttagattttgagactgctgaaaagcttcgttccttgtcaaagagagagctgttgaactgttatcattcagtgggaaatcgattgttgtatttatggaacatatttctgaagttccacagggataacaaaacaaagattctagaatttttgcatgatgcttgggctaaggatcgaaaagctgaatggtcaatatggatggtgtactctaaggtcgagatgcctcatcattatataaatagtggtgtacacagaagagtttccagtttgtggaaactacctgatgagcctcctcagactgctgctacacgtgcagaacttcatcgaagaagcattgcacaaatgaggattaacaaccggtcaattcaagacatgcatatattcggtgatccttcaagcataccaattgtcattgttgaacgtgtgatgaatgcaccacgtcggactatcagtgacaattcatacttgagacaggtagaacttgtaaattcacatagctttcaaactggactcaacttggacactgcaaacaagatatctgctccacaaactagtacccgtgtgttgaagattgttgtctttgtgcatgggtttcaggcaagtcttacacttgagctcctctttttttttttggtctaa

SEQ ID NO: 64401 - DNA, 1059 bp, Glycine max
  Peptide Sequence Number=SeqID_181179
atgaaaaactcttccctcccattgcttcttcttttggtactttacacaatttcagcctcatcccgaccttatgaaaactatgatgataagtcatccctttcctccacaataagtgaaactgtcttctctctccaagtcccagcattagatgaaaccacctttgataatctcctatcctttggttactaccgtaaaacctgtccccaattcgaatccatcctacacaacaaagtcaaagaatggatccagaaggactacactttagcagctagtctcatgaggctccacttccatgattgctctgtcaggggatgtgatgggtccattctgttgaagcatgatggaagtgagaggacagcacaagctagcaagacactgagagggtttgaagtggtggatgatataaaggcagagttagagaaacaatgccccaagacggtgtcttgtgctgatattctcactgctgctgcaagggatgccacggttgagttaggtgggccttattgggccgttccttatggtaggagagatgggaaggtatccattgctaaggaagctgatatggtgcctatgggccatgaaaacgttacttccttgattgagtttttccaatccaggggcatggctgtccttgacttggttgttctctcaggggctcatacaattggaaggacttcatgtgggtccattcaatacaggctctacaactaccaaggaacaggcaaaccagatccaaccctagatcctaagtatgttaacttcttgcaaaggaagtgtagatgggcctcagagtatgtggatcttgatgctacaacaccaaagacctttgacaatgtttactacattaatctcgaaaagaaaatggggttgttatctactgatcagttgttatactctgatgcaaggacttctccccttgtttctgcattggctgcctcgcactcagtttttgagcaccagtttgctgtgtcaatgggaaagcttggcattgttgatgttctcactggcctggaggaaggagaaatcaggaccaactgcaattttgtcaatgattattga

SEQ ID NO: 64402 - DNA, 633 bp, Glycine max
  Peptide Sequence Number=SeqID_181180
atgataaagacgaaggttgagcatgcacatgtgccaattacaaaggacttttttagcaaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaaacaaaaggaggcacaagatatgttcccgccacgctaacctccaccaccgacgacgtgttggtcttgtcaattggcttcaacatcgatgattctagggccatctttctgtggggcatccacataagtgtggaagacatgaacaacacaattaaaaggtttttgatgaatttcaaagaagcgccttcgtcgcaaggtgacgatgattataggttgcccttgcacaccgaagggaagtatgagaaacttgtcaagcatgctattgaaggagattctcttgatagtgtaggagggttagtgggtaactacgatgttttggtggtggtgggtggtaaccgaccaccaatgactgtggaagacctgttgaaactatggtgcaaagggtgcaccattatcggaaatcatctctag

SEQ ID NO: 64403 - DNA, 249 bp, Glycine max
  Peptide Sequence Number=SeqID_181181
atgaagtgcagcaaaggaactgatggcatatttggtcaagctacagtcctcactttcagaagtcaatcaggtactcaaagatttttgcaactcttagagttgtatgcaagtgttgtgatggggttggaggcgcatgcactaatttttgaaactgaaccctttttggatgttatggttaaagctgagctattatcggagtccactgctttccatgttcaatcccttgattcagttcatatgaatttttaa

SEQ ID NO: 64404 - DNA, 417 bp, Glycine max
  Peptide Sequence Number=SeqID_181182
atggggcaaatgatagttgtcccttcatctagtgtccccattaacttcggatcctcgttttcagtttcgtccgggtcagggcatcccatgagaagcgtcaacgtctcacgacagaggagtctgggttggggctatgcttcttccatgaggggctggtggagcgagaatgcgaggggggaaaaacgtgaggtctatgtttggatccttcttgatggaggtgcaaccagctcgtctaatgatcctttgcaggcgattggaggtcttgtgacaagaagtcgtagacaatcaacttcagaagaagaagaagaagaagaagaagaagaagaagaagaagaagaagaagaagaggaggaggaggaggaggaggaggaggaggaggaggagtattcaaatgcaaaaagtcatggaagaaggtga

SEQ ID NO: 64405 - DNA, 3759 bp, Glycine max
  Peptide Sequence Number=SeqID_181183
atgagaatttcaacgcttgcaattgtgatccttttgttcttttcttttgcactactactttgtcatggcaatgagagcactatgagagtgcttttggaagtaaaaacatcgttcactgaagacccagaaaatgttctaagtgattggtcagtgaacaacacagattactgtagttggagaggggtgtcatgtgggtcaaaatccaaacctttggatcatgatgactcggtggtgggactcaacctgtccgagttatcactcagtgggtcaatatcaccctcactcggccgtttgaaaaacctaatccaccttgatctctcttctaaccgcctcagtggtcccattccaccaaccctctccaacctcacttcgttggaatctctcttactccactctaaccaactcacgggtcacatccccaccgagttcgactcgctgatgagtctccgagtcctgcgaatcggtgacaacaaactcactggcccgattcccgcgtcatttgggtttatggtcaacctcgagtacattggcttagcctcatgcagactcgccggtccgattccgtccgaactcggtcgactcagtttgttgcaatatctgattctgcaggaaaacgagttgactgggcggattccgcccgaattggggtactgctggagccttcaagtcttctccgccgctggcaacagactcaatgactcgatcccgagtacactgagtcgactcgataagcttcaaactctcaaccttgccaacaacagcttaaccgggtcgattccgagtcaactcggcgagctaagtcaacttcgatatatgaatgtcatggggaacaagctcgagggtcgtattccaccttctttggctcaattgggtaaccttcaaaatcttgacttgtcaaggaatttgctcagtggggaaattccagaggagttagggaacatgggtgagttgcaatacttggttctctctgagaacaaactttctgggacaattccaagaaccatatgttccaatgctacaagtttggagaatttaatgatgtcaggtagtggaattcatggtgagataccagctgagttgggtcggtgccactcactgaagcaacttgatttgtcaaacaattttctcaatgggtcaatacctattgaggtttatgggttgttggggctaactgatctattgcttcaaaccaacactttggttggttcaatctctcccttcatagggaacctcactaacatgcagacacttgcattgtttcacaacaatttgcagggtgatctccccagagaggttgggaggcttgggaaattggagataatgtttctctatgataacatgttgtcagggaagattcctttggagattggtaactgttcaagcttgcaaatggttgatttgtttggaaaccatttcagtgggagaattcccttgactattgggaggctgaaagagttgaatttctttcaccttaggcagaatgggcttgtgggtgagattcctgccacacttgggaactgtcacaagctgagtgtgcttgatttggcagataataagctctcaggtagcattccttctacatttggattcctcagggagttgaagcagttcatgctctacaacaattctcttgaaggtagtcttcctcaccaacttgtaaatgtagcaaacatgaccagagtgaacctttcaaacaacacactgaatggtagtttggctgcattgtgtagctctaggtcttttctttcttttgatgtcacagataatgaatttgatggtgaaataccctttctcctgggaaattcaccctcccttgagaggctgagattaggtaacaacaaattttctggtgaaattccaaggacattgggaaaaatcactatgttatcgttgttagatctctcaagaaattcactcacaggaccaataccagatgagctttctttgtgtaataatctgactcacattgatttaaacaataaccttctatctggacacataccatcatggcttgggagtttgcctcagttgggagaggttaagctctccttcaatcaattttctggttctgttccactaggcctattcaaacaaccccagttgctggtcctttccttgaataacaattctcttaatggaagtctcccaggtgatattggtgatcttgcatctcttggtatcctcaggctcgaccataataatttctctggaccaatccctcgctcaattggtaaattgagcaatctttatgagatgcagctatcgaggaatggctttagtggtgaaataccatttgagattggaagtctccaaaatctccaaatcagtttggacctcagttacaataatctatctggtcatatcccatctacactcggcatgctgtcaaaattggaagtacttgatctttctcacaatcaactcactggagaagtgccttcaatagtgggtgaaatgaggagcttggggaagcttgacatttcttacaataaccttcaaggcgcattggataagcaattttcccgctggccacacgaggcgttcgaaggaaatcttctttgtggagcctctcttgtaagctgcaacagtggtggtgataagcgagcggtcttaagcaacacatcagtggttatagtctctgcactttcaactttagctgcaattgctctactgatacttgtagtgatcatcttcttgaaaaacaagcaagaatttttcaggagaggcagtgaattgagttttgtgttctcctcttcatcacgagcacagaagcggacattgatccccctaactgtgccaggaaagcgagatttcaggtgggaagatatcatggatgccacaaacaatctaagtgaagagttcataattggttgtggaggttctgggacagtgtacagagttgaatttcccactggagagaccgtggctgtcaagaagatttcgtggaaaaatgattatctgttgcacaaaagctttataagagaacttaagactttagggaggatcaagcacaggcatctggtgaaattgttaggttgttgtagcaatagatttaatggaggaggttggaatctgctgatatatgagtatatggagaatgggagtgtttgggattggctacatggggaacccctcaaattaaagaggaaacttgattgggacacaaggttcagaattgctgtgacattagctcagggagtggagtacctccatcatgattgtgtgccaaagatccttcacagggacatcaaatctagcaacatattgctagattccaacatggagtcacacttgggagactttggtctagcaaaaacactctttgagaatcatgaatctatcactgagtccaattcttgttttgctgggtcttatggctacattgccccagagtatgcatattcaatgaaggcaacagagaaaagtgatatgtacagcatgggaattgtgctcatggaacttgttagtggtaagacaccgacagacgcagctttcagagcagagatgaacatggtgagatgggtggagatgcaccttgacatgcaaagcactgcaggagaggaagtgatagatcctaaaatgaaaccccttttgcctggtgaagagtttgctgcattccaggttcttgagatagcaatacagtgcacaaaaactgcaccacaggagaggccaacggcacggcaagtgtgtgatcttcttctgcatgtgtcaaacaacaagaaggtggagtttgagaagacgaatctggatcattactag

SEQ ID NO: 64406 - DNA, 723 bp, Glycine max
  Peptide Sequence Number=SeqID_181184
atgggaacctcgagggagatagcaattggtccggtggcagtggtttctcttctgttatcctcaatgatggagaaattagtagaccctgctactgatccagtgggttatacaaagctgattttgcttgctactctctttgctggtatctttcagacttccttcggactcctcagacttgggttccttgtggatttcctatcccatgctgcaatagttggatttgtggcaggagcagccattgtgattgggcttcaacagttaaagggactcttaggaatcaccaatttttcgaccaagaccgacatagtctctgtcatgaaagctatttgggaagcagtgcataatctaggtaaaaggaagaagaaactattctggttggcatcaatctctcctcttgtatctgttgttgtgtcaactttaattgtgtttatcacaagagctgataaaaatggagttaaaattgtgaaacatgtcaaaggggggttgaatccaagatccatccatcagttagacttcaacaacccctacattggagaagtggctaaaattggactagtggttgctgtcgttgcccttacttttttaaagaaaagaaaatggaagagatgtcagtcaggcttttcacttttaattcttgacacctccaatttggtgaacattgacaccgttggaatcactgctctagaggaactgcataaaagtttgtcttcacatggaaaatag

SEQ ID NO: 64407 - DNA, 942 bp, Glycine max
  Peptide Sequence Number=SeqID_181185
atggcttgcacgaagcatactacttgtgtctcaaatgttaaggcagagaggcaacttgtgactgcattagcatgtcgtgatacagaacccccatttggaggagaccctatggatttgactctgcttcgatcctataaggatcatatagctagccatgtattgatcagtcatcctagagacaaactaaaattggttagccatggtggtaaggttatggactaccctaccaatgcgacggtgaaggggtacatggataggtcaaggctgaaggttagagagatgaccatcaccctcaatgatttgtcatgtcttttacatcttatcacgggtcgtttccttgataacacaaacaccacctacaacaaaaaggagatcaaaggtctattaaggttagagcttgacattatgacggtccaggaagcagatgttatgacgtcatcaggcaacgaggtgtttgagcatctattgatcattccttgtagtgagaaggtgttgaataatgaccgtgataagccgcttacagctaggtggttactgttaaggggtaccgacaaggctaatggaaccaggcattgcacttttgctacatcaaagttgggacatacatacagtcgcacgggccgagtgggaatagcatatggtggtggtggacgaggctgttccacatggggtttcatgcctcagccacaacctagtggtggtcagatgtcagattatgtactaggtgttgtttgctcatgtcaggatcaatttcaaataatgtcagcatccacacagagacaattgggcatgagagttgttcctgaaggcacaaatagtcatcaggtcatacaacagcttttattgatagcacaaaagggtcttacagttggacgtaggtcaactgaggagcgaccgccaccaaggaagaaagctaacaaaggtggccgcaagggcacttga

SEQ ID NO: 64408 - DNA, 435 bp, Glycine max
  Peptide Sequence Number=SeqID_181186
atgtctccttatcgggttgtctttggaaaggcatgttatcttccagtggagattgagcacaaagcatactgggcagtaaagacctacaacttctctatggatcaagctggtgaggaaagaaagttgaacctgaatgagttagatgagatcctcctagaagcgtatgagaatgccaagttctacaaagaaaagaccaagaagttccatgacagcttgataattaagaaggacttcatggttgggcaaaaagtgttattgtataattctaggcttggactcatgagtggtgtcgcaacctaccctccggcaggagggcgacgcgagactcacgggtgcgtcttccaagaaaggaaaacgcgcgaagtcgccaccaacgtttattcgaggaaaacgtcggataaactggaaaagacgtggtctacgaactttaagtga

SEQ ID NO: 64409 - DNA, 411 bp, Glycine max
  Peptide Sequence Number=SeqID_181187
atgaaagatgaaacaattgaacaaagtttgttgacactgtcccttgaggaattttttacgaaccatttccgtccgccaccaactgttgtcatccaacaagctcttctggcagcaacaccatcgtcggaatcgcggttcgctgatctacactacactgttgacgatgtccttttccgatcacgaacatgccctcacattctgttcatgtttcctatggtgtctattggagctactaaaaaatctaaacttgaggccctgctttcaaacttcacactttccagggagaagttggacaattccaattactctacatgggcttccaacattctcctttggattagtggtcaagggtacaaagagcacctcacttctattgttgattctgtaccaaaagttgaacatgctaagtga

SEQ ID NO: 64410 - DNA, 267 bp, Glycine max
  Peptide Sequence Number=SeqID_181188
atggctttagtaacatgtgagctgatttggttgaagcaacttattagagagctcaagtttgaaggagctgcacaaatggccctgatttgtgataatcaagcagctctacatattgcatcaaatcctgtttttcatgaaaggacccagcacattgaagtggactgtcattttattatacagaaaatcgagtcagatgtgtttaccaaatccttgaggggtccatgggttaactacatatgcattattgcattagttacaaataaatag

SEQ ID NO: 64411 - DNA, 189 bp, Glycine max
  Peptide Sequence Number=SeqID_181189
atggtggggaagataatgtcgcaaaattttaaagtggactctagactcaattaccaagcagttgttaattcctgcacctccaagttgcttcccgcaccctgtctagaatgtttattttacattttgaattggtcattctcgaagccattaaggaggtgtaggaagcaacttggtaggtgcaagaagtaa

SEQ ID NO: 64412 - DNA, 663 bp, Glycine max
  Peptide Sequence Number=SeqID_181190
atgtctgtgatatacctcaaatggtcgattctgaggaagattctcacaaatggccagttccgaggaggatgctcagatgagtcttcctatgacacaaagggaagaggaggaatagaaataacaggttgtgagaacatcaccccaaaaacgggaagggacattgccatggagaagaagtgtctgggttgtttcaacaagatgcttgtttttgcgttcaacaaccccattttgttgagggaacaggaagaccaagatgtcccaactgagcatgtatggcaagtggagatgttgcggaagaacacgcttgttgtgaggctaacagtagttggaggtttatcagttgttgaggaactggccacattagtaggacaagtaggcctgttgcaatttccattccgagaccgagtcgatgctgacccactacttcgagaggcaagggcaaaagtatcacctacagaagccaaagatgaggcaccagtatgcttaggtggaattcatagaagggcagaagatgtcctagtcatagaggaaaaagttcattatagtcatggaatgcagtatggagtcgaccaagataggcgaacatcaagccatcaaaccgttgtggagcaacgacagtcatcaactcttggcacactatatagaggcactgagcgtcattag

SEQ ID NO: 64413 - DNA, 354 bp, Glycine max
  Peptide Sequence Number=SeqID_181191
atgccgaacaccttatcagcaactattggagaaaacaaatctgatcaaaatcaaaacaaaatatcaacacaaattagaatcattactcagagcagtcacataaaccatccctgcaaccacacttgtgaagccatgaagccatcacacaagacatgttcttcattccaacgaaaaagagtttggacagaagctagcagagctgctggagtcgtcaagaggagaggagtcttgagtggtggtggaggaaaaagagtgtgtgtggcagtggagcaaaaatgcaacgaccaagcgatggtggtgattggtcggagatggcatacagtagaggtgggtacaattgttggtggtggttga

SEQ ID NO: 64414 - DNA, 252 bp, Glycine max
  Peptide Sequence Number=SeqID_181192
atgaatgctcatccggttagcaagccaaaccctcatgacctccttgctttcgaggaaaatatgttcaatagttttttcaacctttttacaacaagggcatattggatcaatgttgggcatcttcctttggaggttctctctaactgggataatattcttacaagctcttggtaccaggtttttgcacttaggatccacattgaccttccaaatgttttgccaaaaatcaccagggggacaaaaactctatag

SEQ ID NO: 64415 - DNA, 894 bp, Glycine max
  Peptide Sequence Number=SeqID_181193
atgatcgactcttccctggctccaatcaccttattggatcctgaccctccatctaaccttaacctacccatttctctttggaaaggtacacgttccacaagtaacccatctcctcattatgttactttgagttatcaccatctttctccttcactttatactcatctttctttgatgtcctctgtgtctattcctcactctacaggtgaagctttttcccacttagaatggagacatacaatgattgacaagatgtgtgctctccaaagaagtggtacttgggatttggttcctctagccctgggaagaccccagttggatgttgttggttatacaaccttaaagttggacccgatggcaagattcattgttttaaagcccgcttggtggcaaagggctactacactcagatccctctacggacttaaacagtttccaagagcatggtttgctagattttgtactgttgtacaacagtttgggttggttcatagtgaagctgaccacttagtttttgatcgtcattcaccacaaggatgtatctaccttgtgtatgtagatgacattgctatcactggagaagaccagcatggaaaagcacaattgaagcaataccttttttgtcagttcccaactaaggaccttgggaggtatttcttaggtatagaagttgctcagtccaaagatgtcagtgtggtgagccagttcttgaattcttcctgccaggatcgttgggatgcagttatacggatcttgaaatacatcaaagatgctgatagggctgggtctcctagtgataggcgatccactttcgggtattgtgtaatgattggagggaatctcatgtcctggaagagtaagaagcaaaatgtgatggcaagatctagtgcttaa

SEQ ID NO: 64416 - DNA, 2403 bp, Glycine max
  Peptide Sequence Number=SeqID_181194
atggcatcgtcccaggttgaaatcgcttcttcttcgccgtttggttgcgttttgagggaccgcaatcaccgcgaagcatgcagcagggaaagcagcaacgtgaagggcacgcatcatcatgctacgttccaaagaaacatgaagaactttgtgatggaccttaacacgtgcatggtagtgtcttctgattcgacaacaaatgaaaatgaaaacaacagcagcagcagcaacaacaaccagcggaaggctccaaaaaacagccacctagagaggcttcgtatcacaccagccaacccctttattaacaacaacaacatcaacaacaatgaaacctcgttggcctcgttgatcagcccgagacactcgcggcttctcgatcgatgggccacgagacagggttgccagatggtgtcgaatttggagaatgaggcagagttgttgtcgatggacgacaatgacatgcttccaaggacttctagttcctccgaggaggaggactcatcctcggagactcaaaacctgggtggtgcctcttctcttgttcagatatgggagaagaggctgaaccaatccggtgtctccaaacccaatacaccaagggagaggattggttcgacctcttcttccataaatgagaatgctaatgctttctcttcggagaatgctaatgctctcactggggaggaacaatgctttgatggaccctcagggaacgaagaatctttgttccctgattgggaatctagtgatcattccctttcgccaagtggcaggtcggagagggacagggtcagggttgctgacatcataaagaaactcactgctacaaacccgaatcagagtccaacaccttcctttgctgatgacaatgaacatgaagggtatggtagcagcgtgacaggttctccttgtagggagcgtgaatgtggtaatcaacaacaacaacaacaacattcggagcagaaccagagagttaattgttccttgcgaattagagggcgccgggcatacaatgatttgcttgcacagatgaagaatgacaggcatggggagcttaacaacctggtagagcgtggagcagtctccaagttcccacaaagaggtcgcattcaggcattgcttcgacttaaattattgcaacgtggcacggcagctaatgattcgacccgccagaaatcaacagcatctgaagtaaacaacagacagccacagggatctgcaattatgcaattaagggaaaggtttagcagtggggctgaacttagaactgcggtccaggcagaagtagctaatccaaaaagtcctcaaagggggacagcaaacaaaaccacacaattggataactctgccaccactgatcatctgagcaaagacacaagcaacaataaaggtcatggcaatgccaatcatgccacagaatccacacaaaagtcggcgtcacagactagaatagatcataacacagaagaagctcatccaagttcagatgtcaaggtccaagaaacacgtccaagttcagatgtcatgactccacacaatgactcacaagaaactaccgaggcaagttcatccacaattggttcaaatctaaatgagataatggcagatagggcagagacgagcaaccaacagaatgctatggctaaaagcagtaatgatgagacattggatgaggaagtggaaagttaccagaagtatgccgaaaccagttatgaggagaaagtagaagaggcaagtaatcacaactatggtgatgagatggaggaagaggtagaggaaattgaacagaattgttatgaaactaattatgactggatcagtgaaatttctaggcctaggagctattgggaagagcgcaggcaagcatggtatagagagatgcttgaaactggttctcaaaatgaagatatacgaaggcttcttgaaagaagaacagtgtcaagtttcctttctagtgacttcagggatagaatggatagattgatggaatctcatagaggaacacaaacacatctagtcagtagtcaagagcgtgaggaagatagtcatggattgatggcatttttacaagcacgcttgcattctacaatagcttctcaagatggaagagatgcgagggaggaagaagaggaggagagtagaaatcaaaatgaggaagaggaagaagaagaggaggaggataatgcagatgagcaggagcaggagcatgaggaggagagcttgataagtggtttgtatcatgaagctggcgattattctaatggatcctcatcatggagttacagggacatcgaagctggttatgatttcgatagagttgtttctacatccccacaaccttatcaatctcaatctttctatccagaaagtcggcactctccatccaccaatcatcattcaatt

SEQ ID NO: 64417 - DNA, 1292 bp, Glycine max
  Peptide Sequence Number=SeqID_181195
cgcaccggacaccacgcgacgtgcggtgctcttccaaccgctggaccctacctccggctgagccgtttccagggtgggcaggctggttaaacagaaaagataactctttccgggggcccccgccgacgtctccggactccctaacgttgccgtcagccgccacgtcccggttcaggaattttaacccgattccctttcggagtacgcgcacagagcgctatcagacgggcttcccccgtcccttaggatcgactaacccatgtgcaagtgccgttcacatggaacctttcccctcttcggccttcaaaatctgcaccgacgaccgctccgcccgggctcgcgccctgggttttgcagcgaccgccgcgccctcctactcatcggggcttggtccttgccccgacggccggtctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgacccttcacagaagatcagggtcggtcggcggtgcaacccacagggggacccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 64418 - DNA, 767 bp, Glycine max
  Peptide Sequence Number=SeqID_181196
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggcccccggaaagagttatcttttctgtttaaccagcctgcccaccctggaaacggctcagccggaggtagggtccagcggttggaagagcaccgcacgtcgcgtggtgtccg

SEQ ID NO: 64419 - DNA, 171 bp, Glycine max
  Peptide Sequence Number=SeqID_181197
atgaccgagccagccagccagggcccaggtgcactcctaagccaactcctgccattgcagataaacgttcagattccaagccacaagggttacgaggggaccaggtttcaaaaggagatccaaaagctgcaagcagcaagtacggcaactagccccactagctttacttga

SEQ ID NO: 64420 - DNA, 1545 bp, Glycine max
  Peptide Sequence Number=SeqID_181198
atgaacgaggattgcaattccagaacagcgtcgctgttgttgtcctcatcctcctccccttcgaattccaagatcgtgggagataagcgtggaagctctcacgcgggtcacggcgctcggaaacgggttaagatgaaagatcttgacgccgttgttcactctgtggaaacgaatagccgttattcgggattcaaaaacgacaaagaaaacactgtgcagtggtcgttgggagctacggatggttctcaacaagcgaaaacgggaaggaaagcgatgtcagaagagtttaattttgcggctaggcctctggatctcaacactgatgtgtgcaaaagtggagggtgtgagaagcaagaaaaaggacatgctaatttagtagtctcgaggggaattaatgtggatctgaatgtagaagatgttaccagccctgtgaatttggaagccgcgaattcctctaaagggcacaatccttttaagtcgaaggatgtgtccgagagtgggagctgtgttggacctttgggggataaagatccgatgacgaaatggaaacagatgaaggaatatggtttttggtcgccctctcacgctggcattccaaagccaaaacaacgtggaaggaaaagtaagaatgaagtgcttaagagaaagatagagcttgcgaagagggaacaggttaaccggtttaccaagattgctgctccaagtggactgttgaatgacttgaaccccggaattataaatcatgtgaggaatagaaaacaagtgctttcaattattgagaatcttgtaaggtctgaaaaacatgaaagcactagcgcggggagtaagcaagcagcacatcgaatacatggaagtgtagaaattagtaagagggatcaacaaaatgtggctgatgtaggtgagcatcagcatgcctttgcttgtgaggaaggggcccttcatagctcttcagggaacagacaagctagaaagtttcctgtgacaatggatgattcttcttctttgattttggagggtaaagtttgtgatcgtgacacaggcactttagagaaaggtagtcttaaaggtggtgtgacacagtcaacgaatgttgcagaggatgatgttttggctctgaaactatcatctgaaacgagggcatcaatgagttccaccactttgtcaaatgaggaatcctcaaatgtcactatggtttcatccctttccctaaaaggctcgtatttctttgagcctttgctgatatggatgcttctatgttttccagctgctactgttgcttctcaatggttggagcttctacaacaagacatcaaaggacgcctttcagctttgcgtcgtagtagaaggaaagttcgatctgtaatcactactgagttgccgttccttttatcaaaagaatttggaaataaccaagactatgatccttgcactgtggaaatgtctgcgggacttcccactagcaaaatagcagatatgcatcgggcaagatggagttctttgtttgatcatatggatgcagctctttctgaagaggaaaaacaactt

SEQ ID NO: 64421 - DNA, 471 bp, Glycine max
  Peptide Sequence Number=SeqID_181199
atggacattgaagaagatgttgagatccccttgattttgggtcggccattcatggtgactgcaaagtgtgttgtggacatggggaaggagcaaaaagctaaccttgttggggggcacctgaattttgtgtttctaaaagaagatgaagccaagccagttatgaatcctacaaactcttctagtgtctttctaaggccaaaacagttcctccctatgttgcatagcctccatcatggccagtatctattgatgcaaagcctccaccatttttccctccagcagccgatgatgacaccaaaggcattcctagcccaagttgcttggccaaaaggccaatgtccttctgttaaggtgggtgacacctttggtgtagctgatgatgatgccgcagatactgaagctgatgatgattatgttgcggacatcaatgatgctcatagagcttgggatccaaggcccacacaggattaa

SEQ ID NO: 64422 - DNA, 183 bp, Glycine max
  Peptide Sequence Number=SeqID_181200
atgtttgagaattcgttgcgtcaacaccaaacaaagttgaccaatagatcacttgttggtcatgggtttgaatccggaaacagcctctttgcatatgcaagggcaccaggttgggcttcgttgtgggcttttccatgcgctaagcctgagctgtgcactaagcctgggtggcgcactaagtga

SEQ ID NO: 64423 - DNA, 153 bp, Glycine max
  Peptide Sequence Number=SeqID_181201
atgatggccaaaggttgggagctttgtttggagcttcaatggagaatgaagaagaagagaatggccaacctatgccacatgtccccatttgagtggagcaaaaagggcccactttctcttttgattgtgacctatactcagccacaaaagtga

SEQ ID NO: 64424 - DNA, 327 bp, Glycine max
  Peptide Sequence Number=SeqID_181202
atggccttcatgtcggcctccatctactcttgtacctcctccgctttactcattactctagctctagcacagattttcaacatggtccatgacatctccgtcaaggtgaaactggaagtaatagggacatcgacagctctaaatgtgtttggcattagacgaaggagcgatgtaacacgatccatcttttgccccaatttttgcaagatggttacttccatgcttcaacttgactcgatgaaccttttcgtaaaagcgcgagcttggttcaaccccataacccagggaatggcaattgatcgccaatacttcatcaacaattcatag

SEQ ID NO: 64425 - DNA, 225 bp, Glycine max
  Peptide Sequence Number=SeqID_181203
atgggtgaccaagaggagacacaggaacagatgaaagccaacatgttggctttgaaagagcaaatggcttccatgatggaggccatgttaggaatgagacaactcatggagaataacgtggccaccgctgctgctgttagttcggctaccgaagcatacccaactttcccagctaccgcgcaccatcctctcccaaacccggtaggacgaggtgggatcctctag

SEQ ID NO: 64426 - DNA, 546 bp, Glycine max
  Peptide Sequence Number=SeqID_181204
atgccagctggtctctgctattctgacccaggtatcacgcctccaatacactcagtggacccagaaaagtccaacaaagcactgggatttccagccttgatcacaagtctctggcagttctatggggtgccggttacgcccacaaagctcattcggcctcccattaatagatcgtccattgagaagtattgcatgccaaggcaggcacaagagccgaggcaggaccagcagcacccggccgcagatgcacccctaccatctctacagcaaccaccatctctagagtccatctcaactcacatgcaaaggatggagctctacatgcagcatttggctaaccagcaagtggccaaccataggagtcaagaccccagcccttacccatggcctactccagggcagttcagggccactgtagcatggcttggagacatgcctaattttcaagcaggggcaagtcccgcagaggccccaggaggtgaagacagagctgaggaagacagtgacatggcagatgtcatggatttcttccttggaggagactga

SEQ ID NO: 64427 - DNA, 309 bp, Glycine max
  Peptide Sequence Number=SeqID_181205
atggaaggtcctacttcggttgctagggagggactttggcaagagctttgtcaccttgctgagactttgcaacgaccattggtagtgctaggatttgattaccctcggaaagtcgagcaggcaatgttagacaaaagggacaaagtcactgtcagtaaagtggctgcaaagacctacatccaaaatcccatgggaatcccattccgtaagattttaccggaagattttgggttacctgaggctgatatttcagtaaactgctattgtaactgcttctgcaaggacaacatctgctattttgtgaaatga

SEQ ID NO: 64428 - DNA, 240 bp, Glycine max
  Peptide Sequence Number=SeqID_181206
atgtcgatgcagtgcgttgcaacgtcgtggtcgtccacaacgacgtcgtggcagttcccgacgaggagaggggggagggctgccaaaaatcgccttttcaagtggcatgcagtggttggaatagatgagaatggtgggaactatatccttgatcaaacggggaactgcaaaattcatcataaaccaagtatacgaggaaaagaaaaaacatgcaaaaagattcaagaagtagccatataa

SEQ ID NO: 64429 - DNA, 780 bp, Glycine max
  Peptide Sequence Number=SeqID_181207
acgccgtcgcatccgagctgcatcatgagcgcggcgtcggcgggggtggcgactccgccggcggcgaagtggacgacggggaggcggccgagctgtttggtctgcatgacgaggtcgtagggcgcagcgatgctcttggcgaaggtgaagacctcgtcgtcgtccatgttgcggagaaccctaatgtcgctcatgacggaacgcacgtggcgaacggcctcgatgatgttgccggtgccggcctcgcccttggtgcggatcatggcggcgccctcgcggatacggcggagggcctcgccgaggttgcggcagccacagacgaaggggatgcggaagttgtgtttgttgatgtggttggcgtcgtcggcgagggtgaggacctcgctctcgtcgacgtagtcgatgccgatggcctcgaggatctgggcctcgacgaagtggccgatgcgggccttggccatgacggggatggtgacggcccgcttgatgtccttgatgagctgcgggtcgctcatgcgggccacgccgccctgggcacggatgtcggcggggacacgctcaagggccatgaccgcgcaggcaccggcctcctccgcgatgcgggcctgttccgcgttgacgacgtccatgatgacgccgccgcggagcatctgggccaggcccactttaacggagaagggggacttcttggtctcggtgattgcaccgttgccgtacacttgagaagagaaaggaaaagaattagaaggaagaaggaaggattgttgttgtgcggtgagg

SEQ ID NO: 64430 - DNA, 1050 bp, Glycine max
  Peptide Sequence Number=SeqID_181208
atggcttctgcacaagtagataaaaccaacatagaagttgatgatttccttgtaagggagattgagaaaccaagaaattcaaccatggagagcttgcaaaatgaaaagcaaattatggtggatccactttcactaaaaggttctcctattaaatacactaccactatgcttccaactataatcacaacttcatcatccatcattttgcaccctccaccactacaacctccaaagccaagattcttaagcacaagtctcccaaattcagctaactcatcgcctcgatttgcttcaccactttccaagaagaaacaaagaggagagagcccggaatcacagggccacggaagtaatttgacccacaaacttcagcatttgctacaagaagtgcatttaaggaagagcaagtcatgtggtggagcaatagcatttgctacctcagatgaatttgatcactggttgagcaaaataagtgcattggagcatgaaaagtggcaccatgacaacttctccaaaattgaagttgtcaaagcaagtccaaagagtgttaagcttaagcacatgaaaactgcacatgatggatttaaatgcagtgccctttgcctttatctacctggctttggtggtaaactaaagccagttaaagcaagaaaggaagaatcagaaaagggtggtacaatgtctaggacagtttccttggaaaaatttgagtgtggttcatggtcttctgctgcaatattcaatgagattgaaggggactccactaactcctactttgatttgcctatggagttgatcaaatgcagtgccaatgaagtgtattcgcccgttgcttcatcttttgtttttgaaagagaccttaaaggcattctgaagaatggttcctctagagctagtgtcagaaaatcagatgcatcgcctcgccatgttcggttttctacatcatcttctgcatcacaccctgcctctccagcgtcctgcatctctcctcgtttgaggaaagccagagaagatttcaatgccttcttagcagcagcacaaagtgcatga

SEQ ID NO: 64431 - DNA, 1698 bp, Glycine max
  Peptide Sequence Number=SeqID_181209
atggagggcaaaatcttggattctcagaatcaggttaaatttgtggaaaatttatctgcaagggtttctagttgctcccttggcgacaagatatcctattccgattctcctctggatgatgaggtggatggtcggaggagcaattgtgttactaaagagtattgtgattcgtttttcaatgatagcactgaagggcattgtataaattcttctagattatatcttgaatcacccgaaaaacaaatggaaaagaataacgaggacatggagtcttcagctaatcttcagaagcggggaaagtacttctattatgatactccactgcaagaagatactggagtttggataccagtttctgttccaccaatgttggaagatgatcacaaagagtggaccaaaggttttcactcaaatggtggctattttcctgatgatgatatgggatggaatcaatacgttggagatgaaagggaattgactatgtgggatgtgctagcagaaatgttacttgtagctcgaggaaaagtgacttctttggcatcgggagatattcatacatgtaatttttcatggatatccagccatgtgcttgaacaagcttggagagaaatggcacaaactctcacagaggccaactttggtaatgtaaaggaactactggaagcagagcctccaaaatggttagcagatagtgctgcttcttcttgtatgctttgtggtgtgagatttcatcccatcatgtgctcccgtcatcactgccggttttgtggaggaatattttgtggtgagtgttccaaggggcggagtttgttgccttcaaaattccgagtttctgacccccaaagagtatgtgatgtatgctgtgtccgacttgactctgtgcagccttatttgatgaatcatgtaagtaatgctgctcagttgccaacccatgacctgacagatctgagcactttgagatcgtggattaattttccttgggggcagtctatggaatatgaaatttacaaggcaactaacactatcaaggcttataatcagataggttttctaaagccggagaagtcaattccagatgccattctaagacaagcaaaaggccttgcaattatcaccgtggtcaaagtaggagtggtggttacttataatattggaacaggacttgtggttgcacgtagggaagatggttcatggtctcctccatctgctgtttccacctttggtgtagggtggggggctcaggctggaggtgagttgacagacttcattattgttttgagaacaaatgatgctgtcaagacatttagtggcaatatgcatctttcacttggagctggtttgagtgctgcagtaggcattgttggtaggtcagttgaagctgatgttcgagctggtgatggtggctatgctgcttgttatacctacagctgcagtaaaggtatatcaaattcttcaacaatagatacacgtgcagctaatgttccactcttaagtgagcacagttcagtagaaggtgcatttgttggatgttcacttgaaggaagtatggtgactactcgcacacaagaaaattcccttttctatggcagccaatctattactgcaacagatatacttcttggctcgttgcctaggccacctgctgctgccattctctaccgtacacttgttgatttgtattcgaagtttgatgattaa

SEQ ID NO: 64432 - DNA, 237 bp, Glycine max
  Peptide Sequence Number=SeqID_181210
aatcctaacagagcaaccagaggaaaagttctagaaagtactgaaaatgccacaattgctaacggagaacgtttgagcaactacattgaggaatatgaatgtgataacttactcttcatgtattgtctgtgtttggatcctgtgatgatcttgaacctcgtattcatgggagcagatgactatgtggattactttaaggaaccttatgctggaggaagtcacgacacaatgctttga

SEQ ID NO: 64433 - DNA, 531 bp, Glycine max
  Peptide Sequence Number=SeqID_181211
atggcgttctctctcttcatccccagccaacccttccctttggtgccaacccttcttcttctcgttctcctccacgcttctctcttggaaccctctcacggcgctagaatttccaaggatgcttcaactcggcacctgtttgagtcgaggaacactaagcaccccaacaagtgtggagagttggtggcgctgtctcagtgctcgcagaactcaaagtgcagctggtgcaccagtgaggtccttgatgacatgtgtttcaccaaatctgaggcgtggaggttgccacaacaggtttactcttgcagcttgatccggctgtatctaggattaggggctagcaggactagacttcatttgagacaaaggttaatggagtggcagatgataatagctggaaatggagggaaagataacacagaattgtatatagaactaaagaggctggtgaagccaagcaccttcaaaactccctccccaatgctatactgccattggaaaagattcatacagtatgctataggattcatataa

SEQ ID NO: 64434 - DNA, 887 bp, Glycine max
  Peptide Sequence Number=SeqID_181212
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacttgaaggcagatatcacaaagaagtttctgagaatgcttctgtccagattttatatgaagatattcccctttccaacgaaatcctgaaatctatccaaatatcccctcgcagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64435 - DNA, 183 bp, Glycine max
  Peptide Sequence Number=SeqID_181213
atggggagaatcaaaatttcccacaacccagatctttgcgaattcggaaaaagaatgggaacctgtttttgctggcctcgatgtccgatggtggctgttttggtagaatgggtgttcgtgtttggctcagttcattttgggcttcaatgtagtaatggggacaagtacatctctgttgactaa

SEQ ID NO: 64436 - DNA, 606 bp, Glycine max
  Peptide Sequence Number=SeqID_181214
atgagttccgccattctagcctttaactctagtcacgagaagtcagaagggctaacccaaaaggactacatcatagggttctcttgcaccataggtgcaagcttcttgttttccttgtacttgccactgatggagaggatctacgagagggtttactgctacgaaatggtgatggagatgcagatcataatggagattgcggccacggcgttagtcactggaggcatggtgtacaaaggagggttttctgagatgagggaagaagctgagagggtttttgacaagggatccactttttactggttgacggttgtgtcaagtgtggtgacatggcagtgttgctacatgggaactgcagggttggtctttctcacatcttcagtaactggaggggtttctgctaatgctttgttgtccctgaatgtgttggcagggtggtttgtgtaccatgatgccttcaatggttttaagattgtggccactgttttgtgcatttggggcttctgctcttatgtctattgcatgtactttaaaaggaggcaagaggaggcagctgaaagaaggaacagcagtggtggatctaccacagagttggtagttaaatag

SEQ ID NO: 64437 - DNA, 213 bp, Glycine max
  Peptide Sequence Number=SeqID_181215
atgagggagcaagaaagaaagaaattagagatgatgagcttaattgataaaatgaaaaagccaaatataatggccaagagatacgaatgggaagctttgggaaaaattttcaagaaacacaaggatttattggacaagcaaattgacttgcatgagaggactcctcttcactacgcagcacactgtggcagggagacatcaagcgtgtgctga

SEQ ID NO: 64438 - DNA, 934 bp, Glycine max
  Peptide Sequence Number=SeqID_181216
ggcttctcgctgggcagctacgaccccgattacctggtgcgcttcccggtagcgctggtcgaggccgaaggccagatcgtggcgttcgccaacctgtggcaggcaccggccggcgccgagctgtcggtcgacctgatgcgccacgtcaacgaagcaccgaagggcacgatggacttcctcttcatcgaactgttcctgtggggccgcgcgcagggttatgcgcgtttctcgctgggcatggcgccgttgtccggtctggcccagcatcggctggccggtcgctggaaccgcctggccggcctgctggcgcggcatggcgaacgcttctatggcttcagtggcctgcgccgcttcaagtcgaagttcgatccgcagtggcggccacgctatctcgcggcgcccggcggcatgcatctgccggccgcgctgctggatgccacgcgcctgatctcgctggatccgcggcggaactgaagccgcgatgcgtcgggcatggcttgacgctacgccccacccttgaggatcacttcggccaagcgatcgtagtcccccccgaaatggtgatcgcccggcagcttcaccttcctcacgccgtcattggccggcaggtccgggcacagtgcgtcctcatccttgtcgccgtacacgcacaacgttttttccgccggcagcctggccacttccggcgcgatcggcaggccgtcgccgccaccgcccagccagttgctgacatggaattcgaagtcggccttcctgcccaccgacagcagcacgatgcgctccagcgcctcgcgggtaccggcgtcgagctggttgatcgtggccggcagcacgtcggcgccctgcgagaaaccgatcagcatcaccttgtctcggtgccactgctggcggtagtggtcgatgatcttctgcaggtcgcccgcaaagcccttcg

SEQ ID NO: 64439 - DNA, 234 bp, Glycine max
  Peptide Sequence Number=SeqID_181217
atggatccaatttgcttgatcatggcccaaggatcctggaattcatgctcagaatcactttcccacaaagatatggacttgataatagatatgcttcctcctttcatcaactccaacaaagtggttgatttatggggtgaggagaaggatgatgaggatgctgctgaagatgacaaagaagatgatggcctatatagagatttttgtgggtatctacatctatttcctcagtaa

SEQ ID NO: 64440 - DNA, 180 bp, Glycine max
  Peptide Sequence Number=SeqID_181218
atgaggttccacaacgtccacattgaaagtagtatttttgtcccatgcaacaaaacgcatgacaacactttcatgaatgtcatgggttctcctaagttccttcagtccatctccaaaaatgaatcggttagcatatttatgaagctttataaagtgcttgtttctttcgtagtcgaatag

SEQ ID NO: 64441 - DNA, 513 bp, Glycine max
  Peptide Sequence Number=SeqID_181219
atgccctcgccttcagaggactacacgccctcgcctttagatggctacacgccctcgccttcagatgactacatgtcctcgtctttagaggactccacatcctcgccttcacaagactccacgtcctcgcctttagagggctgcaagcccttgccttcaaagaactacacgtcctcacctttagagggctccacaccctcgccttcacaggactacacgtcctcacctttagagggttgcacacccttgcctttagaggactacatgtccttgccttcagagggctgcacgccctcgccttcagaggactacacgccctcgccttcagaggactacacgtcctcgctttcagagggctactcgcctttagagggctacacgtcctcaccttcagagggctacatgccctcacctttagaggactatattcctcactttcagaggactacacgccctcaccttcagagggttgcacgtgctcgctttcagagggctccacatctgcgcctttag

SEQ ID NO: 64442 - DNA, 1182 bp, Glycine max
  Peptide Sequence Number=SeqID_181220
atggtggaacactctgttagggttttggagagtgcggaaggggtcttggagaatacaacccgggttctagaaccagaccctgggaagggggaggatgatctatctaaggctacaaagaaggtcaaagataaggtgcctgagacacctttcgagtttcaaacgagcgagggagtgaaaggcaatggtgcgaatgataagtcatatatggattctcttctgactacaggtttatatcagggtcatgggggccaggatcttaatttggagaagaagatgacatggtggagaataatggggagaaaaaggatgttggaaaataggtttttaacccttgtccggttgttcaaatacctgatgaggagtttgcacagtagtgtgcaccttggaaggggcacagttcttaagattgacagacttatgccacgtgggaaatttgcaagaatctatgtggaagtcgactcggagaagcaactggtgtcaaggattaaagctagagagcacacgtattatgtagaaaagcaacaggtggtgggtgcgagtggtggaacgataacggaaaagctagtggagctaactagtgtggcgaaggaggcaactagggttgacttcactgttaatgattgcactattaatggaaatattgtagacaaatctggtgagattaatgagattgcaactgaaattaaatctcctatgttaggacttgaatgggttgatgctttagatcaactgctgactacggacccaccatgtgccaaggaattcggaaggaataaagatgttggtgccataaacagaggcaagaataatactaatgatagggataaaggtgttacctattcgggtaatttgatgaaaggcgcccagggagtacctagtgtcatagtgacacgtccatttctcaagtcaagaagggccacacgtttggagaaaggaaattatagcaaggagggagttcctaaggattatgaccctcgaggtggcatagacgagcatttattggatttgatgagaagaataaaggttcctttagaggtgctcaatgcgagtctagctctagatcaaatgggtgctgactctaatttggtggagatggcagatattcaacctcacgtggaggaaaggaatgagactatgggatctcctaataatatggacactgagaatctaagccttaattag

SEQ ID NO: 64443 - DNA, 162 bp, Glycine max
  Peptide Sequence Number=SeqID_181221
atgccagatttctacatcggttgtcctaataaccgatgtagaatgatcagcattctacatcgggtgttggattttcagggcatggattcaatatatgctcaccaagaacaaaattttgatgtctccaaacatatgcctgggcagtgtccatatgacaagtga

SEQ ID NO: 64444 - DNA, 606 bp, Glycine max
  Peptide Sequence Number=SeqID_181222
atgctcactctaactcacgttcttgctcacgactctttttcgctcaacacccgtagacagcgacagcaacaggttgttgtcgaggaccctcctacggccgaggaggaattggtcaacgaccagccaaaagcacctattgaagaaggtgctgctgatgttgagggttttccaggtggaccccatgacacatcagttttgagtgatcttgaaaatcacattgctttgaaagtgtggaatggagaggaacgtcctgagttgaagttatcttcccatggaaggaagatggttgagttcgggaggcctaccccagagattgaaggccttgtggtggctagtggactgagtcctttgatcgcttgttccctagatacgggtgatcggggactaatgtctacttttgtggaatgctggcctaaggaaactagcagtttccatttgcccgtcggagaggtgactatcaccttggatgatgttgtgtcgttgttacatttgcctgttgtaggggcgttccacagcttcaagctacttcatgtcgacgacactatcgagatgttggtggagttactcgaggtcaacgctgtagaggctagagctgagaccatttag

SEQ ID NO: 64445 - DNA, 306 bp, Glycine max
  Peptide Sequence Number=SeqID_181223
atggtttcgtttattcatggtaacccaaatctggaaattcgtatggggcttttggctgatcttatacagtttgtaataagcattcacatcccttcggtcgctctaggagactttaatgcttacaatttcgtgtctaagaagagtggagaagctccccctaaccagtctactatgatttgggtttcaaaggataattttgttgggggtgtgaagcctttcaaatttcatgcttgctggcttgtgaacaactctttccatgatgttgttaggggaacatggaatggtgcacaacattatttggcataa

SEQ ID NO: 64446 - DNA, 267 bp, Glycine max
  Peptide Sequence Number=SeqID_181224
atgggtcaaaacacaaaaacatcaagagcactcaagtttactcatcagaacatcaattggcttcccaaacgtcagaaagaagaagggattgaagcctccattttatattatcttaatgttattctgttttctctctccatggatattatttcacaaatcccaacggttaaggtttggtggtctgcgggaaaaagagaggattttgggaggagaagagagaaaaacgaaaatgaggggaagaggaggcatcgttggtctgaaaactga

SEQ ID NO: 64447 - DNA, 405 bp, Glycine max
  Peptide Sequence Number=SeqID_181225
atgagttattttacttccctttttggtgatactaagaggatccaagctactaacaacaccattcctgtgatctctcttgatgaggataagatgttttgggagactgttggagatgatgtttggaggttagtgcgagaggcctttgagacaagtatgtttaatcctaaagatgtcgagattttgattgtgcttattcctaagaatgatggtgccaagcatttgaaggacttcagacctattagtctctgttttatgatctataaactgatttctgaagtccttgtgaacagactgagaccctttcttagtaatttggccagccctatgcagagtagtttcatcccaggcagagagactactaataatgctatcatccactcttttctggagtcatttgctacttga

SEQ ID NO: 64448 - DNA, 247 bp, Glycine max
  Peptide Sequence Number=SeqID_181226
gggcttccttcaatctcgtggtgaaagaccttttagatttattgcagcttggtgtactcatgatgactacaagcatatggtgcacaatgcttggaacagatatgctaatgatgttctcacttccctggataatgtgaaggaagagacactggtttttaacaaggaagtgttagagagtatcttttgctgtaaagaaagagctttaggcaaggatcaaaggcctagagaagtacttggagaacgttga

SEQ ID NO: 64449 - DNA, 330 bp, Glycine max
  Peptide Sequence Number=SeqID_181227
atgtgttggcccaaaccaggttgtaagggaagcattggtgaagtgatggcagggacaagatttgggaacgtcttgggcaatgttatgaaacccggtctagtcattgacccggtcgaagtagtgggtcagtggtccaaccggtgggccgattttacactttgctacaccttattttctcgctttgaaacccttacactcctcttcctctttggtcatcaccgcttgacaaagtcaccgaagtttgacccctcccaggtcgtcgacgtcttcgtctgcgttatcggtagcgaggtcgatgcagcgagttccctcacagtgcaacgatggtga

SEQ ID NO: 64450 - DNA, 216 bp, Glycine max
  Peptide Sequence Number=SeqID_181228
atggagaagagcaaattcgatacattgatagcaatttctccaaacacatggcatgcatcaaattggaagtggaagttactggaaattgaagttggaagtggaagttggaagttgaaagttggaaatggaagttattggaagttgaaagttgaaaatggaagttggaagttggaagttggagggggaagttactggaagttgaatgttggaatttga

SEQ ID NO: 64451 - DNA, 411 bp, Glycine max
  Peptide Sequence Number=SeqID_181229
atggaagcatacggcggcttcatggtcgacgagaaagccgttagggttgagaacgctttccttgatttcctcaaaagcggaattagcagcttcaagtctagtagccagcggaacgaactttattacgaagcggagatcgaattgatgaagagcaatgaatccaacaccatgttcatcgatttcgaccacgtcatcagattcagcgacctcctccagcaaaccatctccgatgaatacttgagatttgaaccttatttgaagaacgcttgcaagcggtttgttatggatctcaagccatcacttgtgtccgacgatagccctgacaaggacatcaatattgccttctataacatgcccattgttaaaaggtctatggtttttcctatacaatgtttactcagtcttggttaa

SEQ ID NO: 64452 - DNA, 1203 bp, Glycine max
  Peptide Sequence Number=SeqID_181230
atgagtccttgtattaagatcaatacaagtgaaattgaattctttgatcaattagaagctggtggagaagcattagcacatgcagatctagtctcttccatggacaacacaacaatgcaggtgcatgcagatcaaaagggtagcagtagcactaaaaagaggtacattaacatcaacatgcccctttttgtgattaactatgcatgtctctttgtgggttcactttcttctagtttgctctctaagtactatttcacccacaatggttcaagtagatgggtttcaacttgggttcaaaccgcaggatttcctcttttgatgatcccaatttgtgttccttatctctttaaattcaccaagagggtacccttcactgatttcactccaagaatgttgattctctcaatttcaatcggtgttatgttaggattcaacaatcttttcttctcatggggaaattcataccttcccgtttcaacctcagcccttttgctatcttcccaactactcttcaaccttctcttctctgtcatcatagtgaagcaagaaataaccttttcaaacgtgaattgtgtgatccttctcaccctaagttccatcctcctagccttggactctagccacgagagaccacaagggctcacccaaaagaactacttcattggattcttttgcaccataggcgcaggcttgatgtttgccttgtacttgccactgatggagaagatttacaagaaggtgaattgctaccaaatggtgatggaaatgcaagtgataatggaggctgcagcaacagcattggccatagttggcatgacatgggatggtggattctctgagatgaaggtagagagccaaatggtgtttgacaaaggaagcagagtttattgggtgacagtgatgggaaatgtggtgacatggcagctatgtttcatgggaactgcaggaatggtgtttctgacatcttcattgactgggggcatttgcatgacatttttgttgatcatgaatgtgttaggaggggttgtggtcttcagagatgcatttggtggaatcaaagttgtgtccacttttctctgcattttggggttctgttcttatatttgtggcatctacaagtacaatcaaatgggggaacacaaattagctccaaccaggaacaagaatagtagtgatgattcatccactgagatgatccacatt

SEQ ID NO: 64453 - DNA, 363 bp, Glycine max
  Peptide Sequence Number=SeqID_181231
atgcgggtgaaccttacgaagaacgggccagctcgcttacccacccctagttggaaagggaagggaaggaggagagggattgagaaggagaaggatggggccttgtgtgcaaagagggggaagagatggtgggaggtgctaggaaaggagggtgaagagggaggggtggagaatttgaacgtgagaacaaaagagacttttcaccaaatgatagaggcaaatagtaaaagttgtagagctaataacaaatccctctatttcataacagattttatacgcataaatattggtggtcaccatttgtttcaaccattgattaaacaaaacaataatgatagcggatggatagatgagcccaaatag

SEQ ID NO: 64454 - DNA, 657 bp, Glycine max
  Peptide Sequence Number=SeqID_181232
atgggttattggaagtctaaggttcttcccaagatcaagaaggtttttgagaagaatagcaccaagaaagctgctgctgctgaggccaccaagtcctttgatgagtcaaaggaggaatacaacaaagcctttgaagaaaagaagactgaacttcaaactaaagtagttgaaatatacgaggcttcatcaactgaaatcaaaagtttggttaaagaacccaaggaagctggtttgaagaagaactccacagaagtccagaagttcctagaagagcttgttaaaattgattttccgggatcaaaggcagcatctgaagcatcttcaaagtttggaccagccttggcttcaggctcagttttctttgtgtttgagaaggtgtcaactttcattgttacagaagagaaagatgttgaagcccctcctggagtagaaactaaaacagaagaagaaacaagtagtgttgtcaaagagagggagatagtggttgaagaagagaaaaagaaagaaaaaaaggaagaggaaaaaccacaagtaatagagacaagtgatgagaaaaaggtggaagaaaaaccagctgagacttctgcaaaaggggaagagaaacctgctgaagaagctgctgcagtagttgagcaagcagaaccaccaaagccttga

SEQ ID NO: 64455 - DNA, 1935 bp, Glycine max
  Peptide Sequence Number=SeqID_181233
atgcaggagacgtccaaagagatacctgcaggctctcttcctaggtcattggacattattcttcgtcatgagattgtggaacatgccagagctggtgacacggtgattttcactggtactgtagttgttatacctgacataatggcattggcatctccgggagagagatcagagtgccgccgtgatgcttctcaacgcaagggttctacagctggaaatgaaggtgtgagtggtcttaaggctctaggagtcagagacctcaactatcgtctagcttttattgccaactctgctcagatttgtgatggtagaagagaaatagacatcaggaatagaaagaaggatgttgatgaagacaatcaacagtttactgatcaggaactggaagaaattaaacggatgaggagcacaccagattttttcaccaaacttgttgaaagcattgctccaactgtttttggtcatccagatataaagagagctatccttcttatgcttttgggtggtgtgcacaaatttactcatgaaggcatcaacctcagaggagacataaacgtttgtgttgttggagatcccagctgtgcaaaatctcaatttcttaagtatacttcaggcatagttccaagatctgtgtatacatctggaaaatcatcatctgctgctggcttgactgcaaccgttgccaaggaaccagaaactggggagttttgtattgaggctggtgctttgatgcttgcagacaatggcatttgctgcattgatgaatttgacaagatggacatcagagatcaggttgcaattcatgaggcaatggaacagcagactattagtatcacaaaagcaggaatacaagcaacacttaatgctcgtacttccattcttgctgctgccaatcctgctgggggacgctatgataaatctaaaccacttaagtacaatgtggcccttccaccagctatactttcaaggtttgatctcgtatatgttatgattgacgacccagacgatcagacagactaccacatagctcatcatattgtgagagttcatcaaaagcgtgaaggtgctctggctccagcattcactacagcagaactgaagcgttatatagcttatgcaaaaactcttaaaccaaagctctcgcccgatgccagaaaactattggtagactcttatgttgctctccgtagaggtgatacaaatcctgggagtagggttgcataccgtatgacagttaggcagttggaggcattaatcagactgtcagaggccattgcacggtgtcatttggacaatgaggtacaacctcgtcatgttcgtctagcagtaaaactgctgaaaacttccataataagtgtggaatccagtgagattgatctgtctgagtttcaagaacaaaaccacgatgatggtgcaggtggtggcaatgaaaatgataataatagagatgctaattatcaagaggggaatgatacagcgcagcaagctgctggaaatggtaatgatcaagtgggaaacgatgcagctcagcaagccactggaaataatggaaatccagcagatggatctaaaccccaagtgagaaaactcattatgagtgatgaatattatcagagagttaccagcgcccttattatgcgtctaagacagcatgaagaggctgttgtgcaaggagacggtttgtctgggatgaggcaaaaagatttgattcaatggtacgtagaccaacaaaatgagagaaacaactacagttcgatggatgaggtgcaagctgaaatttccaaaattaaagctattatagagagcttaattcggagagagggccatttgatagttgtagataatggggaagccgcggcagcagcagcagaacccccaggcgcaccaagaaattaccgaattttagcagtggctcctaattatgtcattgattga

SEQ ID NO: 64456 - DNA, 225 bp, Glycine max
  Peptide Sequence Number=SeqID_181234
atggtctccacctcaaactcaatcgcgacagagagaccaaagattatacggacagagagggtctcatcactgtgttcttttcactctcttttggatcttcaggagatagcgccgagatgcatgttttttgcagatgacatagtcctccttggagagtcgagggaggagttgaatgagaggttggaaacttggagacgagctctagaaacacatggcttcgcctaa

SEQ ID NO: 64457 - DNA, 369 bp, Glycine max
  Peptide Sequence Number=SeqID_181235
atgggtcacagagttctcttcgatgtaccagttctcttccggaaccaaggggacgctggagttgtcttcgaacacgagatgagacgctgggtcaacagtggaaaggaaggctgtaaaggaataatcccaaatttgagggaaataaaacaaagccgggtgccaaacttcttggtcaacaacaacaaatatcatctgaaaaagcctttcaatgcaaagcacaaaaatatagggagagattggatctctttgaggataattaggtgtaattgtgagggtcatgctttaggggtgatgacagctagcaatcacgctttaagtgtgttcaaattgatagcaggccgaaatattctttatcgagatgccatctga

SEQ ID NO: 64458 - DNA, 168 bp, Glycine max
  Peptide Sequence Number=SeqID_181236
atgtctagatgtgctccaaagccagaagaaaatacccagatgaggttgtctaagagctacggatttttaatcaggagtagatggacgttcgtgggatgttgcaagagagcgtggtacaaggtacaagttaggcttacaaaatctaaaatctccatggttaattgttga

SEQ ID NO: 64459 - DNA, 264 bp, Glycine max
  Peptide Sequence Number=SeqID_181237
atggttcctgatagagtcctttccttggcattgctcaatgtgacgggtggaggttttcaatgttttccaaagttggaccaaaaaacaatctccgttgcttaccgtttcttgaaagcgaagacacctgaacaaagggctgctgttgacttggacacccattactctcaagaatatcttgaagaatatgttggaacagataagaggagagccatcttatatcagttaaacagcaatataccagatgcatttataaagacaagttaa

SEQ ID NO: 64460 - DNA, 720 bp, Glycine max
  Peptide Sequence Number=SeqID_181238
atggaacctgtagatgttgaaggtcttgggctgcatgactattatcagattatcgaaaagcctatggatttcggaacgataaaaaggaaaatgaatgctaaggatggttctggttataagaacgtgcgtgagatatattctgatgtcaggttggtttttgagaatgcaatgaaatacaacggtgaaaaaaatgatgtccacattatggcgaagacattgctggaaaaatttgagaagaaatggctgcagctattacctaaagttgctcaggcggaaagagaaaaggaagaagcacgtgtgctgttggaagcgaagcgtgctcaagaagctacttatgccaaaatgacaaaggatataagacatgcgctgtgcgatgttgatgagcagttaaagaatctcaaagaaatggtgattaaaaagtgcaggaaactatcaactcatgagaaactggcacttaagaaaaatttaagcagactgaatggtggcaatctcctcaaggcaatgagcataattcatgagattgacccaaccttccaacatgatgctccacaggtcgaccttgaccttgatcgtcagagtgacttcatactgtggaaactaaacctttttaccaaagaagcactggaagatcaagacaaagctgctgctgaggagatggctgttaaccacaacgttaacactgaggaccagaaaaacaccaacaaaaggaggaaactgtga

SEQ ID NO: 64461 - DNA, 432 bp, Glycine max
  Peptide Sequence Number=SeqID_181239
atgactgaaacagagattgaggtgatcaaatctgcaggttttcttgtttcagtcatccatggcaggcatgatataattgctcagatatattatgcaaaaagacttgctgaaaggcttcatccagtggctagaatggtagatcttcacggaggtcatttagttaatcaagcactatttgacttgatcaaggcatcagaagtgaatatgagcccacatgattggactaatttgccaaagaaagagtcttttcaccctactcctcccttctcagtagcaactagcaaaacccaatttcattcaaaagtgttaactgataattggttccatacatggtttgattacttatctatcacccaacagcctcaagtcttcacaaagcacagggacatgtttcatcagtgcataatcagtcctagatggatttactggtga

SEQ ID NO: 64462 - DNA, 289 bp, Glycine max
  Peptide Sequence Number=SeqID_181240
tactttaggtgctgtttgtgctgttctccaattagaattggagaactacctcagtaatccacataataaaggtggtgcttctaattcacaaagaaatgttcggcatgtggactcctttggcgactctgattctaaggattctagtgaagaacagaatgaactatctgaggtaaaggaaagcaagaagaagaagaaaaagaaggagaaaaagaaaaacaaaaaacgaaagaattcagaggacccaggatgtgcagtggtgaaaaaacctaaacagaagtttaaattctga

SEQ ID NO: 64463 - DNA, 426 bp, Glycine max
  Peptide Sequence Number=SeqID_181241
atgccgttttgctacgtcggaacgcagccatcttcccccgtcgccgatgcgcccctcaataatgacatcaagatattctacagaacttacggtggcggtccaacgaaagtgcttctcatcataggattggccgcgacacacgaagcgtggggcccacaaatcaaaggcttgacgggaaccaccgtctccaacgacgacgacgacgacgacgtccgcgtcgtttggagcggagaagaagtaaatggtggcatccatgtatgcgcgtttgacaatcgcggcgtgggtcgcagctccgtggccgtctcaaaatctgaatactcaaccaagatcatggcaaaggatgcaattgctttgttagatcatctaggttggaaaaaagcccatgtttttgggcactcgatgggtgagttccgagtttgtcattga

SEQ ID NO: 64464 - DNA, 282 bp, Glycine max
  Peptide Sequence Number=SeqID_181242
atgttgctgaagaaatcaaaggagggtatgatctctctgtgtagttttcgttcaagaatgcagggcgaaggacggcgtcgggtgtctggcgggtctggaagagaagtgtcgggagagctattcagcacggcgaggggagacccagcacgtatgtgtgagagccatgccaatggcaatgcctggttttgcaagtcaacaaccagtttcaacctaaacatggaagagagtgaaggaactcaccaatttgggaaatgcattatgcagaacacttggccgaagtga

SEQ ID NO: 64465 - DNA, 294 bp, Glycine max
  Peptide Sequence Number=SeqID_181243
atggtgaaagaaatcgaaaatctgacagaagatgaaagacgcgcacttcgtggcagcaaattcgcccctcttccccgacgttccaattccaaacccaggttggctcatccctgtggacccttggcgacgaataaagcagcggctttggccaagtttctggagagaaagctgaaggacccaaatggattggcatctattaaccccgatctccttgaacttgctgtcaataatgctaaagaaactgtctatgcaagtaacacttctaactctttctctttttctctcccctctctt

SEQ ID NO: 64466 - DNA, 810 bp, Glycine max
  Peptide Sequence Number=SeqID_181244
atggctaagttcgacccagaaatagtcatggaattctacgccaacgcctggcccaccgaagaaggtttccgtgacatgcgctcgtgggtaaggggccaatgggtccctttagatgcagacgccctcagccggttcttggaccacccgctgatcctggaagagggtcagcaatgcaagtacggccagcagaggaaccaggctaacagtttcgacgaggaggccatcgcccagttgctatgtacaccggggcaggattttgcccggactgccgcagggaggcgggtgcggatcatgtgcaccagcatgaccgccctgacccagatgtggatgacactgctactcagcaacatcctctctagcgaccacaactctgaccttcccctgccgaagtgtcagctggtctatagctcccacgagataccccttggacccggagaagtccaacagggccctggggtttccgactctgatcacgggcctctaccagttctatggagtgcccgttacacccagcaaggtaccgggcggagcaccctagcaacaggcagtgggcgcaccgccaccacctcagcaggccacttcgaccagtccactgaacgtggagcattacctgcaacatatggttcgccagcaggcggccaaccaccgcggacagagcagttcagagctgcggtcgcatggcctggagattggcccgatgctcagacaagggtaggacccgtagggggccctggagccgaagaggaagcccaagaagatgaagagatgactgacctattcgacttcttgggagggggcggtgccaggtga

SEQ ID NO: 64467 - DNA, 162 bp, Glycine max
  Peptide Sequence Number=SeqID_181245
atggggcatctgtttaagcaactctcttcagttgcacaagtaatgttgtatttatatgagtctgagataacacgcggtcaaaagcctctaaagggtaatattaccctatttgggagtatcaacaagacactttatcgagtcaaggttggttcagcctcttga

SEQ ID NO: 64468 - DNA, 225 bp, Glycine max
  Peptide Sequence Number=SeqID_181246
atggcgaagaacgacggaaaatctttacggaatcatccacggaaatatttcagaagcgttacggaagcacctcggtttgaattttctttacggaaacgcccttcccctatttatagggaaaaaagggtgatgcttgctgcccagctagcctcagcgagctctgctctcccgggcaagcaggtggcttcctcaggaagcttcctgaggcacccccctgattcctaa

SEQ ID NO: 64469 - DNA, 855 bp, Glycine max
  Peptide Sequence Number=SeqID_181247
atgaataagatttttccaaattcgcggctcttccaggttgaatttggtagttttttcaatctaggtgcattgaattggcgcggcattcactggaatttgcgacgtgggagctggagaagctgcgatgaagtgtggtgcttggagggtattcttaaagtagcactcaattcgaggtttaatgtttggtcagagcatggattctgcaaggaatgcgggtggtgtggcagggacagtgctaattcccatgcgttttgtgtggccatatggaggaaggagtgtgtttctcagtggtggttggagcttctaccgatgtcgccagtggaaggttgtccaactgtgtttcaagtgatttataacttgccacccgggtaccatcagtacaagttttttgttgatggagaatggcgccatgatgaacatcaaccttatgtacctggagattatgggatagtcaacactgtcttcttggccactgatcctaactacatacctgttttacccccagacgttgcttctggaaatagcatggatgtggataatgatgcttttcgacgaatggtccgtctgaccgatggaacactgagtgaggtgctgccaagaatatcagatactgatgtacagatctcccgtcagcgtatttctgcatttctatcttcacacaccgcttatgaattacttcctgagtcaggcaaggttgttgctttggatgttgatctacccgtgaaacaggcatttcatatattgcatgagcagggaattttcatggctcctctttgggacttctgcaaagggcaatttgttggtgttcttagtgctttggattttattttaattttaagagagaggtgccattag

SEQ ID NO: 64470 - DNA, 4542 bp, Glycine max
  Peptide Sequence Number=SeqID_181248
atggtggagatgaaggaaaatactgagcttgaggaaggagaggcttgctattataatggtgacgatgaagccaacattgaccctgattctttctcttacattgatgagaagattcaacattttcttggtcattttcaaaaggactttgaaggtggtgtatctgctgagaatttgggtgcaaaatttggtggctatggttcctttttacctacccaagagcgctctccttgtttatggtctcatccaaggactccacaaagaaaccacagctcaccaaagtctaatatcaatctccacatggaggttgtgtctcataacacaaaagcatcttcaaatgtgcctcatgcaaggcctgaaaatgcttctcatagttcttattcacttcgtgatttaagagaagcttcagtaaatgactcagtgaagaaagaacgaggaatttcttccagtgatacagctgagaggtgcactttgaaagatgatactacaaaaaagacaggaaattcaactgaccaaaggccactgaagtttcgaattaaaatgaaatctaatatcttagcacaaaagaatgctgagatatatagtggccttgggcttgataactctccctcttcctcaatggggaacagccctgtggaaagtgaaggcatgccaccagtgtctcaagagaatgctgaaggttctccaactggcattattcaggttatgacttcctttcctatccttgggtgtgtcttagtatcacctctacacgaaagtttgctctacatgatgaagaatgaaaaagttattagcgacagcaaatacttgtcttctcttaaaggtcatcaagatacttgttccatgtctactgatgaatcagattcttttgtgggaaatgaacatttgaagaagaggacagtgagaatagtgagacaaagtgaaaaacagttggaattgaagcatacaaatggcaccttttctgagaaggatttgacattgcatacaaagaaaagattaggaaacagaacgccagattgtaaagattttctctctaatgacttgaaatgtacacctctgtcaagttcaatatgtgatgctggtgaaacagctgaagtcactgccaaagcttttgaagcctccaaggagtttaatgagaatggggtgcaaggcagaatggttcctgtagaagctttgaaggaggagtcgttggagtcaatatctggtcaggattttgagaagactgaaaagcaaaattcaggaaatggttttatgaaaaatgctttagagcataaactggaaaattctcgtaaggataattatacggaccctatgaataataacacgcgtaatactttcatgatttctaataaatttgaatgtgatgcagtgaaacataaggtagatcataagtatgagaaccatcagaaagtaaaggctgtgtctgagcggaagactaagtcaaagggtgatcagagtcctagaaaagctgaggctgttgctagaaaagatagcttttgtggtactagtgatgcaatggtaatcaataaagtgagtgctggctgtgacaatacatctaaaagtaaaatgaataagtcaaagtcactgaagggcaaaaagttcagtgatagtaacagggattcattgagaggaaaaaaatcggaacagaaagttgacagtgttgccggtaatggtgctataaaaaatggtaacatcagtaatggaaaacagagtgcatttggggctaaggtaaaggtaagaccgagttgccataaagtggccaaccagttgctagctgggccatgcataaaagatacttcagctgcacttcttattactgaaaacagcattgctccagagatgatttcatcagcaggagtgcctcaagttattgcggaagattgggtatgttgtgacagttgccagaaatggcggctactgcctaatggtgtgaagccagagcatcttccagagaagtggttgtgtagcatgctaaattggctgcctggaatgaattcatgtgacttcagtgaggatgagacaacaaaagcactttacgcctcgtatcaaatgccaatttccaatggtcaaaataacatgcaaagccatggcactgaaactgcaattggagtgagctctactgatgctttgcagtatggcctgaatcacaacatgtccagttctgatatgttgtctgatcgaggaaagaagaaacatgttattaaggaaaagacaatgtcaggaattaataatgacgtgcttcagtttccaaattctgcaaagaccaatgttcaagtatctggaaaaaatagaagcttgaatgtcatgaatcagcatcctgccgacttaaacccaatgaagaagatgagttcttctaaacatcttagcagtcttgacaatatgatagaagagaaaagcgtgcctatagagaaagaaaagcaagtaaatgaaggtgagagaaagcatgttaagttgaaacgtaagatggatgctgatcaatataaattgggaactcctaagaaaccaaaaattgaaaatgttttctatgctgataagcaattgaatcctggcatggaccttgagaaggtgtctctatattcaagaaatagtttggcaacaaaagctagtgggaaggatatgaggaagcatgatgaatattgtttatctgatgacgtacaggacagtttaccagtcactgtcaagaaagagggagatcaagctcaggtcttgtctggtggtgggtccttggatgtgataaacggcagtaaaagtggtttaatgaagaaaaggaaattgaaggagtgtatggatgatgaaaagcataacaactcttgctcctcacatggtgaaaagcataacaactcatactcctcgcatggtgaaaagcagtatggtgaagagggcaatgcaagtgaatttaggaaggaaaagagatacagaattttgaataaagaggcaaaatcattaactgaaggtgataataaattgagtaaaggtgggatgagacaagtttgcttgtcaggcaatagggaccaaatggctgttgggacagaagtaagatttgttgataaaggcaaccaaccaaggaagcataggaaaaatactgcatctcttcatgcttcagatggtattggtcaattgggcaaggatttgggctctagaccgctttcattggcagcaacttcgagctcttctaaagtttcagggtctcataaagctaaaacctactttgaagatctgagaggttcacctgttgaatctgtcacctcatcacctctgagggccttcaactcggataagaatatttgggcagtaggaggcacttcagcgaaagatgatgctacaaaaggttgcctctcttcagtaggttccaggagaagcgttgataatagggagggaaagctatcagtaaaattgaaggcgggtagaatttcacgtgacttacatcctgcatcccacaaattatcttcaatagaggtccgggttgaggatgctaaagacacagccagggtccaagctaaaaaatcttctgaactaaagaatagtcatttgcttgaaggtggtgttcatgttgaacaacctggttattgtgctaatggtaaacgttatgaggagaaagtaaacaaggacaatcaggaaagtgaattttcttggcagaaatctggtaaggtttcatcattgcacagcaaggagaaggacagaaagtctggttctcatgttggtacagataagatgaagatttcagtttcagagactggtggttattcaaaaaaaagtgggaagtatgattcagcagttgatcccagtaatcatgaatctggtgctgagtcaaaaaataatgctaaatatatttctccaaagtctaaaagtgaaattgactgtattagtcagaaaagtgctttaagacatgggccaaatgaaactggaaagcaaactgagataaaacaaagagactttgagaattcaattctgaagatggatgctcaatgtagcactgataataataagcctatcccctggcaaaacctgactcaggattttgagggagaaaacaaagctaatctcacagaatcaagagttgggaaatccaaagttctctcgtctgcagtggatgaagtaaaaagggaagcattgagtgtgggttctagaactgtacctcagcatcaaaagggaggcatgtctaatgagcatcatgtccatgtttctggcaatgatgatatggccaagtcaatgagaaattatgctgatgttagtaacaatgctggagttaattatagttctggaaattttgcacctgatcagcaacttacgttgttaagtcctttgagaacaaattctaaccaaactgctactgacaccctgaaagaagctgcaaaactaaaagatagagcagataattataagaactccgggtttgactttgaaagcaatgagacatactttcaagctggtttgaagtttctgcatggagcatctcttttagaaaattgtcataatgagagtagcaagcacggggaaatgagtcaaatgcaaatttttgctactgcagccaaacttttcaagtaa

SEQ ID NO: 64471 - DNA, 129 bp, Glycine max
  Peptide Sequence Number=SeqID_181249
atgaacaaaagaggaatgcgagagaatcttgagaaacgggtgggaataggcaagtcaggtcaagctttgaaaggtctgagtctgagtctagtctacgatgaatctttaaagtctgagtctggcttataa

SEQ ID NO: 64472 - DNA, 204 bp, Glycine max
  Peptide Sequence Number=SeqID_181250
atgcatgagatggctccgaagaagctctccacaaagaggtccagaaaggacacccctggagaaggctccagtgctgccatggattttgacagtcgccatttccggagtgccaagcaccagcagtgcttcgaggccatcaaagaatggtccttccatagggaaaggcgtgtccagcttagggaggccgagtaccctgacttctag

SEQ ID NO: 64473 - DNA, 339 bp, Glycine max
  Peptide Sequence Number=SeqID_181251
atgtattttatggtggaggctacggcgggagagtctatgatgtttcccaccgtgaaaaagacaatttctaccgcaataacaaggagagaaagtagggattcatcagagatatttttcctttttttttttttgagatatggagaaattggatctggtttggaacttgcagatctagaaaagaaaaaagaaaaaagaaatgaaaaaggtaagaagagaaagggctatgagaaagctcattggaaaaaacaaatgaaatatcttcggaaacaaaagaaacaaagctggaagggcattatgcatgggagcaacagtctaagagtagccgcaacaattgcttga

SEQ ID NO: 64474 - DNA, 603 bp, Glycine max
  Peptide Sequence Number=SeqID_181252
atgggatcaaggaaaacgcctccactcaagaaaaggttctaccaagtcaagatcaagggtctagcagcaatcgacactttcctcgcctttcaccacagcaaggaaagcccagtcaactggttccctcgctggaaggaaggaagatcaggaattctattttcatgcaaaggatttccaaatgttcccttaatggggataaggggttgtatcaactataattttgtcatcgcaataagacagcttggctatcccatgaggggagcaccgtcggtggagagcctcacacctttcgtaacacggggtttcagtgaccccaacgcaaggatgcttcaaggagtccacaaggcatgggaaaaggtgcaaagaaaagacagagaacttaggggaagtggcaacgggatcattggcgactatcgtaagtggctgagagccaacacacaaggtctggattggctcctgaagctgagagccgctaaggaggaggaggctgaagccccagaagaaagtgaagaggagaatgaagaactgagagacatcaacatagccactgccaaggccttggagcaagaaaccaagagggcccggaaggaagaacacgactga

SEQ ID NO: 64475 - DNA, 126 bp, Glycine max
  Peptide Sequence Number=SeqID_181253
atgacgggaccaaacatacagcgtaaacgcgatgacgcgatgcggaaaaaatgcgcatgggtttgcggcgcaacaaggagacacaaaatcatgggttgcaattttgtcccctacgaggaagaataa

SEQ ID NO: 64476 - DNA, 321 bp, Glycine max
  Peptide Sequence Number=SeqID_181254
atgattctgaaagatgaattgaagacttgtctaaggtccaaaaggagtttgtctcagcagctgagcgagaccgaagcaaacatgttagccatcatcggcaagtacaaagaagaactggatctggcaacagcccatgagcataaggtggcgaatgagtacgcccaagtgtttgcagaaaaggaggcaaggggaaggtcaagatcttccctgattacttgcaaaggccaaggtgatggtggacatatactcggtccccgaggaaatccatgggctcctcagctattgtcagcatatgatagacctgatgacccatataattag

SEQ ID NO: 64477 - DNA, 246 bp, Glycine max
  Peptide Sequence Number=SeqID_181255
gcacgaatatcaagagaatggggacaatgtggcacgcgccattacttcagaatacaccctaggccaaggccatcccttacaacccctcaattcaacaaaaacaagcaacaatttgaggataaatccctcacgtttcttagcaaacacatgcaatttagagcaccaaaatacatcaatggaaagctagaaagcccaagaatgagaggtggctcgcccaggcgagcccagctcgcccaggcgagctaa

SEQ ID NO: 64478 - DNA, 303 bp, Glycine max
  Peptide Sequence Number=SeqID_181256
atgacccgagcattttcgctcaatccatgggtgtcataccctaatttcgtccggggacctttgctcgatgacgtgcgaccattctttggtcctcgtgagaaggcggttgcttctggaggaagcaaccctgctcgcctgggcgagctgagctcgcctgggcgagctgggcggcaaccacctcccctattttccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 64479 - DNA, 411 bp, Glycine max
  Peptide Sequence Number=SeqID_181257
atggcaatcaatttgttgtcactcttatctgctgaagtaacagatccaggaagtcttactctagaaatagtccagcagatatcaaaagcaaaagaaagggcttctagtaggaaggctatcatggagaaagtggagaagtggatgttagcatgtgatgaggagcgctggctagaagaatatagcagggaaaaaatcataatacgattaaaagaagactcaccagagagtgatgaacaaagtgtggagaacaaaaccctagagaatagaaaagagcatgtgagggagaacgagaatgagccactgcgagagagaagaacccaccgcagagagagcgaatcgagtgagggagaacgagagtcacacgagagaaagggtcactggagaggaagtgaggtccgtgaaggaggataa

SEQ ID NO: 64480 - DNA, 314 bp, Glycine max
  Peptide Sequence Number=SeqID_181258
atgaaggtgctaagggtgcaaaccatagcttccaaatccaaagatgctgccatcccagtcatgtttgttaggggagagacagagcaaccaggcatcacaactgttcaaggggtgaaccttgaggtgccaattattgactttagtgacccagatgaagggaaagtgatgcatgagattttggaggcaaggtatggcacaaagcttcagaaagaggtgaatggcaagaaagggtgggtggatcatttgttccacactgtgtggccaccttcctccattgactaccgttactggcctaagaaccccccttcaaccag

SEQ ID NO: 64481 - DNA, 285 bp, Glycine max
  Peptide Sequence Number=SeqID_181259
atgtcctacctgacaattctggtgcccaacgaggtgcaaggtcttcaagtttgtagggatggtcattgcatgatacggagcaatggaaaatataaggcagtttttcacagaacaacagtgaacaaatacgagacaagaatgtcgtggccagtgttcataaagcccaaaaaagagcacgaagttggtcctcacccaaagttggttaaccaagacaatccatcaaaatacaagaccaagatatacaaggattatgcttactgtaagctcaataaaatccctcactga

SEQ ID NO: 64482 - DNA, 372 bp, Glycine max
  Peptide Sequence Number=SeqID_181260
atggactatgttcatcatgtgccagtgactttttggaatggagaggaatgtcctgagttgaagttatcctcccatggaaggaaggttgagaaacttgacaggtctattccagagattgaagggttagtggctgccacaggattaagtcctctgatcgcattttcattagacactggagaggtgattatcaccctcaatgacgtgacatcgttgctacgtctgcccattacaggggcctttcatagctacgaggcacttcatgtggacgaagtcatcttcttgttaattgaattgcttgaagttagttcagaagaagcaagggttgagatagtacaatgtcatgaggcttatgttcggctatcctggatgtga

SEQ ID NO: 64483 - DNA, 105 bp, Glycine max
  Peptide Sequence Number=SeqID_181261
atgtggatccagagcaacatcgacctcgatcaaaatctagaccacaccagtgaagcgctacaaccagcatcgtcatcaccatcgtgtcttctacggataatgtag

SEQ ID NO: 64484 - DNA, 336 bp, Glycine max
  Peptide Sequence Number=SeqID_181262
atggatgatataggcatcgatggagatggaggagtggttgagaaaaccagcaaaggaaagaggacaaggttggcgtcgtggatgagagaaggagcatggagtgtggcagctagtgttggagttgtggaggccttgaaagaccaaggcatatgcaggtggaatcatgctttaagatcagctcaacaccatctcaaaaaccatgttggctcattctctcaggctaacaagctttcttctactgctatgatctccacaacactaaaacatgagaaggcaaagcaatcagaggagtccttcagaactgtcatgtacttaagctgctggggccccaactag

SEQ ID NO: 64485 - DNA, 225 bp, Glycine max
  Peptide Sequence Number=SeqID_181263
atggtgatgacgatgctggttgtagcgcttcactggtgtggtctagattttgatcgaggccgatgttgctgtaattgcgacacgaatgcgttttccaccttcatttgttggaaccctcctcgttacagtcagtataaactgtactgtgatggttcggtcaaacttaattcaagccaagcagttgctgatgatggtgtctttcgagaccacaagggttctgtttaa

SEQ ID NO: 64486 - DNA, 351 bp, Glycine max
  Peptide Sequence Number=SeqID_181264
atggatgatataggcatcgatggagatggaggagtggttgaggaagccagcaatggaaagaggacaagtatcattcatcacaacaacaagatgagttcaggaattagagcatggagtgtggcaactagtgttggagttgtggaggccttgaaagaccaaggcatatgcaggtggaatcatgcattaagatcagctcaacaccatctcaaaaaccatgttggctcattctctcaggctaacaagctttcttcttctgctatgatctccacaacactaaaacatgagaaggcaaagcaatcagaggagtctttcagaactgtcatgtacttaagctgctggggccccaactag

SEQ ID NO: 64487 - DNA, 959 bp, Glycine max
  Peptide Sequence Number=SeqID_181265
ttgggagagacaatgcagatgacgctcttcttgagcaccttaagcggtgggtctctgaaaatcctccaccggcgcatgtcatgttgatagctggtgacagaggctatgctcgaaccttaagacagctgagagagaacaagtataatatattacttgtcacgcgggatgcgcctccttccaaggtgttcagtgatatagcaagtatattgtggaagtggtctgccatattagagaagaaacccttaggaaaacatttgaacgatcccctgatggatacgtgcttgatgaaggttcatcgacggccaaaaaagagtagtaacatttcgactgtttatgtattttgtacagttgagagagacaatgcaaatgacgctcttcttgagcgtcgtccaccccgtatcaggcccctctactcgtccttttggtcccattatccctcgtcatcgttgtcatcaagtcccaccaacctcatgcaaatttgtgtttggtgggacataaaaaattgtctcattccttcatcgtgtgatgcttcccagattgatgattacatcgagaccgctctaattgccaacaaagcacacgatttatcccgacgaaaccaggagaagcttgttgaacgacccaagataagaatcatcttcaatcaaggtacctttcttgattcagtgattcagcattaccacacacccagagtaggtgtattttgtgttgttgggagagacaatgcagatgacgctcttcttaaacaccttaagcggtgggtctctgaaaatcctccaccggcacatgtcatgttgatagctagtgacagaggctatgctccaaccttaagacagctgagagaacaaatggcaagaggatgtataacacatgctgcaaccacaacaatgatagcagccgcaatagaggacagggttgtaaacagatccgagagattccactatgcaatagcactatag

SEQ ID NO: 64488 - DNA, 396 bp, Glycine max
  Peptide Sequence Number=SeqID_181266
atgaagaggacggtgaagaggatccatgtgcgagggttttggggggagaaacggggttggaggagggaggtgaagaaagaagtgagggtggttttggtattaagtgtttggggttggggttccgctgggggaactgatttcggaagcatgagagagagggaacgagtattccggcgaaattggaccggaaaagtgggttgcgtggaggagtatggggatgggaaagtgttgggtttaaagcgtggttgtgtgaaagaatatggactgacacgtgtcccatgggattaccgtctgctaggtgcaaccgacaaaagattcagtgaaaaaggagcacgtgccagtttttgtaatttctccggtaggtttttcgagcttcataaatcaccttccctttaa

SEQ ID NO: 64489 - DNA, 419 bp, Glycine max
  Peptide Sequence Number=SeqID_181267
atgagttcagcacagaaagcttggattgtggcaactagtgttggagttgtggaggccttgaaggaccagggcatctgcaggtggaactatgctttaagatcagctcagaaacaagtcaaaagccacgttggatctttgtcacaggcaaagaagcttccctcttctgctatggtttctacttcttgcggattaaaggggcagaagcagtcagaggagtccttaaggactgtcatattggtacaaactcaattttcaagcaataaacgagataaggaattcgtagcggcatttgagcttagcgagtatgacgacgatcatgcgcttagcgcgagatgcgctagtacgtctttgggcttcttcgtggatcttccgctaagcttgagcgggtcgctaagtcaaacaagcgctaagtctgtctt

SEQ ID NO: 64490 - DNA, 570 bp, Glycine max
  Peptide Sequence Number=SeqID_181268
atgcctaaacagtcaataggcagactacgtcatgagagaacttcacgaagggatctacagtctccatacccaaggatgctccctagccaccaaagtgacgtgccacacacccctcttgacaaccttcacagtcggagcttcctttggcccttcgccatgtgggtaatggacatattgggaccactgctaaaggccctaggagctgtcaaatacttactagtcgccattgactacttcaccaagtggatagaaacaaaaccacttcgggaaatcacggtcaacgaggtggaaaaattcgcttggaaacacctcatctgcaggtacgacctctcatatgccatcgtcactgacaacgacactcaattcaaagcccaaacttacgaagacttcctgacaaggcttggcatcaagcacctagtcacatctattaaacatcctcaaactaacggacaggcagaggcaactaacagagtcatcctcaaggccctgcgtattagacttgataagtctaaggtcctatggaaagaagaactctacatcatactctgggtgtaccactgtacaccttag

SEQ ID NO: 64491 - DNA, 384 bp, Glycine max
  Peptide Sequence Number=SeqID_181269
gaccaccttcctctcacttcctcattcattcattcatacggtttccttctaaagcacaacactaaagttcagcaatcagtactctcaagaagaaaattacaagatcatcatcacaataacaatatgagttcaggaattagagcatggagtgtggcaactagcgttggagttgtggaggccttaaaagaccaaggtatatgtaggtggaatcatgctttaagatcagctcaacaccatctcaaaaaccatgttggttcattctctcaggctaacaagctttcttcttctgctatgagctccacaacactaaaacatgggaagacaaatcagtcagaggagtcattaaggactgtcatgtacttgagctgttggggtcccaattag

SEQ ID NO: 64492 - DNA, 321 bp, Glycine max
  Peptide Sequence Number=SeqID_181270
atgatcaaacaagttcttcttcttgttctgctcttcttggcctctggattggccctctcagtctcagagtctgagtctgtttctcttctgcctcacgccgctgattccttcaatgttagctatatccagatgaagaacgctgggacttgctcttactcggtggttataactactagctgttcgtctcctaggtatacaagggatcagatcagtatttcttttggggatgcttatggcaaccagttgatgtttttggcatctagcagtcacgcagatgagtcttggaattcatctctaaatattttgttaggtccttctgtg

SEQ ID NO: 64493 - DNA, 645 bp, Glycine max
  Peptide Sequence Number=SeqID_181271
atgctctcagagataacacacaatgcggagggcagaactgtaacgcccatgaccattattcccaatgaaggtgcttccaaaccaaattcggtcagattaaacacaaacaccttataccacccaatgcagggacctgatatccaacgtgatagaacttcgatccagcatgatcatcatcaagcattcattgccttccaagttttgaagaagcattttgctggaagtaaaccactgaatttaaaagtacttttgtgtgatggggataacaatgatgatgacaatgttagtaacaatagagatactaaggatgatcatgatgacaataacgatggaggagacattggtggtggcaatgacaatatgatggtggtagtagtgttggtggtgaaagccattggtgacaatggtgcggtggtggcggcgaataacggtggtggagtggtattggtgacaacaagtagtgacagtgtggaggtggtggttgcggtgacagtgatagtaataaaagtggtattgttggtagtggtggtggctggtagcacaaagatggtggtggcggtttgtagtaatgccgatggtgatgttggtggcgatgacggtgacaatgataataaagatagtggtgatcatgatggtgacaactag

SEQ ID NO: 64494 - DNA, 216 bp, Glycine max
  Peptide Sequence Number=SeqID_181272
atgtcattgcctagcgctgttcatgtgttctcccttatcaagtgcgaagcttctggtgactgggaagcacgttattctgttgttttccagatcggttccttcgccaaaagaaaaaaaaaagaagaagtagagatgagagtcgtcattgcgaaaagggcaggacggacgaaatcagtgtcctatctttgctttcctcttatctccgatgagaggtaa

SEQ ID NO: 64495 - DNA, 258 bp, Glycine max
  Peptide Sequence Number=SeqID_181273
atggaaggttcccaacaaaacactcactatcctaaggaaaaattgcctaaaattattacacacaaatggaagtttggtaacctattggaggctcccaacacacttccaatgaaaggcctttttgttacaaaacttgaaagcaatgaaatgcttcttagtccaatagctcttaaggtggttggtgttggaccttgtggcctcaataatcttaagagggataggcttagaatacagaagaaacaacaacaatcaatttaa

SEQ ID NO: 64496 - DNA, 318 bp, Glycine max
  Peptide Sequence Number=SeqID_181274
atgggcccttctagaggtttctgggcattttcttgcttaaggtggaagcaacctagctcgggcgagctaggtggcaaccacctcccccgttttgttaaaaaatgggcttccggggcttccgggacacccactgttttttggggctcgattgcttctcgcctgggcaagctgggcggcaacctcctccccctttttcctataaaaaggcaaaagggggttgttctaaaggtccccgattcccctggctatgcatttcagttgttttgggtgaaaaaaattgtttccgtgaagaaaatccaagccgaggtgcttccgtaa

SEQ ID NO: 64497 - DNA, 1533 bp, Glycine max
  Peptide Sequence Number=SeqID_181275
atgcgcggcgaaccggccgacaatcgccgccggatttacctgaaacgctgcggctggcgtcacaaattttttcctttcagttgcaactgtggtcatactgaaacgcgtgcaagccgtaacaaatgctcagcatgccgggccagacaggatgcgcccggatggaatgacggttcttatatcaacaagagtgttgccatgaaaaatatcaatccgacacaaaccgcagcctggaaagcgctgcagcagcattttgatcagatgaaatcggtagagattgccgacctgtttgcgcaggatgccgatcgttttgcgaaattctctgccacctttgatgatcagatgctggtggatttctcaaaaaaccgcatcacccaggaaaccctcgacaaactccaggcgctggcgaaagagaccgatctggcgggcgccatcaaatccatgttctccggtgagaagattaaccgcaccgaagatcgcgccgtgctgcacgtggccctgcgcaaccgcagcaatacgccgatcctcgtggatggcaaagatgtaatgccggaagtgaacgcggtgctggcgaagatgaaagccttctcagagcgcatcatcagcggcgagtggaaaggctacaccggcaagccgattactgacgtggtgaacatcggtatcggcggttcagacctcggcccgttcatggtgaccgaagcgctacgtccgtataaaaaccacctcaacatgcattttgtttccaacgttgatggcacgcacattgccgaaacgctgaaaccgcttagcccggaaaccacgctgttcctcgtggcgtcgaaaacctttaccacgcaggaaaccatgaccaacgcccacagcgcgcgcgactggttcctgaacaccgccggcgatcagcagcacgtggcgaagcactttgccgcgctctcaactaacgcgaaagcggtcggcgaatttggtattgataccgccaacatgttcgagttctgggactgggtcggcggccgctactcactgtggtccgcgattggtctgtcgatcatcctgtccatcggcttcgaaaacttcgaacagctgctgagcggcgcgcatgccatggaccagcactttgcgaacacgccagcggagcaaaacctgccggtgctgctggcgctgatcggtatctggtacaacaacttcttcggtgccgaaaccgaagcgattctgccgtacgaccagtacatgcaccgttttgccgcttacttccagcagggcaacatggagtccaacggtaagtacgtcgaccgcgacggcaacccggtggattaccagaccggtccgattatctggggtgaacccggcaccaacgggcagcacgcgttttatcagctgatccatcagggtaccaagctgattccatgcgacttcattgcgccggcgcagacccacaacgcgctggccgatcaccaccagaagctgctatccaacttctttgctcagaccgaagcgctggcgtttgtaaagcccgcgagtgtagagaagagtttaccgatgcag

SEQ ID NO: 64498 - DNA, 525 bp, Glycine max
  Peptide Sequence Number=SeqID_181276
atgaagtttccctcgtcctatagggaaattgtcactagcaaagctgatcaagaggatgctcatgaatgctatgttaaaacttgcatgattgaaccatacaatatggtatgcaaaagctatagctcagagaaaacacaagcttgggaagaaaggagaaaagctataaagacaaaaatagacagcttgttgaaggctgatttcatttgcgaagtgaattacaccaattggttagccaatgtggtcatggtaaagaaagcaactggaaaatggaagatgtgcatggattacaccaacctcaacaaagtgtgtcccaatgatgcctaccctttgcttagcattgacagactagttgatggggcatgtgggttcagggtgctcagtttcttagatgcctactcaggctataatcaaatcaagatgtatctacccaaccaagaaaagacaacatttgtcattgatagggctaattttttctataagggactagtcaccagagccatgagcaagaggctccaagaggattga

SEQ ID NO: 64499 - DNA, 279 bp, Glycine max
  Peptide Sequence Number=SeqID_181277
atgacgccaggcactaggcataactctaccatgtcaattgtcgcaacctacccttcggcgggagggcgacgcgagactcacaggtgtgtcttccatgggaggaagatgcgcagagtcgccaccaatgtttattcgaggaaaatgtcgaaaaaaccagaaaggtgtcgtggagttgtatttacgcacggggaaggcgttggaccattaacgatctcttgcggtgatcgacaaaagcggggcttttgctcctacatatcctcaattgtgatgaggaaataa

SEQ ID NO: 64500 - DNA, 132 bp, Glycine max
  Peptide Sequence Number=SeqID_181278
atggagcagagaaaaagaatccatgtacttgaggagcttatggatatggtcatgaatgttggggcaggttatagagtttctgatacaactgagagtatggtttcaataaagagaacttccacaatcaagtga

SEQ ID NO: 64501 - DNA, 321 bp, Glycine max
  Peptide Sequence Number=SeqID_181279
atggagcacgcgacacctgatacagcgcggcgcacgaggcagcagcagggtagcgcccctgacgtgagcgcatttggtagcgccctgccgctgggcgcaactggtagtgcccaacgcgtgggcgcgactggcgcctggttgtgtccgcgtcaggggcactaccagtcgcgcccacgcgctgggcactaccagtcgcgcccagcggcaggacgctaccagacgtgcccgcgtcagggacgctaccctgctgctgcctcgtgcgccgcactgtgccacgtgtcgcttgctccatggaagcgccttcctgggggcgctttgtaa

SEQ ID NO: 64502 - DNA, 282 bp, Glycine max
  Peptide Sequence Number=SeqID_181280
atgtccgaagagctccattcattgggaattcagccaatgttggtacttgaaagatcttgtgtggaaatattcctctcaacctgcaaacgaatgactgagaggttctcaagtctggtcagtgaagaattaaggggtcctgagagattgcagtttggcattctcaactcttcaagactaagcagtggtagcaatgcattgtaccaatcttgtccccatgtttatgcttacaccgtccatatacagatgtctaatcctgctgaagttttggacaaacctttgtag

SEQ ID NO: 64503 - DNA, 932 bp, Glycine max
  Peptide Sequence Number=SeqID_181281
gctccgacattgtggaactggtgactaagaaccccagaatcctgtatgcgaacctcgagaataatattgttccttcctatgagttggtgcggaggttccttgaatccgataagaaaacgatggattgcattcgtggttgcggacatttctttggttccgatcgtgcgtcgcagaatgtgaagttgttgattgatgagggagccacggactccgtcatcgcctttttgttacagagaaggttttctgtgatcttgtgttctggttttaaggagaccttggatgaaattaaggaaatggggtttgagcctttcaagaagaagtttggggtggcgctgattgcaaaaaagatcgttccgaaatcgcactgggaggctaaagttgatgtctttaagagatggggttggtctgaagaattggttattggtatgttcaagaggcagcccctctttatgttagtgtcccaagataagattgatcgggtaatgagattttgggttaagcagttaggttgggattctttggcccttgccaaaaagccagagatttttggatttagtttggagagaaggatcattccaagggctcttgttgtccagtatttagtcgctaaaggcttgaggaaaaagagtgccagcatgattgtcccatttgctgtttctgataaggagtttcttgaaaagtatgtgatgcgatttaaggaggaagaagcggaactattaaagctgtaccagggaaaaatgagtggtcatggaaataaggaggatggtgcagctcctttaaccgtagtgctttcgatgagtgagggctttcaagtttcaaacaatgacgaggaccaccacgacgcgagtagctcaacagtccatcacgacaacgatgacgacgaccacaacgacgcgagtaactcagcgggagtcattttcgggggtgagtag

SEQ ID NO: 64504 - DNA, 183 bp, Glycine max
  Peptide Sequence Number=SeqID_181282
atgaagcattcttaccttaaggctcatgcttctgcttcgttgaagcaatatggtgaagaaaacttgggcccttctatgccagaaaataattcaggtgtaaaaagcaatatgttaagaaccatccctcgtaagctaatagttgcagaagctgtagcctttaagccaaaaaccttgtgggtatga

SEQ ID NO: 64505 - DNA, 1620 bp, Glycine max
  Peptide Sequence Number=SeqID_181283
atggttagaaccagaggattgggttgggctttaaacaagattataagaagaaccttagggagaaaagttagtggtgatgcggatgaagtccctcaacgacgaaggcccacagcatctggacgtaggcaacgggaagctgcacctattgctgaggatgttgcgcatgtggatcctgtagttgacgagggttttccagttgtcctcccattgaaagaaggtagagaaatttggaggcctgctccaaagattgaaggtttagtggctgccacgagattaagtcctctgatcgcttgttccttggacactggtgacaggggacttatatatacttttgcggagaggtggcataaggaaactagtagtttccctcttcctgtaggtgaggtcattatcagcttggatgatgtggtgcccattacaggcgtctttcatagctttgaggctcttcatgtggacgaagtcgtggacctgttagttgacttggttgaacattttcctactattgtttcttctattgctgttgaagattatcatgaaaggaaatcatatgcttgtcgttggaagtctaggaagggactcacaacaccaccatcacttcaaaccccgaaacccaattctccttttccctcaacactctttccgaaacacatctcactcacttcacagcaacactcatttgcggcttcctacctcgtaaacaccttcggcctctccccggaaaccgctctcaaggtctccgagcgcgttcgcttcgacacccctcagaagcctgactcagtgatcgcgttcttcacaagcaatggattcaccgttccccagataaaaagcatcgtcaaaagggtacccgacgtgctcaattgcaacccccacaagaggctctggccaaagttccaatttttactctcaaaaggtgcttcttatccctctgacatcgttcacctcgtgaataggtgccccagaatcatcaattccagcctcgagaaaaacgtgatccccaccttcgaattggtaaaaaggttccttcaatctgataagaaaactattgattgtgttttcgctaataggcatttccttaattacaacactgcctctgagaatgtgaatttattgcttgatgttggagtcaaggactccagcatcacctatttgttccgtaggagggcttctatactcttgtctaaggacttgaggaagaacattgatgaagttaaggaattggggtttgatccttccaagatgagttttgtgatggccttgcacgccaaaatgagtgtcccgaaatcgaggtgggatgccaaagttgatgcctgcaagagctggggatggtctgaggaaatggttcttgatgccttcaggaagcatcccatctttatgttagggtccaaagataagattaatgaggtgatgagattttgggttgatcagttaggttgggaccctttggccctcgccaaaatgccgaagatttttggatatagtttgaagggaaggatcattccgaggggtttggttgtccgatatttgatcgggaaaggaggaaacacatcaactatcaaaggtttatgtggaaaaatgagtttccaagaaaacagggaggatggtgtagcatctggcagttag

SEQ ID NO: 64506 - DNA, 1341 bp, Glycine max
  Peptide Sequence Number=SeqID_181284
atggcaagggtctgcatcatgactctgttcaaatgttcttgtcatagaaactacccttttgctcatcgtgataggggtacagcaggaaaataccagaaagggtttgaagctgggacaaaatccgagttactcacaaccgagctcaagcttggtcgctttaaccccatcaacatgttgaatacccttctctgcaaatgcatcactttcgcagcaacatcacgttaccctcttttccaccactacccattaccattttctctgcgtttctacaccacaaccacttcaaattcacgctcctttgcggtatcctacctcatccacaattttgggttctcccctgaatctgcttccaaagtttctgaaaaccacaaaatttatttccgtaccccggaaaagcctgagtcagtaatcaggttcttcagagaccacggtttttctgactcccaaataaacaatatggttagaagggtacctaggctgatttcctgcaacccttgcaaaagggtattgcccaagtttgaatttttactctcgaaaggtgtttctagctctgaaattgttgacctaattagtaagtaccctttaatgttgactcgaagcctgaagaattttatagtgccaacctacgaattggtatatagattcttgcaatctgataagaacactgttgcttgtatgtttgctaattcatctgtctttggtagcggctatcttgtggcacacaacgtcagtgtgatgcttaagaatggattgagtgaatcaaacattgcaagattgcttcggtaccgtagtaaggcggtgttccgtgcaacggatattcttaaagtggtgagggaagtaaaggatttgggatttgatccttcaaaagttgcttttgttatggcattgctagccataaaacgttacgatcaaaacttgtggaaggagaaagttgacgtcttcaagaaatggggttggtctgatgaaacctttcttgaagcatttaggaggcaccctcactgtatgttgacatccactgacaaaataaatatagtgatgaatttttgggtcaatcagatggggtgggatgctttagcccttgtcaaaggtccaaagattttcgggttgagtatggagaaaacaatcattccaagagcctcaatagtgcagttgcttcttgagaaaggtttgcgaaaaaggagtgcaagcataacttgccccattatgatacctgaaaagaggttcctgaacaggtttataaaatgttttaaggaggagtcttctgatctgttaaagttgtatgcggaaaagctgaatcttgcgtattccagggagaagtctggaatgttgtgcaccaaataa

SEQ ID NO: 64507 - DNA, 1032 bp, Glycine max
  Peptide Sequence Number=SeqID_181285
atgagcgtttgtagttcaaatggggactgcgcgggagaaaaagctcagatgtgcaaaataaaaactcagatctcagatcttgcgcgtattggtctcattattgcttcatcatgcggcgtggtcggagtccggcggaggttcaacgacggagatggcgacgcggggctgctaaaggagcggatgagggagggagagacagagatgtggtggaagagagaagacatcacaaattattattttttttacttaactcaattctgtaaaattagtttaataagggtacagcagaaaaatatcaggggagtaaggattgaagctgggacttgtattgtatctgtgtcaatatccgagctcaagaccccggaaaagactgagtcagttatcaggttcttcagagaccacggtttctctaactcccaaataatcaatatggttagaaaggtaccatggttgctttcctgcgacccttgcaaaagggtattgcccaagtttgaatttttactctcaaaaggtgtttctagctctgaaattattgacctagtgagtaagcaccctggattactgagtccaagcctggagaataatatagtcccaacctatgaattggtacatggattcttgaaatctgatgagcacactattaattgtttgtttggtaattccattttctctggcggccattatgtcgcgcgcaacatcagagtgttgcttcagaatggagtgggagaaacaaacattgcacgattattgcggaaccgttgtaaaggggttttctcctcaactgatattcttaaggtggtgaaggaagtaaatgatttggggtttgatccttcaaaatcgacttttgctttagcattggttgttaaaagtaggagccaaacctcatggaaggagaaagttgacgtctataagaaatggggttggtccgatgaagcctgtcatgaagcttttagaaggtgccctcactgtatgttgacatcgattgacaaaataaatactgtgatgaaattttgcgtcaatcagttgggctag

SEQ ID NO: 64508 - DNA, 135 bp, Glycine max
  Peptide Sequence Number=SeqID_181286
atggataacatgtcttcatgtctaagtacacatatccacgaagttttcaaagacatggagccaccttctagtcatttgctccccacatacatcaaatacgaggtcatcatagacatgagtgacacgtataacaat

SEQ ID NO: 64509 - DNA, 258 bp, Glycine max
  Peptide Sequence Number=SeqID_181287
atgagtgagggctttcaagtttcaaacgatgacgaggaccaccacgacgcgagtagctcagcagtccagcacggcaacgatgacgatgaccacaacgatgcaagtaactcagcgggagtcattttcgggggcttccagaaaaagagtgccaccttgcttagccagttttgtattcctgaagaggcgtttcttgaaaagtatgtgaaatgttttaaggaggaagaagcagaactattaaagctgtaccgggaaaaatga

SEQ ID NO: 64510 - DNA, 846 bp, Glycine max
  Peptide Sequence Number=SeqID_181288
atggattgcattcgtggttgcggatatttctttggttccggtcgtgcgtcgcggaatgtgatgttgttgattgatgagggagccacggactccgtcatcgcctttttgttacagaaaaggttttctgtgatcttgtgttctggttttaaggagactttggatgaaattaaggaaatggggtttgagcctttcaagaagaagttcgggctggcgctgcttgcgaaaaagattgttccgaaatcgcactgggaagctaaagttgatgtctttaagagctggggttggtctgaagaattggttattggtatgttcaagaggcagcccctctttatgttagcgtcccaagataagattgatcgggtaatgagattttgggttaagcagttaggttgggattctttggcccttgccaaaaagccagagatttttggatttagtttggagagaaggatcattccaagggctcttgttgtccagtatttagtcgctaaaggcttgaggaaaaagagtgccagcatgattgtcccatttgctgtttctgataaggagtttcttgaaaagtatgtgatgcgatttaaggaggaagaagcggaactattaaagctgtaccagggaaaaatgagtggtcatggaaataaggaggatggtgcagctcctttaaccgtagtcatagtggtcaactggtcatgtcaatatgttagggtagataagtgctggcttggggtgagcctagttgcaatgccaatgccaaggttctgcttcatgacttggtgttcaaatgttcaagtcattgaaaccatggttgttaaactcatgattctacgtagaattgtggaggctctgtaa

SEQ ID NO: 64511 - DNA, 327 bp, Glycine max
  Peptide Sequence Number=SeqID_181289
atgcacaaacgtattggagagaaacttacagcagccaaaggaaaagacgaatacgatggttttggtggtcattggcggcacgacaggagggttggaactgggtcaaggagacccgacccaatccgtgattatgcaacagggttggaaaaccttagttgcctcatgcaccactggtgcaaggtcgagcagcgtgaggccaccacggggatgacaacggtagtgcggcagggacatcacgttggcgtcgcgcgagcttcgccgaaaaacaaaaaaagaaggaagaaaaacagaaaagaaaaggatgacagaatgcgaaaaatatcatga

SEQ ID NO: 64512 - DNA, 471 bp, Glycine max
  Peptide Sequence Number=SeqID_181290
atgaaggtcgatatggaggctatgaaggagcagatgacaatgatgatggaagcaatgatgagcatgaggaagatgatggaggtcaacatcgctacaactattgctgccagtactgctattgagaaggactcaattcacccgcccgatttcaatcaaaaaggtcgtccggtcttaaatgtagcaggtcaaggaggcaaggcgatgatgaatgcgtatgggcctcattatgtccaggaaaaatttgatcatataaaggagaggctgagggccattgaaggaggaggaaattatggctttgttgagatatcagaattgtgcttggtacccgatgtggttattcctccaaagttcaaggatcttatggatgccttcattaggcagtatcaatacaactctaacatggctccaaatagaatgcagctacaaaacatgtacaagagagacaatgaatcattcaaagaatacgcttaa

SEQ ID NO: 64513 - DNA, 360 bp, Glycine max
  Peptide Sequence Number=SeqID_181291
atgtcggagcctgaggcccctttggagcgtaaaaattcaaactttgggaaaatccttttgtgggggtcgcatgagagaacattgggtgctcttctaataatgctgattatctgggtgttggagaaaccgtggcttctgaataaggcgatgattgaatcgggtttttcgggggttttgaattgggtgaacttggagatcttgagagcggtttctacggagaagccacaagtgcttacgagagtattaaggcaacttggtgaagggagcatcgaagcttgccttgctgatgggagtgggatattaacccgaagtgaccatgaaaggggatgtgttttagggtttggacggaaaggagggtag

SEQ ID NO: 64514 - DNA, 657 bp, Glycine max
  Peptide Sequence Number=SeqID_181292
atgatgcagatgaagcccaccagtggcaaaggcccacaacatccacacgtaggcaacgagaagctacatatgttgttaaggaagttcagcatgtctactctagagatcgaaggcttagtggctgccacaagattaagtcctatgatcgcatgtttgttggacactggtgatcggggacttatgtctacttttgtggagaggtggcataaggaaaccagtagtttccatctatcagtagaagagtgttggatcttcgagcactttccttctgttggttctactattgctgctaaggattatgatgagaggaaaccatgttcctgtcattggaagtctaggaaggaattaccaatattgacgcattgtaagcatttggatagattgacgtctgatgttgtgtgctggattttgtatggtgaccaccgtgcattcagagagttcgagaccattcctccacaccatgcttctccttctctatgtatagaagacattaatgatagatggattcaattttctgaatacattgcaccggtgggtcagatatgtgtagtgcctggtcagtgttcaccagacaacatggagtggttctacttgatatctcatcccctcatgagtccggcacatcattgggatcctcctagacatccgtccatgtag

SEQ ID NO: 64515 - DNA, 129 bp, Glycine max
  Peptide Sequence Number=SeqID_181293
atgtgttcagaacaacaaatctcaagtacaacacaacatctcacactcatacaattcattacccatcatcacctagctacgaagttttggatgatgccacttccagtgaaggaagataagtcaagatag

SEQ ID NO: 64516 - DNA, 189 bp, Glycine max
  Peptide Sequence Number=SeqID_181294
atgttcctcaagattccttttattcccatcgaacccaacagaaccctaacgatgccactgttgatttcttctaaatccatctatcttaatttacattccagagagagaagaagacgagcaatggcaacatcaatagagagtgagaagaacgaacaagttgtgaacccatgcgaggattctaccacatga

SEQ ID NO: 64517 - DNA, 243 bp, Glycine max
  Peptide Sequence Number=SeqID_181295
atgtgggtgcaagccattggtctgtttgctcaagcgacctgtgctcctgagtttggacttccaagaccgctcaatcagagattactcgtctttcacgttggtgggggtgccgtaaaacaacaaggacaacccttcccttgtgctcaagaatcccctacaacaagagacccacggtctcttaatcccttttcggaaataagaagaagagaagaagaaatctctcgtaaaagaggtagaatgtaa

SEQ ID NO: 64518 - DNA, 165 bp, Glycine max
  Peptide Sequence Number=SeqID_181296
atgaaagctatgccaagtgagtatgaagtaagttcctcttttaatgttgctgacttgactccatcttttgcaagtggtgatcctgaagatttgagagaaaatgctttccaagaaggaggaaatgatgagaatatcaaagttgcccaaaaatacagggacctatga

SEQ ID NO: 64519 - DNA, 675 bp, Glycine max
  Peptide Sequence Number=SeqID_181297
atgtggcttgcaactcggtccattcttcctaagtggagtcttcaagacttagcccaagccattgtacaagtaccagaagcttgggtggggcacgttcaagctttcgttagagaagttggaaagcctcttgtcgtgaacgctgcagaaaatctaatgcctcgacagaagaggagccatcacctcatacggggtcagattggtggacgaatggctagtggtgttataacaccatcctgccaagctgagaaactttccccattacgagggctgcttagtgccattgattttgaagagctcttgctagaagcggctcatgaaatcaaggagacctatgatgaagtccaaggctatgtcttcctaggggcaagtaggaggtggaataggctgaagcaaacagtgtggcttttgcggcatttcttcgttgatggaaaatctagggtgatcaagaggatgataatggatagcttgaataggtgcatcagccacaatgttggtttaccccgatttattcttgatggtataatcatagccgagaagttttacaagatattgccgccatcgcttgactgtcgaagtgattgtgtgcaactctcggatataagtcgaggaacagagcaatttaaggcagaattatttgctgaagtaatgcgagtactggagcgtggctcatggtga

SEQ ID NO: 64520 - DNA, 552 bp, Glycine max
  Peptide Sequence Number=SeqID_181298
gttatagttggaaaaaaaggaagggtttttactttggcggcaatggagggggaaccgagccaactgaagcgtgccgcgattgatgcctctgctggagctatttccggtggcatttccaggacaatcacgtcacctctcgatgttattaagattaggttccaggttcaactagagcccacatcttcatggactttactatgcaaggatttgtctacaccttcaaaatatactggcatgcttcaagcaaccaaagatatttttagagaagaaggcatacggggtttttggcggggcaatgtgccagctttgctcatggttatgccatatacagctatacaatttactgttctacacaagttgaagacttttgcctctggttcttccaatacagagaattacattaatttgagcccttatctatcctacatgagtggagcattagctgggtgtgctgctacagtagggtcatatccctttgatcttctccgaaccatattagcttcccagggtgaaccgaaggtcaatgacggaaattgctggcatgctttttaa

SEQ ID NO: 64521 - DNA, 813 bp, Glycine max
  Peptide Sequence Number=SeqID_181299
atgactgaaggagatcacccaaccaagatgccaccaaggaagaagaagaaggttgttttagggcataaagttactaaggttgttgaacaagtagtgaaggcatccatgcatcatgcaacaagttcatcaaatggtgtaactaggtcaacctctactccttcagagccagttgcacaatctggtgcctttgtaatgatccctacaccactgggtattaattctactcgtatggagtcacaaggtcaaccaccacaccattatgatgatgtgccacatgatatagaccatgaaaatgatcttgatgatgatgatgatgtagagaatgaggaggctcaactaccccatgctctaattgaccttgacttagtgtgtttggagacacatattaggaaaaaggacaacacctgggtggataagagattagagcaaacctatggagactttcagaagaaattgcaggaagactctagcgatgggacaaaggccattaacgctacatcaagagttaaattgcgggctgatattgctagagacaagtctcagggatgtctttatggagctggagacatgtcatctcaaaccattgctccagagtgggtggctagacaaatctcacaagcaaatgaaagatttgaacaacaaatgaaagagcaacaagaacaacatcaaaagatacaagaagagatgcttaacaccattagggaaattaaagcatctgtgagtgagcttagccagcatcttcaatcttgttgtcgtcgccatccagactgtgaagaatattctcatcatgatgaccaatacaatcccacctaa

SEQ ID NO: 64522 - DNA, 420 bp, Glycine max
  Peptide Sequence Number=SeqID_181300
atgaaggttaccattgtgtacaaccattttggacctaattgcaatcaacgcatgccaaggattcgccatggatatgcacatgtggccaacaatctttaccagggatgggtgcaatatgcaattgggggaagcatggaacctagcctcaaaagcgaagctaacctcttcatagcaccaataacaaggagtaaggaggtgacatggagaaagggtagccataaaaatggggatagatgggaatttcatttagtgagggatgcttttgaaaatggagcctcttttgcagtaacaaaaggaagacgtgtgccaaaaccaaattatagcaaggaacaaaggtttaaagtttttgattccaaatatgtgagatcattgacgcgttcatcagatgtgttaccatgcaataaaacctctaaatattga

SEQ ID NO: 64523 - DNA, 330 bp, Glycine max
  Peptide Sequence Number=SeqID_181301
atgagaaagagccccaaccaacatttattccaaaacggaacatatgagggaaagtttccttcaatactgctaccaattgaagttcaaaacatccatagaagcaagcatggaagtgactctggtgtctacgatagtgaaggaagcaagcatgctcgaacacacccaaattctttaacatctgatgaattgatggggatgcttgtggcaaatagagttcctaaggattacgctggatggcttgctagctacacggagtggaagatcctatatgttcttggcaaagacaaggatggtttactgcacaaaagagactattcgagctgtttatga

SEQ ID NO: 64524 - DNA, 828 bp, Glycine max
  Peptide Sequence Number=SeqID_181302
gcatattgagcgaaacggataagcaatcccttgccgcaggcgttacggggagtaagctcaactgggcgtggggaatggagcgctaccaggggacagcaaatgacaaagggatgttagatataagcctcaaggtcgttgactatgcaggccccgaggcactgcatgctgttattatttgtaaatatgacatgctgcgtgacgagtttgctatttgtatgctggaaaattttattgctgataaagagacatcattgtcaggtaaagtctttattatagcgctggtatatgccacgactttttgcgcaatggtgggtttggatgacgtgcatatttgtgaccctgttcccgaagctcagtcccgataccgatcgtatgggtttgctttcgtatttgatgctcctgataaaatgtcctcatcggtagaagaaatacaagataaaatacgcgagaaagtgagacgggcgatgactgctgccaaacgttcagtcgctttctggtcttccattgatggtgcgaagcttgccagagtaggttttgccgaaaaagacgcggacgttattggtccggagaagccgtcagcgaaggctcgaatcgccagccggacacagggaaacgccgtgggccaggggccagttactgcgcgagaaaaaaacgtgtcactgcctggtctgactgaacgtcagggcgacttcttgctgcccgcttccgcgccggtgatcggatcgatcagcggatcggacgcggtgcgtgcagccagcgcgtcaatgtcgcgctgctcatccggcgacagcgtcacggagggcagaccatcgccgccatccaccgccg

SEQ ID NO: 64525 - DNA, 174 bp, Glycine max
  Peptide Sequence Number=SeqID_181303
atgttttctcaacttgtccagcctctcgctcaacactttgttcatggacttgcaccactccttacgaaacatagaataaggcttggaaaagaagttaaaggtctgaagactctcgctcaatacgccatacgcactcaacgccacccaatcgctcagtgggtaatactcacttag

SEQ ID NO: 64526 - DNA, 845 bp, Glycine max
  Peptide Sequence Number=SeqID_181304
tgcacgccctcaccttcagaggactacacatcctcaccttcagaggacagcacgccctcgccttcatagggctacacaccttcacctttagaggactatgcgtcctcgccttcatagggttacatgccctcacctttagaggactacatgtcctcaccgtcagaggactatatgtcctcgccttcaaaggactacacgtccttgccttcagagggctgcacgccctcgccatcggaggactacacgtcctcgccatcagagggctgcacgccctcaccttcagaggactacacatcctcgccatcagagggctgcacgccctcacctttagagggctacacgtcctcgccaacaaaggactagacgtccttgcctttagagggctacacgtcctcgccttcagaggactagacgtcctcacctttagagagctacacgtcctcgccatcataggactagacgtcgtcgccttcagaggactacatgtcctaacaatcagagggctgcacgccctaaccttcagaggattacacgtcctcgtcttcagggggctgcacgccctcgcctttaaaggactacacgtcctcgacatcagagggctgaacaccctcaccttcagaggactacacatcctcgccatcagagagctgcacgccctcaccttcagaggactacacgtcctcgccatcagaggacttcacgccctcaccttcagaggactacacatcctcgccatcagatggctggacgccttctccttcagaggactacacgtcctcctctttagaggactggatgtcctcaccttcagagggttacacaccctccccttgagagaactacat

SEQ ID NO: 64527 - DNA, 234 bp, Glycine max
  Peptide Sequence Number=SeqID_181305
atgcggggctaccgtatggttatccgcaccttttgtcatccagagacgagacggcaagtccaatggcatgcgggggtaccctatggttatccacaccttttgttatctagagacgccaagtccgatgacatgcgggggtaccgcatggttattcgcaccttttgtcaacctggggcaaacgagaccgttgacgcagagagactaacgtcatcttctgcaccttttgtcatttag

SEQ ID NO: 64528 - DNA, 646 bp, Glycine max
  Peptide Sequence Number=SeqID_181306
atgaagctcctcaagaacgttcagactgggtgcggccatgcattcctgattttccattgggaaagtggcaagtcgtggaacgacccgaagcttccatggcgggcacaatatctgataacgagtcttgtgaaaaaaggtactaatactgaggaccctgctgttgattttgaacgagaagcgaatcggcctgaggttgataaagatgaaggtgttggcaatgagaagaaagaggtaaaggtggtccctaagaaagatgggaaggtacgaatgtgcgtggactatcgggacctaaaccgagctagtcccaaggataacttccccttgccacacatcgatgtccttgtgaataacaccgccaacttcgctttgttttgtagaagcaagcttcatgatgatgaatcaaattcaagaaaagtcatcaagaagaatcaagattcaagagaagacgaattcaagattcaagagaagaaatcaagaagcaacaagtcaagacttcacaagggaagtattgaaaaggattttgttgttgtaactgagaacaagagagggtacatctcttgtggatcagttcaagtggagggattttacaaggttgacagaaatctcaagaacccggtggttgcttggggactggatgtaggcatgg

SEQ ID NO: 64529 - DNA, 231 bp, Glycine max
  Peptide Sequence Number=SeqID_181307
atggctaagtatgaccctgagttactcatggagttctatgcaaattcctggcccattaaagaaggagtcatggataagcgctcatgggtgcggggccaatggatcccctatgatgaagatgctacccaccaattcatggggcatccattggtcctagaggaggggcagcattgtgaatacactgaaagaagaagccatgtcttaggttttgatgaagaggccataggctag

SEQ ID NO: 64530 - DNA, 822 bp, Glycine max
  Peptide Sequence Number=SeqID_181308
atgaggaggtgctggaggtgtcctcccaacacgtctacttcgagcacggtttctttagcttccactctagaagggaattcgtcttccactggcaatggggattctaatgacttccccgccttcttgaatcaacttctcgagagggtggccgataacataggaaaggttcttgacgtaggagttattgccaccaacaagattttgaggcttctttctccaaaagttatggaggcggaggcagattcccttgacccatttgttgaagtggtacaaaaaaaacaccaatgcgagttgatggagaagaaggtgtgccctccgattaccctttcagtgttgaagaaaaaagaatttttctacatgtacgaatgcctatttcaagatatgcatggatcatggctcaagctagtgccaacatggcagcattccgccttgctcggtaatgtcttccccatggcccctgtttaccaaactaccagtttgagggactctccagcggacatcacccctggactgccaaggagcctaagggaaaagacaaacataaaatcgcatttctgggccttccagtcgagggtggaggtaattgctcaacaccttcaaggcttttcaaatactaataagttgaaggtcgacttggagaaggctaaaagctcctatgactcagctcttcaagccaatatcactttggccaaagacaattcaaatttgaaatggaagaaaagcttcagattgagcataaagcatataatgatgtttacaaagctcatgagtccaacttcaatcactacctccaacaagtactcttccattgtgaggtcctag

SEQ ID NO: 64531 - DNA, 507 bp, Glycine max
  Peptide Sequence Number=SeqID_181309
atggaagctcattattacaatgggttcaacttgattgtggccgatattccgtcgaaatgcatggtttacatctccaacagtcccaaaggacaaccaattaccattaaagaggtctctcctggcctccatgttctttcaaacgccaagctggactctaagtggcataaggcacagcgtcttgaagtgggttttaaagaacaacttgccaaatatggggaaggcgaaatacctgtgaaggaggtagttcacaagctaatgaaggacaaaactaaagccgataacagtcatctacctcatatatgctctctcgattgggaattcaatttgagttccatatttgttgaagtagaaactccactgggtctatatggcactaggagtagtgctgctttaattgtaacatcaagtgaggaagtgagtttctttgaggcatatcttgatgagggcatgtggaaggagcatcttattgatttccatattcagaagatgacaaaagggcatacataa

SEQ ID NO: 64532 - DNA, 497 bp, Glycine max
  Peptide Sequence Number=SeqID_181310
tcgtgtccgatggcacgcagagacaaattatggtcattctgcgtcttttgtcatccagagagacggtgggctcgatgacatgcgggaaccatttggtctcgcactttttcaccttttgtcatctagaggcggcgggcccgatgacatgcgaggtggcgggcctgatgaaatacgggaaccatttggtcccgcactttttcaccttttgtcatccagaggcggcgggcccgatgacatgcggagacaaattatggtcatccgcacgcttttcaagtcgagtgataaatgtgcagagacatattatggtcattctgcgccctttgtcattcagggacagctcgatcgtggccgagggcacaaagagacaaattatggtcattctgcgccttgtgtcgaccgagaggaacgaattcgacagtatcaggatgatgtgtcggtactgatcactttcaaaatttttgcaggttccgttggcagggagattgaccggccaaatg

SEQ ID NO: 64533 - DNA, 243 bp, Glycine max
  Peptide Sequence Number=SeqID_181311
atggcggcgttgccgaagaacaaccaacaagaagacgaaggcacagggactagaaaacgaacgaagaagacgaatgtgcagggagggagaaggaaaggaagcgacatcgtacggaatgtgaacagtgacactacacagatgcgtggaaaaaatctgctcacccctataatgcaaagagtcaaacatttaaaggttaaggggaattccatgattatggaaaatagccatgtgtcaacattctaa

SEQ ID NO: 64534 - DNA, 369 bp, Glycine max
  Peptide Sequence Number=SeqID_181312
atggagaagcagctacacttctttcatcagcttgtggatgtattgccatggattcaaaaaccatcccaattaactttgatagttggtcaaatgttccaaaatcatacaaggatggttgctttaatatgtgtttatgatacttcactatctagagaacaattaattgctaatgttcctaatggaattcacaaagatcagtggtcttcattcattgattatcatctaaggccagaatataaggatccacgatgtcggatacaatgtcctgacatcctgctcgagaatactggagttgctgtgcaatgcaagataaaagtcaagtgcagaagtgaagctgcaggatccacgatgtcggatacgatgtcctga

SEQ ID NO: 64535 - DNA, 263 bp, Glycine max
  Peptide Sequence Number=SeqID_181313
atggcttttaaagatatcatcctctttggtaacaacattgtggcggtgcaatgtgtgcatagagcaatcaaagaattaccccaccctacttcccaagcaaacaggcaactcccaagtagatgcaacaaccattttggggcagttgaagttcacccaggcaagctgatgcttagccctgaaggaatgagctcgcccaagcgagctggttgcttaggcatgaagctatttcatggcccaggcgagccagatgctagcctgggcaa

SEQ ID NO: 64536 - DNA, 303 bp, Glycine max
  Peptide Sequence Number=SeqID_181314
atgggtttgtgtcggaacaatgatggcacgacaagcttgttgaagtttgctgaaaaccgtggaagatctgacaatgagtcctgtgaaagcaatgataccaaggacccaaatgatgactttgagcagctagtaaatcaagccgaggaggaagaaaatgaggattggggacttcccccagatttgaggagaatggtggaacatgaggaaatagagatgaagccgcatcaaaaggagacagaggttgtgaatttgggcacaggaggtcaagattggcacttgtgtgtccgggaatgttcgagatga

SEQ ID NO: 64537 - DNA, 717 bp, Glycine max
  Peptide Sequence Number=SeqID_181315
atggttggactacattctattataggctttgaaggatttaacatggctagtcatatggccccgaagaaactcgctgctaagagagctagaaaggccactacaggggaaggatccagtgcagccccacaagcggaaattgagtttgatgggcaccgctttcgaagtgaggagcatcagcatcgttttgaggtaattaaggattggtcttttctcaaagaaagacgggtccaaataacggagggagagtatgcagaattccaagttgaagttgccaggaggcgttggacacaactaacagagcctatggcaaagtatgatcccgaagtagtcatggagttttacgcaaacgcctggcccattgaagaaggagtcgtggacaagcgctcttgggtgcggggccaatggatcccatatgacacagatgttatcaaccatttcttggggcatccattggtcttagaagagggacaacgatgcgagtatgctgatagaagaagtcaatttttaggttttgatgaagaggccataggtcagctactttgctccccaggacattattttgcacagagcgtagcaaggaggcgggtatggatcatgtgcactagcatgaccactctgactcaaatctggatgacgctcctgctcagcaacatccttctagtgaccataactctaatctcccgctatccaaatgtcagttggtctacaacatcatga

SEQ ID NO: 64538 - DNA, 777 bp, Glycine max
  Peptide Sequence Number=SeqID_181316
atgaccatagttgctactctagacattgagttagagaaactcaatttcaaaactgcctttctccatggaagattggaggaagacattattatgaaacaacttgaaggttttgaagaggaaggaaagaaaaattttgtttgtagattgaagaagtctctttatggggtgattgtaacaatcaccaaggtagtgaagttgaagtcactactaagtagtgaatttgagatgaaggacatgggagctgctgaaaagattctaggcatggagatcaagagggatcgtgtccagaagaaactatttttgtgtcggaaggaatacattcaaaaattgttaaatcattttgggatggcatccgtaaatccaatatgtactctttttacagtgtccatttgtctatttgaactcaacaccactcagtcaaaattagagaaggaatacatgtctcatgtaccttatggaagtgttgtaggcaatcttatgtatacgggtaatcctaggaaggaacatttgcaagctgtgaaatgtacactcagataccttaagggtacaacttatattcaactcgtctaccatggagttaagtcttgtgctcttgatggttattcaaatgttgactatgttggaaattttgatgcaaggaaatctgtgactaggtatgcattcacgattggcaactttcttgttagttggatggcaatacttcagccaccagtgactttatccactatagaggcagagtacatggctctggcagacgcaacaaaggaagagatctag

SEQ ID NO: 64539 - DNA, 906 bp, Glycine max
  Peptide Sequence Number=SeqID_181317
atggtcatctgggatgactcagacggtgaaaagagtagcagtccagacgatgagcaagccaacatttgtgtcatgccatatacaaaggagaaatttaaggtaaaaacctactctgaatttgatacttcttgttgctcttcttcaaacgatgaagaagatatgccctatgatatatccttggtaggaaaaggttatggtttaagctggtacttggataatggatgctcacgacacatgacaagggaaagaaatgaactcgcaaagtttggtttagaggtggataaaggtatcttcctaggatattctgacatatctaaagctttcagagtgtttaactcaagaactttattcgtagaagaatctatctctgttaagtttaatgatggtctaacaattgatagcaaattatcagaccttgaggatgattttgcagatatgcagattgcatgtgtgccctctcctacattcctatgcaccaatgctgctttcgcttcccttcctccttttgttgcctctcccagccactggaacttcctcaaatacacccttatcggggatctcaccgaaggcactgcctttgccagctacgactgttatgaacagaaaacgaggtcgctccatgaatcgaccaagtacacgactggtgataaagccactgctcttgatgtcagtattgactacttcttaggcttttttcactttcaatcttctttgttaattttgtgttttgatctcattgactggattgttagaatcatattggccgaagtaggaggtgtagcaggagctatgaatgaagtggacagtgagttgcctggatttttaggaggtacttgtgcatgtgttgatcaaggaggttgtatgcgctctgataagggcccttggaaggatgtagaaattatgagg

SEQ ID NO: 64540 - DNA, 738 bp, Glycine max
  Peptide Sequence Number=SeqID_181318
atgagggaaggtttgccactgaaggaacatcttgatgagctaaattttgttctaatggagttatgtgacattgatttcaagatggaaaatgaagatctggcatctaggaatggtgatgatgcctctacgtctggattatcggtgactgatttttctaaagggaagaagaagaaaggaaaatgtggcaagaagagcaaagctgatcctaaggacatctacaattattgtaaagaatcagatcattggaaaatgactcatcatcggaaaacaatttggttctggctgttggtgaacaactacaacaacattttaaacaatggggataatgatgctccttgtaagtttgttggtatgggttctgtacaaatcgtaatgcataatggtgttgttgaaaccttaactgaagtggagttatgtagatcagaggaaaagggaagtttgtgccatgcgtctattggcttgtctaattattctctatggcatctgcgtctaggcaacatgagtgaaaaagttctagatattctgagcaaggccagatgcatgctatccaattcaggctcgaatatgagtttttgggctgaggcagtcaacacaacatgctatctcacgaatggctcactgtccactggcatagactttaagagctttattgagccaagaatggattctttatgggctataaagatggagtcaaaggattatgagtctggtctctatctgaaagaaaggttattctga

SEQ ID NO: 64541 - DNA, 177 bp, Glycine max
  Peptide Sequence Number=SeqID_181319
atgcctaagcaaccagctcgcctggggttccaaggttcaggagttgagagaattgagagaaaagaaggaaaaagagagaaagaagaagaaacgaagccgaggcactaccgaatcacaaccgtgatcattccctacatcgttctcttgttctatgttcctcgtgcaacagtcggttag

SEQ ID NO: 64542 - DNA, 285 bp, Glycine max
  Peptide Sequence Number=SeqID_181320
atgtcgtcacgagtgcgttgtatgttggtctcatcttttgtcacgggaagccaaaaggtccatatcaccttcttaactgcatacatggggcactacgcccctgaatgcgcaatattggcaatcaaaattgccattccttgggttatggggttgaaccaagctcatgcttttatgaaaaggttcatcaagtcaagtcgaagtatggaggtaaccaccttgcaaaaaattggggcaaaagatggatcgagttacatcgctgcttcgtctactgccaaacacatttag

SEQ ID NO: 64543 - DNA, 450 bp, Glycine max
  Peptide Sequence Number=SeqID_181321
atggtcacttgggatgactcagagagtgagaagagtaatagttttgacaatgaaaaggccaacatttgtctcatggtagatacatatgataaggttgagggaacaacaccctccaagtcacagtttatttcagacaaatgcgacttatgtggggaaatgtctatgttcctagacatgaagccacatgaggggggagtagttgcctttggaggcataagtaagggaaagatctttggcatagataactttggtattacctctctagcctccatagacaacgtcttatacattgaaggccttggatcttcttcatcaatggagtcatttgcttcttggagttcaatggcagaagaatggagaatgaagaaagatgattggagacaccacttcaaggagaagatgagtcaagaacaagctcaccaccataagaagccatggataagagcttga

SEQ ID NO: 64544 - DNA, 1004 bp, Glycine max
  Peptide Sequence Number=SeqID_181322
tcgtcggtgctggtgagatcactggagagaagagaggagttgttgaatggtggttggaggcgttgctcaggatgaggaagatgaagcatgaggaggtggtgcagtgtgattggcttttgagtgagggaacgacaggagtcagtttgaagccgttgtggatggtggaggaaacgcatatctcacaaggccaccaggcttcattagacaagactacccctactagaaggatggaatggagatgcacatcaagtccaccaaatatagaatttggcttatatatcattaccaatggggatattctcattccccaacttgaagctgaatggacatatgacgatctgacccttatggagctcaacacaaaagccaaatatactatggcatgcactaaagatgtcagactgaggaaaaccgtgactctgactagacattatgaaagcttcaccgtgaatgatgaagagtctatggattgtagaagcaagcttcatgatgatgaatcaaagggtacatctacttgggttgttgtaactgagaacaagaaagggtacatctcttgtggatcagttcaagtggagggtacatccacttggttgttcaaagagaacaagggaggacttcaagttcttctaaacaatttggaggcttttggacaaatgtacatcaaggctcagataaacttgaaggtgctggacaactttcccaaggtgtgggaaccaaagaccatagtcatccaggaagcaagagatctgaaaaatcttgtctgggataagcgattgggcatcttgagagtccgtgaagaatctgatgaattagacaactctgatggatccatagatgatgaaatggccctcgtgtctagaaagttcaaacagatgatgaagaagaaaggaaagtttcaacactcctttagacgcaaggaatcaagattcaaaaagaagaaaagggaggaaaacaatgagatcatttgctttgagtgtagaaagcctagacacaagaaggcttaa

SEQ ID NO: 64545 - DNA, 375 bp, Glycine max
  Peptide Sequence Number=SeqID_181323
atgaagcttgatctttcatcctttcaagctttattaaaatctcttaataggcagtgtggcagccaaatgcttgatgtttgtgtagctgcggttatattttgtttgtggggtatttggcattgtcgaaatcaagttagatttagaaatgtcaacctcaaacctgtttcaatgttttcaaaaattgcagctaatgtttgtttggcaggcaatctttccaaaggaggaagtttattaaagcgcctaacattattgaagcctgttggtatcagcctcttcccaactgggttaagtgcaatgttgatggagttgcgaaagcccagggcatgcggctcttggtggtatcttcagaggcgcaaatgccactacaatgggtag

SEQ ID NO: 64546 - DNA, 486 bp, Glycine max
  Peptide Sequence Number=SeqID_181324
atggaagctagggatttgagcacatgcaaaagggaaagagttgtactcacctcttcaatcttcgatgctaatcggaacaatgtggttagggacttcagagatcatgtgattcaactccatgatgcgcaacaacctaagagggagaagaatgtagcaaatcttgctgtaaagaaggttgttgaaaaggctgaaaaagaaaaagctaaggcacatgctaaagttgttgcaacaactgctaaggctatgggcaacaccactattaatgagatcctcgtccatctcactaacattgtacctatggaagaaaaatctatggcatccaatgtagaaaaagctaatgaggatgttcctccagaagcaaccgccttctggaggaagcaacctggctcgcctgggcgagctgggtggcaagctcctcccctattcttctataaatatggggaggagtcgaggagaaaggggttcatcccttctggtacttcgtaa

SEQ ID NO: 64547 - DNA, 1561 bp, Glycine max
  Peptide Sequence Number=SeqID_181325
atggaaggcagagcacaaaactccaatgacactacaattcccaagaaatcaagatctctggatcttaaaagtctatataaatcaaaattgacagaaaacactgcaaagaagaacttaaagaggattggcaatagtagtgggggtggtgatgagaagaggaagaaaaaaaaggctagaaaggaagtctctttaagtagcttagaaaatggtgatggtagcagtgagttgaagttaggggtgagtcagaaattgagtagtagtagtagtacgcttaatagagtttcatttagtgttggtgatgatgatgttcagattcccaagaggaagaggagttttgtggggaggaagaaatcagaacttggtctagcatcaaaagtggtggagcagtctggtctgaaaattggctacaacgatcaggtgccaaagttaggtagtgatgatttgggcagtggggttgagtctttcaagattaagcgtaagaaagaatttgatgaatttaaggaaaataggaatagtgattcaaattcagttcagcatgctaaggagaatggggattgtgcatctcattctgttgtaaatagtggtgattcttctttatcaaagtcacgaaggcagcataggaagcgaaaggcttcagctatagatagtactaaggtttccaaggaggctgaacctttggtttcaagtagtaaaatatctgacgatttgcaagatgaagaggaaaatcttgaggagaatgcagctaggatgctatcttcaaggtttgatccaagctgtactggattttctatgaaaggttcaaatggtttgtcctttttccaatcttctagtcaaagtattgttaaccacagtttgaagtctccgttaggttcagaatcaacatcagctgatactgctggcagagttttgaggcctaggaaacaatataaaaacaagagtaactccaggaagaggcgccatttttatgaaatccttttaggtgatgtggatgcatattgggtactaaaccggagaattaaaatcttttggccattggaccagagttggtattatggtctcgtggataactacgatgaaggaagcaagctttaccatatcaaatatgatgatcgagatgtagaatgggttaatctccaaactgagagattcaaactcttgttacttcgtagtgaagttcctggaaatgcaaagggtgagagagccttaatgaaacgtagcagttttgatcaccagaaaggaagcaaatccagaaaagaaaggcaaagaacagaagagaatgcaggggatgatcgttgtggtgagagtagtatggactcagaacctataatttcgtggttggctcgatcttctcatcggcttagatctatccaaggcattaagaaacagaaaacttctgttacagttccaagtacaacgtcatcattcttatatgatgaacctgttacggcaaaggggcatttagctaagagttctgtgagggatgttgaaaagaatttctctactggttctgtatcacaagataaattcagtgaagatttaaggataagtcttccattgccaa

SEQ ID NO: 64548 - DNA, 3247 bp, Glycine max
  Peptide Sequence Number=SeqID_181326
tgtcacttgcgctaaagatggaaaacagcctattgtctatttcagaaggcggtgggttcataagccagctccaatatcccctcatatctctgaagaaaaccatgctattataagtgcatctggttctgttgccttggaccatatgtttggtggggttgagaatgtgaaaaatccaattgacagcagggttgaggtcgggggcccattgttcttcacttacaaggcaggagtaccaaaagtcttttgggacatgaagtcagcatcattcaaatttggcttaaactttccaatgcgtttggttttgaatgacttttttcaatcagaaaatttgtggttgctttacactgttttgctgcttcggttcggtacagttatggccaagtggcctagagtttatttggagatgctttttgttgataatgtggttggcttgaggtttctattatttgaaggctgcttgaacacggctgcagcttttgtcttttttgtccttagggtgtttcatcaacctgattgccaagggaagtatgttgacttgcaatttccatgtacatctattggattcaagttttctagtgttcatgttattaagaagccacttgtgtttgagttctataatttctctgaagtgaagaattcaaagtggatgcacttggattctaagcttaaagagcattgcctgctcagtaagcagctccatctttctgaatgcacatatgataacatccaggcacttcaaaatggatcaagaaggttctccataacttctatcagtgggtcttcctcagtcaaggtcacgcaaaagagtaggccagggattaacatcatgggtgtttccgaagtgtccactcaagctgttcagtgttctgatgctggcgagaggaaacttcctccatttgctctctcttttgctgcagcacctacattttttctttgtttgcatctcaagttgctgatggagcagtctgcagctcatataagatattgtgatcaaacaccaatatttgatcaggaagaccctggtttgatgacaaatggatgtactagcaccgataattgctcaaacaggaattctgaagttattcttaggaagggtatggagactttgtcaattggtactccaggtgatggagggtcttgtgctgactcagatcatccctctacttgcaatgaccgaattctcattcaaaattaccagaacattggtcttaacggtgctagtacttccatttctcatgattctgagaagctttgtaaagctcacttacctgaatggcaatcccaccatttggagcaagagttaggctctttatcttcaagttctttaaaacatcttgataaggctaatgatggttctcattcttttattggtgatctcagtattcaaattcctgcagttgatcaatttgagaaacctgatgaagatggtgatttatgtgatgctgaacactctcctgatatctcttggaatataaatggatgtggtattccaagctccaatccaactgcacgcagaagttcttggtatcggaaccggaataattccttgtcattgggatttcagtctcatgtgtggtctgatggcaaggttgattctctttgcaatgatttgagcaatggacctaaaaaaccacgtacacaagtatcatactcagtgccctctgctgggtatgaattcagttcaaggcagagaaaccatcatcagaaagggctttctcataaacgagttagaaaggccaaggagaagaagtcatcagatgttgatagggtccctgaaaagaatatcaaatgcttatcttgtggtgcaaatgtcttgattactcttggtgataagggttggagagaatccggggcccatgttgtactagagctgtttgaccacaatgagtggagactttctgtgaaacttctaggaattactaggtattcatacaaagcacatcagtttctgcagcttggatcaacaaatcggtacacacatgcaatgatgtggaaaggagggaaggattggatcttggaatttcctgataggagtcagtgggctcttttcaaggagatgcatgaggaatgctacaaccgtaacatccgttctgcttcagttagaaacatacctattcccggtgttcattttatcgaagaaaatgatgctaatggatctgaggaaacttttgttcggagctgtatgtacttccaacaagttgaaacagatgttgagatggctctggatccatcttgtgttctgtatgacttggatagtgaggatgagcagtggatttcaaatgctcaaaattctttaaaagacaacagtgaattttgttggatctcagaggagatgtttgagaagacaatagatgtgtttgaaaaggctgcatatgctaagaagcgtgatcattttactcctgatgagatagaggaactcatggttaatgttgggcctttgtgtgttgtcaaaatcatttatgaccattggcagcagaagaggcagaagaagggaatggctttaattcggcactttcagccccctctgtgggaaagatatcagaaacaagtgagagagtgggaactagccatgaccaagaacaatgccccttctaatggatgcctggacaaggttacaactttggagaagccggccatgtttgctttctgtttgaaacctaggggtctggaatcactgaacaagggattgaaacatcgatcccaaaagaagatttcagtctctgggcatgcaaacagtaatctagatcaggatggcttccacactttcagaagaagacaaaatgctttaccttttgccgatgaaaagttcctataccaaggccacaattacgattcttttgatgattcatcattggctctgacctcaccaagggtattcttacctcgtgatgctggcagcttgaaatactatcttactagtaatggagcaggatatagaaatcatatcccaaaatttcacaagtccagatatgattcacctggtagcaggcatcacattcttgctggccctaagaggcaagggattgaacagttggatgcttcagtccttgaggagttaagacagcgtgatgccatggctgaggctcgttttaagcgtcatgtggctatgctgaagagagatagggctaaaagattgctatataaagtagatgtagccattcacaaggccatggctgctctaatgactgcagaagcaatgaaagcttctgaggactcccttgttgaaatgaaagcttatgaggactaa

SEQ ID NO: 64549 - DNA, 255 bp, Glycine max
  Peptide Sequence Number=SeqID_181327
atgaaagtgatttacaaaaagatgcggcaattccaaatgtgcaaagggcgttctaagttagcacagtattttggactaaaaatggacaaggatgacttgcagatagagctcgcacttgggcttgagtgcaacgagtccactcccaagaccaacaatggtaaaggcaccaacctcaatagagatgcagtggttggtgtcagagagcagagcatgaagatctttgttttggtggtggctacagtttgggagccatag

SEQ ID NO: 64550 - DNA, 438 bp, Glycine max
  Peptide Sequence Number=SeqID_181328
atgacaatgtgcattgtggtgaagctgacaattgctggaaaaaacattgtgaaggaagaagattttaaggttctgacatctgaatttgtcaaagactatgacgtgtcgaagaatgaagtggttgagaagttgaaatctttgactgctgagcctagagacaatacctatttgaggattgttctggttgcgtctggtgggcacttcgcagatgttgtaagggcaaaggcaggaaaaaaacaatcacctaaagatgcttctggcagggctgctcattctgctgggggcttcacttcgtcatataacgaaattgcattaaaggtgttcaaatcacagatatgttgtcttgcttgccaagttttttattttcatgctagccaattgttgtgttgcacaatctttgaattggagctagttatatacaagttaataaacgattga

SEQ ID NO: 64551 - DNA, 441 bp, Glycine max
  Peptide Sequence Number=SeqID_181329
atggagcagatcaatgttcatgtggcccagctcatttcagatgctattcatcagtttgttggtactaaaccttctaggcacccagtggatccagaaaagtccaaggcactgggttttcctgctttaattataggtctctgccagttttatggagtatcgttcacaccaacaaaacacatctggcctccaattaacagatcatttattgacaaatattgcatgccaaggcagcatcagcagaatcctgacccttacccttggcctactcccgagcagtttagagctactcctgcatggcctggagacagacatatttttcaagaggaggcaagtcttgcaaatgctcaaggagctacccaaggaaatggaggaagagcaaaggaagatgaagacatgatggatcttattgattattttatgggaggaaagggagcttcctag

SEQ ID NO: 64552 - DNA, 249 bp, Glycine max
  Peptide Sequence Number=SeqID_181330
atggcgacgacaatacacatgacaagtattgccctacgacgttgttcgatgacggcggcgtctctgatgaaggatgtactcaacacggtggaccaactcagggtagactcgatccgcgttgagtggcaacgattcatggccggcgagtcggaatacgagggagaaggaaggttcggaggtgagttgttgatgtggccatccaacgattcacgttcgtggcgggaatccgagggctatgagaaagtgatg

SEQ ID NO: 64553 - DNA, 444 bp, Glycine max
  Peptide Sequence Number=SeqID_181331
atgatgaatatttccagagatgtgaaggttgcaaacatattgcttgatgactattgtgaggcagtggtaggacattttggattggaaaagcttttagatcaccaagattcacatgtcacaactgcaatgaggggcatagtggggcatattgcactagagtacctttccacagggcaatcttctaaaaagactgatgtatttggatttggtatactgcttcttgaattgatcactggccaaagggctctagaatttggaaaagcagccaaccaaaaaagagccatgcttgattggttgatgaccgtctttgaagggcatgcgtatgaagacgagcatggtgccagactcgtcttagaaaggggactgttctacatcgattgtgaaggtacaaccgatgtagaatgtgagtgttctacatcggttctgaggctgaaaccgatgtag

SEQ ID NO: 64554 - DNA, 333 bp, Glycine max
  Peptide Sequence Number=SeqID_181332
atggagtatgccctcaatgtattcccgctaatgtggggtccaggtgtcgtgttgactatacttggttcgtgggaaactaatagacccggatgctcctctattgggtatggtgcagttgttgagattggacctcttatagtcaacaaaaatgaggaaagactacatttcaacacacactcctggattcaagaagcaaatttgttatttgtggagtcacctatgggagttggattttcttatactaacacatcttctaatctcaccatattagaggataattttgtgggtgagtttcctttacagaagcccaacctctctgattttgttgaatga

SEQ ID NO: 64555 - DNA, 219 bp, Glycine max
  Peptide Sequence Number=SeqID_181333
atgttaagaaagcatacattagtgcaggagtatgaaacgttgagaatgaagaacggggaagccattttgaaggtcttggtgccatgtactggtcctgatacattacgagctgagactttgaggtattacgagaacttatttgtttctcatgagtcagttgctactaacccattacagggccaatcaatcacaaatgcaagtggtatccgccactcttaa

SEQ ID NO: 64556 - DNA, 573 bp, Glycine max
  Peptide Sequence Number=SeqID_181334
atggtgaagaaaggtccatgttcgcattgtggagttactcatactccactttggcatgatggaccaactgagaaaccagtgttgtgtagcgattgtggatcacaatacaagttaaaaggaaatttagacaattattttcccaagaatcccgttgttcagtcattccacaataagtttacaaatgtaaatggtggaaaacatctcaatgttgatgtggaccaactttcaaactatgttccaccaactgatgaagacaacaatatgtcaaccccaaatgtccattgcatatccgcgcaagctactccactttggcgtaacggactagttgataaatcggtgttgcacaaagcttgtgaattatccccccaagaaactccagcttcagccattaatgcccccaagaaactccagcttcagccattaatccacaagaactttataaatgtaaatggtggaagcagtctcaatgttgaggatgaggaccaactttcaaaccatattacacctgcaagtgatggagacaacaataaatcaaccccaaatgtccaacacatatcaccacaaggtatgtag

SEQ ID NO: 64557 - DNA, 444 bp, Glycine max
  Peptide Sequence Number=SeqID_181335
atgcagaacatgtcaagtgcaagaggagaagaattgatgaagggggtgttcagaaagagggctattgacaaggggaataatgtgatagaaagcaaccaaataaatgactccaagaaaaagtccaatgtttctggtcatcacaatcagcagaatcaaggtggaaacgagttgatgaatgtggtaaggaaagggacagagaagttgagcataaaagaaaacaaatgcaaatcaggtccacattcaaaggtgtgctactgtgcaccaaccactcatgaaggttcattcaggtgccgtctccaccgcaagaagtcagccacagatgataataataagagcaatctgaggttgaattcccagtatgggatggtggagtttcagcctcagatgccaaggtgttgcggtgtacatgtcacaaagctttccatgaaacccctgcaattttag

SEQ ID NO: 64558 - DNA, 276 bp, Glycine max
  Peptide Sequence Number=SeqID_181336
atgtcaggtgcaaaaggagaagaattgccaaagtcattgttgagaaaggagactactgacaagggaaaaaatgtggaagaaagcaaagaagtaaaagactctgagaaggaattggtgaagctggtaacgaaaggaacagagaatttgaacataaaagaaagcaaaggcaaatcaggtgcaaagcctaagatgtgcgtgtgtgcaccaaccactcatgaagattcattcaagtgtcgtctccaccgcaaggagtcagccacacataagagcaaatga

SEQ ID NO: 64559 - DNA, 183 bp, Glycine max
  Peptide Sequence Number=SeqID_181337
atgccatgttacacaacaaaaaaaacagctgagaaattaaaatacattgctagggttgtgccgtcctcagcggcggcggctccggcggcggagaggcagcagcatccggctagggaacaggagaagagggttctgccttggatcacgtccagtggtgcaatggggtgtcatggctcctcttag

SEQ ID NO: 64560 - DNA, 294 bp, Glycine max
  Peptide Sequence Number=SeqID_181338
atgaatgcagtggtcagaaccaggactatttacatagaaagcagcaaacaggggaatgatgactccaagaaagcagcaaccactaatgaagtttcatgcaagtattccagcctctacagcaagtcatcagccacaaaaaataagagcaacctgaagttgaattccaagtccacacatgggatagtggagaatcagcctcatttgccaaggtttagtaggattcgtgctcaacttgaaagacataaacatgatagccgaatgaaagtgaaactatctagagtggattctctttaa

SEQ ID NO: 64561 - DNA, 228 bp, Glycine max
  Peptide Sequence Number=SeqID_181339
atgcaagtaggagtcgtaagtgtaggtggtggatgtgatattggtggttgtgatgacgaaggtggtattagtggtggtggtattagtgctactgctagtggttatagcattgttggtgctgtgtttggtgacgatgtgataagtagtgatggtgataataatggtgatagagacactaatggtagtgatgtgagtaatgatggtggtaataatcataatcatttatga

SEQ ID NO: 64562 - DNA, 132 bp, Glycine max
  Peptide Sequence Number=SeqID_181340
atgaccggtgttgctgatgaagcccccgttaccctcgacacgctgaagcaattaatggctcagttcgccaaagagagagactgggaccgttttcacagcccaagaaaccttcttttggctctgtttttttag

SEQ ID NO: 64563 - DNA, 207 bp, Glycine max
  Peptide Sequence Number=SeqID_181341
gggcctgatctttccattacattttgtgtgactccagatgatattgattgcccttatgctcgatccttgatcagcttacagggaatagaagagaagactgccaagttgaaaggaagtgagaaggctctagttgcacggcatgaagctagtcatgctgtagtaggtactgcagtagcaaaccttcttgctggacagccacatgttgag

SEQ ID NO: 64564 - DNA, 751 bp, Glycine max
  Peptide Sequence Number=SeqID_181342
aggactatacgccctcgccttcagagggctgcacgccctcgccttcaaaggactacacgcgctcgccttcagaggactacacgtcctcgccttcaaagggctgcacgtcctcaccttcagagggctgcacttcctcgccttcagaggactacacgtcctcgccttcagagggctacacgtcctcgccttcagagggctacacaccctctccttcagagggctacacacccttgccttcagagggctacacaccctcgcctttataggactacactctctcaccttcaaagggcttcacgccctcgccttcagaggactacacgtccttgccgtcagaggactacacgtcctcgccttcagaggactacacgtccttgccttcagaggactgcacgccctcaccttcagaggactccacgtcctcgcctttagaggactacacgccctcgcctttagagagctacaagccctcgcctttagaggactacacgtcctcgcctttagaggactacaagtcctcgccttcaaaggactacacgtcctcgcctttagagagttacatatcctcaccttcagagggctacacgccctcgccttcagaggactacacgtcctcaactttagagggctacacgccttcaccttcagagggctacacgtactcgccttcagggggttacacgccctcgccttcggaggctccaaatctgcgcctttagagaactcaaagtcctctacccttaatgcttaa

SEQ ID NO: 64565 - DNA, 1089 bp, Glycine max
  Peptide Sequence Number=SeqID_181343
atgaccccgaggataaatcacctaagcaggtttgcactcttgaggcctgatcctcaagagttggccgctaagctctgtatcccagggaggggatttgagctaaatgcggatggtcagccgttgaagatattaaggaagaacatgaccattttagctcagacatggagcgttctttccttctctaacctgattcctacctcccacacatttgatgtcaccttagacagagccaaattaatttacggcatcattatgaagatggatatgaatgtagggtacctcatctcccaccagatctctattactgcacaacatgattcttccagaattggattccctgccttgatcacagctctatgcaaggctagaggagtccaatcagattctagatccctggagagcctgagccccaccattaacttggcatacatcaagaagaactggtggaatcttgatgatccaacagtgtcatttaaagggccaacgaaggccaggggtaagagatcagaggtccccactactttagcagcactagagacaccagctccttcttcttccacagctctagtacctcctattcagactccggctattcctcctgcatctactcagataccacttcttgcttcatctccattccagtttccagctcatttatctgcaggaccatcagatttttcatttacaccacagatgcttcacttcatgctccagaacttacacagggggcagtccattatcatgcagagccttcagggcttgggcttgccatccatcatgagcatagatgagtttgacgtgcaggtggcttggccaaaagcccagccttctccttctggagggggtggggcctccgcagcccaggagcctgagctagaggagccaacagcaacagtagaggggaaggatgagcttactcctcctgagcccttttattttgattcaggtgtacacatggctcaggaggaggagactgccacagaacagattctagagccatctccagtacccacacctgatgattccatgccatctgcaccagcatctgagctagagcagcctatccctcaagattcaccagctactcag

SEQ ID NO: 64566 - DNA, 429 bp, Glycine max
  Peptide Sequence Number=SeqID_181344
gacttggacgacaccacctttgatgaagaggatgaagaggaagtcaacctatgtctaatggttgatactggaatagaagaatcaaaattagaacaagacaaaaagaatgattctttaaaaggtcaacctcaagatgttgtaaacattcgtgaggagattgatactttaaatgaaatcgtagccaaatttgttagagggtctcaatgccttaacaaactgttaaggtacaatagaagtcctgtggacaaatcttgtcatgggtacaaagcaaagaagtatgttcatgatgaagatacaattgtgtgttatttctatggaaaagttagacatatgacatccaaatgcaaggacttaccaaagaagggtatgtctaatgcattcaacactagcaagaaaggacccaaaaagattattcttgttgcaaattga

SEQ ID NO: 64567 - DNA, 432 bp, Glycine max
  Peptide Sequence Number=SeqID_181345
atgcattcctatgaagcggtgaaggtgctggtggcagcgctagtggaagtgctagaaagagagacgacgatggtgaaggagaatgcaacggaggaagagaaggcgatgatagggaggccaggagcgtgggaagaaggaggggtattacgtgggaagaaggacgcagtgactgcgttgtgtttgattgtgcgagaagaaggaacgacgactgcacgatatgcgttgtgttcaatgacgaaggacaataaggtgagggcgggggtcatgagggcgctaatggagttgatggtggacttggggtcaagtatttcatacttggtgagcctagtggtggtggcggtggcagaggggagggtggcgctggtggaagaaggggggcttccagtgctggtggagatagtggaggtggggatgcagaggcaacattcctaa

SEQ ID NO: 64568 - DNA, 384 bp, Glycine max
  Peptide Sequence Number=SeqID_181346
atgcttcaatatgtaccccacaatgatcagaggttgaagcagcaagagtggacaacctatgacaaagctaatgaagaaggagaaagccattccaccataggaaaaaaagcttttactgaagagagccaagaggcaaacaaggaaggcaagaaggaggtgctgacacctccttgggacaccaacaagatgaagactattgctgctaagccttacccaatatggggaaggaggaccctccaaggaagaaattcattccaaaagatccaagatggagtaagaaaaagagacatagaatcacatttcaagctcttggttatgggagttgatgattatactagagaatcaatgcaaaaaaggaaaatcaccttgttcaaaggtggttga

SEQ ID NO: 64569 - DNA, 204 bp, Glycine max
  Peptide Sequence Number=SeqID_181347
gataacccattattgatcgagtgttttgatttcaacagcagtggcaatcatgctataatggaggttggcgaagttattcaattttatgattcagataggcagagtttcctgcttaggacattggaggaaagctacctggtggctgtaggagttgaaggcataatggaagcttatgccagtgctttacacagtgtcactctctga

SEQ ID NO: 64570 - DNA, 384 bp, Glycine max
  Peptide Sequence Number=SeqID_181348
atggcacaattagcaaatagggtaagaagaatagagaaaatagaatatgagaaagaaaggaacaaaagatttgataaaagtataagagagaaagtagcatacgtggaaacatatagagatgatgataattctataaattttcaagatttagatgttaatcaagaagatgaaatatgtgtggaagaattacaacctagatccccttatacttgtcaaatatgtatggtccaaaagacaattgacgaaggaagattgcaattcgaagagaaaccaatgaaggtggatactgatccattccacatccatgctaattatatcaaacccatgcaaatcatgatgatgggtgcttcaataagaacaccaaaagtgagcactccttgttag

SEQ ID NO: 64571 - DNA, 702 bp, Glycine max
  Peptide Sequence Number=SeqID_181349
atgggtgaaatagaggaggtgcaagagcagatgaaggccaacatggaggccacgaaagagaaaatggccacaatgatggaggccctgatgagcatgaagaagataatggaggtcaatgtggctgtagttgccgctaccaacggcgttgctgaggtggacccaactcccctatctggcctcaatcaagtaaatccttcagtctcggatatggtaggtcagggaggagaaacattgggaagtacaaacagcccccatgtcgtgcaaagcaagaatcctttcccaccatacggctttcctcccaactatacaccacccaatgttacacacactcccgatgagaatgtcagtaactccactcctatactcatggagagccaacaacctcaatatgatcatgcacatgtctctcaacccatgggggagacacatgaagtaccccaccacaatctagccgacttcgagcctcgcctcggatatgccattgaagggcaagcatttggtggtgtacccctgccaaacactttggagggccctcaatttcgcccacaaccacaacccttgcatttcacgatggggagagtccctcctgctatgatggaaaggggaaaatttgatcatatagaggaaaggctaagggtcattgaaggaggcagagattatgcctttgctgacatggaagagttgtgcctagtaccaaacgtg

SEQ ID NO: 64572 - DNA, 231 bp, Glycine max
  Peptide Sequence Number=SeqID_181350
atgggagaccccaacttgcccaagctagcatttggctcgcctaggccatggaatcacctcctggctaagcaaccagcttacctaggtgagctcattacatcagggctaaggttcaggtcgcttaggcgagctccagctcgcccgagcaagcttaaaccgccccaaggtgactattttcctataaataggcatgattggggtgttttaaggggtgagaagggtcagcactaa

SEQ ID NO: 64573 - DNA, 391 bp, Glycine max
  Peptide Sequence Number=SeqID_181351
ggaggtcatcaccaattgtaacctctatgacctccctatgaagggtaaaaaatacacttgggctagaagaaaaggcaaatcagatggagtagaagaaaagtatgatagagcactagcgctttgcaagaaggagttggaagagcttattgagttcaatgatgaagattccatagtaaagtacaagaccacatgtgataaactgaataatctgattgctcaagaggaggcataccgaaagcagagggctaaagtctattggctcaaggatggtgacatcaacttgaaatttttccacttagatgctttagctacgaaaaaatggatattatctcttctatttcttgtgaggatgggggttgcccttgctcctatgtatcctcgggtgcgatga

SEQ ID NO: 64574 - DNA, 195 bp, Glycine max
  Peptide Sequence Number=SeqID_181352
atggaggttgaggaatctttgctggggttatggctaccattgcattatcgagcagataggggagcttttttctggaaaattccttccttagttggtgctttggttggtgctttggtttgtgttaagggtgaggtggcctttgtggatgattacgcgttcttggctgatagggtggtgggtaatgagaagggctga

SEQ ID NO: 64575 - DNA, 360 bp, Glycine max
  Peptide Sequence Number=SeqID_181353
atggagaggatactgcattggatgatggctcataaggaaagcgtggcaatgaagatgaagatatcgaaaatccagatctccataaggacaaaaacccacaaggccttccccgacgtgtacctcatgttgaaaggagaagattataggaaattaagtgaatgtgaactagttctcaatctaaactatatctcaatttgggactttctcaatctaaactggtttttgttatgggagatgaaggttgatgtagggttaaggcacatggtgtggaatgatgaggagaaggctgagttctatagggaacccaatgagaaagaagagggtgggaccaacagagaaggcgcatattggatgaggtag

SEQ ID NO: 64576 - DNA, 315 bp, Glycine max
  Peptide Sequence Number=SeqID_181354
atggattcaaatgttgaagagagagcacatgaaagtaaaaattattttggagtgctagctggatcagcagattcacaacaggacaaagacacccatgaaaacagttggaaaattttaaagtctcagaatggtcatatcttgaaaaaattgctatcccagttcattaaagagattgttgagggaatgattggttttgttcaccttccaactatcatgtctaaactcctgtctgataatggtagtcaagaatttggtgattttaaacataccatattgggaatgctgggaacatacggctttgaaagaagaattctg

SEQ ID NO: 64577 - DNA, 564 bp, Glycine max
  Peptide Sequence Number=SeqID_181355
atgagcatccatgtggctcagttaatcgctgatgccatctatatttttgcagtccaacagggccctgggatttcccgccttgatcacaggactctgccagtcgttcggcgtcccgtcacacctagcaaggtgattcagccgcctatcacccaagcttttattgagaagtactgcacgcagagacaggtccagggtgatgcaccacaggccgtggacgcgccgccacgtcatcaggctggtccagccggatcatttgatacagagcagtatttgcggcatttggttcgccaacaggcggccaaccaccgggcacatgtacagactcatgattgtctttatcagatgagtcttagcctgcagagccagggctttacttcttttccgtgccctactctggaccagttcagggcagaggttgtgtggcctggagattggcccgagacccgggcaggagaggcaccagcggaggcaccagcagaggctcccgacgaggcagatgaggcccgcgaggacgaagaggtgaccgatttacttgatttcttaggagggagcggggccacatga

SEQ ID NO: 64578 - DNA, 242 bp, Glycine max
  Peptide Sequence Number=SeqID_181356
gacccaacaacaacaacaacaacaacaacaacaacaacaagaatatacagacatttcagaaaatgtatcaacagaaaaatcatcacaatttcaaagcatgctgttgcaacctaccctacaacgagaatgagggcgaaaagccaaaggagcatcttttagaaaggaaaacgcgtgggagtcaccaccaacatttatttgaggaaaatgtgagaaaaaccaaaaaggaggtatacgaattttga

SEQ ID NO: 64579 - DNA, 168 bp, Glycine max
  Peptide Sequence Number=SeqID_181357
atggtggatgattcattcatgtatattgaagtatttatgactatagtcatgaatgtcgcccaaatgatcaatgttgcccattacttttgtagtggtacaaaaagtagacaaaaggccctgcgcgctctacgtctagaggattttgtgaatccctactgcttatattaa

SEQ ID NO: 64580 - DNA, 1143 bp, Glycine max
  Peptide Sequence Number=SeqID_181358
gtatgtacttcagatgattcatgtagatatggaagagttactgagctttatgtgtatgacaaattcaatagggtccctgcaaataaggtggaggcaggagatatatgtgcagtatgtggaattactgatattcagatcggggagacaattgctgataaagtatctgggaaaccactaccttcaatcaaggtggaagaaccaacagtgaaaatgtctttctccataaacacttcaccttttgttggccgtgagggaaagtatgttactagtaggaatttaagggacaggctttatcgtgaacttgagcggaatctggctatgaaagttgaagatggtgaaacagctgatacatttgttgtcagtgggcgtggaactttgcatatcaccatacttatagaaaatatgcgaagagaaggatatgaattcatggttgggcctcccaaagttatcaacaagaaggtggatgaaaaactgttggaaccgtatgaggaattgctgcagattgcaactgtggaggtaccagaagagcacatgggagctgttgttgaacttcttggcaagagacgaggacaaatgttcgatatgcaaggagttggattggaaggaactacactactcaaatataagatcccaacccgtggccttcttggattgcggaattcaattttaactgcctcccgagggactgctattctcaacactgtttttgatagctatgggccttgggctggtgaaattagtactcgggatcaaggctcattggttgcttttgaggatggaacaagtacttcttatgcaatctctagttcacaggagaggggacagatgtttattggtcctggagtggatgtttataaaggtcaaattgttggcatccatcagcgacctggggacttgtccttgaatgtttgcaagaagaaagctgcaaccaacatacgttccaacaaggaacaaacaggcttttcagagtatgtttggtttatgtatcccaggttgacaacattattgattcttgatacgccattggactatagtctggatgactgcattgaatacatccaagaagatgaactagtagaggtcacccccgcaagtatccgaatgtccaagaatccaaaaattacaaacaagaaaacaaggtag

SEQ ID NO: 64581 - DNA, 201 bp, Glycine max
  Peptide Sequence Number=SeqID_181359
tgtgactttcaagtaatatatgcaagtggtataaaagggcaagcagggttgactcctgaaaatctggcagaagaccttggtccattgtttgaatctatcattagatgcattcctggaccacgtattgacaaagatggtgcccttcaaatgttgcatatttttatacgtattaatttaccaccttgggggaaacagaaataa

SEQ ID NO: 64582 - DNA, 750 bp, Glycine max
  Peptide Sequence Number=SeqID_181360
atggaacacaaacacatcgacgaggccatgcaagatgacaactgggtgaaagcgatggaaaaagagcttgaccagtttcggaaaaatgatgtttggaagctattcaaactaccaaaaggaaagaaagcagttggagcaaaatgggtctttcacaacaaattagaagaagatgataaggttgtgagaaacaagacaaggaagtttatgttgaactacctcctaaatttgaaagtgaaacctttcctcaacatgcttttaaactcaacaaagccctacatggacttaaacaagcttctagaactggtgaatgtgggtgatatcattttcggtgcaactaatgaaatgctttgtgaagatttttccaagttaatgcagactgagttcaaaatgagcatgatgggagagctgaaattcttccttggattgcaaataaagaaaacaccccaaggcatttatattcatcacaaccaatatctaattggaactcataaccttggtcttatgttcaaaagaagtgaaagtttcagactcacaagctattgcgatgtggactatgctaaggataaagtcgaaagaaaaagcacaagtgaaagctgccactttataggtggcaacttagtaacttgtgatgcaatcctccctaggaagggactagtcactagagccatgagcaagaggctccaagaggattgggctagaactgctgaagaaggccctagggttctcatgaacctcagggtagatttctaa

SEQ ID NO: 64583 - DNA, 603 bp, Glycine max
  Peptide Sequence Number=SeqID_181361
gtggtaggcagagatacccaagtggttatccgtacaaaatgatttctgttaatcctgacccgagaagtcagactaacgttgtcatctgcaccctttgtcaacaaggggcaagcgagcctgttgacacgcagagactaacatcgtcttctgcacctttgtcatccagagacggcgagtccgatgacatgcggagatacccaagtggtcatccgtacaaaatgatttctgttaatcctgacccgagaagtcaggtggcaggcagagatacccaagtggttatcaagactaatgtcgtcatctgcaccctttgtcaactaggggcaagcaagcccgttgacacgcagagactaatgtcgtcttctgcacctttgtcatccagagacggcgagttcaatgacacgtggagatacccaagtggtggagatacccaagtggttatccgtacaaaacgatttatgttaatcctgacccaagaagtcaggtggcaggcagagataccttatggggcaagcgaggccgttgacacgcagagactaacatcgtcttctgcaccattttcatccagagacaatgagtccgatgacatgcggagatacccaagtg

SEQ ID NO: 64584 - DNA, 147 bp, Glycine max
  Peptide Sequence Number=SeqID_181362
atggatttcttggccacggttgcggcttaccctatgccagatgacaaaatcagaagcaccaccttgaagggtgaaggaggtggcaatgtcggcaacgccttaacctgccttgctcgcttgggcttaaacccaaggctcatttccaag

SEQ ID NO: 64585 - DNA, 411 bp, Glycine max
  Peptide Sequence Number=SeqID_181363
atggctggggaggttgaagaatcattcagcatgaactttcagggatacaacaataacaaagccttatcccatatgagccgttctcaagcccgggttaaggaggaaggttgtgtttggcccttagcagccaatataaaactcacggtagattctatacattctggttgtatctcatttgggagatttgaaaatgagcctttatcttgggagagaaggtcctctttctctcacaataggtacttggaggaggttgagaaatgttcaaaaccaggttcagttattgagaagaaagcatattttgaagctcatttcaagaggaaggacatgtttggttttattccatctacaggtcataagggatcatcagatagagcaaccagtgaaaatgatggatcagagagaaatgcctag

SEQ ID NO: 64586 - DNA, 1200 bp, Glycine max
  Peptide Sequence Number=SeqID_181364
atgactggtcagattagggaagaattgaggactcaaattaaggaagaattgagggctcagctagaagaggaaaataaaaggagcttggaaataatgaccatggcattgaaagaggctattaagaaagagttgtcacataaaggatccccagagtcaccccaaattcagccggacatacaacaattaggtgcgcgtgtcagcactaagggaagtaatgttgttatcaatgtccagccttcacaggaacatgatgctgatgtcataccaatgatgggactgtatgtgcaacgtaaggatggtacactcgggttggtggccatggggaaaataatggagggggattcaatcatacacatagtggcttatgcagatgatgttgtacaggtaactgtagagacaattatcgatcctgaggctgaggtcccctatgccacctcagaaatacaatatgtgaagcaggccgtcgatacatttgtagcttggcccacagaccttgtgaaagcaattgtagatgaggagccagcaattattccgcacaacaaggatgcacatgtgccaaagccggctaatgtggacgcagatgatccgttgtgtgggctgataaagtatagttttgatatttatgacaagccagttgaaatcaactttgatgggagctgctttggtattgtacatgcacctacatcaatattcataacatattcagatgctagtgaaataatagcaggagacaaaagtcttaacatatatgtacaacaattatggtatatgcatgagtggagtcaaaccttgggtcaaggttcgatgtatgcattccttgagccacatttgctggtggtttcaaaggatagacgcagcgaatgccaacaatatcttgaaaaatggattaaggaatctgaccgagaggtgtacattggaccttacttccatcatgtaatgacgaaattaaagacgacattgtctcctgaaactaaggcagctgcacctaagtggattgaagttaagagtcatgttcaaccaagatgttatgaatgtggatattacgtaatgcattggatgtggaacatcataaccaacgagataaagagtgactggtccatgtggtttgctgatgagacaccgttggacatcggcaacataacaacaattcgaaagaaatgggcaacatattttttaaagactgcgtgtaaaaagggctaa

SEQ ID NO: 64587 - DNA, 861 bp, Glycine max
  Peptide Sequence Number=SeqID_181365
atggtggggatagggaagcggtccttcacggtcacggcgttgagagctctacaatcaacgcaaaattgccaggtaccgcccttcttcttcaccaacagcaccgatgaggagaatgggctatggctgagggttatgaggccggtcgatagaagtgaatttggtggaaaattagtcacgggggtggtaaggatgtgggggtctggaataggtgagaatatcgaagaagagggtggtggattgcggggagagggaggtgtccgcgggggtggttggtgcatcagcgtggagggcacgtttatgggccaactcgtcaggggtagtgggagaaggggtggtggagttgggtgggttggggtggtgggcatggggcgtgctaagcaagaaggaggggggaagacctgtgacccggttcgcgagctgttcaaactcgtggaggtaatcgttcaccgagcctcgttgagtaagcttggccagtgtgccttgggggtcatcataaaatgtcggggcaaagcgagtctcgagcgcgtggagcaaggaagaccaggaagtgatcaaatggttgcggtgcatccattgaaaccagctcaaagctggagcatccatataaaaagaagcaacagagatgcgttcctcctcaggggtctgatgatagtcgaaaaattgggagatcttaaagatccatcccatggcgtcttggtcgtcgaagcgcggcacatcaagcttaagggtatggcagtatggggggtgaagttgaagttcaaggagttggtcctggatggaatcgagacgaagggtgaggtcatggtgagcgtcggtaagggtggactggttctgggcaaggcgactgatggcctcttctaa

SEQ ID NO: 64588 - DNA, 714 bp, Glycine max
  Peptide Sequence Number=SeqID_181366
atggctttcttggcttctcaagtcacatgtcgcactctccaagatgcatccatgtatgagaggcatgaggaatggatgagtcgttatggcaaggaatacgagttggaacgggatgatcgtttgccattttctttcttcttggatcaggatcccactgatctcgttcatattcttgtcacattgattcggtggagattagaaaaagtaggagagagaatatgtatttacggaaaaccaagatatgtgttccttggtcacaagaaaggagcagttacacctgtcaaggaccaaggtcattgtggattttgttgggcgttttatgatgttgcttcgactgaaggaattcttgcactgacggctggaaaattgatctctttgtcagaacaagaacttgttgattgtgacacaaagggtgtggaccaaggttgtgagtgtggccttatggatgatgctttcaaattcattattcaaaatcatggagtcaagatgccaattacccttataagggtgttgatggaaagtgcaatgcaaatgaagaagccaaccctgctgctactattactggctattgatgcgtgtgactctgactttcagttttacaagagtggtgtcttcactggttcatgtgaaactgagttgaatcatggtgtcactactatgggatatggtgttagtcatgatgggactcaatattggttggttaagaactcgtga

SEQ ID NO: 64589 - DNA, 375 bp, Glycine max
  Peptide Sequence Number=SeqID_181367
atgactgatgggatggaaccaagagggagacaagggaatatgcttcaaggttcgttctttgaaaatttaagatttttcttcttccttcaatcaagcaaaaacatgggtttccatttacctgctattcgacaggcatcattggcagctagccaagcatcttcaaaatttgtagaagtaccaaagggctatcttgcggtgtatgttggagagaaagaaaagcggttcatgattgccatatcatacttgaatcaaccatcattccaagatcttttgtatcaagctgaagaagagtttggatatgaccatctcttgggtggacacacaattccttgcagtgaagattttttccaatgcataacttctcacttgaattga

SEQ ID NO: 64590 - DNA, 414 bp, Glycine max
  Peptide Sequence Number=SeqID_181368
atggaggatgagaaagcaatggaggatctaataaatggtgtggaatttgcaaaaagagctctcatgaagagaaagattgctggaacaaaggcaagtcacaatgtcacaattgcaaaagaaaatagtgaaggcaacctgttctttgcttgtcagaaagcaactgaagaatataaaaatgtgtggtatctagacagcggttgcagcagccatatgatgagagataaagatgctttcattgacatggattcttcatttggctcaaaggtcaaattgggcaatggagaatttgttgaagttgaaggcaaaggcagcattggagttgcaacaaagcaaggagatgaaaacttgttaagcatattgggcagcttttggagaatggttattctcttcaatttgagaattgggagtgcataa

SEQ ID NO: 64591 - DNA, 246 bp, Glycine max
  Peptide Sequence Number=SeqID_181369
atggaaattgctgaagaaaggactaagtttcatttgactaacatggttcgtgagagaagaagtggagtccctgagtggcgccaaagtgtctctctcatcactgaaccaaaattctacggaagagaagaagataaggatagaattttagactttttgattcatgatgcttctcattttgaggatttatctgtctatccaatagttggtctaggtggactaggaaaaacaacactcgttgagcattaa

SEQ ID NO: 64592 - DNA, 135 bp, Glycine max
  Peptide Sequence Number=SeqID_181370
atggattgtttctactctggtattgctccaaaattcacaacagcaatggatgaagatgttacaaagttaggtggacatgaaataggaattactccgatatgcaggattatagatgcgaagccgcaccatacataa

SEQ ID NO: 64593 - DNA, 202 bp, Glycine max
  Peptide Sequence Number=SeqID_181371
atgggtttccgtttcccttctattcgacaagcatcattcatggctagccaagcaacttcaaaatttgtagatgctccaaagggctattttgcagtgtacgttggagagaaacaagcggttcatgattcccctgaagaagagtttggatatgatcatcccatgggtggcctcacaattccttgcagtgaagatgtattccaac

SEQ ID NO: 64594 - DNA, 366 bp, Glycine max
  Peptide Sequence Number=SeqID_181372
atggattcattgcttttcaagccacatgtcgcactctccaagatgcatccaggaccccaggaaagggaaaagcgtttcaagatattcaaggaagatgtgaattacattgaagccttgaacaatgctgccaataaaccttacaagttaggcattaatcgatttgcagacctcaccattgaggagttcattgcaccaagaaatagattcaatgggcacacgcgtttctcattcataactacaaccacttttaagtatgaaaatgtgactgcactaccagactcaatagattggagacagaaagaagcagttacacccatcaagaaccaagactctgttggaaaggagaagctaataggaagtatttga

SEQ ID NO: 64595 - DNA, 321 bp, Glycine max
  Peptide Sequence Number=SeqID_181373
atgaaggcacccccacagagcgaccacgaagagaagtctcgtgccctaaacaccttgaagactatgtgtgagctgaactgcattatttgcagcaaatcaagcatcttcaaaagtggtggatccatcaagggctatcttgcagtctatgtcgatgagaaaatgaagcagttcgttatcccggtatcacacttgaaccaaccttcattccaggaattgttgagtagagctgaggtagagtttggatattatcatcccatgggtggcctcacaattccttgcagtgaggatgtcttccaacgtataacttcttgcttgaattga

SEQ ID NO: 64596 - DNA, 411 bp, Glycine max
  Peptide Sequence Number=SeqID_181374
atgagtgaaactgctgaggcgccctctgatctgactatgcctttacttagataccaaaaagaatggttagcctggggtttgaaacaggaaagttctgtgagtaaaggtggaatacttgcagatgaaatgggaatggggaagactgttcaagcaattgctcttgtccttgccaaactgttcaagcaattgcatgggaaggagcaacagcctgtcgatgatgctgttgggggagacgaaacaactactggcaagggaagtaacaataaagataaaggtgttgatgttatatcttcagattcagatatagtttctggtcctgattctgattctgattttgaagatttgggatttatgcttccttgcatcctgtattctgattctgattctgatattcacactcacagtggttga

SEQ ID NO: 64597 - DNA, 678 bp, Glycine max
  Peptide Sequence Number=SeqID_181375
atggctttcttggcttctcaagtcacatgtcgcactctccaagatgcatccatgtatgagaggcacgaggaatggatgagttgttatggcaaggtgtataaggaccctcgggaacgggaaaagcgtttcaggatattcaaggaaaatatgaattacattgaaacctccaagaatgccgccattaaaccttacaagctagtcattaatcaatttgcagacctcaacaacgaggatcacaagaaaggagcagttacacctgtcaaggaccaaggtcattgtggattttgttgggcgttttatgatgttgcttcgactgaaggaattcttgcactgacggctggaaaattgatctctttgtcagaacaagaacttgttgattgtgacagaggtcaagatgccaattacccttataagggtgttgatggaaaatgcaatgcaaatgaagaagccaaccctgctgctactattactggaataccatgggtttccgcatacatggtattattaggtgggcttcgtcccaagcaacctcatcaagggttgccaaaaggctatcttgcagtctatgttggagataagatgagacggttcaggattccatctcctagtgtgagctttgttgtcaattcaagcaagaagttatatgttggaatacatcttcactgcaaggaattgtga

SEQ ID NO: 64598 - DNA, 1384 bp, Glycine max
  Peptide Sequence Number=SeqID_181376
aaccaagctaaatgctgatggttctatcaacaaacacaaggcaagacttgttgtgaaaggctatgctcaaatctttggcgtggattactcagacaccttcgcaccagttgctcgtttggacaccataaggattttgcttgctgtagttgctcaaatgaattggaaagtgtatcaacttgatgtaaaatcagcatttttaaatggtgttttacatgaagaaatttacgttgaacagcctgaaggttttctgaaaaatgaagaaaaggacaaggtgtatcttctcaaaaaggctctttatgggctgaaacaagctccacgagcttggtacagcaagatagatgaccatttgctgagcatcgattttaaaaaaaacttgtctgaagccactctttatgttaaacattggagcaatgaagttctgatgatttcactttatgttgatgatcttttggtgacaggaaataatgcagggatgattcaggaattcaaacaagaaatgatgaaggtttttgagatgacagatctcgggttaatgaccttctttcttggattggaaattaagcaggctgagtatgaagtcttcatctgccagaagaagtatgtcaaggaaattttgaagaagtttaactttcaggaatgcaaggaagtaagcactcctatggatcaaaaggaaaagctgtgtaaggaagatggagctgataaagctgatgagagatatttcagaagtttgattggttgcttgatgtatcttactgcaacacgtcctgatattttaaatgctgtaagcattttgtccaggtttatgcacaatgcaagcgaattacatctcagagctgctaagagaataattcgatatgtcaaaggcacaagtgattttggtgttaagttcacatggagcaaagaatttaagctggtgggtttctctgacagtgactggggaggttccattgatgatatgagaagtacatcaggctactattttactcttggatctagtgttttctcatggagctcgaagaagcaagagaccgtggctcaattcactgctgaagcagaatttattgctgcaacagctgctgttaatcaagctttgtggctgaggaagattttaatggatctaaatctggagcagaaagaaagcaccaagatttttgttgataatcaagctgcgatttctatctcctataatcctgtgtttcatggaaaaaccaagcatttcaacataaagttgtttttcttaagagaagtgcagaaagaaggacttgtgactttggtttattgcaagtctgaaaatcagctggcagatttgcttacaaagccactcccagtcagtaggtttgagtttctaagggaaaaaattggagtttgcaaggaggagtgttaa

SEQ ID NO: 64599 - DNA, 300 bp, Glycine max
  Peptide Sequence Number=SeqID_181377
atgattcatgttgatgaattaacagtgggagagaatatggatgtgaaattttcttttggagaaggttctttgttcgggtttgattcttgggagggggtgacacaaggtattggagatgcatgcaaacattcgggcattagaaactttattaaggaactaagcaagtggtctggttcaccaggatactgcttagaaattggaaatggatcctgggattcttggactaagcctctattaaaacagacatctattgcctgtgagaaggtggtgaacttgtttggtaattttctgttccagtag

SEQ ID NO: 64600 - DNA, 300 bp, Glycine max
  Peptide Sequence Number=SeqID_181378
atggcacgctcggccaccgcgttcctcccctcggcgccgatggtctacgcggtgatctccgatccagggatcgtagacaaccccgacatcccgagctaccaaccgcacgtgtacggaaggtgtgatcctccagcgctgattccgcttcaaatgaacgcgagaaatgtacacaacccagtgaaccaacctgaatggcgctcaccgggcactgacactggtctcgaagaatcgatgtggcatttgactttggttttgttattttgctgcttgagttatttatctcgtatcactgattgttga

SEQ ID NO: 64601 - DNA, 630 bp, Glycine max
  Peptide Sequence Number=SeqID_181379
atgcaggtgcttaacttaatgagggaatttgaacttcaaaggatgaaagagtctaacacaatcaaggaatactccgacaaactgctgggcattgccaacaagataaagctattgggtagtgattttgcagattccaaaattgttgagaaaattctggtaacggtgccagagaggtatgaagaatctattgcttcgttggagaacacaaaggatctgtctaaaattactttttcagaagtgctacatgccttccaagcccaagagcagcgaagattgatgagggaagatcatgctattgaaggtgctcttttagccaagagccaacaagcaaaaaactacaagaagaatcatccagtgagcagtcaaagcagtgcaaacaattacaacaaaggaaagggtgaaaagaaaagttacccaccatgtcagcattgtggcaaaatgggtcatcctccatttagatgttggcagagacctgatgctaaatgcatcaagtgcaatcaaatgggacatgaagcagtcatatgcaagagcaaaaatcagcagcaagaggaagaagctaaagttgctgatcaggaggaggaggaggaggatcaactctttgtggccacgtgttttgcaagcagtgaatag

SEQ ID NO: 64602 - DNA, 237 bp, Glycine max
  Peptide Sequence Number=SeqID_181380
atggcagctgattttccagaacttgatgatcacgtaccaacatgcaaggcgtgtctatttggaaagcaaaaaaggaagaacaagcgtgacaagcttgataaaagagcatcaccaggcatttttataggctatagcactgttagcaaagcctataaaatttttcagccacaaactggaagcattgttgttagcagagatgttcacttcatagaagatgaagagtggaactgggatgag

SEQ ID NO: 64603 - DNA, 282 bp, Glycine max
  Peptide Sequence Number=SeqID_181381
atgatatgggataacaaaccgcttcattttctctccaacatagactgcaaggtagcctttggcacctccacggcttttgaaggtgctaatttgttttcagcaaccgatgtcttcctgatgccagaaaaatgggtttccgtttaccttctattcgacgggcatcaaaagcggttcatcattgccatatcatacttgaacctaccttcattccaggacttgttgagtcaagctgaggaagagtttggatatgatcattccatgggtggcctcacaattccttga

SEQ ID NO: 64604 - DNA, 893 bp, Glycine max
  Peptide Sequence Number=SeqID_181382
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcacccagcacgagcggatccacacgggggagaagccctacgcgtgcggggactgcggcaaggccttcagccagaacatgcacctcatcgtgcaccagcgcacgcacaccggggagaagccgtacgtgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64605 - DNA, 468 bp, Glycine max
  Peptide Sequence Number=SeqID_181383
cgggaaaggagtctatctatctgcctagctttggtagatttcccccaacgcaatccatataaattccacgaacccccccccttggtggataagtccgacgactcagcagcagtgcggaatggagtttctcgtctggtggatctgatctttagggggcaatacataccaaaaggtgctttagtgatctttgatggtctgaacaaggaactctgtgtggggatccatcttgttgttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctggtgaagttttattaa

SEQ ID NO: 64606 - DNA, 616 bp, Glycine max
  Peptide Sequence Number=SeqID_181384
gcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggcaataaacatcactgcaccaaaagggtggtccggccgcatctgggggcggcgtggatgcaccttccatagctatggcagtggcacatgcatcacaggagactgtggaggcaagctgaagtgtgatggagttggtggtgcaccaccagcttcactggcagagtttacactagacagccaggaggggggtttttatgatgttagccttgttaatggttacaatttgccagtgtcaatcttccctaccggaggatccgggcagtgtaaggcggtaacatgccagtcagatttgaacagaaactgccccaacggattggaggtcagaaaccaaagtcaatcaagcttatcgataccgtcgacctcgagggggggcccggtaccagcttttgttccctttagtgagggttaa

SEQ ID NO: 64607 - DNA, 917 bp, Glycine max
  Peptide Sequence Number=SeqID_181385
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgctgcgtgatcgtgcaggaggccccgaagaccgcgggcttcggcgccgagatcgccgcgcgcctggccgaggaatcgatctacgacctgctggcgccggtcgaacgcgttactggctacgacacccacattccgctgttccgcctggaaatgaagtacctgccgagcgttgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 64608 - DNA, 231 bp, Glycine max
  Peptide Sequence Number=SeqID_181386
atgaggcttcactattatcaagcgagtcggagacccaacatgaccacatatcaacctccacttcttatgactcacatagacccgagtataaggcctaatatctcaatgtccccagtagagtcgccaactgtcgcaacctatccttcggcgggaagacgaggtgaaaataaaaagcgcgtcttccaaaatggaaaacgcatgggagtcaccaccaatgtttattcaaggtaa

SEQ ID NO: 64609 - DNA, 252 bp, Glycine max
  Peptide Sequence Number=SeqID_181387
atgtcaggatttacacgcaattctcctcaaatttcagccagcccgcatcaattagaccttgcaccttacgcttcagagccctacaatgctcaatggaacgccccggggcttctccgtgacaaacacacgttgcgttcgagtcgtattctcggagaaatggaggttgatgaaccttggctagggttatggctaccattgaattatcaagtggtcttcgtcattggaagtgcggtagacaggctttgtggttga

SEQ ID NO: 64610 - DNA, 246 bp, Glycine max
  Peptide Sequence Number=SeqID_181388
atgacattgctacttagcaacattatgcccagcacccgcaatgccaatctccccttgcggaagtatcagttggtctgtgccgtcctcaagaagcataagaaggctataggctacaccctggtggacattcctggtattagcccatccacatgtatgcatcggataaatttagaggatggggctaaaccagtaagacagccacagagaagactcaacccggtgattcttgatgtagtgaagaaggag

SEQ ID NO: 64611 - DNA, 372 bp, Glycine max
  Peptide Sequence Number=SeqID_181389
gtatcatccccttcgacaaacatattgcggcagtaaagactaccagcaacaatatgttatcaaagagaaaaactctagatgagggttcactgttatcaagcaagtcggagactcagcatgaccatagattcacctccactccttatgttcctatggacccgagggaaccgacaaaagaggaagtcatgatattgcacgagattagaaggcctaactctctaaaaacaatcccaactggagtagccaactgtcgcaacctacccttcggcgggagggcgacacgagggctcacgggtgtgtcttccaagaaaggaaaatgcgcggagttgccaccaacttttattcgaggaaaacgtcggaaaaactggaaag

SEQ ID NO: 64612 - DNA, 459 bp, Glycine max
  Peptide Sequence Number=SeqID_181390
atggagaattgcactaagcaatcactacgcatggctccaaaaaagtggggaggatgcatgaacaaaaacgtaattcatggggctccaaaaaagggtagagaatggagaattgcactaagcaatcactacgcatggctccaactcgtgggtggaggatgcatgaacgaaaatgcaattcatggggctacgaaaaagggtagagaatggagaattgcactaagcaatcactacgcatggctccaaactcgtgggtggaggatgcatgaacgaaaacgcaattcatggggctccgaaaaaaggggtagagaatggagaattgcaataagcaatcactgcgcatggctccaaacttgtgggtggaggatgcatgaacgaaaacgcaattcatggggcttcgaaaaaaagcggagaatggagaattgccgaacaacactacgcaataacgtcgccgggctgtag

SEQ ID NO: 64613 - DNA, 192 bp, Glycine max
  Peptide Sequence Number=SeqID_181391
atggtggtgagcttgttcttgactcatcttctccttgaagtggcatctctaatcacctttcctatttctccaccactgccattggtcttcaagaagcaaaggactccattgatgaagaagattcatggcctacaagctctacatggagctacatcttgtggtatgagagcatcttcctctagtttagagtag

SEQ ID NO: 64614 - DNA, 314 bp, Glycine max
  Peptide Sequence Number=SeqID_181392
atggaggatcaaatccctgacaataaaacatgcaaaagaggtgtccagaaagttaagtgggaaaagcgtaaatctttggaatcagtggatgagtgggggaaagctggagtaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 64615 - DNA, 317 bp, Glycine max
  Peptide Sequence Number=SeqID_181393
aggaagcactgggtccaacaaagataggagaaaatcactcaaagtgtatcaatctcacacagtgcgtggcgagaaagtcgctagcgcacaggattttgtcagcaatcaaagggagaggaccactttaggtcgtggtttcctttttcttgtttacttggtgacaattctgtattgttcagatattgtctggtccaaagacctttctggatggcaaggattgacattctcaccctgggtcaaggtttatgataagttgggattttggctcaaggcttgtagaacggctggtcatgatatatgtcagggtttggccagcg

SEQ ID NO: 64616 - DNA, 578 bp, Glycine max
  Peptide Sequence Number=SeqID_181394
atgtcactcactaccgggcaacttcatggatatgaggtactgtctgagcctcccgctgaggtcaatattgcagagtggtttgaacagtgctcttccgcccagcttctgcagttgagaaagtggcagctcaacacccttgcaagacaaagaatccctgtaaagctctttgttaacctcaccacgaccattctcgccagcgaagagggagccgcggcgcttctgcaagaccctttaccgggggtcattgaacttcaggacccaatggcaatcgcccgtcttgacgcctccaggctcgcattactggatgagaatctccggcggcttcagcatgccggtatggaggtctggctcgatgattatctcagcgactatgacagtacgcttgccgatagcgggctggtgtttgatggggtgaaactcgactgcgctgctttccagcaatatcgcaacgattgcgcgggtttagcgcaactgattgctgaagcacggcgtttcggaacggtggtccttgcagaaggtgttgagagtcagagtgacgtcagaacggcatcgctggcgggtgccgatcttgctcaggg

SEQ ID NO: 64617 - DNA, 512 bp, Glycine max
  Peptide Sequence Number=SeqID_181395
gttacaagcactggaatatctcaacctctatcaggaagtgttgatggcatcatcgaccctccatcccccgtcagacgccacgattcctttgaggagcaggcgtcacaaggatccttcgtcccccatcgacgtcaggatgttctcactattgctattggatgtccagagcaccctggacgtgtccatgttgctggagccggtgtcaccatcatgaaatactttagatcggctccacggatgtcccgcaactcttcctcgttgcctcttgaagaattgcatcagctgacccagcaaatcagggaccaactagaggagttgatcacagaaaaagtgactcgacagcttatgacatcattcagccagatgcagtcccactttcggtcccagatgcaatctcagggacttgcactgcctccggagcctctggttggttcctcaggtcctcgagtaagcacaattgagagttgtgttgatccctcaggaaacgatcctgagacgggtgactcagacag

SEQ ID NO: 64618 - DNA, 300 bp, Glycine max
  Peptide Sequence Number=SeqID_181396
atggtgtcacacactagaccctcacacttcaacccaattgcaaggccatcattcaccaatatgcttaaccttgagatgaagggaagccacattcagaacaatcaattccatgagcatagtcatgagaattcatacacacatttttctgccttcattgatgtatgcaacaccgtgaagatcaaccatgtgctggatgaggctttgtgcttgtgtttgtttcccttttctttagctggagatgccatctcatggttaagatccttcctcctaacaaattttctaggtgggatgatgtggtag

SEQ ID NO: 64619 - DNA, 306 bp, Glycine max
  Peptide Sequence Number=SeqID_181397
atggctgttcatgtgcctttatctttagaagctcaagcagaagctcgtttacttaggttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttagatcatatagatggttggtatctaagataa

SEQ ID NO: 64620 - DNA, 778 bp, Glycine max
  Peptide Sequence Number=SeqID_181398
tggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 64621 - DNA, 399 bp, Glycine max
  Peptide Sequence Number=SeqID_181399
atgcaatcacaaggactagtattgcctcttgagcctgtggttggtccttcagctgctcatgtcaacacaaagaaaagttgtgttgatcccatagggaataacccaaacacgagtgactcagagaaatgcaggttgtacgtcaaagaaaatcctccccgcctggtttccctaggaagactttatgagtggtcgacaatcgttcacaacatcactttgcgcaatgatcaagtcaaggttggtgttgaggaagttagagatgcaggtgctcccattcttgtacccactcaagagggagttgtgggaccgataaaacctgtagatagaccggatcatgatgtcgatgatcccttatatttgatgacatggaccatcccacagctttttctaaagctgttgtag

SEQ ID NO: 64622 - DNA, 427 bp, Glycine max
  Peptide Sequence Number=SeqID_181400
cttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 64623 - DNA, 187 bp, Glycine max
  Peptide Sequence Number=SeqID_181401
agcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 64624 - DNA, 255 bp, Glycine max
  Peptide Sequence Number=SeqID_181402
atggacgaatacgcaagcatacgtttcatgcttgtttggctaggatttccagaagaagatgccattcgtttgatgagaaataaaaagggatatcgaaaattcgagtggctgaagctgaagcagcttactttcgaagtaacagaaagaaaagcaacgactggagtgggagagtcagagtcgaaaagaggattcctcacttctttctctcattcaaaaccgtgcatgagactttcatctcgcacggctcctaagtga

SEQ ID NO: 64625 - DNA, 216 bp, Glycine max
  Peptide Sequence Number=SeqID_181403
atgctacatagttggtactcatccttcagagactacgagtataataggagcatccgtcaacaaaaggatcaccctaaagatgatcatctcgtggctattgagaacgaatcaaatcagatggaacaagtcatagagattgagaaaaatagatcattcacaaccactgatgaaggatacctcgaaaagttaaggattagtaatccttttgaaaattaa

SEQ ID NO: 64626 - DNA, 665 bp, Glycine max
  Peptide Sequence Number=SeqID_181404
tggagagagctaggctgatctttggcctagtctctcacatggatatgaacataggagcgcttatctctggccagatgacttctacagcccagtctaacacttctagacttgggtttccagctctgatcaccgcattatgtagatccagaggggttgtctctgatagcctcacttttgagcgcctgagcccggtcattaacttggcctacatcaggaaaaactgttggaaccccaaggctctaacaatttctatccgaggggttaggagggtgagggctaggccagctgagctcccttccacttttgcggctcctactccagcatccatgtcagtggtggcgcctctaggatctattccctcagtcgagcagttcaaagagatggtagtctggtctaggaatcaaccttctcttcacaaggaagataaaggtcccacagctcaggtaccacagaatatggaggatgagttctctgaggccaccattccagagccatttactgcaggggaggaggcaggtgacacacagatgacacaagtagctactgccacttctgagagatctcttgaggccacttcagagcctcctgcatcagcagtggacctaccttcacctcagcacgcaacagacccttctactcctgtcctagagatacctaaagactag

SEQ ID NO: 64627 - DNA, 234 bp, Glycine max
  Peptide Sequence Number=SeqID_181405
atgtttaatatgctaattgactatgagaatcaagttacctatgatcttctagactatgagatgaaaactgagatacctttctctaatgttctaaagttaccacaaaggtcatcacctccaacaattgtcgttcaagagccagctatagttcaagatcaggttaatgaaccaatcttaaagccaactcaacaacctatgaacccaatgcatgagccttctagaaaatctaattga

SEQ ID NO: 64628 - DNA, 360 bp, Glycine max
  Peptide Sequence Number=SeqID_181406
atgagtaacatgcaatgttactattccgatgagaatggtcatgtgcaagagaggtgtaaacaaatgaaggaggacttaaagaaattaatagatatgaacaaagatggcgccaactcccaagctaatgtagtaaaaagcgttgaaaatgaagatgacttgtttttggcaacaaatgatgaggttgctaaaacaaaatcccaagagaatgatttcaagattgagtcaagaacaattcaagaatcaagagttttaagtttcaagattcaagaatcaagtttcaagtttcaagaatcaagaatcaagaataatcaagatcaagattcaagaatcaagaaaagactcaatcaagataagtactaa

SEQ ID NO: 64629 - DNA, 249 bp, Glycine max
  Peptide Sequence Number=SeqID_181407
atgggagccatcctaaagaaaaagaaaaagaaatatgaaaaaattcatgatgaagaaatctataggtatgcctcaggaaaataccacacgaaaccacaggaatccgacaagatgacgccctctaaggtctcctaccaaaacataaaacataaaatgaagtttgacaatcaagaattatcagtaattacgaatgagtttcactaccctggtagagaagccatcaatgataaattcaattgcacttattga

SEQ ID NO: 64630 - DNA, 327 bp, Glycine max
  Peptide Sequence Number=SeqID_181408
atgtacatcaagtatggcccaaaatacatcacgaagcatagccaacaaaacaagttatccaatgaaacaaaacccccccacacttattcccaaaacaattccaaagctccaaaattccttaaggatatggtgatatcatggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacatcaaatga

SEQ ID NO: 64631 - DNA, 171 bp, Glycine max
  Peptide Sequence Number=SeqID_181409
atgggtcgtcggcttaagtggagttgtaacaccccgcttgaatcacatcagaatgagagggatccaaaggttgtgcaggatcagtcaatgatcctagaagcaaataaaactgattctcgaggtcttgggaaaagctacctacagagggttctgaccggtgaagggttctga

SEQ ID NO: 64632 - DNA, 771 bp, Glycine max
  Peptide Sequence Number=SeqID_181410
atgaaggatgacatgcaagttgcaatgaaaattcagtaccctggtgtggcagatagcatcaatagtgacattgagaatggaacgttacttggaggtcaagatgtagcagtaaaaaggcttttaggtgtttccactcaaggcttacatgaattcaagaatgagtatctgaaggagttagatgaacttagaactcaacttgtagcaaccagagcaactgctgatgcaatggaatcttcacaaaagcaattgaaagatgaagttttgagaattgagcatgatattatgcagctcaagaccaaggaattagctcaagaatggttgcatgcggaagaatggttgcaactcaagctcaagaccaaggaatttaaagcaaatttctaccacaagaacatagatattaagatcatatcaaaccataacagcaatgatatgttcataggagggatagacacaactacagttactctacaatgctcactggcagaactaattaaccatccgactgtcatggagaaagcaaggaaggagattgactctatcattggcaaagaaaaaatggctattggtagggatccaaagtactgggatggccctcttgagtttaggcctgaaaggtttcttagcaatgataatgagagtggaaaaatgggtcaagttggagtcaggggacagcattatcaacgtttgccttttgggagtggaagaaaagggtgtcctagagcttcactagcactaaaggttgctcacaccacccttgctgttatgatttaa

SEQ ID NO: 64633 - DNA, 372 bp, Glycine max
  Peptide Sequence Number=SeqID_181411
atggaaccaacgtggaggaccttatcggcacggagggagtttgaggtggccgtcaacgacgacgcatgttctggtgggaacgagttggccgagttcacccagcccgacttcgacgatgacttggaggttgccggtgcaacttctgtcgttgatttccaggagcgcgaaagtgtccttgttggctttgcatcccgtcttcacccagctgccaacgcgcgccttcctactggcaaggcccgagccgccattgatgtgggagatgatggattggatggggatgtggtcggagaaattatctttgggaacctcgtcgagggtgatggcggcgagttgatccatcagtggagaagatgcgtctgccattggtgctga

SEQ ID NO: 64634 - DNA, 429 bp, Glycine max
  Peptide Sequence Number=SeqID_181412
atgagactcactctcgagttcctcagagatttcattcaccttcattccaaaaccaacacgatatttgcggtggctagaattagaaattctcttacgtgtgctacacatacatttttcaacaaggaagggtttctatacgtgcacacgcccattgttagcacaagtgattgtgagggtgtgggcgagatgtttcagattggagaaggagttgttgttcaggagaaagggaaggttatgtctcagttgaaagctgccaaggcgagtaagaaggagattggtgctgctgtggatcaacttaagaaggcgaatgagagtttggctaaggtggatcagcttaagcctgagattcttaaaaaggatgatggaaaggactattttgcaacaccgccaacaatagtgccacgttggatagtttatgtggtactataa

SEQ ID NO: 64635 - DNA, 654 bp, Glycine max
  Peptide Sequence Number=SeqID_181413
tgcaatgctgatttagactacgacgaggtgtcaccacgcgcatgtcggtggattgcaacaaagaagactgtgaagaaggtatctacagcgacgtacaggcagtgcctggatcgtctgagaatcccagatgtctgctggatgccatatgcggagcaccgacctgtgcagaactttcatttgattttgtgcttctcgggacagctccgttgggggcctattgttgtcagatacaggccggagagggttatacgccagttcggctatgtccagtgcattcctgcacaccctgtccattcatgggtgtcatatgatgacgtggacgatacatggacgcactactcagaccatctagcgacagcaggtgatctatgtgttgtgccaggtcagtgtgcgcctgactacatagattggttctttgtcatatcgcatccattcatgactatgccacagacggatcctcctcgagatgcatatgcgacgcagcccagtcatatccctcctgaggcaacatcggcatcgacacatgcggatcctgatgcggacgagcccagacatgcagtggaggcttgtcatgcgatcatggaggtgttggagcaggatctaaatgcgccaggattgctaggggtgtcacataagaccgcaatgtgtatgtga

SEQ ID NO: 64636 - DNA, 858 bp, Glycine max
  Peptide Sequence Number=SeqID_181414
atggttaaaaaggaggcattgccaaatcaaaacaaactaccaacgtggagagtggaccctacacagagcacagttgttaaaccctgttcggctccaccagtcagatcggtccaactgggacctggtggcctaaccagaccgattccactattggatcgactcgcgaaccaagtgcggatcaagttgatccgcgagtcttttacggatcaagttgatccgcgagtttttccacggatcaagttgattcgccagtcttccacggatcaacttgatccgtatgttgattttacttctacggatcaagtttggcttacggatcaagttgatccatttcaggaaaatctaggagatagggtgttgggtcatgctcggaaggtagagggatcagtgaggaagaagacaaatgcaaggaaagagcagagaaagagaaaagaggagagaatggctatagaacaaaaggagaaggaggaggagttgaaacacttaaagaatttgaagaagcaggaaatacaagagaaggttaaaaagataatgaagactacagggatccatggtgatgatattatcccattgtctatggcagaaattgaagaggaatttgacccagaggagtatgatagaatgatgaaaaaggcatttgatgagaaatattataatgcagaggatgctgaccctgacttttgtagtgacatgatgacaatgagaagccagatttttaaaaaggaggatgaattacttgggcttcctaaaggctgggatgcatgtagatcaaatattaatagggataatctatcacggaaagccaagagaaggcaacaagtggctaatttgaagttatcacaatcaacaagtgtctaa

SEQ ID NO: 64637 - DNA, 1809 bp, Glycine max
  Peptide Sequence Number=SeqID_181415
atgacaccgagattaatcgcgattcaccgaactgatttagaaagtggaaccgcaatggagccagctcaaagaagattgggaggaggaatggtgtccttgtcgccgtcacagactccgcgctccagcgataagcccatgctagatttgggatctgcagattcaaattccaacagtcacaacaagtatgataaggacaaaggtgtcaatgtgcaggtcctcgtgaggtgcaggccattgagtgaagatgaaatgaggctgcacacgtcggttgtgatttcgtgtaatgaagatagaagagaggtgtttggtcctaactctcaacagaaagaactgtatgatcaggcagtgtctccaattgtgtatgaagtgcttaagggttataactgcactatttttgcgtatggacagaccgggatagggaagacatacacaatggaaggaggtgcaagaaagaagaatggtgaattttcgagtgatgctggtgtcatcccaagagctgaaacctattgctctaatgtaggacgggaagggggtgtttttgtcaggggcttggaagaagagattgtttgcactgcaaatgaaatttacaagatattagaaaaaggttctgcaaagaggcatacagctgagactcttcttaacaaacaaaacagccattctcactccatattttctatcacaattcatattaaggaatgcactccagagggtgaggaaataattaaatgtgggaagctaaatcttgtggacctcgcagggtctgagaatatttcacgttctggtgcaagagagggtagagcaagggaggcttatgcacaccgtggattatgtcttgataattatattcactgtctggaagaaactcttagtaccttggattatgcacaccgtgccaaaaatatcaagaacaaaccagagattaatcagaaaatgatgaaatctgcaatgattaaggatttgtattctgaaattgacagactaaagcaagctctggtcttgggtgtgcagaccatttactttttgtctcgtccagtcgctttccaagttgtggagtgtactgcctatgaagaaaaacaactactggagaaagtggcagaaatgctagcaagttcaaatgctagaaagaaacaattggttcaaatagcagtcaatgggcaaatttacgcaaaggggtcatatttaaaaactatttacgcaaagagggtatcgccagtcgtactagcgatactggctacatggagggagccgctttttccattggcgacatatagggagtgcacgtgcgctttggacgcgtgtcgtaatctagtagccactaaggtcaaccatttcagcggatcaacggccaagattcgtttagaaaattaccgcgacggcgagaatttcggcgttcgccgggatctgaaccgaaccggatcacgctcgttcccgccgatcgtgcctcacgaagaagaattcctctccgatgccgctccgcgcaagctcggaatccggccggaggatctacgattcggaggtggagacggcggcgataacggtggaaggaatctcaccggcggaaatggctgcgaatggattaaaatcggcgcatactacgaggaaatgttgaggtcaaatccgacggacgcgcttctgctgagaaactacggcattcttttaatttcatgttgtgtatatgcagccaatgcaaaaagcggctccctccacacagtcagtatcgctcgtgcgactggcggtaccctccagccagtatcccatgtcagcactgtatcgttgttggcaatggcggtccatgctttctcgccatga

SEQ ID NO: 64638 - DNA, 258 bp, Glycine max
  Peptide Sequence Number=SeqID_181416
atgttgggtaaccctgaaacatctgatgctgaggactggatgggtctggttgattatgcttggagtcatgttgtgatatcttatgaacactttaagactcaagctactgttgtcgcaacctacccttcggcaggaggacgacgcgtgactcgcgggtgcgtcttccaagaaaggaaaatgcgcggagtcgccaccaacgtttatttgaggaaaacgtcagaaaaaccggaaaagacgtggtctacaaactttaagtga

SEQ ID NO: 64639 - DNA, 249 bp, Glycine max
  Peptide Sequence Number=SeqID_181417
atgaattatttccttattattgatataaatattaaagaagatccatacgtttctggtgtgcatcagtcagttgttcctataatcaatctgaagatcatggcctcatctagctactctaactctccctatgatgcctgcaagttcttgagaagaaaatgcatgctggattgcattttctccccgtatttccctccaaaagagcctcaaaagttcaccaatgtgcacaagatatttagagcaagcttctaa

SEQ ID NO: 64640 - DNA, 336 bp, Glycine max
  Peptide Sequence Number=SeqID_181418
atgaaattctatgcttcgcctattattctcaccacggggacttttatgagtggtaaaatttgggtcagtagaacttctatgcctgcaggaagagctggcgagtctgcttcacttggattaacaaaaaacttacaacgacttggttttgaaattgatcggttgaaaactggaacccctgcccgagtagacattcacactgttattcaacatttaacattggtgcttacatcaccaacgatgttaaaacacgcaggttattcaacatttaacatcggtgcttacatcaccactaatgttaaaacacacattttttacatagttgacgaataccactaa

SEQ ID NO: 64641 - DNA, 450 bp, Glycine max
  Peptide Sequence Number=SeqID_181419
atggatgtatcagtagggtccatgcacactcagaactttgtgtgcaagttactggaccggagtcatggagcagtttggaccactacagctccaccaagtggacctttgactttaatatctactggacaagacaattacaagctctttgtgaagttagagttcaggtacgatgcaacttcaaaaggtcggagtaacaaattgtacaagaaaattatcacatcaaactcaattccaaatgataaggatgaagaatgtttatcactccccaccattcaatgggaaacacttgcttccaatcttgaagatttttcaaaagtagctgaaaaatttgcaattagcaagtctgctgtggaagttgctgttagcatgaaacttcaagatgatgctattcctgctcttgaaaagcttcggaaggtatggacatcctttagtttagtgtttgattattag

SEQ ID NO: 64642 - DNA, 450 bp, Glycine max
  Peptide Sequence Number=SeqID_181420
atgaggatgcaaaggtcgacaacaaagatcctgccaaagagactgctttcatccagaagctctacgaatacggcgaacaactcaacaatgcctgatattggctttctttgtgtgattcttattcagttgacttctaagaagagtgttggtgaagtatttattgaccagggaatggctgggactgtgagtgaggagtctggagtgggaaagacttcaagcacttcaccttcttccaagaatgaggtcaaacatgatggaaaagccggctccggctttcttggtgtcaatggtgtcaatcttggaaagaacaagacaagtgaagatgctactgcagattatgatcaagaagttcatacattgtcccaatatgctgattacttggtaattagtcttttcttatatccttttatagaaaaagaagggaaagatagacaaccatctatactgtaa

SEQ ID NO: 64643 - DNA, 246 bp, Glycine max
  Peptide Sequence Number=SeqID_181421
atgcatcgaagcagctcaggaatgaggattagtcaagataaaagatggaaatctttggaatttgcaagagataggcttctaatggagttggcacgagaacaagcaatgtcgatcgaggcaagtagagatgctcaagctaaggcaaattcattgaattctgctgctgtgggggcatctgttggtgctggtcttggccttgtcctggcaattgtaatgggtgcagcatctgccctgaggaagccctaa

SEQ ID NO: 64644 - DNA, 570 bp, Glycine max
  Peptide Sequence Number=SeqID_181422
atggaggccgaggcagagaacaatgacgtgaagaaggaagaaaacaacaatgataacaacaacaacaaaaatgaaagtaacaacaaaatcaggaattcaaaattacccgtcggagactatgagggtggagttgtcagagaagttggggttgtcggatcgatagttgtagatgtggttctatcaccgatagttgaaggacaagaaggagttgccgacaaagaagctgcgaaaggcagcgccgctgctggattctccggtggaggagcccaagttatcatgggtcaagctgctgtgcagaggtgcaatggaaatgtcaatttccatgatgaagagaaacctttatatcctccaacaagatgcagaggtgcaccattacattcaccatacctcgtaatcaatgaagatggacttccctatggggctacacttcatgcatcattggccactagttatcttacaaattatcagcaggacatagccaggaagctaacctatgaggataggaaggttaagttcacttcacgcgtgacggctctcaactctgctgccgataatgatgaagatgattag

SEQ ID NO: 64645 - DNA, 2367 bp, Glycine max
  Peptide Sequence Number=SeqID_181423
atggatgtcaaaacaaaaaggagagctgatgtagagaatggcgatgaaggagaagacttagttctagctactctggttgccaatggagatgacattagtcctcttgtcagacacgccttcgaaatggggcggcccaaggggctcctacgccagcttgattttgtggtgaagaaaaaggaagctgaaattgaggcaatgtgtaaaacccactatgaggaattcatccttgcagttgatgaacttcgaggcgtgttagttgatgctgaagagctcaagagtgagctccaaagtgataattttaagttgcagcaggttggcagcacccttcttatcaagcttgaggagcttcttgaatcgtataccgtcaagaagaatgtgactgaagctataaaaatgtcaaagaactgtattaaagtattggagctttgtgtgaagtgcaacaatcacatttcagaaagccagttttatcctgcactgaaaactgtggatttacttgagaaatgttacattcagaatattcctgccagggctctcaaaagggtgatagagaaaaaaattccttccataaaatcgcacattgagaagaaagtatgcagtcaagtcaatgaatggatggtccaaataaggagttcttgtaaaataattgggcaaacggcaattggtcgtgctgctcaagttcgtcagagggatgaggaaatgctggaaaggaagagaaaggctgagggattaaatatttcaggggttgatgatcaagcttataatttggtggttgaagaagatgaagattctgccatgaaatttgatctcacacctctttatcgtgcttgtcatattcatagttgcctgggaatcctggagcagtttcatgactattactataagaacaggttgttacaattgaattcggatttggagatatcttctgctcaaccttttgtcgaatcacatcagacatttttggctcaaattgctgggtacttcatagtggaggataaggtcctgaggactgctggtgggctcctggtacccgataaggttgaaactatgtgggagactgctttagcaaaaataacatcaatgttggacacgcaattctctcatatgaattctgccacaaatcttctcctagttaaggattatgttacacttcttgggtctactcttagacaatatggatatgacattggccaacttcttgatgtgcttgataatagccgtgacaaataccataggcttcttttgcaagaatgtcagaaacaaattgttgatgttcttggcaacgactcatatgagcagatggtgataaaaagggatactgattatgagaataatgttctgtcatttaatattcaaacatcagatattatgcctgcttttccatatgttgcaccattctcctccatggtacccgatgcttgtcgcattgtgagatccttcatcaaaggctctgttgattacttgtctaatggtgtacgtaccggtttctttgattttttgaggaagtatttggacaagttcctgatagaagtattaaacgaaactttacttgatacaatcaatagtggaaatatcagtgtgtctcaagcaatgcagcttgctgcaaatataactgtccttgaaagagcttgtgactatttccttcgacatgctgctcaacagtgttgcatctcagttcgatcagctgagaagccccaagctactttaaccgcgaaggtgttactcaagacttcgagggatgcggtttatattactctgctgagtttggtaaacacaaaattagatgagtatatgaatcttgtagaaagtatcaactggacttctgaggaggcaaagccaaatggaaatgactacataaatgaagtgatcttttaccttgattcactaatgtccacagcgcaacaaattttacccctagatgctatgtacaaggttgggacaagtgcaattgagcatatttccaatacaattgtggctgctttccttagtgataatgtcaaaaggtttaatgcaaatgcagtgatgaatttcaacaatgatcttaggatgttagagagttttgcagatgagaggttccattcttctggcttggctgaaatttactcgggagatagtttcaagagctgtatgatagaagcacgacaattaatcaatcttctgtcaagtagtcagcctgagaacttcatgaatcctgtaataagggagaaaaactactatgcgttggattataagagggtagcctccatttgtgataaattcaaggattctccagatgggatatttggaagtctttcaaataaaaatacaaagcaaagtgctaaaaagaaatcaatggacatgctcaaaaagcgacttaaggatttcaattga

SEQ ID NO: 64646 - DNA, 1875 bp, Glycine max
  Peptide Sequence Number=SeqID_181424
atggcagcagcagcaacaacaacaacagcacaagatacctcctcggtcccgccgctcgcgtactcaggccgggtccagctcaaggagctgctggaccggtccgaggcggcggtggggcagcgcgtggtcgtgggcgggtgggtgaagtctgcgaaggaggttgagaagacggcgccgcccccatcgattgcgacgacggacgacaccgccagggaaggagggaagggcaaggacgtgtcgtgcgtggagattctgcagtcgaggataccgctgattcggagtatactggatgtgttcggaggtggcggttatgggcagcgcaagaaacgtgagaatgtgactgcgccgaatgataaggttttgcctcccaaagcttctacggcgtatttgcttctaacggatgggtcgtgcgctccaagccttcaggttgttgttgattcttcagtagctactcctagccggcttgtgcctactggaacgtgtctattagtggaaggtcaactagaaagagcagaggggaagcatgctattgagcttatagctgagaaagttcttcatattgggacagtagattttgacaagtacccattatcaaagaaaagaattccactggataagttgagagattactctcaatttcggcctcgaacaaccacggtggcaactgtcatgcggattcgaagttctctttcttttgcaacccacacatttttcaatgaacatgcgtttattgatgtgcaagtacccattattactagcacagactctgaagggtttagcaacatgttcagggttaacaccctggagcagaaagcagagaaggagaaactagaaaccgtttatgagacagaaggtgttagccttgaacatgtgaaggcagctgcaaaggagaaaagcaacattgttgagcatttggaaagaactgagagcaatagggaagcactggctgctgctgttcaggatctgaggaaaacaaatgaactcgcatcacaattggaagcaagagaaaagagaaagctaggagcttcttttaaggatgacaaagtagactcttccaaagagtttttccctttccaaacttatttgactgtctcgggtcgcttgcatctggagagttatgcatgtgctcttggaaatgtctactcatttggtcctagatttctagcagataaaacgaattctgctaaacatgctgcagaaatgtggatgatcgaggttgaaatggccttttcgcaattgaaggattccatgatttgtgctaatgactttttcaagtacctctgcaactgggttctggtacattgctctgaagaaatgacgttcgttgccaaaagaatcgacaacacctgcatgaatcgtcttcggcagattatatcaggttctcctgaaatgatgacctaccataaagctatagatgttcttagaaagtcgtcctcccaggctgaagataagaaatttgaaacaaattttgagtcaggttttgtactcacttcagagcacctaagttatctaactgatatgatctaccagaaaccggttatgatatacaattatccaaaagaagctaagccattttatgctcgccagaatgatgatggtactgtagctgcatttgacttggttgtcccaaagctaggaacaataatttctggtagccaaaacgaggaacgtcttaacatgataagctccaggattgatgagttaggcttgccacgagagaagtatgaatggtacctagatcttcgtcgaaatggaacagtgaacaactctgggttcactctaaggtttgaccttatggttctctttgcaactggccttggcaatgtcagggacgttatccctttcccaagaagctatggcaaggcctatacctaa

SEQ ID NO: 64647 - DNA, 957 bp, Glycine max
  Peptide Sequence Number=SeqID_181425
atggagaagatgatgaagaacaaggaattaaagccttggatcttcttcatcaatggagtcctttgcttcttgaagattaatggaagcggaatggagaaggaggaaagactaaaggtcttcccaggtaaactcaagtccaaatggtctggtcccttcaccatcaaagaagtgaagccttacggagcggtggagccgatagatcttgcttcaagaagcgcagagcgagacccagtcaaccacaagaaggggattccacttgggattcctcctgttttgcttcagagaaagcctggatccactactaggataacacttacccgccaacccgagaagcaaattgatgtagcattggtgaaggagttctactccaacatggacccctgtcatccttctggagggggagcaactgactacatactcccacatggatcaaacccgcctgatatacagtctcgtgatgaagatggacgtggggagcatgatttctttgtagattaccttgatcacccagtccagtacatcaaagctcggcttccttgctttgactgcaacactgtgcaatgcataagggatcaattcagacactttaaccttttagtccctcaccctgtgatcaacttgacttatataaagaagaactgttggaatccaataggcccatctatagtatttccagggccaaggcggagtagttcttccccatgctgcaaagcctccaccatggctagtatcgttgatgtagagccttcactagtcatctctctagcaaccagtgatgacaccagaggcattcctatcttaggttgcctggccaggagtccaacttccttttgtaatgtgggtgatacctctagtactagtaatgatcatgctgcagagactggagctgatgatgattatgttgcggacatcactgctgcacagggagcttgggatccatggcccccacaggattga

SEQ ID NO: 64648 - DNA, 969 bp, Glycine max
  Peptide Sequence Number=SeqID_181426
atggatctaagaacgaaggggtttgaaggaagtgggattcctgaaatggagccaaggcttctccagcacggtggcttggtaactggccgtggtggatccattcttgaccttgaggaccaggcgcgtcagctttgccccagaacgcttgtcgtactcgctcaccgcgtagttcgcgatctccgccacgtggctgtcgttcacgtccttgatggggctccagccgcccagcgcagattccgaccgtcgggcagcgtaggagaccaagacgagggagaggagaaggagacagtgcattggaaaaacgcggttaacgggcttgtcctgagtattctcgtttgggctagcgcattggcaaagccaactacatttgatggtgttgaagttggaagccagaaagcaaactcggttgctattcctccagggattataagaataagaggaataggtgatactttggggaagtatttgaaggtagatagattaacgtctttgcagtatcgtgagaaatttgccaggatctgtgttgaattggacttggagaaaccccttcttgctgtaacaacaatgacacatacaactgagagtgcagataacggagatgaggtgaatacggtgacacagtcgttagggagtatgcttgtgggggtaggactgccgtcaacaaatttgagaggaccaaaggaattgatgataattctaaaacgattaatgatgagggaaaaaacagttatggtaaatggatgttggttcaatgacctttcaagagaaataagtggggatggttcaaataaaggaggtcgcgccaaagatattggtactaaaaagaagtcctttggagttgatgaaggaaaattcgcaaaggatgttgcaggtgaaggttcaaaatttgcagggggaaaaaccctcactgtgaaaataagggactatggagttggaggaaagtctaatttcaaaaagaatttcaactaa

SEQ ID NO: 64649 - DNA, 273 bp, Glycine max
  Peptide Sequence Number=SeqID_181427
atggtagcatctcctccatctaaagctgcaactccagctccgatggctacacctccaataaccactcctcctgcggctacaccaccgaaaggtcatggagttcctcctccgcagttctgtcctcgattctgtcatcaagaaaaccctaaccgccctccctctctcccccgtcgaaccccgcctcaagaaaaccaccctcctcctccgcacccttcaaaccctcatccatacaaccacagtatcggcaagaagcgtgggatctctggtttctga

SEQ ID NO: 64650 - DNA, 495 bp, Glycine max
  Peptide Sequence Number=SeqID_181428
atgagtaacatgcaatgttactattccgatgagaatggttatgtgcaagagaggtgtaaacaaatgaaggaggacttaaagaaattaatagatatgaacaaagatggcgccaactcccaagctaatgtagtaaaaagtgttgaaaatgaagatggcttgctttttgcaacaaatgatgaggttgctaaaacaaaatgtgagatggattttgtttcctcaaagcacatttgtagagatcgaaagatatttgacactttgaaaaccaatggagaattcagtcatttcatgttagagaatggtggaaaaataaaggttgaaggcatagggagcatgaggatgaagctttataatggtgctattcaaactttctcaaatatgacatcacaagggtacaagtacgttggttcaaaatgggcatgcaaggtgtacagggggagacacttggtattgcgaggaaagaaaaataaaggcaacctttgttgtttagatgaataa

SEQ ID NO: 64651 - DNA, 885 bp, Glycine max
  Peptide Sequence Number=SeqID_181429
gagtcttcttggttggctaactttagttgtcgctgtagagcaacgacgctcgccgcagagctagcaacagtgggaggggacgaaggcgacccagcattgtggctacgcttattgcggggtgaaaccctaacatccccactgccattctttctcgctcccccaaaagcagaaggaggaaggatcatggtcactggaacgggttccccatccaaagaggtagcagaaggtcacgccctcctacggtggcaagaagcacctccgccaacacagcacaagtttgccaacctcttagagaaagtggactttctatcagaagctccatggtgtgtctcattcgaggaggagctactgattagaatgacctcccggtccaacagggaatcagagatgaaagacatgatggaaaggaaatgtatcttaaaagcgaagaagataatcagaggagaatggaaaatcacgaatcgcgagcaaaaggcaaggaagtttcaggaaagagagagagctgaaatgatgccttggaagtttgcaccacaatgcaaccccactaatccgcacaccgcgtctccagtatgtgtccactctacgggtgacacatatgcaagagtagcgtgcttgtgttgcactcacttgcaacaaaagaaaaatgaaacacatgccttcaatgtgttctccaatgaaatagcccgtacaacacttgtccaagctggggggcttgacaagcttgacaagccaacaactctcgcacctgggcttgacaaactcgcaaccctcttacttgtcaaggctactacctttgacaccataaatctcttttgccaacaagctaactcaaagcttgggggattatgtactgcccggggtccacaaaatggacgtggcaagtga

SEQ ID NO: 64652 - DNA, 423 bp, Glycine max
  Peptide Sequence Number=SeqID_181430
atggggaggaaatgttcaatggctttcaagttatacatgtctaaagcctatggcagggtagaatggatcatcttgaggagagttctagaacaattggatgatagtattcttttttctagagcagctgtggaagaggttggaattataaggaatattttgcatcagtatgagttggcatttggtcaaatggtagatcaaagccataaattttcagctttgttcgagaaggggttggaaagagaagactctgtcaaagaaatcaaagtggatagtacagacatgaagtatttggagataggaagtgctagtggggtgaaggtgtatggtgataaatggctggctagtctccttggtgcaactgtctctcaacatgagtgcactatcatggatcgtaacttccatgttagtgatctaattgattag

SEQ ID NO: 64653 - DNA, 741 bp, Glycine max
  Peptide Sequence Number=SeqID_181431
atgaaaaaagatttgatccaacctaggatgatgagtgagccaaatgcgacgcatggtggtctcccttacgcgtattgtaaggagcttgagcctgttgacggtgggaataaacacaaggatcagatggaaccatgcgatgtgggtgaatgcagctgcggccatggtgccggctttgaccacgcacatggtgcgaagtttggggtccatgaaggcgcatgcttgcatgacgatgatgacagaagatgccactcccatgttcacaaatgtgattgcggaaaaggaaattccttgtacgcacacgataaggatgctaagtcctgtgaagcagtgcacgagtacaagggacaacctgatatcgaccttggtgatgttgctgatggatttatggagaaggatgatgacaacgtggaggactgtgcggaggagacaacggtggcatggacaaatttcgttcggcttcttctccatggctttttccatcaaggctctcatttttgtgataacaacttagagggtgtcatcggagagaagggagtcaaaatgctttgtgggggagctgaagaaaaaggggaaatgttgggtgttggaggcaattgcagtggtggtcatggcaattgtgaaggctatgtaggtagttgtgttagagttaatatcaaggtaatagagatggttgtgttgttcgttgttatgggtggtggtggttgcgctgatggaagcagctggggttgtggtggccactga

SEQ ID NO: 64654 - DNA, 426 bp, Glycine max
  Peptide Sequence Number=SeqID_181432
atggcagcggaatggagaaggaagagagagaggaaatgccacttcaaggagaagatgagtctagaagaagctcaccaccataggaggccatggataagagcttggaggaagaaggagatgaatgaagggagaggaagagaagagcatgaaattttgtgctctaaaagagctctgaaatctgaaggaggattgcatcaacaaggaaccaccacgaacatgaacggtgacaggaaaaagaagcaccgtaggaagaggaagacgaacaagaagcatcgtaggaagaagacgaaccatcgtaggaagaggaagatgaagggttgtaagaagaggaagaggaagaggaagaggaagaggaagaggaagaagaaggatgcgcacgatggccgtaggaagagaaagaagaaggatggcgcgacgactatatag

SEQ ID NO: 64655 - DNA, 291 bp, Glycine max
  Peptide Sequence Number=SeqID_181433
atggaagtatgtgctagattttctaggatgagattgatctttgtccatgtgggtcattgtagtgttagtatttctaggcttggtgatgaggacaaggcaaggaataagggcaaggaatctttagaaggacttggaggacctatggcaagggctagaacaaagaaggccaaggaagctcttcaacaagtgttaaccatgttccaagtaacaagtggagaaactttagaatgtcaattgcaccatgttccaagaagagtagaggatgccaattttgttgagtggttttattag

SEQ ID NO: 64656 - DNA, 963 bp, Glycine max
  Peptide Sequence Number=SeqID_181434
atggctgaatcattgaaaaagcaaaagggctcatccacttccttcgccattgctgcccatcgacaccacggaccatctagagcacccacaacaccacttcccccttccttgtcatctcaacgatcatctactctattttcttcagatgatcaatgtgcaccttttgagggcaccattattgatgactggaagttcgactattctagtcatgatgctcgccgcatggtctgtaatgaccaggctgatatgaccggtagattgctggtcggatcattaacctttgattatcgcatcatgcactatatcatcgttagaattttgcttccccgttcttctaatttggctcaagcctctgaggaggacttgattttgatgtgggctttctttaccggtcgtcagattgactgggctcacttggttagggaccgaatgcttaaggcattacgggccaatgcacctcttccgtatcctcaattggtcacgctttttctccatcattttcaaattcctcttgatgatgaaccttttgttcaagtcaagagatctattgccataagtgtcagtgcagtaacttcatttggttactgtaaggatcgtgatggacaatggctgaagaaggacgcgcaacctctgcaagacgagcgtactccctctcctccgcctcaacgagatgattcctcagcccttatcaatgaagttctttcggaattacggggcctccgcacctatgttagcgaacgctttgattctttggatggtcgctttgaaggaatggatacctgtatcacgcagcttgaagaggatgaattaaattgtcatcatcaaaaagagggagattgtagaagcaaaagcaaagactttgactatgatgttttgatgatgccatgtggtcatgcacttctcaagtttaattcaagacaaaaatccaagaaatacaagatacatcatcaagaagatctctag

SEQ ID NO: 64657 - DNA, 228 bp, Glycine max
  Peptide Sequence Number=SeqID_181435
atggtcttgaggtgcttcatgtgtctcccccacgggttgagagatttttgcatgaccagattggggatgttggctctcaatgggtgtcgcaacctacccttcggtgggagggcaacacggggctcatgggtgcgtcttccatgggaggagaacgcgcggagtcgccaccaacgtttatttgaggaaaacgtcaaaaaaaccgaaaaagatgcgatctacgaactttaa

SEQ ID NO: 64658 - DNA, 363 bp, Glycine max
  Peptide Sequence Number=SeqID_181436
atgattatttggaaacaacgtgcaaaattagtcatggctacagctaggtgggtactcaagcatccagtttatggcattgtgatattaaggcttgggatttacacaagacgacgttcctatagaaaaaccctacaaggttccagaatttcaagaaacattatcgacaataacgaaaaacaagataacatacaaatgataaatgatggaacatacgaatttgtggatcccacggtcatgtggctctgcatgccaccggactcttgggtcacggtaacaaaaggtgggctggttgacaaaagcaaggcttttgctcctacgtatcctcaatttgtgatgaggaactcagacctacatagttcttga

SEQ ID NO: 64659 - DNA, 195 bp, Glycine max
  Peptide Sequence Number=SeqID_181437
atgattgatatctcaaagccctacactgaggaaatgaggggcaccgtgcatgagcctcaagcaaacctagagacagggctacaggttctctccttcagagggctacatgtcctcaccttcagagggctagacgtcctcactttcagagggctcaagatcctcgccttcagagaactcaaggtcatctaccattaa

SEQ ID NO: 64660 - DNA, 609 bp, Glycine max
  Peptide Sequence Number=SeqID_181438
aacatccttccggagaggaacgtcgtcctatacgtcacagagtacaacgagttccgttgggagcttgagaggggcaccctggaagctcctgaggaaggacctcaccactttggcgttggtgatgaagatggatatggacttgggctcgctcatttctgggtagatctcttagatggcccagaccaactcctctcggcttggctttcctacactcatcacaaccttgcttctacttctgctccttcctcctcagctccagctccttctgctccaattccaccaccaccagcatcagccccaacaccttccggcacctccgctcagagcagagttatcagtgtcgatgttacaaagcctacaccatggcttatgcctagtgatgcagagtatccacgacttggctcagcattggcccatcatgagcatggaggcatttatggcctaggtgaggctcctacagcccaggagccgcatccagagtcgcagccacagccggaggtgacacctgaggccactccacagacttcacctgctgccacaccattagtggaggtttcagaggatgaggatggcactaaggacactgattatgcagctaatttggcagcg

SEQ ID NO: 64661 - DNA, 525 bp, Glycine max
  Peptide Sequence Number=SeqID_181439
atggatgtcccttgcaaaagttgtggagatcctgcagtaagtgattcccaggactccatgatgtcttcacgacgctctgcctctagattgccaccagatgaggcttccaatatcaaaaccctcatccatgttctctttgcacaacttctccgtcctcctccgccatgcgcactgccaccccaagctcctctgacagcagaaacacgttcattttctgctccgcgtaaagcggccacaccaccatgggaaccccataaaagaattccaaaacagaatgacatgttggagatcgagcatcttgccacgaagcttgttggtgtcgactgggacgaggtcgtcggtgaggtcccgagtgaggatgagaaagggagaataagagagaaaggaagggtcgcgcacactgatgcaatcctccctaggaagggaccagtcactagagccatgagcaagaggttccaagaggattgggctagagctgctgaagaaggccctagggttctcatgaacctcagggtagatttctga

SEQ ID NO: 64662 - DNA, 759 bp, Glycine max
  Peptide Sequence Number=SeqID_181440
atgaggggcaccgttcatgagcctcaagtgaacataggggccgatcaaaagttctcacccatcgaggatggaccctcgggtactagtaccctagtcttcagaggactacacgtcctcgccaacagagggctgcacgcctttaccttcagaggactgcgtgtcctcactttcagaggactgcatgtccacaccttcagagggctacacgccctcgccatcagaggactgcatgtcctcaccttcagaggactgcatgtcctcaccttcgtatggctacacgctctcaccttcagaggaccacacgtcctaaccttcagagggctacacgccctcgccatcagaggactgcatgtcctcaccttcagaggactgcatgtcctcaccttcgtagggctacacgccctcacctttagaggaccacacgtcctcaccttcagagggctacacgccctcgccatcagaggactgcatgtcctcaccttcagagggctacatgccctcgccatcagaggacttcatgtcctcaccttcgtagggctacacgccctcacctttagaggaccacacgtcctcaccttcagagggctacacgccctcgccatcagaggactgcatgtcctcacctttagagggctacacgccctcgccatcaaaggactgcatgtcttcaccttcagagggctacacgccctcgccatcagaggactgcatgtcctcaccttcagagggctacacgccctcgccatcagaggactgcat

SEQ ID NO: 64663 - DNA, 615 bp, Glycine max
  Peptide Sequence Number=SeqID_181441
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaatgcgcaaggaagctgattggtgggatccccctgtggcggggcgaagccagaggaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 64664 - DNA, 426 bp, Glycine max
  Peptide Sequence Number=SeqID_181442
atgaaaaaagaagaacaagaatcaaacgcaagctcctcttcacgacaatggttcgtggctgaggaagaagaagaagaagaaggtagcgcgagagagataggtccaagaggtcaccaacactatacgaaaatggctctgaggaagaagaagaatcaaaggttgtgtgaggaagaagaagaatcaaaggggctgtgtgaggaggaagaagaagaaactgcaacggagagagagagtagcgggagagagagtcacacatttgttttaaaaaattacccaggggtattacgaccttttcacatcaagtgctgggtgcaccagcaaaaatgctgggtgcacctagcagcactcccagcatttctatccctagtaatgggcaaagggtataagccatactcattacaaaacatgatcaaagtcaccaactag

SEQ ID NO: 64665 - DNA, 1119 bp, Glycine max
  Peptide Sequence Number=SeqID_181443
atgggaggtcaacatagttataggaacatatgcaaagacgaatcagtagaatacaactgtaaagagtgtgatctcaggaaaaggaggttgaaaaacacgaataagaaagaagatagagaggatgtaagatggggatatgatataaggatggaagaaaacaatacaaaccagttagcaagaagtctcattgcaacagttctggttgtcaagcttatccagaatgccaaagaactctccttttttggaagggatgcaatcgattcaaatgagggagtggatctaaatgaggttctgaaaggggttgaggaatggatgaacaagatacaactgactaatcaagactggagtatgctagggtgctcattagaacctctagactggggtggattcaagaagtcaaaagggtatgaagactcagatctagaatcttctgttaaggtgcttcatatgggagaagggcctagtgtagtagagtgttcagacgacaaaggtcagctacctacgcaaatagagaaagaggtatatgggggtagtgcgacaattttggtaggggcaaacaaacaacagggaaaaggcttagctaatgcagcagtcttctcatatgataagaaaattcaacattttaacaatggaaacaaggatgaaaggaccaatattgataatatgatgaggaagaatgctaaagacgttatgggggagacaaagaataagaaatgtggcattaccatgagagatgcaacatgtggtagtgcgactaaacgtttcggtgactatgtaattgaggaggatgaggctgaatcaaggaccatttggaatatagctgaagatattggggttgtatgtaatggggagaaagtggatattgaatggaaaggaggggtcaacatcacttacattgggaaaggttatgtaggggtacaaggagtgtggaaagaagacatgggtgagttcaatcaatttattgatgacatggaaatcaaagatatacctttggttgacaagaaacttacttggtatagatcaagtactcattccaagagtaggcttgatatagattttgtatgtcaatggggtggctacataggtggtcgggtagcactcaagcttctcggatcatag

SEQ ID NO: 64666 - DNA, 1389 bp, Glycine max
  Peptide Sequence Number=SeqID_181444
atggggaaagtggaaagcttgtggaaatcatatgatgtacaagggagagtggcttatgtgatcaaaaagaaattgaagcttctaaaaatagatctaaagaaatggaatatggagagctttgagaatctagaaaaacaatgcaagaagttgattgctaaagttaatttcttggaggaaagagataaagtgttggggttgacaaatgaagaattagaaacaagaaggagagaaaatggcattaaaggtcttcaacttgaaaggggatgggtagaagaacctttgtttgtaaagagaggtattcttgatttctttgataaaagaattcaagaggaaacctttgatagaccaaagcttgatggggtggcttctaacaaactcgagggaggggagggggaggataatgcattgctttttgacccaggactcgataggatcaactttaacttcatcaagaaatgttgggctacattgaaggtggattttataaatatgttgcaagagttttgggaaaatggagcaattccaagaagagaaaatccttcgtttatcattctcatctcaaaaaaggatgatccacaaggccttaataactttaggcctatatccttaatcgggtgcttgtataaaattttgtctaaggttttagcaagaagactaagagtggttctccctaaaattattggtgaaaagcaaattgcctttatgggagagcaaaatatgttagatagtgtagccattgcaaatgaggtggttgatgatgctaagagaaggaagaaatcatgccttgtgcttaaagttaactttgagaaggggtctgagacaaggagaccctattgcccctttcttattcctcattgcagcaaaagggacaagtggcttcatgagataagccttactttgcgggaggattctacacataatgtcttatgcattaaggcgattatgagaaactttgagatggtgtcaggtctaaagggaggggaggaaggaaaaaagaaaattgtatgggtaaattgggaagatgtagaggatgatgagcaaaagagattctttatgggacttggtgaaggtgtgtgggaaaaggagagagggttcatggatgctatattgggtgatgtttggaggtggagatttgaatggagaaggcaatggttcaattgggagttgcctatagtggagtcattcttgacggagttggagggcttgtatacggttaaaattgcatatgagtatgtatcttctagcctttatcctttcgaagatcctttccatagttatctatggaaacttttcatccctaagagtgtagtgatctttatttggagactttcagccaatagattacccgccttggataatcttatggcacgaggagttgtcttgcaatag

SEQ ID NO: 64667 - DNA, 690 bp, Glycine max
  Peptide Sequence Number=SeqID_181445
atgggtgcacaaactgatgattttggatttactttggtagatatgaagaagcctttcatcattggtcttaaccttgaagatgatgactcaacccttgatacttgtctcactcctttctccacacaaatggctaacgtcaatgaagaagaagaagaagttgacgatcacatgactacaccaccgagctcccctcctcctcctgagttagcaacatggctcagatcgttggctatcagactcgttaggatggagagaccaatggttcatgtggatcctaccactggaaaagctgatggtccccatagaaagaaattaaggatgtatttggggatcgtcgctcgagacaaggctgaatttgatattctagaagcatccgaccaaaggacgaagaagaagatccttaagatgggcgaaggcaatgtctgcaagaagtacaatattagcaaagaaaagtggcaacaattttgtcggagttgtagagacccttcatgggaggatgttagaaagaaagctcaggccatccaaaaactaaacactacccttcacgtgttgtctcataggggttatgatttactaaaagaaaggttaatggaggaaaaacaaaagaaacgattggagcaagcagcccaatctggaagcacaaaaacaatcgttgatcctccatctcccattagacgacaagtgaagtga

SEQ ID NO: 64668 - DNA, 348 bp, Glycine max
  Peptide Sequence Number=SeqID_181446
atggggggaatttctcggaggaatgaaatgcctcttcaaaatattatggaagttgaagtttttgattgctggggtattgacttcatgggtcctttcccttcatctgtaggtaatgagtacattttggtggttgttgattacgtgtctaaatgggtggaagctgtggccactccaagaaatgatgctaaggccgtgattttgattagtgatggtggttcgcatttttgtaatgctcaacttcaaaaggtgttgagtcaatatcatgtgcatcataaggtgacatccccctatcaccctcaaactaatgggcaagccgaagtatccagcagggaattaaagaagatgtag

SEQ ID NO: 64669 - DNA, 466 bp, Glycine max
  Peptide Sequence Number=SeqID_181447
cacaagatcagtttccaagtcgaacctcactatcattccccacccaaaaccttataaacttcaatggctcaatgagcaaggggaaatgatagttaaccaacaagtgaaggtggccaaagatcaattaactatgacagataagaggggtgaggaagaaaaacaaaagaaaaagaaagacagtaaggccttgtcttccaaggccaaggggaaggaaaaagaagaaaaggattcctccaagaagattgttaagaaggaaaatcattttgaaacaaaaggtgatattaaaagagcactcattcttaaacaatctttctaccttctcctatcaagggaaacatcccttagcactgccataattcccacatttgagaccttacccccaaaggtccaagaactcttacatgaatttggtgatatatttcccaaagagataccccttgggctacctcctctaaaaggaatataa

SEQ ID NO: 64670 - DNA, 126 bp, Glycine max
  Peptide Sequence Number=SeqID_181448
aaccttgcgtttggactgacgaatgtgaacgagagaggtctccgagcaacacaaagaggaaatgacgtagagctcacgatagacttgtgttgtctgacgacctgggagtgtgaatctcaggcatga

SEQ ID NO: 64671 - DNA, 369 bp, Glycine max
  Peptide Sequence Number=SeqID_181449
atgacccaagagctggtagcccgcggagacaccttacggttatccgcacctcatcattcagtgaccccaagtgtgattgatgagcagaggccaatgtggtcatttgtaccctttccggagatgtcagcatcttccggtggagactttttcaagtctcacaagttatctagaactacaggcggcgggcccgatgacatgcgaagacaaaatttggtcaatctgcacccctttgtcattcagacacagttgtgtccgatggcacgcagagacaaattatggtcattctgcacccttttgtcatccagaggcggcgggcccgatgacatgcggagacaaaatttggtcattccgcacccctttgccatttag

SEQ ID NO: 64672 - DNA, 387 bp, Glycine max
  Peptide Sequence Number=SeqID_181450
atggtagccacaacctaccaaacatctcatgagtgtccggaagaaaccattattgatatcctagtagaaggattttccagacagttgaaaggttgtgtagttaagacgaatctcaacggaaaagtcattactaatgacgataataagaagattcctgacgctgttaatacacttatatttacaatagcccaacattttattggagaccggtctctttggaaagataggtctgcagaattactatccaatcttaagtgtagaacattagcagattttaggtggtacagagataccttcctaactagagtttacaccagagaagatagtcaacaacctttttggaaagaaaaatttctagccggtcttccaagatcattaggagataaa

SEQ ID NO: 64673 - DNA, 417 bp, Glycine max
  Peptide Sequence Number=SeqID_181451
atggatgctgatgaagcgatgagtagagaaacaaatgaagtggaattcatggggttaggtgttactgccatagatttagaagaaccaagctctaatacaaaaggaaaaagacaatgttcgacttcttctggcacacatcctcacaagagaaagatgggagaaaaagacggaatagcagcttctttggataaaatggcgaactcttttaaccgaatggtggaaaaaatggatggtaaagttgatgatgaagatattcaagaagtattacgtgaggcagctttgataccagatcttagtagacaacaatgggctaaagctattaaatggttagctgacgatccaaagcagttagctattgtgaaagcccttccaattcaccaaaagacagattatgttttaacacatcttggagaatga

SEQ ID NO: 64674 - DNA, 792 bp, Glycine max
  Peptide Sequence Number=SeqID_181452
atggtggaagagtttgaagagatcctgggatgccctctaggggcaaggaaaccatacctcttctcaggattctatccctctttagctagaatttctaagatagtccaaatctcggcgcaggaattagaccacagaaagcaagttgaaaatggggtggttggagtaccgagaaaatgtttggagacaaaagcaagaatcttggcaggtagaggcgaatgggccccgttcatagacatcctcacgcttttgatcttcggaggagtcctctttccaaatgtggatgggttggtggacctagcggcgatcgatgcttttcttgcctttcatgaccgcaaggaaagcccggttgtcgctatcctagccgatctatatgacaccttcgaccgaagatgtgaaaagagcagtacaaggattgtttgctgtactccggccctctacgtatggctggtttcacaccttttctgccaagaggtgagacatgcttgcccgctagaaagccaccgttcatgcacagagaaaaaaaaggcaagttgggaccgactcttagcaagcaaagaaggagcatctatcaactggttccctcgatggaaagaaggaagaaccggggttcttatttcgtgtggaggatttccaaatgttcccttgatggggacaaggggttgcatcagttacaatcttgttccttctataagacaactcggctaccctatgagaggggcaccactagaggaagagcttgcacctattattgcacgaggtttcaataacaccaacgcggaggcacttcagaag

SEQ ID NO: 64675 - DNA, 909 bp, Glycine max
  Peptide Sequence Number=SeqID_181453
atggacagatttgacgagctgcaggtgtttgttgcggtgattcagcagggcagcctggctggcgcggcgcgcgtattgcagcgttcgccgccggtcattacccgcacgctgaatgcgctggaagcacgtttcggcaccaccctgattgaacgcaccacgcgccagctggctcccaccgagagcggctggcagctgtttgagcaggcgcagcgcttgcttaacgattaccagagcgcgctcgacagcgcccaccacagcggactgcacggcctgctgcgcattaccgccccggtgatgtgtggccgtcgccacgtgatgccgctggtcaatgcctttctgcaacagcatccggaaatgcaaatcgaactgattctaagcgacagctatcaggacctgattgaaaacgggctggatattgcggtgcgcattggcgagctgcaggattcgtcgatggtggcgcgcaacgtcggcagcgtacgctcgatgctggtcgccagcccggactaccttcgccaggccggaatcccggcccatccggctgagctcagcatgcatgcgctggtggcaggcgtgcgccatacccgtgagtggcgcttcgcgcacgacctgcgcgtgcgtatcaccccacgcctgcgtgtcaatgatatcgccagccagctggatgcattgcgcagtggccagggcattggccgtctgttgtcttatcaggtgatagatgaactgcaggcaggcacgctgatccgcctgctgagcgagtgggagccggcaccgctgccggtgcatctggtggcgcagcgggtgaaaaacatggcgcccaaggtacgctgtttctgggatttcgcgctcacggcactgccgccgcgactgcaggcggccgctgaatttcccgcgcccgcccgcaattcctga

SEQ ID NO: 64676 - DNA, 141 bp, Glycine max
  Peptide Sequence Number=SeqID_181454
atggaaaataacgtggttaatttcgtgggtcttaatcaggtggttcttggcataaaatggatgaatgggatgaacaagggtgaagatgaaaggaaggaaagaatcactctttccagcgagggcaacacacaaaggttgtga

SEQ ID NO: 64677 - DNA, 441 bp, Glycine max
  Peptide Sequence Number=SeqID_181455
atggctattacagaatcaagggatctttcaaacatgtctcttgcaactttgtttggaaagttacaggaacatgaaatggaactaataagattgaatcagcatgaggagaatgacaagaaaaagaaaggaatcacacttaaagcttcatcctcaattcaagaaggaagtgataaaaaagatttaaatgaaatagatgaagatgatgatttcagtttccttataaagaggttcaacaaatttctaagaaacaaaggaaatcaaagaagatcaaatttcaaatcaaagaaaagagcagaagattcatcctctcttccaaaatgttataaatgcaatcaaccagggcatctgagagttgattgcccaagtttcaagaaaagaatagagagatctgaaaagaaaactctcaataagaagaaagcaaagaaggcctacattacttag

SEQ ID NO: 64678 - DNA, 1860 bp, Glycine max
  Peptide Sequence Number=SeqID_181456
atggcgaatacatctggcaccaccagcactaccacaccatctgccaccgggatggtgattcaattacataccattgacgatttacgtaaacaggaacctgtttcgattggcgaaattgcgtcggtgctggaatacagccgtggcagtcggatgggcggcggcgtgtttgtctacgatgccaccgacaacagcacgcccgatgacggcgggctgaatttcgtgacgtccggtaaaaagcgctggaaaagagtggtcctcgattatagcgcggtcacggtggtggattttggcgcgatagctgatggcaccaccgattgtattgatgcggtgatccgcatgtttaaatggtcgcagcgtgtattaccctccgcgggcattcgctttactgccggtgagttcagcctgtccggctttgatttagcggaagtgctgggcagcgacagagagattaaccgctttaaaatttccggcgcgccggtcaacttcggttatttccccaccaccacgctgaaatttaactggggaccgaaaccgcgcaaaactcatttcttcagcgtacgcgcacgctatgtggaaatttccggctttgtggtgaaaggcatgagttctgatagcggcgaagacggcggcacggcgtttaataatgtcggcttctttaccaacagtattatcggtggccagtttctgcgcgtcagcagcatggagtttcgctatctcggcgggcgggcgctggaactgattgatacgctggactgtaaaatcgatcagttttattcacgtggctgtcagggcagtattgtctatgcgcgctggtccgatcgggaaaaaggcgcctgggatcactcgaccgcgattgaactctccaactttaatttgcagcgcagcaccagacagccggtgttcgatctgccgcgctgtacgcaatcgtttattcgtaatggctggatcgagcactccgaatttgccggcgatctcaccaatggccagtggaccattgaagggctggtgattgaatcgacgcaaaatcctatgaaaatgggctattgccgcgcgatgattatccagaaaagcgtgcaccgcgatagcgcgggctttgacttcagcaaagagggtattgagccatggacgctgctggccgagggcgatcgtggcgtgatggagatttccgatcttggcgcgatcattcagggatcgctgagttatgacttcaccacctcgcagcatcacatggataaccgtggcaaagacgcgaaatggttttacgtcggcgaatttaatttttccgacgccacctcacaaattcacgtgcgcattgtcggcagcgcacagtatgtttcccagtcggaaacgcaaaccgattacagctaccggacaccggaaggcgtggcgcatatttatctgcaggcgcgcaacgacgataacaccattggcagctggtacagcgaaggctcctcacccgtaattaaggtgcatattgagggcaaaggcgcgcacaccaaactgtacgttaaaattccggcctataccggcttctcaattgcgctggtggaaaccaacgggcgcgatcgctatcagtccggtcagtgttttattttccgcaaaagttttaccgcctgcagtgcggaagaagccacggcgctggacaaccagccggtcgtcgcctttgagcagcactgggtgggcaataaagatgtcggctttggctacaacaataataaagaactgctgctgcgtgggccgttttttgaacggcaggagcaggacgccacggggaagtggatcacccgccgtttcctgaaagtccgcgtgaacggtgtgccgcgcagtattgaattactcgatccggataacccgcgctaa

SEQ ID NO: 64679 - DNA, 372 bp, Glycine max
  Peptide Sequence Number=SeqID_181457
atgatgaagcctatgcggacacgcgccgctgggtgcagcttggcatgctggattacatcgcgccgcagctatactgcccgtttgcccgaccaggctgcgcgctatgacgtcctggcgcgctggtgggccaatgtggtacagccaacgcacacccggctgtacatcggcgtggcgctgtataaggtgggtgaagcctcgaaaagtgagccggactggacagttcagggcggcgttcccgagctgaaaaaacagctcgatctgaatgaatcgctgccgcacatcgacggcaccattctgtttcgcgaagattatcttaatcagccgcagacgcagcaggcggtcgattatttacgtcagcgctggggaaaatga

SEQ ID NO: 64680 - DNA, 252 bp, Glycine max
  Peptide Sequence Number=SeqID_181458
atggcctccaggaagcgtaagagcattggggcaaggccaactgctcaatatgatactagatggttccattcccttaatgcttggaaccgttatacagataatgtcttaggaagaagcattttgcctgagaggaaggttgagatataccacaaaaagtttgatgacttcaagacaaagttggagaggcgtaatcttcacaaacgcctcaccaacttggttgatgggactattgatgttgctttggtgaaataa

SEQ ID NO: 64681 - DNA, 714 bp, Glycine max
  Peptide Sequence Number=SeqID_181459
atggctacacgccctcatcttcaagggccgcacgccctcgccttaagaggactacacgtcttcgccttgatagggctgcatgccctctccttcagaggactacatgtcctcgccgtcagagggctaaaggccctcaccgacagaggacaacacgtcctcgccttcagagggatacacgccctcacctttagagggctacgcgaccttaccatcagaggactacacgtcctcgccttcagaggggtgcacgccctcgccttaagaggactacaagtcctcgccttgagagggttgcacgcccttacctttagagaactacatgtcctcgccttgagagggctgcatgcacttgccttcaaaggactatacatcctcgccattagaggagggctacacgccctcaccttcagaggactacacatcctcgccctcagagggccgcacgccctcgccctcagagggccgcatgccctcgccttaagtggactacatgtgctcgccttgagagggctgcacgccctcaccttcagaggactacacatcctcgctttgaaagggttgcacgccctcacctttagaggactacacgtcctcgccttcagagggcttcacgccctcactttcagaggactacacaccctcgccttcagagggctgcacgtcctcgcattcagagggctccatatctgcgccttcggagaacttaatgcttaa

SEQ ID NO: 64682 - DNA, 572 bp, Glycine max
  Peptide Sequence Number=SeqID_181460
taaatgtcctcgccgtcagagggctaaaggccctcaccgtcaaaggacaacacgttttcgccttcagagggctacaggccctcaccttcagaggactacacgtcctcaccttcagaggactacacatcctcgccttaacagggctacacgccctagccttcagaggactgcacgtcctttccttcagaggactacaggtcttcgccttcagagggctacacgccgtctcctttagaggactacacgtcctcaccttcagaggactacatgtcctcgcgtttagagggcatcacgccctcacctttagaggactacatgtcctcgccttcagagggctgcatgccccaacctttagaggactacacgtcctcaccatcagaggaggtctgcccgtcctcgccttcataggactacacgtcctcgccttcagaggagtacacgtcctcgccttcaaaggactacatgtcctcgccttcagaggactacacgtccttatcttcagaggactacacgtccttgccatcagagggctacacgccctcatcttcaggggccgcacgccttcgccttaa

SEQ ID NO: 64683 - DNA, 399 bp, Glycine max
  Peptide Sequence Number=SeqID_181461
atggcaaggacgtgtaatcctctgaaggtgaggacgtgtagtcctctaaatgcgaagacatgtagtcctctgaaggcgaggacgtgtagtcctctaaaggcgaggacgggcaaacctctgatggcgaggacctgtagtcctctgaagatgaggacatgtactcctcttaaggcgaggccgtgcaaccctctgatggcgaggacgtgtagtcctctaaaggctggggcatgcaaccctctgaaggtgaggacgtgtagtcctctgaaggtaagggcttgtagccctctgaaggcgaagacgtgttatcctctgacggtgagggcctttagccctctgacagcgaggacatttagtcctctgaaggtgagggcatgcaaccctctcaaggtgaagacgtga

SEQ ID NO: 64684 - DNA, 288 bp, Glycine max
  Peptide Sequence Number=SeqID_181462
atgtgtctatcggggaaggagagtatgctgatgaaattttctcatgagattttggatgttagcattttgtttctaaacgaccatttagaggaaacactgggttcaacaaaaatagaagaaaatcactcaaagtgtatcaacctcacacagggcaaggtttatgataaattgggattttggctcaaggcttgtagaatggctggtcatgatatatgtcagggtttggccagcggtttggggataaaggggatgtcccacattatttccatgacacacatgcaacgatga

SEQ ID NO: 64685 - DNA, 306 bp, Glycine max
  Peptide Sequence Number=SeqID_181463
atgaaccccttctctctcttcactcctccccctatttatagcaaaataggggaggagcttgccacccaactcgcccaggcgagcaaggttgcttcctccagaagcaacagccttctggaggaagaatctggaaggcccaactttcgaagaagttacgaaaactcacggattgcgaaaaacacctcatttcgatttccgtcacattacggaattttcacggatcgcgtttcaagttttgatgatgccagaaagaattcacttgatactggtgtcatcatcaaaaagggggagaatgtgaatgtatga

SEQ ID NO: 64686 - DNA, 357 bp, Glycine max
  Peptide Sequence Number=SeqID_181464
atgctccaaccatatgggatcagcataggcttaaaggagtactcaaacccggtgacccccaaggcctacactccgaagagtccgtcagggcctcttcctcctgattcaggaaacctacactttctctttaacactgcgcatttacacttttctcaagataacactggtcgggttattgtacaattcccagcttacaacacaaataatgttacatcaagagttaatcatacacttattcataaccaaaactcattgacaatttcacatctcataatgtcacaatccaccatcacatgttttcacgtatctcacaattcaacacatgttctactttacacttttactcaatctcaataa

SEQ ID NO: 64687 - DNA, 246 bp, Glycine max
  Peptide Sequence Number=SeqID_181465
atgcatcccgagttcccagatgaggacatcatggccttgtttgaggaaaaactagacaaggacaaggataagctagggttcgactgcaccaataacaaggctgaatatgaagcatgcgctctgggtgtccaggcagcaattgacttcaatgtcaagctacttaaggtgtatggagactcggcattggtgattcaccagctgagaggggaatgggaaactagagaccacaagctgataccctactag

SEQ ID NO: 64688 - DNA, 291 bp, Glycine max
  Peptide Sequence Number=SeqID_181466
atgactaaagcatgttgtcataccctaatttcgtccggggaccatctgttgttgggatgcgaccctcgtttgaccacttcgaggatgttcctccagaaggcggttgcttctggaggaagcaacctagctcgcctgggcgagctgggtggcaagctcctcgcctattttcctataaataaggggaggagtgaaggagaaaaatatccaaccctcctggtatctgaggttcacttaaaattaatgagaaaaattgtttctgtgaagaaaatccaagctaaggcgcttccgtaa

SEQ ID NO: 64689 - DNA, 255 bp, Glycine max
  Peptide Sequence Number=SeqID_181467
atggtggaggatgcacgaacaacactaggcaatcaattcgtggggctcaggactcaatggtggagaatgcatgtcggcaatcaactcatggggctccgagcaatcaattcatggggcttcggactcaatggtggaggatgcatgaacgacaatcaattcatggggttccgaataagatttgatgatggaggatgcacgaatagtgctaggcaatcaattcttggggctccggacgcaatggtggaggatgcatga

SEQ ID NO: 64690 - DNA, 885 bp, Glycine max
  Peptide Sequence Number=SeqID_181468
atgccgtacaccgacctggtaccttatttgctcaacaaccagttggccgtggtaagcctgggaaaggtctatcaacctccatttctccgatggtacaatcctaataccatatgcacctatcatggtagcgtcccggggcactccgttgaacaatgtgtggcctttaagcacaaggtacaaagtttgattgatgctagatggcttacgattcaagaggatagtccaaatgtaaggactaacccacatgccaatcatggaagctcgacggtgaacgcagtgaaagaatggaagtctcaagagttgaaacggatgagggatgtgtcgactccgaggaggttcatattggaggccttgtgcaaggccggtgtgattaaatatgatggtaacaaggaagatccatgcttaatgcatccaggggcattgcacgatgtggaaagatgcccaatagctgaggaggttttgcaaggactaatgagtagaggtcaaattgaaatccacggtgccaaaaaggaggaaggggaggtattcatgcagtcgagtgacagaaacccaacaaagatgctagcacccttcctttataagagtgataaggtggtaccgtggaagtatggcatagaaggccccgacagaaggcagaacgcgtctgtcatacatgttgggaatggcatgccggcggctaagatcacaaatatttttggtacaagcggcatgacttgtaatggacgtatttttgctcctcctgaactactaacaaggtcgaaagacaaggggaaggtaaaaacagatatgggcgagacagagaagacgggcctgaccgtgaatgacgaggccccggttggaaagcttgcaaaggaaggggacgaccttagcaagagagagatataa

SEQ ID NO: 64691 - DNA, 270 bp, Glycine max
  Peptide Sequence Number=SeqID_181469
atgatttctgatcccaaattcgtccaggctagcaaccatctcgtttgggctaaagatcttacttcagccttaagcaagcaactcgcctgggcgaatggatgccttcagcaggagacgaacatgcagcagaagaaaaatagagagaaaaatgcagagagagccaagaagaagaaggagagaaggaaaagtggagctgaggcgctgcagagttgtgaccatggatcacatccttcgtcatttctcttgttagtcttgtgctttgtgcaatga

SEQ ID NO: 64692 - DNA, 534 bp, Glycine max
  Peptide Sequence Number=SeqID_181470
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtccccagtcccgaacctcgtcggctgtcggtggactgctcgagctgcttccgcggcgagagcgggtcgtcgcgtgctcggtcggggacggattgggaacgggctccttcggggtcctctttcctccgggcgtcgaacagtcaactcagaactggtacggacaagggggaatctcgactgtttaattaaaacaaagcattgcgatggtccctgcggatgttga

SEQ ID NO: 64693 - DNA, 282 bp, Glycine max
  Peptide Sequence Number=SeqID_181471
atggcggagttgattaacaaaacacaactctctccccaaaataatcccaatgtcatcacgttggcttggcggctcctccatataatctcatgcctgcaccctactgctgtcattctgcttccacgaacaagattattcctccagaaggctgttgcttctggaggaagcaaccttgctcgcctgggcgagctgggtggcaagctcctcccctactttgctataaatagggggaggagtgaagggagaaggggttcagccttcttggcacttcttattctctag

SEQ ID NO: 64694 - DNA, 633 bp, Glycine max
  Peptide Sequence Number=SeqID_181472
atggagcggcccgacagcagcgagcatccagcaaaagataggcaggtggccagcagcagtacagcggtgatgagcttcattggattcttccacctccaccgcaaggtgacaccggaacggggcgcagtggacgcgcgaatggcagctcgcgagcagtactgtcgtacgatgggtccacatcgcctcgcaatactcacgcggcagccgcgcaaggatactcggcagaatcccatgttcagtcacattaccgtcggtaccaacgatcttgatacagcggccattttctacgatgccctgctgactccgctcggcatgcgccgccgcccggtcacgcccgatggtggcccggccgcggcatgctgggtgacggcgcacgttgcgctgccgcgcttctacgtctacgcgccctatgaccgtgagccggctagccatggaaacggcagcatggtggcgttcctcgcgccctccgcggacgcggtggatgccgcccatgcggcaggcctcgctgccggcggcaccgacgagggcgcgccagggttgcggccgcactacggagctggctactacggcgcgtatctgcgcgatccagatggcaacaaatgccacatcgtccatcgtggagacctggcctag

SEQ ID NO: 64695 - DNA, 576 bp, Glycine max
  Peptide Sequence Number=SeqID_181473
atggtggtgatggtgatgatcatggataaggtctcgtcgatgctgcgcaacaatcatttcgtttcgcaatgtgcgcacgtccccgttagacaaataaggcaatgcaatcccatgatgaacaacgacgtgctgcgcagcgtgcgctatatgctgagcattaacaacgccaaaatggtcgagattatcaaactggacgatttcgaggtggcggtgtcggcgatggacgcttacgtgatcaaagaaggcgagccgggctacgagaagtgcccggacgaagtgatggcgcacttcctcaacggcctggtgttcttcaagcgcggcaaggacgacaagttcccggcgccggcggttgagctgccgatcaccaataacctggtgctgaaaaagctgcgcgtggcgtttgagctgaaagacaccgatatgcaccagatcttcaccgcggtggacttccgtatctccaagccggagctgagcgcgctgttccgcaaagaaggcaccaagaactaccgtccgtgcggcgatcagatgctgcgctacttcctcaaagggctggcgcagcgcgttcgcggcgagtag

SEQ ID NO: 64696 - DNA, 297 bp, Glycine max
  Peptide Sequence Number=SeqID_181474
atggctccaactgcaggggcatttttgttactactcaacaatactaaccttgccctctatgttggcactgccataattggagtttgtacacgagcaatgaccacaatttctgtgtccaccaccacagagctatttggaaccaagaatttctctgtgaaccataatgtgctggtggccaacattccagtgggatgttttggtctaaatttttgctttgatgcttggggaaaagtggggttagcttcaatcgttgatttgcatatgcttttgggtccttcgatcaaccagggtgattaa

SEQ ID NO: 64697 - DNA, 216 bp, Glycine max
  Peptide Sequence Number=SeqID_181475
atgtcaaaagggctcattgttgtgtttcccagtaaatattccattcaccatgctgacaactctgatggaaaggttgccgctatagtgatttgcattgcggaattcctcagattcgcaatcttgactccatctgctattgcggctgctatgggtgtcgaggttgtggcatgggtcctgcatcctcttgtcatctctggcaagtctcaagccaattaa

SEQ ID NO: 64698 - DNA, 3213 bp, Glycine max
  Peptide Sequence Number=SeqID_181476
atgatgcttgctatacaaggtgatcggttgcacgctccagtgacatccatgtctttcaatcaacaaggagaccttcttttagctggttatggtgatggtcatcttaccctgtgggatgtacagaaaggggtagtggttaaagttattagtggtgagcatacagcaccagtagtacatacattgtttctaggacaggatcctcagaatactcgtcagttcaaagcagttactggtgactgtaagggtctggttctcttccacattatctcagtggttcctttatttagtagattctccatcaaaactcagtgtcttcttgatgggcaaagtacgggcttggtgctttcagcttcaccactcctttttgatgacttcagtggaagtgcttcaccttttaccaggggaaacacctctgccccagccagcagtataagcagcatgatgggaggtgttgttggcggagatgcaggttggaaactcttcaatgaagccccttctttggttgaagaaggtgtggttgtatttgtcacccatcaaactgctttggtggtacggctgagccctacgttgcaagtctatgctcagctctctaggccagatggagttcgggagggttccatgccatatactgcatggaaatacatgacacaaacttgtagttctactgaagctgttgaaagagtttcattgcttgcaattgcttgggaacggaaggttctggttgcaaagttggtcaaatcagaattaaaagtatatggaagatggtctcttgacggtgcggctttaggtctagcatggttggatgatcagatgctggtagttctcacttcaaatggacaactgtatttattttccaaggatggaactgtgattcaccaaacaagtttttccatagatggtattggaggagatgatctagtctcttatcatactcacttcatcaatatatttggaaatcctgagaaagcttatcataactctgttgctgtaagaggagcttctatttatatactgggcccaacacatcttcttgtttctcgtcttctcccttggaaagagcgtatttctgttttgcggaaagcaggtgactggatgggtgccttgaacatggcaatgattctttatgatggccatgctcatggagttgttgaccttcctagaaccttggatgctgtacatgaagccataatgcccttcttgatggagttgcttacatcatatgttgatgaagtgttctcatatatttcggtggcattctgcaatcaaattggaaaactggaccaatccaatgattcaaatagtagaagcaattcagtgcattctgagataaaggaacaatacgcccgcgttggtggagttgccgttgaattttgttgtcatatcaaacggacagacattctttttgatgaaattttcaacaaatttgtggatgttcaacagagagaaacgtttttggagcttctggagccatatattttgaaggacatgcttggatctctacctcctgagggtggttacagcgggttgagcaatgtgtacttcacatggatatatcatccttggattttaatcaggttatgccgggagcatggactatatagtgcgctggtgtatgtcttcaataaaggattagatgattttacggcacctctggaggagttgtttgctgtcttacaaaatagccaaaaggaaagtgctactgtgcttgggtatcgaatgctggtttatctcaagtactgctttacaggtcttccctttccaccaggccgcggaagtattcctcccacacgcttaccatctcttagaagagaacttgtagagtttttgttaaaggactcctgtactccgaaatcacagacagtttcagactttgtgtccagacgaccctgcctgaatctttatcttctcttaaagttagacactgaagctacattagacgtcctcagatgtgctttcatggaagatggaatttcaaatgccagctcatcttcaccagattcagccaataaacctatagaggaagcaaaaaaggaaaatgatattactgaaactcaaaatgctttggttcagaacacagttgatgctctcattcaaataattgatgtgaatattgttcccacagatacaacctctggtagtggtgatgatggattgataaaagagtgtccttccaaggacataggttatgtgtttgagttcattgcgtattatgttgctctccaaagggctaagatttcaaagggtgtgctttgtcaaatattggaatatttgacatcagatagtcagttttcaactaatgtttctgttcaagggtcaactccaaaaaatagagagaagcaagtgcttgcacttttggaagtacttcctgagccagactgggatgcatcatttgtgctagatctatgtgagagagcaaaatatcataaggtttgcggattgatccatagtatcagacatgaatatgtggctgcattggatagttatatgaaagatgtagatgagcctgttcatgctttctcctttattaacagagcattctcacagttgactgacaataaccatgcagcttttcggtcagcaatcatattgcgaattcctgagttggttgaactaagcagggagggcgcgttccatatggttatcagtcattttagggatgaaagttctcgtatcataactgaacttcactctcatccaagaagtcttttcctttatttaaagacactcattgagcttcatttatttggcaccctagacctgtctaatttgagaaaggatgatactatgaatccccttaatagaaagcaggtcaaggatcacccacaaggagtcaaagattacttagagaatatatctaatttccccaagtacatatgtgaaaatcctattcaagtgccagatgatcttattgagctttaccttgagttattatgcaagtacgaaggtggttcagttctcaagtttctggaaatgtttgatagctatcgagttgaacattgtttacgcctgtgccaagaatatggcattatagatgcatcggcgttcttattagaaagggttggtgatgttggtagtgctctttcacttacactttctgatctaaatgataagtttgttgatcttgatgcctctgtggaagctgtagttttaaaccatcgcagagatggttcttcacatatggaaatattcaacagtgttttaaaaacaaaggag

SEQ ID NO: 64699 - DNA, 396 bp, Glycine max
  Peptide Sequence Number=SeqID_181477
atggacatatggttcaaagatactaaagaaattggttcagtactatctaagagtacaatcaaagaatctatgtttacagcttggatggactctaataaaagatatcctcatgggctggatcttatgtatgccgaatatttgttcaaattagtgtatgttgcacatcgaagatgctggcaaccaagaaaacaaggatatacaattggcagactcatatgggtacccccttcaagtggaaagttgttctacatggggatgatgctatcttctgctaaagggtcacaatcttacaaagacattagaacagtaggaaatgtggtgtacggtacatttagagaagcatgctttgcaaaaggttttctaggaaatgatcaagaatttgttggagctctatga

SEQ ID NO: 64700 - DNA, 636 bp, Glycine max
  Peptide Sequence Number=SeqID_181478
atgaacgcatgtcagaacccctctccaataattgatggaaggagggcaaactgtaatattgcagctattggtgcaaacaagaataggacacaggctccacaacatggacagtctagagcagcacctggtgtgttggcctcacctgcttttcatggcccttcctctacatttgtcaatcaaaacattgggcaatacacatttcctaattcaagttttggcatatatactggatattcacaagacacaatgtaccccatggtaggtgtttgtctaaactgctatgggatatttggaggtcaacagttatcaacttattatccctccaatggggcatctgggcaagtgggattagtccataacatttacccttttagtgcccattatccatacaatagccaggctcatggttttggtgtccaatatccacaaatgatgcagtttccaattctccctaggcactatggttcagctggtatccttgcacttccttcttcaatggcaatgccaattactagtgcagttacaacaacagcaactacaacaacaacagaggcattaagaacaagtgtaggtgcttcacaaaccgctggaacaacttctgaacaaaattcttcagctgaatctctacatagataa

SEQ ID NO: 64701 - DNA, 186 bp, Glycine max
  Peptide Sequence Number=SeqID_181479
atggtgggtggtaacatcaattcaaggcaatacaatgatacaacttctaccaaaatctttgttggagggttagcttgggagactcaaagggacacaatgagaaggtattttgagcagtttggagagatcttagaggctgttgtcatcacagacaagaacactgggaaatccaagggttatggtttt

SEQ ID NO: 64702 - DNA, 519 bp, Glycine max
  Peptide Sequence Number=SeqID_181480
atggctactccacctgcctcgcctcctcctcctgttcctcttcctccacctcctgcagacgcatcagtgtctctatttacgttgaagcggacacgcaaggcgacacagctacgatcattggccactagaccacctggggcaaaaagacctatggtcaacgtcgattctgctaccggcaaggtcgacggtccccacaagaagaaattaagaacatatttggtgattgtcgctcgtgataaggttgacgtgacatatgacacctggaaggaagtccctactggtcagaaggatttgatatggaaggatattcaggcagaatttgaaatccctgaagcttctgacaccgacaaggacggtgtggacgacattgtctgtgaaaaatatggcattagcaaggagaaatgggcccagttttgtcagacccacagagatccctcatgggaggatgtgcggaaaaaggcacaagtcatccagaagcaaaacactgcccccccacgtattgtctcgtgggggttataa

SEQ ID NO: 64703 - DNA, 177 bp, Glycine max
  Peptide Sequence Number=SeqID_181481
atgtcgcggcggctccggaagatgccttggccggggaactcgttggttatgcactccacggttatgggagagaagagttccatgatgcctccgtttgagggtttggttttgggagtactgaggaggtttcttgagggtttcttgttcatggttgggaagggaaagaaggttgaatga

SEQ ID NO: 64704 - DNA, 264 bp, Glycine max
  Peptide Sequence Number=SeqID_181482
atggatgatgatgataattcaaatgatatcaatgtttctggaaactcattaccaatgacaagcctacgtaacatcagctcaagtaacagtatatctatgcacactactcaatctaaaggatacaatccaattgttgccaaaggccataaggaatccgtttatgcattggcaatgaatgaaggtggaacacttcttgtctccggtggttgtgcgtatttgggatccgagatctggatcaaagactttgaatctaaaagggcataa

SEQ ID NO: 64705 - DNA, 219 bp, Glycine max
  Peptide Sequence Number=SeqID_181483
atggaggagatgaatgtgcacataataacaaaggggacccctaaggaacacagaacgagaaatgacgtagggacttatcgtggtcgcgatttggtagcgtctcgacttcgttttgatgtagctccatgtggagcttgtaggccttggatcttcttgatcaatggagtcttttgcttcttgaagatgaatggtagcagaatggagaaggaagaaagatga

SEQ ID NO: 64706 - DNA, 1474 bp, Glycine max
  Peptide Sequence Number=SeqID_181484
atgaatggaaacagtggatttaacactcacttaccagtgtttgatggtaagaactggagtcgttggtcaatacagatgcgtgtgttgttcggagcacaagatgtgctcgaatttgtgaatgacggagttccggatttggcggaaaatgcgacggaagcgcagaggaatttgcatcgcgaaaagaagaagaaggatcagaaagccttgttctacattcaccagtgtgttgatgcaaagatctttgagaagattgcggaatcgacgacggcgaaagctgcttgggacacgcttgtgcgttgctatggtggtgatgcaactgtgaagaaagtcaagcttcaatcactgaggaagcagtatgagaacctgaatatgaagcacaatgagaaggtagctgattatgtgtctcgcataattactgttacgaacgaaatgaagacctgtggtgagacaatttctgagcagatgattgttgaaaaggtactgcgttccttaactgctcaatttgatcatatagttgttgctatagaacagtctaaggacactagtacaatgaagattgatgaattgcaaggtagtttagaagcacttgaattaagagtaattgaaagaggaaatggaaaagaaacagatcaggctttgcaagcagcatctaaggaaaattggcgtgaaattaagaagaaacagtggttagataagaaggctaaacagaatcccaatagtagtgataaggataaaggaaaatcactggctgataaggcagaatcatcaaataaaggaggttataactcaaagtttaataagaaaaagaactttgataaaaggaaaatacagtgttataattgtgacagatttggtcactttgctgatgaatgttggtctggtgctggtaagtggaagaaaccagagaaaggtacagagcaagctaatcttgctcaagatagttctgatacagaacctgttatgttaatggtgacaaccaatgatgaaggcgtagtagtagattggtggtatttggacacaggttgttctaaccatctaactgggaataggcagtggttgattaactatgattccagcaaagaaagtagaatcaggtgtgctgatgatgagtacttggttgctgaaggaatgggagatgtgctggtaaaattgaaggatggtggaactgtcttgattgaaaatgtgtggtatgtgcctggcatgaagagtaatttgatgagtgtaggccaattattggagaaaggttactcagtaactatgagagatgcagtgctgcagctgtttgataattctgataaactggttttgaagtcaaagctgagcaggaacaggacttttaaatgcaatgtaaaagattctggtgtgaaagtattgagtacagtgactgaatcacagagctggctatggcataggagatttggacacttgaatttcaagagtctaactcagttgagtgagaaggagctagtgacag

SEQ ID NO: 64707 - DNA, 258 bp, Glycine max
  Peptide Sequence Number=SeqID_181485
atggatgctatgtgtatgatttttctaaaatcatgtatgttttatgcactttggctttttgttgatgccaaagggggagagaaaatagggattaaatcaagaactcatacaattaagtttgtcatcataaaaaaggaagagattgtagaagcaagcttcatgatgatgaatcaagttgattcaagtagttttgatgatgacaaaaagctcaagagaatgatttcaagactgagtcaacaagttcaagatcaagattaa

SEQ ID NO: 64708 - DNA, 2205 bp, Glycine max
  Peptide Sequence Number=SeqID_181486
atgggaatcaatatttgtctctctctttgcttcttctacatcactacccttcaccgcacaatttccacgttggcccagtctgagaattatatcatccacatggacatatcagccatgcccaaagcatactcctcccatcacacttggtatctctccactctctcttcagcattggagaattccaaagccaccaccgacaaccttaattctaagctgatttacatctacaccaatgtcatcaatggtttcagtgcaaacctgtcacctaaagagcttgaagctctcaaaacctcccctggttacgtttcttccatgcgagatttacgcgccaagcgtgacacaacacactcaccacagttccttggcctcaacaagaatgtgggggcgtggccagcgtctcaatttggcaaagatatcattgttggtttggtggacactggaatttctcctgaaagcaaaagctataacgatgagggattgactaaaattccttctcgatggaaaggccaatgtgaaagtagcatcaaatgcaacaacaaactcattggagcgaggttcttcatcaaagggtttctggcaaagcaccccaacaccaccaataatgtttcttcaacgcgtgacactgatggtcacgggactcacacatcaagcactgcagctgggagtgttgttgagggtgcatcatactatgggtatgcttctggatcagccacaggaatagcttcacgtgcgagagtggccatgtacaaggccttgtgggatgaaggagattacgcatctgatataatagctgcaattgatagtgctatatcagacggggttgatgttctttccttgtcatttggttttgatgatgtacccttgtacgaagaccctgttgctatagccacgttttcagcaatggagaaaggaatttttgtgtccacgtcagcaggaaacgaagggcctttccttggaagacttcacaatggaataccatgggtcataaccgtggctgctggcaccttggaccgtgaatttcatggtactcttacacttggcaatggtgtccaaataactggcatgtctctctatcatggaaacttctcttccagcaatgttccaattgttttcatgggcttgtgcgacaacgtgaaggaactagccaaggtgaaaagcaagattgtggtgtgtgaagacaagaatggaactatcattgatgttcaggcagctaagctgattgatgcaaatgttgtcgcggctgtgttaatttcaaacagctcttacagttcgtttttcttagacaatagctttgcgtctattattgtttccccaataaacggggaaactgtcaaagcttacattaagagtactaactatggcacaaaaggaaccttgtcttttaagaagacagttttgggttctagaccagctccgagtgtggatgattacagttctagagggccttcaagtagtgttccatttgtgttgaaaccggacatcactgctcctggtacatcaatcttagctgcatggcctcaaaatgttccggtggaagtgtttgggtcccaaaatattttcagcaacttcaatttgttaagtggcacatccatggcatgcccccatgttgctggtgtggcagcactgttaagaggagcacaccctgattggagcgttgcagccattaggtcagccattatgacaacatcggacatgtttgacaacaccatgggactcatcaaagacgttggtgatgattacaaaccagccactcctttagccatgggagctggtcatgtcaacccaaatagagcccttgaccctggacttgtttacgatgtgggagttcaagattatgttaatcttctctgtgcacttggctacacccaaaagaacatcaccgttatcacaggaacctcttccaatgattgttcgaaaccctctttggacctcaactacccttcttttattgctttcttcaagagcaacagttcaagtacaacacaagaatttgagagaaccgtgaccaatgttggggagggacagacaatctatgttgccagcgttacacccgtcaaagggtaccacgtgagcgttatccccaagaaattggtgttcaaggagaagaatgagaagcagagttacaagttgagaattgaaggtccaataaagaagaaagagaagaatgtcgcttttgggtatctcacttggacggacttgaagcat

SEQ ID NO: 64709 - DNA, 2262 bp, Glycine max
  Peptide Sequence Number=SeqID_181487
atggctacccatatttgtctctctctttgcttcttatacatcacaacactcaacctcgtttccacgttggctcagtctgacaattatatcatccatatggacatatcagccatgcccaaaacattctccacccaacacagttggtatctttccactctctcctcagcattggacaattccaaagccaccaataatcttaactctgttagttcttctaagttgatttacacttacaccaatgccatcaacggtttcagtgcaaacttgtcacctaaggagcttgaatccctcaaaacctccccgggttacgtttcttacatgcgggatttaccagccaagcgtgacacaacacactcaccacagttccttggcctcaaccctaatgaaggggcgtggccagtgtctgaatttggcaaagatgtcattgttggtttggtggacactggaatttggcctgaaagtaaaagcttcaacgataagggaatgactgaaattccttcacggtggaaaggccaatgtgaaagtacaatcaaatgcaacaagaaactcattggagctcagttctttaacaaaggaatgctggcaaatagccccaacattaccatagctgcgaactcaacacgagacactgagggtcacgggactcacacatcaagcactgcagctgggagtgttgttgagggtgcatcgtactttggttatgcttctggatcagccacaggaatagcttcaggggcgagagtagccatgtacaaggcattgggggaagaaggagatttggcgtcagatataatagctgcaattgatagtgcaatattagatggggttgatgttctttccttgtcatttggctttgattacgtacccttgtacgaggatcctgttgcaatagccacgtttgcagccatggagaaaggaatttttgtgtccacatcagcaggaaacgaagggccttaccttggaagacttcacaatggaataccatgggtcataaccgtggctgctggcaccttggaccgtgaatttcatggcactcttacgcttggaaatggagttcaagtaacgggcatgtctctctatcatggaaacttctcctccagcaatgttcctattgttttcatgggcttgtgcgacaatgtgaaggaactggccaaggtgaggagaaacattgtggtgtgtgaagacaaggatggaactttcattgaagctcaagtgtctaatgtgtttaatgcaaatgttgtggcggcagtgttcatatcaaacagttctgacagtatatttttctacgataatagctttgcatctatttttgttaccccaataaacggggaaattgtaaaagcttacatcaagatcactaactctggtgcaaatggaaccttgtcttttaagacaacagctttaggtactagaccagcaccgagtgtggatagttacagttcaagagggccttcaagtagtgctccatttgtgttgaaaccggacatcactgctcctggtacatcaatcttagctgcatggcctccaaatgttccggtggatgtgtttattgcgcccaaaaatgttttcactgacttcaatttgttaagtggcacatccatggcatgcccccatgttgctggtgtggcagcattgttaagaggagcacaccctgaatggagcgttgcagcaattaggtcagcaatcatgacaacatcggacatgtttgacaacaccatgggactcatcaaagacattggtgatgattacaaaccagccactcctttagccatgggagctggtcatgtcaaccctaatagagcccttgaccctggacttgtttacgatgtgggagttcaagattatgttaatctcctctgtgcacttggctacacccaaaagaacatcactgtcatcactggaaactcttccaatgattgttccaaaccctctttggacctcaactacccttcttttattgctttcttcaatagcaacagttcgagtgcatcacaagaatttcaaagaacggtgaccaatgttggggagggacaaacaatctatgttgctagcgttacacccgtcaaagggtactacgtgagcgttatccccaacaagttggtgttcaaggagaagaacgagaagctgagttacaagttgagaattgagggtccaacaaacaagaaagtggagaatgtcgcttttgggtatttcacttggacggacgtgaaacatgtggttaggagccccattgtggtcaccaccctcaaagtgaatttctag

SEQ ID NO: 64710 - DNA, 273 bp, Glycine max
  Peptide Sequence Number=SeqID_181488
atggatccatctgcccggtacttgattttatacacccatctgcaaccgatagcagtcttatgcggtggaagagaagtgagtctccatgtgttattcaactggagagcttgtaactcggcttccatagccttaatccagaagtcatggcgggaggcctcggcatatgaggaaggttctatgttggaggaaatactcatgacaagatacttgccggagaagggaaccggagaaggagctgggttgtttgaatctaattgctgggtttcagaatga

SEQ ID NO: 64711 - DNA, 321 bp, Glycine max
  Peptide Sequence Number=SeqID_181489
atgcataagatcactaacattttgaggacgcaggcaattgatgggagaacagctatatggtctgagtgtgagaaacctacaagatctagagaatcaactggaactgaatctccaaggtgtccgtatgaaaaaggggaacctgatctttcaggaaaatgtggaactttacaagaagatatggccacaacaagcagaaatgcatttgttccactttcatatggtatgcatgctgcaggagggaatccacaagaattggtccaacttcagctatgccagcctgaacaagaagtttgtgagacatcggacacagccacaaaatga

SEQ ID NO: 64712 - DNA, 1335 bp, Glycine max
  Peptide Sequence Number=SeqID_181490
atggaaggactggactacctcgacaccttctctccggtggcaaagcttactacagtcctccttctccttgcattagcttccctcaatcaatggcacctacgacaattagatgttaataacgcatttctccatggagaacttgacgaggaagtatacatgcagataccaccagggctttcggttgacaatccccaactcgtatgtcgtctccaacggtccctttatgggctcaagcaggccagtaggcaatggtttacgaagctctctagtttcctatgttctcatgggttccagcaatcaaatgcagatcattcacttttcctccgtttcaatggagacatcaccacaatcctcttagtatacgtggatgacattatacttacaggcaacaacatggctgagatacaaactataaccattctcttggatcgcgaattcaaagttaaggaccttggtgatttaaagttctttcttggtctcgaaatcgcccgaacctctaaaggaattcacctgtgtcaacgtaaatacaccttggatcttttgaatgattcagggatgttgggttgcaagcctaactcgacacctatggactactcaactaagttacaagcaaattccggcaaccttctttcaacagattcttcttccacctacagaagattgataggcaagctcatataccttacgaatacgcgacctgacatcacgtacgcagtccagcaactcagccaatatatggctgctcccaccgacacccaccttcaagccgcctttcgtgttcttcgatatctaaaaggcacgccgggttccggactattcttccccgccacaggtactcctcaacttcgggcgtttagtgactccgattgggccgggtgcaaggattcaaggaaatccactacaggatacttagtttatcttggttcttcccttgtctcttggcaatctaaaaagcaatccaccgtatcaagaagctcctccgaagctgagtatcgagctctcgcctccaccacctgcgaactacagtggttaactttcctgctccacgattttcaggtcatctttactcaaccaactgctttgtattgcgacaatcagtctgcaattcaaatcgccacaaatcctgtcttccatgaacggaccaaacacattgagatagattgccatctcgtacgacaaaagcttcactcgggtcttatcaagcttcttcctgttgcttcgtccttacaactcgcggatatattcactaagcccctaacaccagctgtttttcaccatctttgtaccaagctgggaatgatgaatattcattcccagcttgaggggggctcttaa

SEQ ID NO: 64713 - DNA, 369 bp, Glycine max
  Peptide Sequence Number=SeqID_181491
atgacgagaagctctaacaatgattgttccaaaccctctttggaccataattacccttcttttattgctttcttcaatagcaacggttcaagggcagcacaagaatttcagagaacaatgaccaatgttggggatggacaaactatctatgttgctagcattacacccgctaaagggtaccacgtgagcgtcaatcccaaaaagttggtgttcgaggcgaagaacgagaagcagagttacaagttgagaattgaaggtccaagaaagaagaaagaaaagaatatggctcatgggtatcttgcttggacagtcatgaagcatgtggttaggagccctattgtggtcaccaccctcacatttgatttctag

SEQ ID NO: 64714 - DNA, 186 bp, Glycine max
  Peptide Sequence Number=SeqID_181492
atgcaagagctgccacataaatggtggagcggagcggcacaggaagatggggtttggtctgctgaaagagaacacgaaatcagagtggagggtggcacaggagtgaaaacgagagcaacaacagcctgggctaggtttgagaggtcaacaacggtgcctcaacccaaagctcttagccttaattag

SEQ ID NO: 64715 - DNA, 1059 bp, Glycine max
  Peptide Sequence Number=SeqID_181493
atgagtgaagtaatcatcaataacatggagagttatctataccttcatcccggtgagaacccaaccactgccttagtttctccggtactagattcaactaactaccattcatggagtaggtccatgatcacagcactaagtgctaaaaacaaggtggagttcatagacggcagtgcgcctgaaccattaaagaccgataggatgcacggagcatggcggcgatgtaataatatggttgtctcgtggatagtccattcagtagcaacctcgatacatcagagtatactttggatggacaaagcggaggagatctggcgcgacctgaagtcaaggtattcacagggtgacctccttcgaatttccgatcttcagcaggaagcttcgatgatgaagcaagggtcactcacagtgactgaatatttcactcgtttgcgtgtaatatgggatgaaatcgagaactttaggcctgatcccgtctgttcttgcaatattagatgttcctgcaatgtgttcaccattatcgctcaacgaaagctcgaggatagagccatgcagtttttacgaggcttgaacgaacaatacaccaatattcgttctcacgtccttctcatggaccccatacctgccatttccaagatcttctcttatgtggctcaacaagaaagacagcttcttggtaacgccggaccaggtatcaacttcgaacctaaggatatttccattaatgccgcaaagaccgtttgtgagttctgtggtcgcactggtcatatggaaaatgtgtgttataagaaacatggggttccttctaactacaactcgagaaacaagaataatggaggaagaaaaacatgcacccactgcggcaagataggacacacagtcgatgtttgctatcaaaagcacgggtatccgccgggatacaagccttacggtggaagaaccaccgtgaacagtgctatgacagttgaaaacaagggtaacgatgatcaagctcagcaccacgagtcccatgagttggttcactctcccccgagcagtacaaggcactccttgccttaa

SEQ ID NO: 64716 - DNA, 168 bp, Glycine max
  Peptide Sequence Number=SeqID_181494
atggaaggtttagcctctcattgtcatgagatgctttacaattgcaagagggtgatgggaaaaaaagagggtgaagtctgcttaaaatttatgcaacatcgcgctaagcgcaaccgccgcgcctatggagagtcgatggtcacgcacttagcgcacgacttgcgttaa

SEQ ID NO: 64717 - DNA, 879 bp, Glycine max
  Peptide Sequence Number=SeqID_181495
ctacattcttccctcgttctaagcatcaccatcattcacatcaacaacaacaacaacaacacaatggccagccatgcagctcaaaaccctaaatctgttttccttatgaccttcctcttgctaatcaccagcgccaaatcagactcattttctttcaacctacccagatttgagccagatgctttaaacatactactcgatggtagtgccaagacaacaggtggagtgctacaactcaccaaaaaggacaaaagaggaaaccctacacaacacagcgttggcctctcagcattctatgcagcacttcatctctccgacgcaaaaactgggagagtcgcaaacttcgccaccgagttctccttcgtcgtgaacacaaagggtgcaccactccacggcgacggcttcaccttctaccttgcatcactcgactttgatttcccagacaactcaagtggtggcttcctcggactcttcaacaaaaaaacagcctttaacacttccctaaaccaagttgttgctgttgagtttgacagctttgcaaatgaatgggaccctaatttcccagagtctgattctcctcacattggaattgacatcaattccattaggtctgtggcaactgcgccatggccacttgatattcaaccacaagggtcaataggaaaggcacgcataagctaccaatcttccaccaaaatattgagtgtctcggtggcttatccaaatagtcctgtgaaactgaatgccactgttttatcgtatcccgttaacttaggggctgttctgcccgaacgggtcctattcggtttcagtgctgccaccggtgacttggttgaaacacatgatattctttcatggtctttcaattccttcttgtag

SEQ ID NO: 64718 - DNA, 558 bp, Glycine max
  Peptide Sequence Number=SeqID_181496
atgcactcctctttgtcccataaatctattgaaaatgtcatgaaaaaatgtttctcccgtggacacctccctcccatacatggggtcctcaatgagagaaacattgacgttgaggaaattgagcagggccatttcggcattgtgaaagtgagggtgggagtgaaggggcaatattttttgagtcaaaaagtttggaatgaagcggaggtgaatgaaggacaaggagagaacttagtgggtaggttgagaagggctatgaattttgcggtgttaatggagtggcagagttggatttgtgcagtgaggaaactcaggggagtgtatttttctggatattttagaggaaaaggtttaaaggggagtgtattaaaggaaggtgcaaataacaaccttctcattttagtaatactagtgtatagtccagtagcatcaccagcccaacgcaagcctggacttgcattcacccgccattcaactccatggcatttacttcttgcatgcccatacctgcttcctgcactgcccaattttttcaatatctctaaactacccttctga

SEQ ID NO: 64719 - DNA, 1656 bp, Glycine max
  Peptide Sequence Number=SeqID_181497
aactcaactcgagacacagaaggccacgggacacacacatcaagcattgcagttggaagccaagttgagaatgcatcattctttggctttgccaatggaacagcacaaggaatagcttcaagggcgagaatagcaatgtacaaggccgtgtgggatggtaaagctcactcaactgatgtattagccgcgattgatagtgcaatatcagatggtgttgatgttctttccttatcattcggctttggtaatataagcatgtacagtgaccccattgctatagccacgtttgcagccatggagaaaggcatttttgtgtccacatcagcagggaattctggccctgatcgtggaactctaaatagtgcaataccatgggtcataaacgttggtgctagcactttggatcgtgaatttcgagggactcttgctcttggcaatggagtcaacatacctggcttgtcactctacctaggaaacttctccgcccaccaagttcctattgtttttatggactcgtgtgacactttggagaaacttgccaatgcgagtggcaagattgtggtttgtagtgaagataagaataatgtgccactgtcatttcaagtgtataatgtgcattggtcaaatgctgccgcgggagtcttcatatctagcacgattgacacgtcgtttttcttaaggaatggttctgcaggcatcattattaacccgggaaatggacaaattgtcaaagcttacatcaagagtaaccctaatgcaaaagcaagcatgtcttttaagacaacaactttagctactaaaccagcaccaagtgtggatgtttacagttctagagggccttcaagtagttgtccatttgtgttgaaaccagacatcactgctccaggtacatcaatcttagctgcatggcctccaaatcttccagtggcacaatttgggtcccaaaacctttccagtaacttcaatttgttaactggcacatccatggcatgccctcacgtggcaggtgtgggagcactgttaagaggagcacaccctgattggagccctgcagctattaggtcagccattatgacaacatcggatatattcgacaatactaaggaactcatcaaggacattgctgatgattacaaaccagcctctcctttagccttgggatctggtcatgtcaaccccaacaaagcccttgaccctggacttgtttacgatgtaggagttcaagattatgtcaatcttctctgtgcaatgagctccactcaacagaacatctcaatcatcactagatcgtctactaataattgctccaatccttccttggatctcaactacccttctttcattggtttcttcagtagcaatggttcttctaatgaatcaagggtagcttgggcatttcagagaacagtgaccaatgttggggagaaacaaacaatctattctgctaacgttacacccatcaaagggtttaatgttagtgttgttccaagcaagttggtgttcaaggagaagaacgagaagctaagttataagttaaggatagaaggtccaatggtcgaaggctttgggtatctgacttggacggacatgaagcatgcggtgaggagccctattgtggtcaccaatcaggcaccctcaaattcaatttccatatag

SEQ ID NO: 64720 - DNA, 867 bp, Glycine max
  Peptide Sequence Number=SeqID_181498
atggctttccccaactcaaaacctaacctccttcaatctcttagtccccttatcaaatttttcatccctttcctcttgttgctacaacatcacagtgtcaagtcacaacaacaacccccatccccaatgtcagcatacgaaaccgttggcattgacttctcttttttcgacaaagatgatccaaacgtacttttgatcggcaatgcctcagtatctggtggggctctaaggttaaccaacaccgaccaacttggcaaaccagttccacacagtgttggaagagtagtgcatatcacaccgatacacctctggaacaagaacaacggacatctcgcagacttcacctctgatttctcctttgtcgtgaaccctaagggttcagcccttcgtggtgatggctttgccttctttcttacatcagccaaccttaacttcctgatccccaaaaactcaagtggggggtatcttggtcttttcaagccggaaactgcactggacccttctaaaaaccaaatagtggccattgagtttgatagtttcaccaatgattgggaccccaattcaccaaaccagtctcctcatgttggaattgatgttgactctattaagtcagtggcaactgtgccatggcctagtgaacttgaacctgataatgctgtagcacatgcgagcctgaactacaactccgaggacaagaggttgagtgtgtttgtgggttaccctgacaataggaatgccactgtctctgctattgttgatttgaggaatgttttgcccgaatggatcagtgttggtttctctgcctccactggtgacttggttgaaacacatgacattcttaactggtcttttgaagcagccttgtag

SEQ ID NO: 64721 - DNA, 135 bp, Glycine max
  Peptide Sequence Number=SeqID_181499
atggttggaacattctcgcaaaatggagtgaccctgactggtcaccttacgattttacttagtgagagtgacctgacatacccattgtgtgatgactttaaagaacctcgtgctactcgtgctagaggacgttaa

SEQ ID NO: 64722 - DNA, 198 bp, Glycine max
  Peptide Sequence Number=SeqID_181500
atgtacaaaaggatgcactaccataacttaaaaacacaaagagcacattttcaaacacaaagcaaaggcaatgctcaaatagggctaacctggggaggaagtcgcgagggaataggccacgaaaccaaatacggcttctttatcacgaggtatcgagaagatgaaacgacgttggcgtcgcagcagaacgtgggttaa

SEQ ID NO: 64723 - DNA, 165 bp, Glycine max
  Peptide Sequence Number=SeqID_181501
atggatgaacatcaacagaactggaagaaaatggctaacacgatgatgaagattcataaaaaagcagaggaaatgttcaacattgttcatgctatggatcaaccttacggtgaagtcaataggtcatttgttgtaagatggaaggatgaactagagcctacttga

SEQ ID NO: 64724 - DNA, 337 bp, Glycine max
  Peptide Sequence Number=SeqID_181502
atgtccgccatggatatgattaagtccctttccagtaagcctgaaaaatttacgggtgaaaattttttctgttggcaacaacaaatgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgccataccaaaacttctgttgagttatgggaagcacttgaattgaaatatggatctgctgaaaaag

SEQ ID NO: 64725 - DNA, 219 bp, Glycine max
  Peptide Sequence Number=SeqID_181503
atggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaaggtgatagtgtgttgtacttgaagattatctcttgttcttcctatataaagattggtgtaatattctag

SEQ ID NO: 64726 - DNA, 432 bp, Glycine max
  Peptide Sequence Number=SeqID_181504
atgacttcgaagaacaacaacgataacctcaacaacctctcgagggagcgatcatcaccggacacttgccggaggactcattttccggcaatagcgaatcgaatcgagttcagatcagaaaccgaaaaagaagaaaacaaacgaaaatcgaaaaatcgcgaggtgacgtggcgaggtcgaccggctgtacccggtcacccagttgcgcaacgagtgggccatttgggcttagtggtgggatattcgcccagcgtggccactcactttccggtcaccgacacgtggcaattctttgggggtttattggtgggtgttccattcgtgcgtgcggtggacacgtgtgcgtttttagtgagtgagaatgtgagttacactgttatcaggccttctggaaaagctgttactgatccaacagaacaccggccttcatga

SEQ ID NO: 64727 - DNA, 1048 bp, Glycine max
  Peptide Sequence Number=SeqID_181505
atggcttccgcatctccgagtttcgtttctcaatcatttcctaattccatcgccgagaagctcgatgatttgaactatctccattggcgacaacatgttgagcattgttttgttgtgaatccggtggttccaccgcgttatctcactgaagacgatcacatagctgatcgtgtcaatcctgagtatgaggcatgggaagttcaggaccaaacactccttgtttttcaaacctttaagtccatgcctaaaactgtcaaacaggcccttgagaatccagattggtttgctgccatgcaacaagagtatgatgctcttctgaaaaacagaacttgggacttggtttcattaccttccaacagacaagctattggatcaaggctggtagctaagggtttccatcaagtctatggttccgatttccatgagaacttttcccgtgttcttaaagaatcaatgtttatgacacagcctcctgactttgaagttggggataggtttcttgtttgcaaacttaacaaggctctctatggcttaaaacaagccccaaggcagtggtttgataggttaaagtctactcttcttcagtttggttttgtgggcagcaaatgtgattcttccctgtttatctacaagcatcagactcacactgtctatcttctagtttatgtggatgatattatcatcacaggtagttctacctctctcattcagcagctaactactaaactccacatcgctttctctcttaagcaacttggtcatttggattatttcttgggcctagagatcaagtatctgcctaataataactctatagtgatgactcagaacaaatatgtgatttacttcacaaaactcacatggcagaagcccattctatttcctctcccatggtttctaattgcaagttatccaagtaaggcatctaacgttgatgacaggcattccacctcaggagcagccatctttcttggtccaaatctgatatcttggtggtctcgcaaacagaaggtcactgcacggtccaacactgaagctgagtaccata

SEQ ID NO: 64728 - DNA, 666 bp, Glycine max
  Peptide Sequence Number=SeqID_181506
gaatcttgcagagatattgtgcgcgtcactgtgcacattaagaatcctgtagagacattgtgtacgtcactgtgcacatcaggaatcttgcagagacactatgcgtgtcactatgcacgttactgtgcacgtcaagaatcatgcaaagacattgtgcacatcaagaatcctacagagatgcagcgacactgtgtctgtcaggaatcctgtagagacattgtgcatagacactgtgcacgtcatgaatcctacagcgacattgtgcaaacactattcatggtactgtgcgtcataaatctcgatgcagacgtgccctccgacctaaatgtccaaccaactactcaaatccatgttgctcaatctcaaagtaatgaaatatcacatgactatcatgctaaaaacgggttgccggatgaagtagttggtgacttcagtgacaatgaagatgaaattttggcggtcaatgatgacaacaacatcaacgacaacaatgataatgacatccaatttcttttccaaccggcaacaactaaaaatgtctatcgtccatatccaaattgcgttgatattggtgacaaccaagtgattgacaatcccaactataggcattttttggacctaccacaacaatctaaatcacaggatggtgagctatatgttggttag

SEQ ID NO: 64729 - DNA, 102 bp, Glycine max
  Peptide Sequence Number=SeqID_181507
atgtggaaagtcaagaggtacatcccaagagctggtaaatgcatcttgactcttggagaattccacttgcataataagaggaatccctactttggagagtga

SEQ ID NO: 64730 - DNA, 663 bp, Glycine max
  Peptide Sequence Number=SeqID_181508
atggccattcatgcagataaaaaccaaattttgctaagttggaaacagagacttcaaattgctctggattcagcaacagggttggagtatctgcataaatattgtaagcctccaattgtgcacagagatgtcaagactagcaacattttacttgacgaagatttccacgctaaagtttctgattttgggttgtcaaagatcttttcaaatgaatgtgacacccatgtactaacaaaaatcgcaggcaccccgggatacatggaccctgaatatcaaataacaaacaagttgactgaaaaaagtgacgtctatagttttggaattgttctattagagattatcacagggcaccctgctatcttgaaaacccacgagaatactcacatagttcagtgggtaaattccatgttagctgatgaaggagaaattgatagtattatggatccaaggttacagggaatatatgactctgagactgcatcgcaagttgtacatgttgcaatggcttgtctagctccgagttctattaagaggccaacaatggatcaagtggtcaaagaattaaaacaatgttttcccatggagaatattgatgatagtatatgtatattcactgaattctctgtggcatcaattagcggagagagttctctagcgaggtag

SEQ ID NO: 64731 - DNA, 774 bp, Glycine max
  Peptide Sequence Number=SeqID_181509
atgttagggaatatctcaaattcatactgggcttataatgatgctgaaagtgagaggcatgaaggagtggagaacttctacagaaaaaatcacacttaccaatcaattgatttcgtgaagaaaatgagagaggagtacgcaaaattgaacagggtagagatgagcatatgggaatgttgtgaactccttaatgaagtggtggatgagagtgaccctgacttggatgaacctcagattgaacacttgctccagacagccgaagctataaggagggactaccctgatgaagattggttgcacctaactggccttatccatgataggaaattgcaagaaaacttccacttataccacaagcatttaccaatttgcttcaatgcagatcttggcaaggtgctgaatttgcctagttttggaggacttcctcaatgggctgtagtaggggacatattccctgttggttgcagatttgatgagtccattgttcaccacaagtattttaaggaaaatccagactacaacaatccagcatacaacactaaatatgggatttactcagagagatgtggacttaacaatgtgatgatgtcatggggacacgatgactacatgtatctagaaattctcaaaactttgggtgcttgtcttaggtggcaaaggagaatgatactacactgccctctgcggctttgtttcattataagataccattcattctatgcattacataaggaaggagcctataagcacttgatgaatgatgaggatttttga

SEQ ID NO: 64732 - DNA, 396 bp, Glycine max
  Peptide Sequence Number=SeqID_181510
atggcctcaattgttactatggccaccattgtcacattagtcctcgcactagcatgttgtggcatgtctgccccgacctcagtgccgaaaaccactgcagcggccccggccccggagagcaatggctgcttgatggcactagcaaacatgtcagattgtctgacctatgttgaggatgggagtaagttgtcaaagcccgacaaagggtgctgccctgagttggcagggttggttgatagcaaccccatttgcttgtgtgagatgctaggcaaacctgactctattggcatcaaaattgatttgaacaaagccctcaagcttccttctgtttgtggagtgaccactccccctgttagcacctgttccgatcatggaaaatataaaatgaatttctaa

SEQ ID NO: 64733 - DNA, 117 bp, Glycine max
  Peptide Sequence Number=SeqID_181511
atgagtgaaggtccaagtattgcaccgggagccttcagtccttcaaatgcagatgctgcgaatcctgcttcaagtcctaactctgcttctagtcctgcagaactagtattcaagtag

SEQ ID NO: 64734 - DNA, 637 bp, Glycine max
  Peptide Sequence Number=SeqID_181512
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgcctgcaaaggattctacccgccgctcgatgggaattgcgcttcaaggcgtctcgtagggctaatccgcctcacgagggtcaccaacgggcacgtgccttttggggggccgaggccccctactgctggtcggcaaacggacggcgggcgcacgcgtcggcttctagcccggattctgacttagaggcgttcagtcataatcccacgcacgggagcttcgcgccactggcttttcaacgagcggatgaccaatt

SEQ ID NO: 64735 - DNA, 1767 bp, Glycine max
  Peptide Sequence Number=SeqID_181513
atggccagtattctgtgtccttctttaaccatagtcacgtcctatgcatccaggaatgaaccaaaacttgtctgtaaactcactgcagtgacaggaaactctcattcaccactatggttttcttgcactcgccctggaaactcagctagaaaccattttctgctcaaatcctcaaatgggcttccgctaaatgctgtttcttctaatgatggtttagctggaagttcaacagccaaagaagatggcaagccccaaccacttgaaggaccttttccctttccagactcagaatgtaccggatccaaccttagtataactgttgttggagcttctggagaccttgctaaaaagaagatttttccagcactctttgctcttttttatgaagattggctacctaagaattttcttgtgtttggatttgctcgaactaaaatgaccgatgaagaattaaggaacatgattagcaagacattaacatgcagaattgatacgagggaaaattgccaagataaaatggatcagttcttaaaaagatgcttttaccattctggtcaatacaactccgaggaccacttttctgaattgggtagcaagctgagagagaaagagggtggaaaactatcaaacagattgttttatttgtcaatacctccaaacatatttgtggatgtggtgagatgcgctagtcttaaagcttcttcaaaagatggatggacaagggttattgttgaaaagccatttggtcgtgactctgaatcatctagtgagctaacaaagagtttgaagcagcacctcactgaagaccaaatattcaggattgaccattacttgggtaaggagctcgtggagaatctatcagtgcttcgcttttcaaatcttgtttttgagcctctatggtcccggaattacattcgcaatgtgcagataatattttctgaagattttggaactgaaggaagaggaggttattttgatcactatggaatcattcgtcatataatgcaaaatcatcttctgcaaatactagcattgtttgcaatggaaacacctgtcagcttggctgctgaggacatcagaaatgaaaaggttaaggttctgagatcaatgagaccactcgagcttgaaaatgttgttgttggtcaatataagggccacagcaagggtggtaaatcacatcctgcttatacagatgatccaactgttccaaagggtagtcttactccaacatttgcagcagcagctctttttattgacaatgccagatgggatggggttccttttcttatgaaagctggcaaggctctccatactaaacgtgcagaaatcagagtacaattcagacacgtcccaggtaacttgtacaagaggaattttggaactgatctggacaaagctacaaatgagcttgtgcttcgtgtacaacccgacgaagctatatatttgaagatcaacaataaagttcctggtcttggaatgagactagacagaagtgacctgaatttgcttttccgggcaaggtatccaagagaaataccagatgcatatgaaaggttactcttagatgccattgaaggtgagcgaaggctgttcattagaagcgatgagctagatgcagcttgggcactattcactcctttgctaaaagaaattgaaaacaagaagattgctccagagctctacccctacggtagcagaggaccagttggagcacattaccttgctgcaaggcacaatgtaagatggggagatctcggagaagactaa

SEQ ID NO: 64736 - DNA, 1722 bp, Glycine max
  Peptide Sequence Number=SeqID_181514
atgcgaaacattcagcctcatcgattttccactcttatcgaaccacccaacaaaaccccaacctcgaagccattcttccttcccatacctcaccgaaccattcccgagcctcgaggccaggaccttgacttcatctgcgtcgcacaccgccacgtcatcaactctcactgggaaaagcttctccctttatccacctccctcacacccttccgtctcaaacacctcctcctcgccctccaaaacgaccacgtttcgtctctaaaactctccacttgggttctcaaacacaacccctcctcccacaccctcgacacccactccatcctcctccacaccctctccaaacaccgccagttcaaaaccacccaaaagttcctcacgcaaaccctctcttcacacccccctcacaccctctttgatgctctgttgttctcctatcgtctctgcaactcttcttcccctctcgtcttcgactccctcttcaaaaccctcgcccacaccaacaagttccgccacgccacccacatttacaccctaatgaaagaacacggcttttcccccaccgtccaatcctgcaacgcttttctaagttcccttcttcgccttcgcagggccgacattgctttagcattctaccgcgaaatacgtcgtcgttcttgcgtttcgcctaatgtctacaccctcaacatgatcattcgtgcttattgtatgttaggggaagtgcagaagggttttgatatgttagagaaaatgatggacatgggtttgagtcctaatgttgtgtctttcaatactttaatttcggggtattgtaacaaggggctgtttggattggcgttaaaggttaagtctttgatggtggagaatggagtgcagcctaatgtggttacttttaacactcttattaatgggttttgtaaagagaggaagctgcatgaggctaatagggttttcaatgagatgaaggttgccaatgtggatcccagtgttgtgacttataatactttgttgaatgggtatggtcaggttggggacagtgaaatgggggttagggtttatgaggagatgatgaggaatgggcttaaggccgatatattgacttataatgctttgattttgggactgtgtaaggatgggaagacaaagaaggctgcagggtttgttagagagcttgataaggagaacttggtacccaatgcaagtacgttttctgcacttattactgggcagtgtgtgaggaacaactcggagcgtgcttttcttatttacaggagcatggtgaggagtggttgtagtccaaatgggcagactttccagatgttgatatctgctttttgcaagaatgaggactttgatggggctgtgcaggttttgagggacatgttgggaagattaatgagtccagatttgagtaccatgtctgagctctgtgatggactttgcaggtgtgggaaaaatcagttggcgctggcactttgtagtgagatggaagtgaggcgtctattgccagatgggtttgacaaagaaaaaatagccatcacccatccagaaaatgagacaaattttgaggttgagctgcatttgctccaattgacgatgcttcagatgtggacaatggatacctctctcaacggagattttaactcaagtttgctacgttatggggataagttccttccactgaatttaactcctattggtggtactcatcaggttgcttga

SEQ ID NO: 64737 - DNA, 150 bp, Glycine max
  Peptide Sequence Number=SeqID_181515
atggcgggatgggaggggaagccccctccctgctggaatcagtgcagtaccgcggtcaacgcggcggcgacgatcagacccaaaacaataaccgtcgttgcaaacgtttacgtatcgataatcagacgatcaggtcaaggtctggagtga

SEQ ID NO: 64738 - DNA, 441 bp, Glycine max
  Peptide Sequence Number=SeqID_181516
atggagcactcgcaccagccaccatcacttccaccaggcaacggcgatgacggacggtaccagctggcggaaccattttcgctgaggactgagacgccgcggtggcggcgcatggtgaagatggagggtgagaaacaacaaaagtttgatgtagacctcgacaacctgatggctttcgactcctatcacaccttcccttctcaaccatctctttccagatgccctctttatcttaccatcaaccgaagatttggatggacccttgtcaccttgcctcccccactcactcaattgcttagagaaaaacatgataatgcaactgctttgaagatgcagcttgatcagcaaaagaatgttactgatgatcttgtgtccaaaacacagcttttggagagcaagatacaggaggcaaagtcaaagaaagataccctcaaagcatga

SEQ ID NO: 64739 - DNA, 3385 bp, Glycine max
  Peptide Sequence Number=SeqID_181517
atgtcgaacgcgctgtcgtttacgctcccggctctcaacaaccctcagctaaacgctttgaatagccctaacaaggcgcgtctgcgccacggcctgagaatccgggttgttgcgtcgtgcatagagaggaagaggttcttggggacccgggtgcggccaagtgggtcggacaggatctggttgctgcagtcgggtcgggtgccgaagctgagggtggcggtgcggtcggcattctcggcggtgccggagaagccgctggggctgtatgatccggcgatggacaaggactcgtgcggggtcgggttcgtggcggagttgtctggcgagagcagccgcaaaacggtgacggacgcgctggaaatgttggtgcggatgacgcacagaggtgcatgcggatgcgaagccaacactggagatggtgccggcattcttgtggctctgcctcatgttgtggattttgagcttcctccgcaaggaaaatatgcagttggcatgcttttcttgccgaagtctgagaaacgaagggaggaaagcaaaaaaatgtttagcaaggttgctgaatctctggggcacacgattcttggatggcggtctgtgcctactgataatgcaggattgggaaaatcggccctgcagactgaaccagtgattgaacaggtgtttcttacaccaagtgctaaatcaaaagttgatttggaaagacagatgtacatattaaggaagctcagcatggctgctattacatctgcattaaacctccaaaatgatggcattacagatttctacatctgttcactttcatctaggtgtgttctcaagaggcaaccacattttcttgagaagactgttgtttacaaaggtcagctaacaccagctcagctgagggattattactttgcagatattggcaatgaaaggtttacgagctacatggccctgcatgggaaacaaccagtaactgaagagaagcaaggttggggaatgacttctgaggcattgagtttggatgctggattggatgcaatggttgagttgatacactcacggttttctacaaatactttccctagctgggatcgtgctcaacctatgcgtgtattgggacacaacggagaaatcaacacactcagaggcaatgttaactggatgaaggcacgtgagggtttactcaaatgcaaggagcttggtttatcagagaatgaattaaagaagcttttgcctattgtggatgcaaattcgtcagattcaggagcttttgatggtgtgcttgagtttttgcttcattcgggaaaaagtcttcctgaagctgttatgatgatgattcctgaagcatggcaaaatgacaagaacatggattctcagcgtaaagcattctatgaatacttctcagctctcatggagccatgggatgggccagctcttatatcatgtaacattttgggactatggttctatcacatgtcgatgttctcttcattttggttttatgatttggcactaatccaatctaatatcactacagttactgatggtcactatcttggagctacattggataggaatggactgcgaccaggccgtttctatgtcacccatagtggacgagttattatggcaagtgaagttggggttgtagacattccaccagaagatgtgcgtaggaaaggaagactaaatcctggtatgatgctgttggttgattttgagaagcatatagtcgtaaatgatgatgccttgaaagaacagtactctttggcaagaccttacgaggattggctcaaaaggcagaaaattgaactcaaagacatcgttaactctgttgatgaatctgaaagagtgccgccacccatagcaggagttgctccactatccaatgatgatgcggatatggaaaatatgggaattcatggtttattggctccattgaaagcttttggatatacagttgaatcattggaaatgctattacttcctatggccaaggatggcgtagaagccctagggtcaatgggaaatgatactccattggctgtcatgtctaaaagagaaaaactcactttcgagtatttcaagcaaatgtttgctcaagtgacaaaccctcctatcgatcctattagagagaaaatagtcacttctatgcaatgtatggttggtccagaaggtgatctgacagaaatcactgaggagcaatgtaaccggctttcactaaaaggtcctcttttatccactgaagaaatggaagccattaaaaaactgaattataagggatggcgcagcaaagttatagacataacttactcaaaggaatgtggtaagagagggttggaggaagccttggacaggatttgtgcagaagcacaccatggaattagtgaaggctacaccactcttgtgctgtctgatagagccttctcaaagaaacgtgttgctgtgagctccctccttgctgttggtgctgtccatcaacatcttgttaaaaatcttgagcgcactagagttgccttaatagttgaatctgctgagccacgtgaagtgcaccatttctgcacacttgttggttttggtgctgatgctatatgcccgtatttggcagtagatgcaatttggcgactgcaggttgatggaaagatcccaccaaaagcaagtggtgaatttcactcaaaagatgagttggtcaagaagtatttcaaagcaagcaactatggaatgatgaaggttctggccaagatgggaatatcaactttggcatcatacaaaggtgctcagatttttgaagcattgggtctttcgtcggaagtgattgcaaagtgctttgctgggactccaagtcgagttgagggtgcaacgttcgagatgcttgctcgtgatgcttttcaactacatgagttggcttttccttcttgggttttctctcctggaagtgcagaagctgttgctttgccaaatcctggggattatcactggagaaaaggtggtgaagttcacctgaatgatccacttgctatggcaaagcttcaagaggctgccagaactaacagtgtagatgcatataaacaatattccaagctcattcatgaattgaacaaggcttgcaatttgcgtgggcttctgaaatttaaagagacagcagttaagattcctattgatgaagtggagcctgctagtgaaatagttaaacggttttgcactggggccatgagttatgggtcaatatcattggaggcacacacagcattagcaatggctatgaataaaatgggagggaaatccaacacaggtgagggaggggagcaaccatctcgtatggagcctcttcctaatggctcaatgaatcccaaaaggagtgccattaagcaagtggctagtgggagatttggagtttcaa

SEQ ID NO: 64740 - DNA, 342 bp, Glycine max
  Peptide Sequence Number=SeqID_181518
atggttgttggctataacctttattgctttcaagtgtttctttctccccctctcaacaggaacttgtacactacagtgcgtttcgctgtcaagaaaagagatggttcaattggcaaaagatgtcgtctcgagtttcgaagcatattacagagccagagtctggtcaggacctgctcgaatcgaaaagagaggagagtctttaagaaggaattcccaggttcagagaagtatttacgaagtacaaagccaagacaagaaagaggacttcgagctattgggcaattcgaactggtgtatggacgagtcgaagtcgaggcagcaagagttctggacttagcataa

SEQ ID NO: 64741 - DNA, 183 bp, Glycine max
  Peptide Sequence Number=SeqID_181519
atggagctccacaacattgatgtcaagatagaatatgaagatcgggcaatgattctgttagcctttctcctcacttcctatgggaattttatgacagaagaagaagaaaggcaaaggcacagcaagaagatcaaggttgaaccaagggacatctgtaattactacgaacaagttggtcattga

SEQ ID NO: 64742 - DNA, 378 bp, Glycine max
  Peptide Sequence Number=SeqID_181520
atggatataaagcaaagaagaagaagggtttcgggagccaggaagaagaaagggtttttgaaacaagaagctgaaggggttttctggggttctctgtactatttatgggatttcacttttaaaaaggggaaaaaacaatataataagaatcaaggatgtcgtctcgagtttcgaagcatattacagagccagagtctggtcaggacctgctcgaatcgaaaagagaggagagtctttaagaaggaattcccaggttcagagaagtatttacgaagtataaagccaagacaagaaagaggacttcgagctattgggcaattcgaactggtgtatggacgagtcgaagtcgaggcagcaagagttctggacttagcataa

SEQ ID NO: 64743 - DNA, 870 bp, Glycine max
  Peptide Sequence Number=SeqID_181521
atggtgggtggtaacaaccctgaccaatataatgacacaactttcaccaaaatctttgttggagggttggcttgggagactcagagggacacaatgagaaggtattttgagcagtttggagagatcttagaggctgttgttatcacagataagaataccgggagatccaagggttatggctttgtcacatttaaggatcctgagtcagccatgagagcatgtcagaatccatctccagttattgatggtaggagagcaaactgcaaccttgcttctcttggtgcaagcaagaatcgaccaccaacttttcagcatggacggttcaggcctccacctggactagtgacatcctcacctgcttatcatggttcttcatcatctacatttttccatcaaccccctagggaatacgcatttccttattcagcatacggatattctggatattcacaagacaccttgtatcctacggtagctgttaatagttattataatgtctatggagttcagcagttttcttcaccttactacccatctgctggagcttctggggcactagggttgatccacaatatctaccccttttatggtcaatatgcacagagtattcaggctcctggttttggggttcagtacccccaaatggcacagtttccatttttgcctcagcattatggctccactgggatattgtcatatccttcttcagtggcagtggcaactactagtgcaggaatagcagccacaactacaactacaacaacgtcaacaagtgtggcagcaacagtggctggtactgcttcacaagcctctcaagcagcttctgaacaaaattctacatcaacaaggacaaagaacttgcaaggctaa

SEQ ID NO: 64744 - DNA, 300 bp, Glycine max
  Peptide Sequence Number=SeqID_181522
atgaaggcattgcaagatgacatatttcatgctatacttcacaacataatagagagtttctgggttgaggaagttagcacaacatgctatctcgtgaatcggtcaccatccactaccatagattttaggacccctattgaggtatggtctaacggacctgctgaatattcaaagctaaaggtgtttggaggtcaaccatactgtgacgtaagtgaaggtaagttggagcctagaaccaagaagggtgtctttatgggctttggagatggagtcaaaggatttagaattttgtctttgtaa

SEQ ID NO: 64745 - DNA, 295 bp, Glycine max
  Peptide Sequence Number=SeqID_181523
tcgacttcgagccttgcctcggatatgccactgaagggcaagcagttggtggtatacccctgcaaaacactttggaggggcctcaatttcgcccccaaccacaacccttctatggaaaaatggtgggttacacaccttcaagctttgcggatttggtcttcaccggcgaaaggatcaaagtgggtatggaaaaaggaaaatttgatcatcctgctttggtgaatgcgaaaactgtggcaaatgaagaggatgagaatgagggacaaacccttgctatgactgtcattcctacacg

SEQ ID NO: 64746 - DNA, 1653 bp, Glycine max
  Peptide Sequence Number=SeqID_181524
atggggaagaagggaagtggtagttcgtggttaaccgctgtcaaaagggcattcagatctcccaccaaagacagtgacaaaagaagtggcagaagaagagaagactgtgatcaagaagaagacgaagaaaagaagagggaaaagagaagatggattttcaggaagactcacatgagtcacgaaggagtgaacaacaacagcaaccacactactcaacaaaaggtgcagcatgatgtggcagcaagtgggggtggttcaaggacagaccaggatcagaagcatgcacttgctgtggccatggccaccgcagaagccgccatggccaccgctcaggcggcggcggaggtggcaaggttgtccaaacctgctagccatgccagggagcattttgctgctgttgtgatccaaactgctttcagagggtatcttgctagaagagcgcttcgtgcactgaaggggttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcacggtatcttcaggacatttcagataggaaatcaatatcaagagagggaagcagcattgcagatgactgggatgaaaggcatcattcagttgaagaagtgaaggccatgttgatgcagaggaaggaagctgctgcaatgaagagggacaagaccttatctcaagccttttccgaacagatttggaggaatggtagaacatcatcaattggaaatgaagatgagttggaagagagaccaaaatggctagatcggtggatggccacaaagccatgggagaatagaggaagggcttcaactgatcaaagagaccccattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccaatcccctgccaccccttctcctgccaaatcaaggcctatccaagtccggtcggctagtccacgttgcgttagagacgacagaagctaccacacctcccaaacaccaagcttgaggtctaattaccactacacaggaaacttgtaccaaaatggaaggattgtttcaactggaactagtagtggtggtgctactgctacattgcctaattacatggcggcaactgagtctgcaaaggctcgaattcggtcgcaaagcgcgccgaggcagaggccatccacaccagagagggacagggttggatcagcaaagaaaaggctttcttttcctgctcctgacccttatggtgtgggagtgagttatggaaactatggacatagtttaaggagtccaagcttcaagagtgtgagtggatcacactttggagggttagagcaacaatcaaactactcctcttgctacactgagagtattggtggtggtggtggtgaggtttctccttcttcaactggtgaccttaggaggtggttgagatga

SEQ ID NO: 64747 - DNA, 441 bp, Glycine max
  Peptide Sequence Number=SeqID_181525
atgacagtgtcgtacaaagattggcatgagatgttgcctttttccctgcatggataccgaaccttggtacgatcttctattggggcaattccgtactccttggtttatgagatggaagcggtactcccatttgaggtagaggtcccttcccagaagatactagcggagtcgggccaagaagaatcagagtgggctcaatcatgctacgaccaactcaaccttattgaaggtgcgccagcgccagttccatcagggggaccttctcctgaaaagatatcccacgctgttaaagataaccgagggaagtgggccccgaattacgaaggacctatcgttgtgaaaagggctttttcggggggggctctggtgctcaccaacatggatggcgaggagctaccctcgcctgtgaactctgatgtcgttaggcgatattacgcttga

SEQ ID NO: 64748 - DNA, 744 bp, Glycine max
  Peptide Sequence Number=SeqID_181526
atgatgtcaaacatagccttcagattaactcttgtctttcttttattttctgcggtgctctctactcctccagaggatccaatcaagtgcgccacttcagagaacacaacctgcactatcacaaactcctatggcgccttccctgatcgaagcatttgcaaagctgctcaagtgttgtaccccaccaccgagcaagagcttgtgtcagtggttgcatcagcaaccagaaacaaaaccaagatgaaagtagctacccgtttttcccacagcatccccaagctggtgtgcccagaaggcgaaaatgggttgttaataagcaccaaatatctcaacaaaatattgaaggttgatgtggaaacaagaacaatgactgtggagagtggtgtgactctgcagcaacttataaatgaggctgcaaaggtagggttggccttgccatatgcaccatattggtggggtttgaccattggagggcttatgggaactggtgctcatggaagcactttgcgggggaagggaagtgctgtccatgattatgtggtggggattaggattgtaaggcctgcaggttctgaagatggatatgctaaggttgagatcctaaatgaacagcatcaagatttaagtgcagccaaagtatcactcggtgtgctgggagttatttcacaggtaccatctatccaaattatagcatatgatgaagtgtatagaatagagaagttaagtcatcatcaatgtgaatag

SEQ ID NO: 64749 - DNA, 462 bp, Glycine max
  Peptide Sequence Number=SeqID_181527
atgaagatgaaagctaacaaaacaagaaatgaattgaaagtctcggattcgaaaacttaccggttgaagaacgaagaacggatgaagaacggtgaagaacgacggaaaaccttcacggattcgctcacgaaaacgtctcagaagcgttacagaagcaccttggcttggattttcttcacggaaataattttttcacccaaaacagttgaaatgcacagccctcctcccctatttattgggaaaaaggagaatgttgcgaaacttaacggattacgtaacaatgctctttttgacttccagaatgttgcgaaactttatggattacgcatcaatgctctttttccttccggaatgtctcggaactttacaaattacctaacgatgggtgttaagtaccttgaagtggtcaagcgaaggttgcatgccaccaaacaatggtctccggatgaaattagggtatga

SEQ ID NO: 64750 - DNA, 741 bp, Glycine max
  Peptide Sequence Number=SeqID_181528
atgaagtataatatcatgaatacactccaacatatgaccatggtagctacggcttaccaaacctcccacgaatgttcagaaaataccattatagacatcttagtggcaggattttctggacaactgaaaggatgcgcagtcaaaacggatctcaacggaaaagtcattactaatgacgatgataaagagattcctgatgctgtcaataccttaatttttacaatagctcaacattttattggagacccatccttatggaaagataggtttgcagaattattatcaaatcttaagtgtagaaccttagcagattttaggtggtacagagatactttcctaactagggtttacaccagagaagatagtcaacaaccattatggaaagaaaaatttctagctagtcttcccagatcattaggagacaaggttagggataaaattcgtagtcaatcttccaatggagacattccatttgaaaacttaagctacagtcaattaatttcctatgttcaaaaggtagccttgaaaattttccaggatgacaaaattcagaggcaattagccaaagaaaaagctcaaacaaggaaggatttaggttccttctgtgaacaatttggcttaccaacctgcccaaaacaaaagaagaaacaaagaaagaaatccaggatcataaatcagccaatagaaggagattttcaaaaggaagatactctcaaaaaccctcaactagtaaggaaatag

SEQ ID NO: 64751 - DNA, 336 bp, Glycine max
  Peptide Sequence Number=SeqID_181529
atgcaatttctagaagcagatattcctttcaacatggtccatggcaaacacgtgtttgaatattctgacatgacctcaagcttcaatcagcttttcaaggcagcaatgacaaaacgtgcaacattaataatgaagaagattgttgaatgctacaaggggtttaagcacatcaataggctggttgacgttggaggtggccttggcgtcacacttaacataatcacttcaaaattagaggtgttaaagaattgttatgcttctattcctagtgatggaaaggtgattgttgtggatggagttcttccatatgaaccgaagacaacagatgcaatttga

SEQ ID NO: 64752 - DNA, 450 bp, Glycine max
  Peptide Sequence Number=SeqID_181530
atggcatttaggtgggctatcaagacctcgtctcagatgtgtttcttgaatataataaattttgaaggtattttcacaaactttggatttggtcatgagactaattctcagttcgacatgtaccaactgaaagatgcaattctggaaggaggtagtccattcaacaggatccatggcaaacacgtgtttgaggatttcaacatgaactcaagcttcaatcagcttttcatggcaacaatgaccaaccatgcgactttaattatgaacaagattgttgaatcctacaaggggtttgagaacatcaataagctggtggacgttggaggtggtcttggggtcactcttaacataatcacttctaaataccctcatattaagggtatcaattttgacttgcctcacgccatagaacacgcctctccctctcctcgtacgatctctaattcatag

SEQ ID NO: 64753 - DNA, 2658 bp, Glycine max
  Peptide Sequence Number=SeqID_181531
atgatgggaatgttattgcagtttctttatgtattgtttggggtacttatttctgtggttctggttcaagcacaggatcaatcaggattcattagcattgattgtggtctacctgaatcctcaagctatactgagaagaccacaagcatattttacatttcagatgccaaatttatagatgctggtgtaagcaagagtatttcaccagcagagaagagtactcatctacaacagctagcatatgtgaggagttttcctagtggagagagaaactgttacagaataaatgtaaccagtggtactaaatatttgatcagagctactttcttttatggaaactatgatggcctcaatcagccaccacaatttgatcttcatcttggacctaatttatgggacacagtgagcttccccaatgcatcactcagcgaaatcagtgaaatcatttacaccccatcactagattacatacatccatgtcttgttaacaaaggtcaaggggctccattcatttcaaccatagaattgaggactttgaaaaatgcttcctatgtcacagcgtcagctgaatcattggcatactatcggcgatatgatttaggttccatcaccaacttagtatacaggtacaactatgatgtttatgaccgcatctgggtgccacatggattcaaccagtggacacaattaagcagcacacttaatcatgatatattccagaatgattacaaattaccagaagttgtcatgagcactgctgctacaccaataaatgctagtgctccatttcagttctattgggatccagataatgtgaatgagaaattctacatctacatgcactttaacgaggttaaaattctggcagaaaatgaaactagaacattcaatatcttcatgaatggcaagttattctatggacctctgactcctggatatctgacgaaaaatatcatatatagtacatcagctttgaccggagctacaaggtatctattttctcttgctaagacagggacttctacccttccacccatcatgaatgccatggagatttataaagtaatagattttgctcaatcagaaactgaacaagatgatgttgatgctatcacaaacatcaaaaacgcttatggggtggatagaaattggcaaggagatccatgtggcccagtagcatacatttgggaaggtctaaattgtagttatgataacaccccaagaatcacatccttgaatttgtcttcaagtggactgaccggacagatattatctttcatctccgagctcactatgttacagtatttggatttatcaaacaatagtttaagcgggtcagtacctgattttctgacacaactgcaatcacttaaagtcttaaacttggcgaaaaacaaccttactggtccagttcccggaggacttgttgaaagatcaaagcaaggttcactatcattgagcctggatcaaaatccaaatctatgtgaatctgatccatgcatccagcagacaaataacaagcagccagatggtgatcaacagaagaacaaaaataatatagttatcccggtagtagcatcagttgctggggttttggtgctcctaataattgtagcagcagctataatctgtggccttaaaaggaaaaaaccacaagcatctgatgtaaacatttatgttgagacgaacactccaaatggatcacaatttgcatccaagcaacggcaatatacattcaatgagcttgttaagatcaccaacaactttaccagaattcttggtagaggtggatttggaaaagtttatcatggatttattgatgacactcaagtagctgtaaagatgctttctccgtcagcagttaaacttctgatgagagttcatcatagaaatctgacttctcttgttgggtattgcaatgaagaaaacaacatagggctcatctatgaatatatggcaaatggaaacttggatgaaattgtttcaggaaaaagtagtagggcaaagttcttgacatgggaagacagactccaaatagcattggatgcagcccaaggactggaatatctgcataacggttgtaagccaccaataatccacagagatgtgaaatgtgcaaatattttattaaatgaaaacttccaagcaaaattggctgattttgggctatccaaaagctttcccacagatgggggatcttatatgtccactgttgttgctggaactcccggttatttggatcccgagtacagcatatcaagcagattgacagagaaaagtgatgtttacagcttcggagttgttcttttggagatggtcacaggtcagccagctattgcaaaaacacctgataagactcacataagtcagtgggttaaatccatgctttccaatggggatataaaaaatattgctgactcaaggtttaaggaagattttgacactagctcagtctggagaattgttgaaatcggaatggcttctgtgtccattagtcctttcaaaaggccaagtatgagctatatagtgaacgagctaaaggagtgtttgacgacagaattagctcgaaaatatagtggtcgtgacactgaaaacagtgactcaattgagttggtcactctgaatttcacaactgaacttggtcccccagctaggtaa

SEQ ID NO: 64754 - DNA, 690 bp, Glycine max
  Peptide Sequence Number=SeqID_181532
atgaggtttagtgttgtgcataagaagaaaactgctgacaaaaaaggtactgatggcaagaaaaatgaggtgagaggtgaaagtaatcaagaaaaagaggaacaaataatggtcaagaataaagaattgaaggcccaagaaaaagaaaaagaaatagaaaatgaaaaaaatgaaaaagaagaaaaaaataataagaatgcaaagaagagtaggagtgaaaaagctgtggatgaaggtgtggaagtaccgtaccctgtggtaccttccaagaaagaaaaagctcgtcatctggtgagctttttagatattttcaggaaactggaaataaccatgcccttcggagaagttttgcagcagatgccactctactctaaattttttaaagatatgttaacaaggaagcataaatatattcatcaggaaaacatcatagtggaaggaaattacagtgttgtgatccagaagatccttccacccaagcataaagatcctgggagtgtaactattacttgttcaattggggaagtcaatatgggaaaagctcttattgacctgggagccagtatcaatttgattccactctccatgtgcagaagattgggagagttggaaataatgcccactcgaatgactttacaattagctgacggctccattaccagaccatatggagtaattaaagatgttttg

SEQ ID NO: 64755 - DNA, 1155 bp, Glycine max
  Peptide Sequence Number=SeqID_181533
atgaccaccccaccagaaaaccgacgtgcggccggcggtaggaaactggcgcaccagtttgccgtagctgatggcggtgaacagcacgccggccagcgccagcagataggaggtcggcacatggccgtcggtaaggccggagacgatgccgaaggtatcgaacaccgtcatcggcgtcagataggccaggcccatcatcaccacctgccacagcttgagggatttgcgcagctgcggtttgcccgccgggccgccgtcggtggctttaatcgtcatggcatttcccctcttggtcctctgctgtcaaccgtgcaacgtcattcagagaggccgcggggaaactgctgctcaggcggcgggaaaaacgggttgaggtcactgtcgggcggccggcgaccggcccgtaggcactgcggcacaggcaaacgtctgcgcatgggaatgactgagtcatggttatttcctcgtcggcgtcctgcgctcgaactgcaccagctcatcggttttgcaggccagatagacgtggctgaaacgttcgcccagcaatgcattgagcaccggctgatgttcgaactcgtacagcgcgtcactctggcggatcgggaacggcagcccgtcctgctccagcccgttgccggtcaccggctcaggcagcggcagcgcggtttccagcccgtagacgatgccggccagaatggccgccatcaccagataagggttggcgtcggcgcccgccacgcgatactccacgcggtggttgtcgcgatcgccgcagggaatgcgcagcgccacggtgcgattgttatgcccccaggaggcctgggtcggcacatacatgccgggctggaagcggcggtaggcgttgacgttcggcgccagcagcgccatcgaagacggcatcagggcgatcatgcccgccagcgcctgtttcagcagcgccgaatcttcgccgtcgtcgtcggcgaacacgttgttgccctgcgcgttcagcatgctgatgtgcacgtgcatgccgctgccggcgtgttcctcatacggcttggccataaaggtcgcctgcatattgtggttctcggccaccatgcgcaccagccgcttcagcgcccagcgcgtgatcgcaggcctgcagcacgtcgtcggtatggtgcaggttga

SEQ ID NO: 64756 - DNA, 894 bp, Glycine max
  Peptide Sequence Number=SeqID_181534
atgcccgctttgccctcgcgtacccgcgccacgctgttcggtttgttggctattgtgttgtggagcagcgtcgtcggcctgattcgcagcgtcagcgaagggctggggccgatcggtggcgcggcgatgatctacagcgtcagcgcggcgtttttgctggtggcgctcggcgtgccgaaatggcgcagctttccgcggccttatctcatcgtcggcagcctgctgttcgtcagctacgagatctgcctgtcgttgtcgctcggatacgccaatacccgcctgcaggcgatagaagtgggcatgatcaactacctgtggccctgtttcaccgtgctgatggcgctggcgctcaacggccaaaaggcgaaatggtggctgctgccggggctgctgccgtcgctgttcggcatcggctggatcatgagcggcgagggcggctggtcaccggcgcagatgctggccaacgtgcgcagcaatccgctcagctacgggctggcgttcagcggcgcggtgatctgggcactgtattgcaacctgaccaagaagatcgcccagggcagcaacggcgtggtgctgttcattgtgctgaccgcgcaggcgctgtggcttaaatatgccttcagcgcggaaagcggcatgcagttcagcgccggcgtgatcgtgacgctgctgtgcgccggggtggcgatgggggcggggtatgccgcctggaacgtcggcattctgcacggcaacatgacgctgctggcgaccgtctcttattttaccccggtgctgtcggcggtgttcgccgcgctggtgttgcacacctcgctgaccgtcaatttctggcagggcgtggcgatggtcactctcggctcgctgatctgttggcgggcaacccgtggaaattaa

SEQ ID NO: 64757 - DNA, 357 bp, Glycine max
  Peptide Sequence Number=SeqID_181535
atgaatgaaacttttaatcaaacactagatgtgcataatccttactatttgcatccgagtgagaatccaacaactgctttggtttctcctgttctggatccaacaaattacaattcatggaaccgttctatgctcattgctttaagtgcgaagaacaaactggagttcgttgatggaaccattttcgagccacaacaaaacaattcattgcattctgcttggcacaggtgcaacaatatggttgtctcctggattgttcattccgtttcaacctcgattcgtcaaagcattttatggatggatagagctgttgatggttggaaagatctgaaatcacaatattccaaggagatttga

SEQ ID NO: 64758 - DNA, 622 bp, Glycine max
  Peptide Sequence Number=SeqID_181536
atggatgaacaggataatgccatgcttatttctaggttctcaaaggaggaggaggatattttaaaggttatggaggagttttgttcccatggagtgttacctaagggtaccaatgcaacattcttgtccctgactctgaaaaatgacaacccacaatctcttagggagtacaggccgatttctcttgtgagtagcctatataaaatcattgcaaaagtttatctatcagtgatgccaaagccagaaaaaaaaccatacattgtcttcaaggctgactttgagaaggcctatgactctgtcagatgtccaacagaggaatttaagaaccagaaggcattcaggcaaggtgatcccttagcccccttcctcttcctgttggtggttgaagaattgggaggcctcatgagggaagccacttccaaaggtctgtttcaaggatatcatgtgggcaatagtgatctccatgtctcttctttacacttcattgatgatgcattgttctttggtgtaccaaatcgtcaacatttgctaacacttaaggcaattttgaggttctttgagatggtgtcaggcctaaaagtcaacttccatgggagcaaagtggcgagagtcgccactactg

SEQ ID NO: 64759 - DNA, 1737 bp, Glycine max
  Peptide Sequence Number=SeqID_181537
atgatgtcaaacatagccttcagatcaactattgtctttcttttattttctgcggtgctctctactcctccagaggatccaatcaagtgcgccacttcagagaacacaacctgcactatcacaaactcctatggtgccttccctgatcgaagcatttgcaaagctgctcaagtgttgtaccccaccaccgagcaagagcttgtgtcagtggttgcatcagcaaccagaaacaaaaccaagatgaaagtagctacccgtttttcccacagcatccccaagctggtgtgcccagaaggcgaaaatgggttgttaataagcaccaaatatctcaacaaaatattgaaggttgatgtggaaacaagaacaatgactgtggagagtggtgtgactctgcagcaacttataaatgaggctgcaaaggtagggttggccttgccatatgcaccatattggtggggtttgaccattggagggcttatgggaactggtgctcatggaagtactttgcgggggaagggaagtgctgtccatgattatgtggtggagcttaggattgttcggcctgctggtcctgaagatggctatgctatggttgagaacctcaatgaacaacatgaagatctcaatgcagccaaagtatcactcggtgtgctgggggttatttcacagattactctaaaactagaacccctcttcaagcgatccatcacgtatgtggcaaaagatgattcagatttgggaggccaagtggttgcttttggagatgcacacgagtttgcagatataacatggtacccaagtcaacacaaggctatctatcgtgttgatgatcgtgtcccaattaatacatcaggcaatggtctttacgactttatcccttttcgtcccactccttcacttgcatcggttttcataagaaccacagaggaaattcaagaatccactaatgatgccaatggaaagtgcatagttgctagtaccgcatcaaatacccttatcaccgcagcttatggacttactaacaatggtataatcttcgctggataccctataattggatttcagaatcgccttcaatcatctgggtcatgcttggatagtcttcaagatgcattgatcacaacatgtgcctgggatcctaggatgaagggcttgttctttcaccaaaccacatttagcattaggttgtcctttgtaaaaagctttattgaagatgtgcaaaagctagttgaattggagccaaagggattatgtgtcttagggctttacaatggaatgctcatgcgctatgtcacggcttcaagtgcctatttggggcaccaagaaaatgctttagacattgatatcacctactaccgtagcaaggatccaatgactcctagactttacgaagacattcttgaagaggttgaacaacttgggattttcaaatatggaggactacctcattggggtaagaataggaacttggcatttgaaggagccatcaagaagtacaaaagtgccgagtattttttgaaggttaaagagaagtatgatttggatgggcttttctcaagtacgtggacagaccaagtgttggggctaaaagatggagtgacaatattgaaggatgggtgtgcattagaaggtttatgtatttgcttgcaagatagtcattgcaatccaagtaaaggttactattgcaggccaggcaaagtttataaggaagcaagggtttgtactaatttgaaatga

SEQ ID NO: 64760 - DNA, 384 bp, Glycine max
  Peptide Sequence Number=SeqID_181538
atgcagtttatattgaagactgtcaatgacacttcttatagtcgcatgtcattccaagtaaaagcaaacattaataatttcaatccgcgatgcttcatgaaaacaagttcgaaatccttttttttttctttcattttatcaactatatatgggttaattaatacggaggctcaaggattggttctaggaatcaaaggtggtactgcaggtgataagggtctggccactagttgtatcctggggaaaaaagcactgctcatcgaagggaaaacagacccaggaagtgtcagaatttcaggttcaattcaggtcatgaattcccagtgggtggaaacgctttgtatcttgatcaaattgacatcttcacacttgacaagcatatga

SEQ ID NO: 64761 - DNA, 1743 bp, Glycine max
  Peptide Sequence Number=SeqID_181539
atgatgtcaaacaaagccttaacttcaactcttgtttttcttttcttctccgtggtgctctctactcctccagaggatccaatcaagtgttctaattcaaagaacacaagttgcaccatcaccaactcctatggcatgttccctgatagaagcatctgcaaggcctctcaagtgttgtacccaacctctgagcaagagcttgtgtcagtggttgcatcagcaacaagaaacaaaaccaagatgaaagtagctacccgttattcccatagtatccctaaattggtgtgcccagaaggagaaaatgggttgctaataagcaccaaatatctcaacaaaatagcgaaggttgatgtggaagcaaggacaatgactgtggagagtggtgtgacaatgaagcagcttataaatgaggctgcaaaggtagggttggccttgccatatgcaccatattggtggggtttgaccattggagggcttatgggaactggtgctcatggaagcactttgtgggggaagggtagttctgtccatgattatgtggtggagcttaggattgttagggctgctggtcctgaagagggttatgctaaggctgagagcctcaatgaacaacatgaagatctcaatgctgccaaagtgtcacttggtgtgcttggagttatttcacaggttactctaaaactagaacccctcttcaagcgatccatcacatatgtggcaaaaaatgattcagatttgggagaccaagtggctgctttcggacatgcacatgagtttgcagatataacgtggtaccctagtcaacgcaaggctgtttaccgtgttgacgatcgtgtcccatttaatacttctggcaatggtctttatgactttatccctttccgtcccactccttctcttgaattggctatcttaagaaccacagaggatcttcaagaatcaactggtgatgccgatggaaagtgcataggttctaagaccacaacgaataccctcatcactgcagcttatggacttactaacaatggtataatcttcactgtatatcctgtaattggatttcagaatcgtcttcaagcatctgggtcatgcttagatagtcttcaagatgcaaagatcacagcatgtgcctgggattctagggtgaagggagagttctttcaccaaaccacatttagcatcagtttgtctgttgcaaaaaaatttattgaagatgtgcaaaagctagttcaattggagccgaagggattttgtggcatagagctttacaatggaattctcatgcgttatgtcaaggcttcgagtgcctatttggggaagcaagaggatgctttagacattgatatcacttactaccgtagcaaggatccaatgactcctaggctttatgaagacattcttgaagaggttgaacaacttgggattttcaaatatggagggctacctcattggggtaagaataggaacttggcatttgaaggagccatcaagaagtacaaaaatgcagggagatttttaagggttaaagagaagtatgatttacaagggcttttctcaagtacatggacagaccaaatgcttgggctaaaggatggagtgacaatattgaaggatgggtgtgcattagaaggtttatgcatttgctcacaggatagtcattgcaatccaagcaaagattactattgtaaaccaggcaaagtttacaaggaagcaagggtttgtactcatttgaaatccaaatga

SEQ ID NO: 64762 - DNA, 177 bp, Glycine max
  Peptide Sequence Number=SeqID_181540
atgagcgaggatgccgagtcagaggattcaaaggagaccttacctgccgctgagtcaccaaggactatgttgagggcaactcacagtttccctctagggactggatgtcctctagtgtcagccattggtgtgggagaggcaatgtcatatgaagcagtgcttagggcttatgagtag

SEQ ID NO: 64763 - DNA, 216 bp, Glycine max
  Peptide Sequence Number=SeqID_181541
atgtctcatcttggaacatgcatgagcctgactcctgagcaccaccacagatattacatcccccaatgtgtatggctgaagaatgaggaggttgcactgcatgcagctgttgagggagattactcagagttgctgcttggtcatggacgatggcgtgatcactggttgctatattctctatcagctccatggcttcttctagagtcttcagcttga

SEQ ID NO: 64764 - DNA, 990 bp, Glycine max
  Peptide Sequence Number=SeqID_181542
atgaaagaagaagtgaggaaggaagtcctcaagttacttgaggttggactcatctaccatatttcttacagtgcttggaatgaccttatccctactctgactgtcacgggatggaggatgtgcattgactatcggaagctcaatgaagccacaaggaaataccattttcttttgccattcatggataagatgttggagtggcttatgggacagtctttctactgcttcttggacagatactcaaggatgtcatttgggttatgtaatgatccaaccaccttccagtggtgcatgctagccatctttgctgacatggtagataagtgtatagaggtcttcatggatgatttctcagtcttcggaccctcatttgactattgcttgacaaatttagagttggtgctgcaaagatgtgttgaagcaaatctggtgctgaattgggagaagtttcacttcatggtggacaaagaaaaaattgatgttatcgagaagttaccaccaccagtaaatgctaagggtatcaggagttttcttgggcatgtaggtttctatcggagctttgtatcaaccacaataatggttgcgcctgacaggagcaaggaattcgagttgatgtgtgatgccagcaattatgtggaaatgctagccattatctatgctttagagaagtttcagtcctatttggtggggtccaaggtcgtcatcttcatagatcatgcagcaatcaaatatcttatcaccaaggcagattcaaagccaaggttgataagatgggttctgttgattcaagaatttggcatcgttatcaaggacaagaagggattcaagaatgtagtagctaaccatctctcccagttagtgaatgaagaagtgacacatgaggaacaagaagtgaggggtgagtttctagatgaatcccttttatctgtagctgaaaggccttggttcatagacattgccaactacaaatttactggagtcattccataa

SEQ ID NO: 64765 - DNA, 347 bp, Glycine max
  Peptide Sequence Number=SeqID_181543
atgtatgatagtataaagtatgaagaagttgatatggatgatgaaaatgaacatgaacctggtgtgaatgaagaacaacatgttgattgttcggatgcgttcaatacatatgagtgggctcaatcaattgcttatgaaaacggatttttggcggtgattatgaggtcagacgctggtatgagaggaaggacttcatttgtgttaattggttgtgagaggagtggccagtataggtctgggaagaaagattttgttagaagagatactgggagtaggaaacataggcgtcccttcaagctttatgggaaaccagtggttgaagggcaaggctggatgatgaagttgat

SEQ ID NO: 64766 - DNA, 267 bp, Glycine max
  Peptide Sequence Number=SeqID_181544
atggctttggcaaaagcaacaaaggaaggtattccaataaatggtcttatcaacaatcttgagtttcctgaggacaaagctatcattttctacgatagtgtgaatgaaatctatttagctaaggatcaagtggagatcgttggacaaaaaagatgtttggccgacactgcttggaccgtcaagtccaatgctcttctttatggccatccaatgtctaatggtggagctcatccaatcaattgtagaaagagcatccaatcctcttag

SEQ ID NO: 64767 - DNA, 423 bp, Glycine max
  Peptide Sequence Number=SeqID_181545
atgggacggtggcatttgagagtgatttggaaaggaagcaggggcacttgtactcatggtgctactggcctacacaatgaaccactaaacagtggcgtctctcctccggctacgaagacacctttcatacctttcatagataaagttatgggtaacaagtcgtgtctacaacctccacctctgagggatttgttcaatgaaaaattggttcatattgagtatgaagggggtaacacaataaagccaatggtgcaaattgataattctgtgtttgagggccgcctttgtgctccttgggagaatgctttgttcattaaactgcttagcaaaagagtaggttatcagaccatgatagacaggctacgagcaaacattaggttggttgaagaaaaagcaattattgaggtggagttgcaacgataa

SEQ ID NO: 64768 - DNA, 462 bp, Glycine max
  Peptide Sequence Number=SeqID_181546
atggcagtagttatccctaccaaaggatctgaatttagcatgaaactgcgtatcggtgacctctcttggcatgattttttggagaaaatcaatagtctcaaaggcaaggaactcatagctacagaacaaccaataggaacatttacaaacattctcttttcttctggaacaacaggtgatccaaaggcaattccatggaccaatattactcctctaaaagttgctgcagatgcatggtgccacatggacgttcgtaaaggtgatgtagtgtgctggcccactaatcttggatggatgatggggccatggctagtatacgcatccttgctaaatggagcttcaatggtctgtatattggatcccctcttaggtctggctttgccaagtttgtacaggaacaaactcattctgctgtttaaattttcagtccttttcatagcttttgtttcctgtgaagtgtga

SEQ ID NO: 64769 - DNA, 804 bp, Glycine max
  Peptide Sequence Number=SeqID_181547
atggcaagcaaaacaaagatctatattgtcctagagttggttaatggaggagaactatttaacaaaatagctaaaaatgggaaacttaaagaggatgaagcaagaagatatttccatcaattaatcaatgccgttgattattgccacagcagaggcgtgtaccacagagatttgaagccagagaatcttcttctggactcaaatggtgttctgaaagttacagattttggattgagtacatatgcacaacaggaggatgaacttctccgaactgcttgtggaactccaaattatgttgctcctgaggtgcttaatgatagaggttatgttggttctacatctgatatctggtcatgtggagtcatcctctttgtgcttatggccgggtatttgccctttgatgagccaaatcatgcggcactgtacaaaaaaattggcagggcccaatttacatgtccatcatggttttctcctgaggcaaagaaactattgaagcttattcttgatccaaaccctttaacagaaaatcttgtgacagagagaaaagagaaacccgtgtcaatgaatgcttttgagctcatatctaggtcacaaagcttcaaccttgaaaatttgtttgagaagcagcaagggtctgttaagagagaaacacattttacctcacagcgccctgcaaatgaaatcatgtcaaaaattgaggaagctgccaagcctctgggatttaatgttcacaagcgaaattataagatgaagctgcaaggtgataagagtggaaggaagggtcacctttcagttgctacagag

SEQ ID NO: 64770 - DNA, 306 bp, Glycine max
  Peptide Sequence Number=SeqID_181548
atgagcgggaagcaggccgcgagacctcgtacccgcgtgggaaagtacgagctgggaaaaaccattggcgagggaagctttgctaaggtcaagttcgctaagaacgttgagaatggtaaccatgttgccatcaaaatccttgatcgtaatcatgtcctccgccacaagatgatggaacaggcacctgaagaaagaaatttctgcgatgaagatgatcaatcatccaaacgttgtcaaaatttacgaggtatgacgcagttttctgatttctctttatctgaaaaacggctagaaatattcttataa

SEQ ID NO: 64771 - DNA, 580 bp, Glycine max
  Peptide Sequence Number=SeqID_181549
ttctgaggatcatccaccaaagcagtccagagtcagaggtcatttggtgaagattgatgctgatagtctcaacacattcttggagacacctgtggtattagctaagggggagaccttactcgcttactctagatattgtaggttgcctacagactacagagagatagaggctgccttatgcatacctaaccaagggttcatcttgaactcacagggccatcctgggaagattctcaagaaggatctgactacactagttcagccagatgacctttatagccagtctaacacttctagacataggttccctactctaatcactatattatgtagagctagaggagttgtctctgatagcctcacttttgagtgcctgagcctggtcattaacttggcctacatcaggaagaactgttggaaccccgaggatctaacagtttctattcgaggggctaggagggcgagggcaaggccagctgagcttccttctacttctgcagctcctactccagcatccacttcagcagcaccttctgtcccagctcaaacagattctcagtgctttgaagctatgctttag

SEQ ID NO: 64772 - DNA, 267 bp, Glycine max
  Peptide Sequence Number=SeqID_181550
atggcgatttcgtcgtcgacgcaacagttggcaccggtgtcgccatcttcaatggcgtgttgcaccaagcttggactcgccagtttgactggcgagttgagggtaggggtttgcagttctcaggctacgtgcagcagctctgcaggaggagggacagctttttggtggaaaacgccagtgctactggcgatttgtgctgcaggttcaaggtacagctttaagattaactatttatatgcccgcctaattgagatattgtacaaatga

SEQ ID NO: 64773 - DNA, 165 bp, Glycine max
  Peptide Sequence Number=SeqID_181551
gaaggggagggggcggaggtcggaccaagagaggaactggaagaggacgtgatagtgaaggatgtcgacaagggtagccaaggagaggtggtagcgggagaagtgatcatcagagacaagataagtgttggggaagacgagaatgaagaggatggagtggtctga

SEQ ID NO: 64774 - DNA, 462 bp, Glycine max
  Peptide Sequence Number=SeqID_181552
atgttgtatttcaatggaagggtatatgaagataatgatggtgtaatatttgaaggcagtaaaaaagcgattcagattaaacgtggaattagtttcaatgctttgaagaaaaaaattggagataaggtaaagttacaaaataatgaaattatttctgctatcagctgtagatttttagtgtcaggaaaatatacttccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatgatgatgattatcttgtgtctaactcatacgttgaagagtcttaa

SEQ ID NO: 64775 - DNA, 462 bp, Glycine max
  Peptide Sequence Number=SeqID_181553
atggcagatcggttggaggacatgattcgtgaccttggacaagagtctttccagcaagcacacacccctgtgtatgaaggattgcagagtgattcaaagaagcctttttatgcagggtgcaacaattccttaaccctgttgtctgttgtgttaagtctggttaatgtgaaggccaggtatgggtggagtgacaaaattttcacctcactgcttgaggtagtgcacaatctgcttctagaggacaacacgttgcctaaaagtaactataaggcgaaaaagatattgtgtccgatgggtatggagtatcagaagattcatgcttgccccaatgattgcatactgtacaggcatgaattccaagaaatgtcgaaatgccctatctgtgggacttcacggtacaaagtgaaggatgaagaggaaagcagttctgatgaaaactccaacacgggccccccagtgaag

SEQ ID NO: 64776 - DNA, 510 bp, Glycine max
  Peptide Sequence Number=SeqID_181554
atggttacccaaaacaatgagagtagaaaatttttgctctgggaccgtgaatgtgttgaattgattggtgaaacagctgatgatgtgaatagggtcaagattgaagatggtgatctttatttgaatgcttcccctcaagcacttgacaaattgttgggtcatgtgcttgcttttaaggtcaggattcaatcaaaattcaaaaatgcagttgtacgtagatactcaaaagacctagatttgatcaatgttgttctcgagatgctgcctgatagtgaggcatgttccaaaatagattcttccaatgttgattgcaatgatgctacacaagctgaacgccaatctctgtctgtcatagatgaccatgatccggttgcgggattgcctttaatacccaaaaagcggatgtcatctggtgaagccgatgataagttagggagctctcaaatttcgccagcccaactatcgtctaacaaattaacaagacattctcataagagcaaatttagttga

SEQ ID NO: 64777 - DNA, 1197 bp, Glycine max
  Peptide Sequence Number=SeqID_181555
atggagaggctccaaggacccctcaattcctgtttctttggagaccctttgggagtgaattgtttggaccatgttctggtggatgaagaaagcctgagactagaagaggaagaacatcttctgatatcaagcttagaggacaacatgccattccttcagatgcttcagagtgtggaatccccacagtttttccctttgaaagagacaaactttcaaacacttctgaggctgcagcacaagaagaatccatgggagggaatagcctattttccaagaatggaagcacaacaagtgcaagcagcattggagctagagagttgtgtgacacatgacatgtccgagatgcagtactcaccagtgaagtcagaaagcaatgagctccaacacccactttcagtttcatgttttgagaagaaagtgaactatgagtgcaaccaggaaccacagaaagtttcacaaacatgccccaaatctcagccaacagcaacaaaggaaaggagaaagagaaagagaacaaggccaagcaagaacaaggaagatgtggagaaccaacgcatgactcacattgctgttgaacgcaaccggcgacgccaaatgaatgaccacctcagtgttcttaggtccctcatgccaccttcctatattcaaaggggtgaccaagcctcaataattgggggagcaatagattttgtgaaggagttggagcagttgcttcagtccctcgaggcacaaaaaaggacgagaaagaatgaagagggtggtggtggtggtggttcttcttcttcttcctcttccactatgttgtgtaagcctccaccaccaccattattattattatcatcaccacatggctatggaatgaggtcatcacctagtgatgaagtgaactgtggagatgaagtgaaggcagaaaacaagtcagaggcagcagacataaaagtgacattgattcaaacccatgtgaacttgaaaattgagtgccaaaggaagccagggcaattgttaaaggtcattgttgctttggaggaccttaggctaaccattctgcacctcaacatcacttcctcagagacttctgtcctttactccctcaatctcaagattgaagaagattgtaagctatgttcagcaagtgacattgcagaaacggttcatcaaatattcagcttcattaatggtgtagctagagaccactag

SEQ ID NO: 64778 - DNA, 540 bp, Glycine max
  Peptide Sequence Number=SeqID_181556
atggcctcaacctcttctgctctcactatatcctcttcttccacccttcatgattgcaaggctccaagacagtcaccagctgcttcaccacaatgtgtgagccttccctctccccttttgcactctcagaactgttcatggaagaccactgcttattgtcgcagtattgctcgaaatgttatggcaatggccacaggagaggcaccagctgaagctgccccgactgaggtgccagagattgtcaagactcttcaagaaacttgggacaaagttgatgataagtatgcagtgagttcactggccctggttggtgtggttgcattgtggggctcagttgggttgatctcaattgtcctcagcagttactacatcactttgaaacaggcaattgataggcttcctttgattcctgggattcttgagattgtaggcattggatacactgggggaagctttggtacggaaagtaaaagaaacatacaacgaaatactggggagcaactgaaagtgttaggaagtgctgagatgctgttgacatga

SEQ ID NO: 64779 - DNA, 276 bp, Glycine max
  Peptide Sequence Number=SeqID_181557
atgtggatggaccaatttgctcttactttgaacaggagtcaagaacttccccgattgctagccaaggccaaagcaatggcggacacctactctgcccccgaggagatccacggacttctcagctatttgcgaatcaagtcactcccgcattttatctctagcatgcattgtatgttggtctcgtcctttgtcacgggaagccggaaggtccatatcaccttcttaactgtacacatagggcactacgcccccaaatgcgcaagtaagaagagataa

SEQ ID NO: 64780 - DNA, 279 bp, Glycine max
  Peptide Sequence Number=SeqID_181558
atggaaaaaggaaccaatggcgcctcactcttccaaaatcgcaaccaccactggcgcctccctgctgcaggccagtctgcaacgctgcaacctagggctacgcatttgactgagccaggcatcaccaagtcgccactactgttggcgcttccaaagccacctcagcaaaaggggacgcgctgctgggaatggcgcttccatgcatggcctgatacgtacgaaacagcaccccatgggaaatacttccaaaacagccctagtttgggaaattctttgtaa

SEQ ID NO: 64781 - DNA, 279 bp, Glycine max
  Peptide Sequence Number=SeqID_181559
atgacgacaatcatgctagtggaggtggtgacgctcatggtgatgaaagtgttctcacaagagtcgtattctaatgttctcagggcaatgacaacgatgaaggtcatggtggcgacaataatggcggcgacgacaatcatgatagtggttgcaatggtggtgacagcggcgacgatgaagataatgtcggttgatgacggtggaaatgtcggtgacaattatgataatgactgcaatggtgctcatggtggaggcaacaacaatcatgatgataattga

SEQ ID NO: 64782 - DNA, 324 bp, Glycine max
  Peptide Sequence Number=SeqID_181560
atggaggagacacatgaaattccccaccacaatctagccgacttcgagccttgcctcgggtatgccactgaagggcaagcagttggtggtatacccctgcaaaacactttggagggccctcagtgtcacccacaaccacaaccctcacattccacaacggttaaaaaccctcatgctatggcagaaatgggaaagaggaaaggctcagggccattgaaggaggtgctggactttgacaagtacaaggggactacttgccccaagaaccatccaaagatgtattgtcggaagataagggcatacgcaaagatgaggaactgctaa

SEQ ID NO: 64783 - DNA, 282 bp, Glycine max
  Peptide Sequence Number=SeqID_181561
atgtccaagcttcttaaaaacaagcgagcagaacaaactaactgggtttttctctgtcacactcacactgatgctgtgcttgtgcatcatcaggctgatgcatggctcactgccggtggagaacccataaagcatatgttggtcgaatggaaagacctctcaaatggatccacttcagtgccatctgctacatcgctcttttcaatgttgaacttttggtataaagcttcagagactccacaacttcggacattggaggacgtagttgctttacaggctgca

SEQ ID NO: 64784 - DNA, 1401 bp, Glycine max
  Peptide Sequence Number=SeqID_181562
atggaggaattaatcatatctccttcttcatcttcctctttggtctctctttcccaagaaaacccaacaccaacccttcaacaaaaacttcaatttctcctccaaagccaacccgattggtgggtctacgccattttctggcaagcctcacacgacgacaatggcaacctctacttatccttcggagagggccatttccaaggcaccaaagaaacttccccaaaatcactaaccattcccacaaagaataagttcctgatgaaaacacccacaaacgataacatcaacgacgccgagtggttctacgtcatgtcgttgactcgcagcttcgcagtcaacaacaattcttcttcaaactccacttcttgttcttcttcttcttcttcactccctggcaagtcttttgctttaggctcggttctctggcaaaacaacaggcacgagcttcaattctacaactgcgagagatccaacgaggcgcacatgcacgggattgaaacgttaatttgcatcccgacacaaaacggggtcgtcgaaatgggatcctacgacaccatcaaacaaaactggaacctcgtacagcacgtgaagtctctcttccatacctctccagatccggttactgtccaaatcctcgacgaccacatcatctccttcgccgacatcggcatcgttgccggaatccaagaaaccaaaaaacgaaaacaaattacccaaacagcacccagcaaaaacgacaactatgtcgactccgaacactctgattcggattgtcccacgttgccaaccgccaccaccccgacagcctcggagccgaagaaaagagggagaaaacctgttctcggacgcgagactccgataaaccacgtggaggcagaacgacaaagaagggagaagctcaaccatcggttctatgccttacgagctgttgttccgaatgtttcgaggatggacaaggcttcgttgttgtccgacgctgtcgcctacatcaacgaactgaaggcgaagattgaggacttggagtcgcagcagccgagagacagtaataaaaaaatgaagacagaaatgactgacactctggataaccagagtgccacgaccacatcaaccgtcgtggatcaaagcgggtctggatccagattaggtctaggcccccttggactcgaggttgatgtaaggatcgtggggcccgatgccatggtgagggtacaatcagaaaatgtgaaccaccctggggctaggctaatgggtgctttaagagacctagagtttcaggttcaccacgctagcatgtcttgtgttaatgatctcatgcttcaagatgtggtcgttaagcttcccaacggaatgaggagtgaagagagtcttaaatctgctattatcatgaggttggatcagtga

SEQ ID NO: 64785 - DNA, 189 bp, Glycine max
  Peptide Sequence Number=SeqID_181563
atggctttaacgttttcaagcaataataaaaaactgaatgaactgataattaatttgatgtgggagttaggacaattttgcttgaccaagaacaagaagggtgagtacatgtacatgttcaacaaggaaagcgtgtacgagatgaatgcgacagtgagtgatgtgttatttttaactctaaatgtgtaa

SEQ ID NO: 64786 - DNA, 615 bp, Glycine max
  Peptide Sequence Number=SeqID_181564
atggagttctttcaaaaggccaaagtggtgcgcttgagaagccaccatgataaatacatgttggctgatgatgatcaagaaaatgttttccaagatcgcaatgggtgctacaggaatgctaaatggaccgtggagattgtggagaattccaatattataaggttgaagagttgttatgggaaatacttaacagcctcaaatatgccattcatattgagaggtacaggaaaaaaagtgttgcaaacattgcctactaggttaaattcttcggtggaatgggaacctattagagaaggggttcaagtgaggctaaggacacggttgccaccttggaggaacaccattacccatgatgtcccacatagaacagcaacagctaattggattttatgggatgtggatattgtagaacttcgcccacaaacacaagctcctaaaccaagaccaaggcctatacctattaccccacccaatcaatctatgaatccaactccaacaaatctttcaccttgttcttctccttcatcatcaccattaatttcaaagatggattccctggtcaagattgatctcaggtctcacacaacatctgaggttcgtcacatgaaattttga

SEQ ID NO: 64787 - DNA, 789 bp, Glycine max
  Peptide Sequence Number=SeqID_181565
atgaatttgacaaaaagattagctcaaacagcccaagaaacctttattgactttgaggaagcagttgaaaaagatgccactaaaactactgttatggatggaactgttcacccactaacaagctatgtgatcaattacgtgaagtttctttatgattatcaatcaactttgaaacaactttttcatgagtttgatcccaatgatccagaaggacaattagcaattgttacaacaaggattatgcaggctctccaaagtaacttggatggaaaatcaaaacaatataaagatccagcattgacgcaattgtttcttatgaacaatatccattacatagtgagatctgtgagaaggtcagaggcaaaggatatgttaggggatgattgggtgcaaatacatagaagaattgttcagcaacatgcaaatcaatataaaaggatctcttgggcaaagattttgcaatgtctcactatcccaggaggggataataatggtggagtctcaagaacaatggttaaagatagattcaaaacctttaacgatcaaattgaggagattcatcaaagacaatctcaatggactgtcccagatagtgaattacgtgaatctcttagattggctgttgctgaagtcttgttacctgcgtatagatctttccttaaacgatttgggcccatgattgaaaacggcaaaaatcctcataagtatatcgtatactctcccgaacatcttgagcaaatgttgggtgagttttttgaaagcaagatttggggtgaacaaaagcgataa

SEQ ID NO: 64788 - DNA, 267 bp, Glycine max
  Peptide Sequence Number=SeqID_181566
atgaagacgaagctggtgtttgctacccgagatgaaattctacattgggctcgatctgttgcttatgaaattggatttgtgacagtgattatgaggttagacacaaacactggtatgagaggaagaacttcatttgtcttaattggttgtgaaaggagtggtcagtataggtctaggaagaaagattttgtaagaaaagatactgacagtatgaaatgtgagtgtccctttaagtttcgtgcgaaaccagtggttggaggccaatga

SEQ ID NO: 64789 - DNA, 225 bp, Glycine max
  Peptide Sequence Number=SeqID_181567
atgacgccaccgccgccaccacagacgagaccaccgcgtgacgccgtcacctgcgaggggcacgccgaggaggtttttccggcggccgttcccgccgccgtctcccgcgaagcacataagggcgtcgctggcgaagcggctcgggcacgcgaaggcggcgccgaaggaggggccgatcccggaggaggaagcggcggcggccgcggcagagcggtcgctggataa

SEQ ID NO: 64790 - DNA, 408 bp, Glycine max
  Peptide Sequence Number=SeqID_181568
atgggtattggagagaagagtccaagcaagagtttcaatctgcaccatcaccatcatcgtgaagggaagaataagcaacaagagttcagaggggtcccaaaagggtgcatggcaattaaggttggtcaaggagaagagcaacaaaggttcgtagtgcctgtgatttacatcaaccaccctctcttcatgcagcttctcaaagaggcagaggaagagtatggctttgatcaaaagggcaccatcaccatcccttgccatgttgaggaattcagaaacgttcgtggcttgattgatagggacaagtcccttcatcatcatcaccaccaccataatttttcacgcgctggaataattggtacaccactctttcggaaaagagaagaagaattggaaaagaacgaattgacg

SEQ ID NO: 64791 - DNA, 618 bp, Glycine max
  Peptide Sequence Number=SeqID_181569
atgttacggaaccttgcggattacataatcatcccctttttgacttacggaatgttacagaacctcactaattatgcaacgatgcttccatttgatttccgcatgtctcggaatttcacaaattgcctaatgatgggtgccaagcaccttacaaggaccaaacaaaggtcgcatgtcatcgagcaaaggtccccggacaaaattaggaggtccaagagatcagtagttaaggctactaagaaaaggaaagggaaggagaagatcatcccagatgcaaatgttggagggtggctattaaatgagaagggcaccctccaacatttgttggagtgtagcatggttgcctcctcttggaacaagaatccaagccatggtctaatggaacactatgaaatggacttcataaacgagaagtatgatattctctcaagctccaacaaagttcacgaatctgttcttcatcatatgtgcctagttgaaaaagatggtcattggttcttgatgatggtttggcaagtgtaccaagttttcagagtagataatcataagtgggttgtcatatccacagggattggtagatattacaataatttctattattttaatgaaaactcctaa

SEQ ID NO: 64792 - DNA, 192 bp, Glycine max
  Peptide Sequence Number=SeqID_181570
atggaaatctttattcaatcaattgatcctggtgcatggaatgccatcattaaaggtcctttcattcctactaaggaagtgaatggtattgtagctccatgtagagcttgtaggccttggatctccttcatcaatgaactcattcgcttcttgaagatcaatggtagtggaatggaaaaggaggaaaggtga

SEQ ID NO: 64793 - DNA, 513 bp, Glycine max
  Peptide Sequence Number=SeqID_181571
atggattttgtttctcaagttgaacaaagaaacattgatgaagctttatgggatgaacattggttaatggaaacgcttgaagagctgaatcaatttaagagaaatgatgtatgtgatttaattcctaaaccaatctttcacaagtcaatcggaacccaatgggtgtttcaaaacaaacttgataaatccgaaatcatagtatggaataaagcaagattggttgcaaaaggatacaaccaagaagaaggaattgactatgatgaaacctatgctccaattgcaagacttttttggatggatgtaaaaagcaccttcctcaatgctgcattgaagaagaagtgctttatatggtttgaagcaagcaccaaggtcatgaaagaatttgagattactatgataggacaattaaatttctttctaggactccaagtcaagaaaatgaaacacagaaccttcctcagtcaaaccaaatactgcatagaactgataaaggaacttggcatggaaaaatga

SEQ ID NO: 64794 - DNA, 383 bp, Glycine max
  Peptide Sequence Number=SeqID_181572
atggctagcaatcccgcaagaactcagaagaaagccaagtccttgaagaggaagcaaggagagtgctctcaagcagctctcaacaggttggatacttggttcatggacgaaagcaagaagggattcaactttactaacttgctagaagcacaaactgatatggaaggcaacttgtactctactgtcaagggtgtagaaatggtcattgacgctgaagtttgcaaagcagttgcaggaatagacatgggtggagtccacaagattttgagaaatggactaggtgttggcggtctgacagctaaggacagaatgttggtgtataccattacttacattctggcacctatgtccagcaatcatgctcaagttactaacgatgactt

SEQ ID NO: 64795 - DNA, 150 bp, Glycine max
  Peptide Sequence Number=SeqID_181573
atggatgaaggggggaaggaagacatgtggagagtgagtggagcaagggaggacacgtggatgggggtgagggctgtgggggtgacagctaggtggatggggaaaatagggaggcacaacacgaccaatagcaatagcagtgacatttaa

SEQ ID NO: 64796 - DNA, 552 bp, Glycine max
  Peptide Sequence Number=SeqID_181574
atgaaactgcaagatgaaatgaaaacacttggtatcagctcccacaatgttgctatgagcgctattgttagagggcttgcaaattcaaagaagattgaaaatgctatttgggttcttgatttgatgcttgagatgcaaatcattccaactgttgctaccttcactactttaatgcacgtttattgcaaagaagctaatgtcgcaaaagctttagaattgaggagcataatggaacattgtcatgtgaagcttgatgttgttgcatacaatgttcttatatccggcctttgtgctaatggtgatattgaagctgcttttaaactttatgaagaaatgaaacaaagagatctttggcctaatacctctatatacatagttcttattgattctttctgtgctggaaattatcaaattgaaagtgaaaaacttttgagggacatacaagacagggaattggtttcattaaattcatatggaggcaccaaaagattgaatgagttgttgataatttctaggaaagaattaattcacttgaggttgtgcttcatatga

SEQ ID NO: 64797 - DNA, 429 bp, Glycine max
  Peptide Sequence Number=SeqID_181575
atggataaatctgattttgaagtgtgtgacttttgtgtctttctatgtgctaataaatggtgtcccaatggaggaattcaagtccttaagggtgatccattgtccccctgtctattcatactatgtgcaaaggctttttcagctctattatgtaaggcaatggagaatcaagctcttcatgaacttaaggtttgtcctagggcccttcttattatctcacacttgccttttacagatgacaaccttatctttgcaagattcaccaatgaagaagctttgcagttagtttcccttcttgacacttatgagaaggcttccggacagaagataaacctcaagaaatcagaggtttctttcagccaaaatgtgctaagtcccaaaattcatgagctagaaatgctggcaaaagcttcattggttgagttttga

SEQ ID NO: 64798 - DNA, 192 bp, Glycine max
  Peptide Sequence Number=SeqID_181576
atgtgggttcatgagtgtgatgaacgcataaatgatgaatatatgatgttacaacctcttatgatgttaggactggtgaatgaatttgtgatgacgtataatattgatttgagtgatcacaacatatatgcattgatgaatgatattgcatattacgatatagcctttgaggagaatgtcactcatggttga

SEQ ID NO: 64799 - DNA, 354 bp, Glycine max
  Peptide Sequence Number=SeqID_181577
atgattcatattgaacatcagttcaacataaacatgttggaagacataaggattgcacttaagaataactttgttctctatgacatcgttaacttcttcaacaaggacaaagtgattgaagacatttttaccgttgcaagtgcaacatggtgcttgaacattggtgaacgagtaagaattggttgggataaagatcttgatgttcaccttatcaaagacactttctacaagcttgatgcttcaatcaacaggattgctgactggaaggaatacccagaagacttgttcattagtgaataccttgtctactggaagcaggaagtactcgtccctccaacatcaactaggatatga

SEQ ID NO: 64800 - DNA, 2406 bp, Glycine max
  Peptide Sequence Number=SeqID_181578
atggagaagagtatatacacttttctcactgtgcaccgttgggagtcactgaactgtatgaaatataggttggcttcccttaggcctgtccatggaaggttggctctgaaatttctcaattgggtcataaagcaacccaatttggagctcaatcatgttactcatattatctgcactaccacccacatacttgttagagctagaatgtacaattttgccaaaactacattgaagcatctgttgcaactgcctataggtttgaactctgtttttggtgccttgatggagacataccccatttgcaactcaaacccggctgttttcgacctcctgattagggtttgtttgaggaacaggatggttggagatgctgtgcagactttctacttgatggggtttcggggactgaacccgtctgtgtatacttgtaatatggtgttaggttcccttgtgaaggagcagaaagttgatatgttttggtcttttttcaaaggaatgcttgccaaggggatttgtcctgacgttgctacattcaacattttgttgaatgctttgtgtgagcgagggaaatttaaaaatgctggctttctcttgaggaagatggaagaaagtggtgtttatccgactgcagtcacttacaatactttgcttaattggtattgcaagaaagggaggtacaaagcagcctctcagctgatcgactgcatggcatctaagggtattggggtggatgtttgtacatataatgtgtttatagataatttgtgcagggacagcaggagtgcgaaaggttatttattgttgaaaaggatgagaaggaatatggtgtatcctaatgagataacttataatactcttattagtggatttgttagggaggggaagattgaagttgctacaaaagtttttgatgaaatgtcattgtttaatttgttacccaacagtatcacttacaatactttgattgctgggcactgtacgacgggaaacattggggaggcattgagactgatggatgttatggtatcacatggtttgagacctaatgaagtgacgtatggggctcttttgaatgggctatacaagaatgctgaatttggaatggtttccagtattcttgagagaatgaggatgggtggggtgagagttagtcatattagttatacagcaatgattgatggattgtgtaagaatggcatgcttgaagaagctgtgcagttgctggatgatatgttaaaagtttctgtcaatcctgatgttgttacattttcagtgctcataaatggatttttcagggtggggaagataaataatgcaaaggagattatgtgtaagatgtataagactggacttgtgccaaatggcattttgtattcaacattaatctacaattattgcaaaatgggatacttaaaagaggcattaaatgcttatgcagtgatgaatcatagtggtcatgttgctgatcactttacatgtaatgtgttggttgccactttctgtagatatgggaaacttgaagaggctgagtattttatgaatcacatgagcaggatgggccttgatcctaactctgttacttttgattgcattataaatgggtatggaaattctggtgatgcattaaaagcattttctgtgtttgataaaatgaatagtttcggacatttcccaagtctattcacatatgggggtttattgaaaggactttgcatcggtggacatattaatgaagccttgaagtttttccatagacttcgttgcattcctaatgctgtcgataatgttatcttcaacacaaaacttacttctacatgtagatctggaaatttatctgacgcaattgcccttattaatgagatggttacaaatgattttctgcctgacaattttacatacactaatcttattgcggggttatgcaagaagggtaaaatagttgctgcactccttttgtcagggaaggcaattgaaaaaggattattatctccaaatcctgctgtgtacactagtttagttgatggtcttcttaagcatggacatgcaagagcagctttgtatatttttgaagaaatgctgaacaaagatgttgagcctgatactgtagcattcaatgtgattatagatcaatactcaaggaaagggaaaacatcgaaggtcaatgatattctttcaacaatgaagagtaaaaatttatgcttcaatttggctacttacaacatcctgctacatggatatgcaaagaggcatgccatggcaagatgttttatgttgtacaaagacatgatcagacacggttttttgccagataagttttcatggcactctcttattcttgggtattgtcagtccaaatcatttgatgttgctattaaaattttaagatggataacactggaaggtcat

SEQ ID NO: 64801 - DNA, 276 bp, Glycine max
  Peptide Sequence Number=SeqID_181579
atggcttcgtcaggtttaaagggggggattgaaattgttcgtcaatctcccaaagtatggcagggagatacgtcgggagacagtgggaactatccaaacaaagccgtccatggacagaaagcaaggaggggtgaagttaaaccagaagatactctatggttgaaggaagcatgggtagcgcgcctaagaaacccagcactgtttgaacgtgtggaggaagagttactctgggagactggaatggatgtaaatcctacattcatgggtgatgattaa

SEQ ID NO: 64802 - DNA, 408 bp, Glycine max
  Peptide Sequence Number=SeqID_181580
atggggggtgtaaatagcaactgggcccattcggaagattctggagaaaaggttgcttttggtggaagcaacccaactcgcttgggcgagatggacgacaaccacctcccttgttctcccactgagttttcacttgaaattagtgaggagaagagaaagaagggaaaaagtccaatccgaggtgtttccataacgcttccgagatgtttccgtaatcaatttcatggaagttcttttccattcttcgtcgttcttcgtttgttcttcatcgttcttcgatcttcaaccaataagttcttgaattcgaagctttcaattcattctatgcaccctcagtggtccattcttgttttgtatgctttcattcttacttcgtttactttcagtattcttttcttccttttttaa

SEQ ID NO: 64803 - DNA, 375 bp, Glycine max
  Peptide Sequence Number=SeqID_181581
atggctgttaacacagagctatcaatggcacatgaagaaaaggcacatccaaagtcgcctatggatcccactagaatgtgtcaaaggggtctaattatgctataccctacctgtgggcaatcacttctaattagaagttttattcgccctccaattattcgtggaaaagttatttctgtgaccttaaaagctgtatgggaattcagcaagcatgacccagcagtttctctttctccctctcaagcatatcatgcatgggaaaccgcaaagcaaacccccccaagggcttcaactttatgctactttacaaaaggtcaaaaaggttccaatttcccaaaagcaattctttataagacagcattcacatattcataa

SEQ ID NO: 64804 - DNA, 1194 bp, Glycine max
  Peptide Sequence Number=SeqID_181582
atgggatcaaatcaaacacctttgttcaagaaaaggttttatcaagtcaaaatcaagagcctagaagtcaccagtctgccagagttgggacagttgatgggtcaacctcaacgacaaaccttccgcaaagcctatgagatcctgggatgcccactgggaggaaggaaaccatatcttttctcagggttctatccctccatggctatagttgccaaagtggcaaaagccttggcaagtcgccaggaagtaagaggggagatcgacctcctgattcagataggcccctacacttaccgggttacctttcaagtgatggatattaacccagcctatagttgcttgttgggccgaccatggattcactcggtgggagtggtccccttaacactccaccaaaaactgaaattcatggtgaaagggcatttggtcattgtttcgggggaagaagatgttctggtgagctgcccctcctctatgccatatgtggaagctgcggaagagtcattggaaatgactttccagtcctttgaggtggtaagcaatgctttcgtagaatccctcccaatgcagccccgcatgtctggcgtggcaatgatggtgccccaggtaatgttacggcacgactatgagcccggaatgagtttgggcaagaataatgatggcatggccgacctagtagacatcaagggaaaccacgggagattcaggttaggctataaacccacgcaggctgatgtaaggaaaaacatcttggaaaggaggaacaagggccagtgcccgcatccaagaccacaagcaagagaggttccaccttgccacatcagtagaagcttcatgagcgcgggcttaagacacgaagagcaagtcaccgcgatatgcgatgaagcccctcaaaggcggtcggacttggtgcagccatgccttcccgttttccagctagggaactggcaagtggatgaggaagatgaagatatagggtttttcctggagctagaaaggatagtcactcaggaagaccgagagaagaagctgcactcagaagaaacagagatcgtaaacctaggtgttggcgatggaaagaaagaagtaaagatgggtatgggtatgaccacacctatccgtgaggaattagtggctctactacggactaccaagatgtctttgcttggtcataccaagacatgcttggtttga

SEQ ID NO: 64805 - DNA, 513 bp, Glycine max
  Peptide Sequence Number=SeqID_181583
atggctccgaggaagcttatcactaaaagggctaggaaggccaccgtaggggagggatccagtgcagcctcgcaagcggagattgagttttatggacatcattttcaaagcgaggagcatgagtgttgtttcgaagcgattaaggattggtctttccttaaagaaagacgggtccaactaaggacgcggtggacccaactgacagagcccatggctaagtatgaccctgagatagtcatggagttctatgcaaatgcctggcccatggaagaaggagtcatggataagcgttcctgggtgcagggccaatgggtcccctatgatgaagatgctatcaaccaattcctgggacatcctttggtcctagagaaggggcagcattgcgaatacaccaaaagaagaagccaagtctcaggttttgatgaagaggccatatgccaactattgtgctctccgggacaggattttgccttagagcatgatagggaagcggttgcggatcatgcgcactag

SEQ ID NO: 64806 - DNA, 120 bp, Glycine max
  Peptide Sequence Number=SeqID_181584
atggccgaggcgctaccaaattgcgaccgtaatcgacttctacatcgttctttgttcgttcttcattcgtcatccgaactacgtaggtctgaatttctcatcgcacctgaggatacgtag

SEQ ID NO: 64807 - DNA, 252 bp, Glycine max
  Peptide Sequence Number=SeqID_181585
atggcattaggggtcatggaagctcacccaagcgagttgttgcttcaacctaaagtaaccttgcttgcccaggcggccagctcgcctggttacttcacccctaagctatttgggggcccaagcgagccagaggctagcctaggcaagccagggtttagaaaaaggcttaaaatgatccttttgccctcctttttggaaaccgatgttgaacaacacctttcggttagcgagaatcaaaatatcggcgaatga

SEQ ID NO: 64808 - DNA, 192 bp, Glycine max
  Peptide Sequence Number=SeqID_181586
atggtgctggtaatggctactgcagccgcattgacctccattatcttcttcatgctcatcatgacctccatcattatggccatttgctctttcatggcctccatgtcggcctccatgtcggcctccatctgctcttacacctcctctacttcacccattactcttgctctagcacaggaaagaatgcaatga

SEQ ID NO: 64809 - DNA, 551 bp, Glycine max
  Peptide Sequence Number=SeqID_181587
atggagcttgcatcaacccttgctgggattatcgctaccattgcattatcaagtagatatgggagcaagttagcatatgacactagaatttggggtgtttgcgctaaaggtggtgtttgggaattgggcttgtgtaatgacattgttgggctgatgggaaatttgaccgtacccactttgatcctttcatcggcgaagaccaaatccgcaaagcttgaagaggtataccaccaattgcttgcccttcagtggcatatccgaggcaaggctcgaagtcagcttgaatgtggtggggaatttcatgtgtctcccccatgtgagtatgggagcggagttattgacatcctcactgggagtgtatgccacattgggtggtgtatagttgggaggcaagccatatggtgggaaggcaagcttgccatatggggggtcaggtccacttcagcaatggtgctggtagtggctattgcagccgcattgacctccattatctcctttatgcttatcatggcctccatcattgtgactattttctctttcaaggcctccgt

SEQ ID NO: 64810 - DNA, 414 bp, Glycine max
  Peptide Sequence Number=SeqID_181588
atgaagtgcctagaaggtgtttgggagaccctcgagggcaacgagaggtgccaattccgcggcatagttcgaatcactgctacattgcttgtacatccggagcaacccgcacgcatacttcagcagcctgtggagtggatactacctatgcctaccctatatcgactagttgagcccgttcaattgatagaggtgtcatcctccgaagaggatcctgaaggggacccagaggagtcatctcctgaacctgctatggatgccgctgacttaccagaggatgatgaggacccacttcctgatgtcgattttccagaggatattatgccaaaacctgaggcagactctacagaggagagtggtccggtaggaatggtgaataaagacgactcttcatcacaacagacgactccttag

SEQ ID NO: 64811 - DNA, 450 bp, Glycine max
  Peptide Sequence Number=SeqID_181589
atggcagcgcagctgatccgtgattgcgtcgtgatggagtgcctagagggtgtttgggagaccctcgagggcaacgagaggtgccaatttcgcggcacagttcgactcactgcaacattgcttgtacatccggagcaacccgcacgcacacttcagcagcctgtggagtggatactacctacgcctaccccatatcgactagttgagcccgttcaattgatagaggtgtcatcctccgaagaggatcctgaaggggacccagaggagtcatctcctgaacctgctatggatgccgctgacttaccagaggatgatgaggacccacttcctgatgttgattctccagatacgaattattatgatattatgccaacacctgaggcttactctacagaggagagtggtccgggagggatggcgaataacgacgactcttcatcacaacggacg

SEQ ID NO: 64812 - DNA, 2073 bp, Glycine max
  Peptide Sequence Number=SeqID_181590
atggtctttgccaaaatcgcatcactcgtcgcccccaattcacattccctcccccaccccctttctctccaggatctctcctcgtaccaccgccacctcgaaccacccctccaaggcggaacaacctcgtcctcacgcaacaaatgcctcagactctcactctacctcgccaccttcctgttcctaacttacctcctcttcctcctcctctactcctactgggcccacgcttcctccgccaagtactacgttgtcctcgactgcggcagcaccggcacccgcgtctacgtctaccgcgcctccgtccgcttcaaccgccacaccactctcccaatcgccatcacctccctgagaaacccctcccacaagaagcctcccaccggccgcgcctacgatcgaatcgaaaccgaacccggtatcgataaattagtaaacaacgtgtctggtttgaacaatgcactgaaacctttgctcaggtgggccaagaagcagataccagtgcgtgctcacaagtctacatttttgttcctttatgccactgctggtgttaggaggcttcctgttagtgattctcggtggctgcttgataatgcttggtctgtgcttaaagactctccctttgtgtgccaaagggattgggttaagactattttgggtcccgaagaggcttattttgggtggatagctcttaattatgatagtggcattttgggggttaggcctaggaaggctacttatggtgctcttgacttgggtggctcttccttgcaggtcacgtttgagagtgatcagcagctgaatagtgagactagtttgtatgttaggattggatctgtgagccatcatctcaccgcgtattcgctgccggggtatggactcaacgaggcatttggtaagtctgtggtgtatttgtttaggaaggagtttggattgggtgatgtggatgtgggtagtggtgggaatattgagttgaaacatccttgcttgcaggaggggtatagggaggaatacttgtgttctcgttgtttgtctagtaagaaaggtgggaatggagggtttggaggaactccattagtgcttgttggtgctcccaattggggggagtgcagcacgcttgcaaaagttgctgtgaatttgtctgagtggtctgatcatggtgctgggcttgattgtggagcgcagccttgtgctttgggtgataatctgcctcgcccatatggacacttttatgtgatttctggattttatgtggtgtataggtttttcaacttgacttctgaggccacgcttgacgatgtgttggtgaggggtaagggtttttgtggaaagaggtgggatgttgcaaagagaagtgttgctccgcagccctttattgagcagtactgcttcagggcaccctacattgcctctttgctgagggagggtttgcacattaatgataaccagataactgttggctctggaaatatcacttggacacttggggttgccttgttggaagctggaaaggcgttttccactagatttgggcttcgtgacttggagctttttcagatgaagataaatcctcttgttcttgtgccccttttgttgctttcttttattcttcttctttgtgctttatcatgtattggcaattggatgccaaggtttttccggaggcaatatcttcccatttccaggcataacagtgtttctggtgcttctgttctcaacataccatctccttttcggttccagcgatggagtccaatgaactctggggatggaagacttaagatgcctctgagcccaaaaattgcaagttcacaacaaagcccgtttggtctagggcatggtcttgacaacaacagtggtggcgtcgagcttatgaagtcttcattgtacccatcagctagtaatgtctcacatagttattcctcaaacagtttagggcagatgcagtttgacagtggcaacatgggtgccttctggtccccacacagaagtcagatgcgtctgcagagtaggagatcacagtctcgagaagacctgaattcctcattggctgaagttcatctggtgaagccgtga

SEQ ID NO: 64813 - DNA, 126 bp, Glycine max
  Peptide Sequence Number=SeqID_181591
atgttctcattttgtgctctcgttcttgctttcactctcaccctcttgttctcgctctcactcacagctctactcagtctggttctcagtcaccaaagatcaacagaactagaaggaaatggctaa

SEQ ID NO: 64814 - DNA, 204 bp, Glycine max
  Peptide Sequence Number=SeqID_181592
atgaggcatatcttattcttatttgcattggatggtcttcactctactggtattgtgcatagggatattaagccacattacattagtttgtttgaagagtctcatacattcaaaatcattgatcttggagctgctacagatctccgagtcggcatcaactacattcctaaggagtttcttttggatccaaggtatcttctttga

SEQ ID NO: 64815 - DNA, 1761 bp, Glycine max
  Peptide Sequence Number=SeqID_181593
atggcccttcgaggccttgacacgaacttccaagactacaacacagtcctaaacgagtgcctgaggaaaagggccatcagagaagggcagagagtgcatgcccacatgatcaaaactcactatcttccttgtgtgtatctaagaacaaggttgatcgtgttttatgttaagtgtgactctttgagagatgctcggcacgtgtttgatgtaatgccggagaggaatgtggtgtcgtggacggctatgatatcagcttattcccagagagggtatgcctctcaagcattgagtctttttgtgcagatgctaagatcaggtacagaacctaatgagttcacttttgctaccgtgcttacttcatgtataggttcttcgggttttgtcttagggaggcaaatccactctcatatcataaaattaaattacgaagcacatgtttatgttggaagctcactccttgatatgtatgccaaagatggtaaaattcatgaagctcgaggcatatttcaatgcttgcctgaaagagatgtagtttcttgtactgccattatctctggatatgctcaactgggtctggatgaagaggcattggagctatttcgccggttgcaaagagaaggaatgcaatcaaattatgttacttatactagtgttttaactgcactttctgggcttgctgctctagatcatggcaagcaagtgcacaaccatcttcttcgctctgaagttccctcatatgtggttcttcaaaactctttgattgacatgtactcaaaatgtggaaacctcacgtatgcaagaagaatatttgataccttgcatgaaagaactgttatctcttggaatgcgatgttagttgggtatagcaaacatggggagggaagagaagtgcttgagcttttcaatttaatgatagatgaaaacaaagtcaaaccagacagtgtcactgttttggctgtgttatctggttgcagtcatggaggactagaggataagggaatggatattttttatgatatgaccagcgggaaaattagtgttcagccagactccaagcactatgggtgtgttgttgatatgcttggtcgtgcgggtcgagtagaagcagctttcgagtttgtcaagaagatgccttttgaaccatcagctgctatatggggttgccttttaggtgcttgcagtgttcattcaaatcttgatattggtgaatttgtgggtcatcagcttctacaaattgagcctgaaaatgctggcaattatgttatcctgtctaatttatatgcttcggcaggaagatgggaagatgtaagatcactaaggaacctgatgttgaagaaggctgtaacaaaagagccaggaagaagctggatagagcttgatcaagtacttcacactttccatgctagtgattgttctcatcctagaagagaagaagtatctgcaaaagtacaggaattatcagccaggtttaaagaagctggttatgttcctgatttgagttgcgttttgcatgatgtggatgaagagcaaaaggagaagatacttctaagccacagtgaaaagttggctttgacttttgggctaattgctacccctgaaagtgtgccaatccgtgtaataaaaaatctccgtatttgtgttgattgccataattttgctaaatatacctcaaagatttatggtagagaagtgtctttgagggataaaaatcggtttcatcgaattgttggaggaaaatgctcctgtggagattactggtga

SEQ ID NO: 64816 - DNA, 294 bp, Glycine max
  Peptide Sequence Number=SeqID_181594
atgaccttttgcttaaagggaattgatcaggaacaggaaccggacagcagtgttgagcaagatgatttcaaagtcctgaaagttgtacatagtcattcaaaaaaaggtcacaggcaaaagacaaacagaatgggatctgcgaagggaaaaaagggtcgcgagattggtgatatccccgcgccattggaggatgaatgctatggctgccgcgacacagagccaaagcctcgtttcgccagagatcctttgtctcaccggtgtcaacgtcgtggaaggatgtgtggtacagtgtag

SEQ ID NO: 64817 - DNA, 216 bp, Glycine max
  Peptide Sequence Number=SeqID_181595
atgggggttttggatgccaaacacaagaatggaattgcatatagaagctacggagaagatgttagaaatggagaatggaggcataggaagagagtgggaggcctaggagctataggtttcagatctgccaaaaatcgaggaggtaaagaaggattgaatgaaggggatgcttcgagaaaaaacaacagagacagcagagaaccatcattcagatga

SEQ ID NO: 64818 - DNA, 1494 bp, Glycine max
  Peptide Sequence Number=SeqID_181596
atggaagcacaaagctcccagcatacccaagttattgagatcagtggtgactttcctgatggtggaaggaagatttgtgcggaagcaccatgtgggtttgcagatgctggatccatctctaaggactctgaagaaagatcaacttctatgcgaaagcttttcatggcagtggtcctttgtgttattttcatgaccgttgaagtggttggtggcatcaaagctaacagtcttgctatattgactgatgcagcacatttgctttcagatgttgcagcctttgccatctccttattttcattatgggctgctggatgggaagctacacctcgccagtcatatggatttttccgaatagagattcttggtgctttggtttctatccaaatgatatggttgcttgctgggattctggtatatgaagccattgatagaatcattgccggtcctaaaagtgtggatggttttttaatgtttttagttgctgcatttggtcttgtggttaatatcatcatggctttgttattgggtcatgatcatggccacggacatgatggtcatggtcacggtcacggtcacggtcacggacatggacatgatggtcatggccacagtcatggatttacagtgtctacccattgtgatgcaaagcatacaaaagatgagcaccatcacacacatgatgatcatgcacaccatcatgatgaaaacctttcaaaagatgctcaccatcatactgaggaagatcacttgcaccatcatgctcacaaagatgttactgaacctcttcttggtgaatcaaaaggtggaactaagaagaagaagcaatggaacataaatgtgcagggggcttatctccatgttcttggggactctatccaaagtattggggtaatgattgggggagcagtcatatggtataaccctcgttggcaaatagttgatttaatctgcactctaatcttttcaataattgttctggggacaaccatcaacatgctgcgaaacattttggaagtcctgatggagagcacacctcgtgagatagatgctactaagcttgaaagggggctgttggatatggaagatgtagtggccgttcatgaactgcatatatgggccattacagtgggaaaggttttgctagcttgtcatgttaaaatcagacgtgaagcagatgcagacgtggtgctggacaagatttgtaagaattttatcaagtcgttaaaacttcttttggtacaatctaatacaggtttgccttgggcacctaaatgcatcaatggtgttaatacaagagggtcccttccaatccagataagcagctgtattgtgttttggagtgtattaccgacaagttttgtgcttcacaagcacaagattgtaaaggttctattccaacaaaaacactattttgatgaatcaccaagctatgtaatctgccctcattctctaccttccgtggtgtccttggtgaacaaccacaagattctgtag

SEQ ID NO: 64819 - DNA, 249 bp, Glycine max
  Peptide Sequence Number=SeqID_181597
atgggaagcaaatggaggaaattgaagctggctcttggtttggattcctgtgttcacattcccagagcctttgatgattcctccgccgccgcagcaaggttttccggcggcatctcacccaccgtcgtttcgccggccggtgacacctccggctaccgtccctccactcccacaccatcgtcttccggcctctggttacccaaatcgggaaccaaatcccctaaggttatcattattattaccctttga

SEQ ID NO: 64820 - DNA, 888 bp, Glycine max
  Peptide Sequence Number=SeqID_181598
atgagttttggatataaagccaacaattggggacttcactctgaccaccatgataggaactccaataagcaaaagccaattgatacgtgcatatcacaaaaactactcttacacaccaaaaaaatcctctatcaccaaactcacctataccctcaaactcaaggccctatagtccaagcaacagaaggtgttgaggcagaaacttacacaagtagctgcaccaccccatcaagatcaaagaagagaaacaacaacaacacaagaaggttcagtgatgaacaaatcaaatcattggagaccatgtttgagtcagagacaaggcttgagcctagaaagaagttgcagcttgcaagagagcttggattgcagccaaggcaagttgctatatggtttcagaacaagagggctagatggaagtcaaagcaacttgagagagactatggcatactccaatccaattataacactttggcttcacgttttgaagctctgaagaaggaaaaacaaacattactaattcagttgcagaagctgaatcatctaatgcagaagccaatggagccaagtcagagatgcacacaagttgaagcagcaaacagcatggacagtgaatcagaaaatggaggcaccatgaaatgtaaagctgagggaaagccaagcccatcatcattggaaagatcagaacatgtacttggtgttctgtctgatgatgacactagcataaaggtggaagactttaacctagaagatgaacatggccttctgaattttgttgagcatgctgatggttccttgacttcaccagaagattggagtgcttttgaatccaatgatctatttggccaatcaaccactgatgattaccaatggtgggacttctggtcctga

SEQ ID NO: 64821 - DNA, 663 bp, Glycine max
  Peptide Sequence Number=SeqID_181599
atggccaagttcgatccatacatagtcctcgaattttatgccaatgcttggcctacagaggagggcgtgcgagatatgagatgctatcggccagttcctgggataccctttagtgctggaagagggttaggagtgcaagtatggccagaggaggaaccggattttgcccggactgctgccgggagacgggtgcggatcatgcacaccaacatgaccaccctgactcagatctggatgactttgctgctcagcaacatccagcccagcgatcataattccgacctccccctgccgaagtgtcaactggccgcagacgcaccaccacctcatcaggctggtccagccggatcgtttgatacggagcagtatttgcggcatttggttcgccagcaggcggccaaccaccgggctcatgtacagacccatgattgtctttaccagatgagcctcagcctgcagagccagggttttacttcttttctgtgccctactccggatcagttcagggcagaggtcgcatggcctggagattggcctgaggcccgggcaggagaggcgccagcagaggcaccagcagaggctcccgacgaggcagatgaggcccgcgaggacgaggagatgaccgatttacttgatttcttaggagggagcggggccacatga

SEQ ID NO: 64822 - DNA, 1092 bp, Glycine max
  Peptide Sequence Number=SeqID_181600
atggatttccccaagtggcagctgatggtcgtagctctaattgctttagcacttgcaactgcacttgggattgaactattagctagacttcaccattgtcatttggttcctttgcttggatactgctccgagttaaaaggaaaacatgttcagagattactagtatttgactacatggccaatggaaatttgagggactgtttagatggagtttctggaaaacatatcgattgggccactcgtgttatgattgcaataggagctgcaaggggcttggagtatctccatgaagcagctgctccaagaattcttcatagagatgtcaaatcaactaacattcttctggatgaaaattggcaagcaaaaataactgatcttggcatggctaaaaacttgagatctgatgacctccccagctgttcaaattctccagcaagaatgcagggaacatttggctattttgcacctgagtatgccattgttggtagagcttctcttgagtcagacgtctttagttttggggtggttcttcttgagcttatcagtggtcgccatcccatccataaatctacaggcaaagaagaaagcctcgttatatgggctacacctcgcttccaggatagtaggcgagtaataacggagttggttgatccccaattgaaaggaaacttcccagaagaagaggtgcaggtaatggcatacttagcaaaggagtgtttgctgctggatcccgacactcgaccaaccatgagcgaggttgttcagattctttcgagtatttccccgggaaaatctaggaggagaagaaacattccagccagcctctttcaggaaccagaagatgcacaaaagcaaaggcaagctccacctagtaaatttccaacacatagttcaatgccaatatataatgatcacaatctttctgttgagaacaaaaataaagcagaagatgcactttcagctgagtatatggagagtttgatcctcttgacttcgaaatctgatggctcttgtgcatcagaagaggaaatagtagacctgactgagcctaggtttgaatcattttgcatcacaaatggcaatgtcccatga

SEQ ID NO: 64823 - DNA, 120 bp, Glycine max
  Peptide Sequence Number=SeqID_181601
atgggaggacgtgttttcaagggatttctctataatcaaggtcctgaaagtttttacagtactagtgcagtagcggagggttcatccagtggcacaaatctcaaaatatacatattttaa

SEQ ID NO: 64824 - DNA, 375 bp, Glycine max
  Peptide Sequence Number=SeqID_181602
atgttgctgctttactctttgaagaggacacaaaattggaggttgagacagcggattcgactctacaagaaaggtagaggtaccccatcatcaattcaagtttgtggctttctaatgaatgaatcaaggggtgtcggagatgaacatagaacaaggattgcaaaaatgtgcatctgtttcatccatggtgtcgcagaggtagttggtgtcgagggtcatggctacgttgatggtggcagagggagaggagccacagtcctcgccggcggggtcctcccgaaagagagggagctccggggaaagatgactgacatcaataatttaacggtgttaaacaattttaacagtagagatctattgggaattaaatggtaa

SEQ ID NO: 64825 - DNA, 1032 bp, Glycine max
  Peptide Sequence Number=SeqID_181603
atggcttccgaaaaccttttccattgtacttcattggctttgcttctcttatttggattttgggctttcagcgccaatactcgcactctcgaagatgcttcaatgcatgagaggcacgagcagtggatggctcagcatggaaaggtctataaggaccatcatgagaaggagttgagatacaaaatatttcagcaaaacgtgaaaggcatagaaggctttaacaatgcgggaaacaaatctcacaagcttggtgtcaatcagtttgctgatctcacagaagaggaattcaaagccataaataaactcaagggttatatgtggtctaaaatatcaagaacatccacgtttaaatatgaacatgtgacaaaagtaccagcaacactggattggagacaaaaaggagctgtcacgcccatcaagagccaaggcctcaagtgtggatcatgttgggcatttgctgctgtggcagcaacagaaggaatcaccaagctgactactggtgaattgatctctttatcagaacaagaacttattgattgtgacacaaacggtgataatgggggttgtaaatggggcataatacaagaagccttcaaatttatcgtgcaaaataaaggacttgccacagaagcatcttacccttatcaagctgttgatgggacttgcaatgcaaaagtagaatccaaacatgtggctagcattaaggggtacgaggatgttcctgccaacaatgagactgcacttctcaatgctgttgcgaatcaaccagtttctgtacttgttgattcaagtgattatgattttcgattttattcaagtggtgtcctcagtggatcctgtggcactacatttgatcacgctgtcactgttgtggggtatggagtaagtgatgatggaaccaagtattggttgatcaagaattcatggggagtatactggggtgaacaaggatacatcaggataaaaagagatgttgctgctaaagaaggcatgtgtggcatagcaatgcaagcttcttaccccattgcataa

SEQ ID NO: 64826 - DNA, 777 bp, Glycine max
  Peptide Sequence Number=SeqID_181604
atgaatcaagataattttcatggacaattgacacctggtggtattgctgggcctaatgttctaatgcaaccttttgatcctcaagatgtgtgcctattggagaaagggatagggactgagattcccgatgttgtacattgcgctgttttcaggactggtgctgtgaatgctgcatctggatctgcttatgctgaggttggaaataccaaggtcattgtatcagtatttgggccaagagagagcaagaaggcgatgatgtacagtgatatagggcgtttgaattgcaatgtcagctttacaacgtttgcaactccgattcgtgggcagggttcagaccacaaagagtacagttcaatgcttcataaagctttggagggagcaataatactggaaacattccccaagacaactgtggatgtctttgcattggtgctggaatctagtggcagtgatctcccagttgtcatatcatgtgcaagccttgcccttgcagatgcgggaataatgatgtatgatcttgttgcctcagtttctgtgtcatgttttaataagaaccttgtcattgatcctgttttggaggaggaaaatggccaagatggaagcttaatgattacttgcatgccttctcgctatgaaatcacccaactcactgttactggggaatggtccaccccaaagattaacgagggaatgcagctgtgtttggatgcttgtgcaaagcttgcgaagattatgaggtcatgtttaaaagaagctgtttcggattcccaggaatag

SEQ ID NO: 64827 - DNA, 114 bp, Glycine max
  Peptide Sequence Number=SeqID_181605
atggcagaacttgagtcctttgctggtgtagatgctgtcaaggattcacacctttctacttcagaggatctagattcagaatgctatcacagtatcacttggaagcttaattga

SEQ ID NO: 64828 - DNA, 489 bp, Glycine max
  Peptide Sequence Number=SeqID_181606
atggttattgactccattctgacatctcctcgtctcaactctccatctttcaggaggcagtttaaaaaggatgaactgggtagttggtccacacttttccagaggcatcgcttccttttatctactcttgttctgataactctcctctgcactatttatctttactttgctgtcactttaggggctagtggcacctgttctggtttgactggagcgcagaaaacttcatgccatatggagcttgttaaggattctgtggccaagggttatttaacatttaacatcagtgctgacgtaagctctgatgtagaaattacatatttttacatcgatgcttatgtcagcaacgatgtggaaacatgtaatttttacatcggtgcttacgccagcaccgatgtgaaaacacgcatttgttacatcgtttatgacgtcagcaacgtagtaaataatgatttttcaaagacggtggtctacttaggaccgatgtag

SEQ ID NO: 64829 - DNA, 1338 bp, Glycine max
  Peptide Sequence Number=SeqID_181607
atgggacagttgtcacaactgcagaaacttgttgcctcgcataactcactggaagggaaaattcctacaaacttcacaggttgcacctgtctcaaaggcttatacttaaatgggaacaatctgattggcaaagtatcagtcaaagttggctcacttggaaagcttcaacatttgatcaactttgaaggagaccttcctcaagaaatatgtcatctcaaaagcttgacaaagatagcattggatgtcaacgtattgactggaacatttccttcttgtctttataatacgtcatctcttactgtaatctcagccgctgcaaatcaatttaatggccctctttcacccaacatgttccacaccctccctaatctccaagaaatttatattgctgacaatcaagtctcaggtccaatcccaccttccatcacaaatgcatttatcctttcaagacttgagatcagtataaactatttcacaggacaagttccaagtctaggcaagctacaaaatcttctatatctaactttggagaaaaataatctaggtgacaattcaactgattatttgaagtttttaaaatcattgacaattaggaaaatcccaagtcccacatcggctaaaaatgaagtcaagagaaatccctacagcaacatagggaacttcagtcaattgtttcaggaaactgtgccaaaaattacaatacttaatctctcaaaaaaccaccttacagatgtgtccgagaatcaactgtcaggtgacattcctggaactatcagagaatgcagaatgttggagtacctctatatgcaagggaattctttacagggaatcataccatcctctttagcatcactcaaatgtctcaaatgtttagacctgtcacgaaactgcttgtctggatcaattccaactattctgcagaacatttctttcttggaatatttcaatgtaacatttaacattttggatggtgaggtaccaattgaaggtgtctttggaaatgcaagtcggttagtggtgattggaaacagtaagctttgtggaggaatttcagaactgcatctaccaccatgcctcgtcaaaggtaagaaacttgcaaaattcaggttggtggcagtgatagttagtgtggttgcttttcttctcatcctctcagttattctagcaatctactggatgaggaaaaatagtaagaaaccatctttggatccaccaacaattggcgagttggctagagtttcataccaaagcttacatgacagaacctatggattctcaactacaaacttgatagggtctggaattttagctctgtctgcaaaggaactcttgagttag

SEQ ID NO: 64830 - DNA, 246 bp, Glycine max
  Peptide Sequence Number=SeqID_181608
atgaggagatatggaacccttcaagttgtaccctcgcaagttcagctatgtaaccctttgaagcatgggattgcatgttattccatgccagttacaaaaagtttgttaattgaagaagaagcgcatgttattccttctgctgctgctttggttttgattaccgacataaaggccttactaatggccaataagaacatgcctgatggaggaaagaagacttcaaatgaacttccgttattaatttaa

SEQ ID NO: 64831 - DNA, 1272 bp, Glycine max
  Peptide Sequence Number=SeqID_181609
atggtactcatcactgcaccggtgacaacagtaccaacccaccacctattcttcgacgaaaacgttgatttaaagaacagcaagctacgtactttgccttctcccaaccatcaactcgagtttcgactacccttgcgccaccccattcacaacttccctaaccacacttccccacaaccccttactcaaacaactactttcactaagaagaagaaaaagaagaagagaaaaggggccacaacctctgacatattgcacttgatggaagctctaccctttcccgtacccattgacatctacacctctctcataaaagagtgcactgtttccggcgacccagaaaccgccattgagttggccacccacatctccaagagcggcatcaaacccccattgcccttcctcaataggattctcgtcatgttcgtgtcgtgtggtttgttggaaaatgcgcgccacatgtttgacaaaatgcgtgtgagggacttcaacacttgggcaaccttgtttgttgcttactatgataataccgattacgaggaggctacaaatgtttttgttaacatgttaacccaattgggtatgatggaatttcctccgtggatatgggcttgccttctcagggcctgtgcctgcactgtgaatgtacctttaggaatgcaagttcatggatggttgttgaagttgggtacctgtgatcatgtgcttctcagcagctccttgatcaacttttacgggagattcacatgccttgaagatgcgagtgttgtcttcgatggggtgtcacgacataacacgttgacttggacggctaaaattgttagtggttgcagggaaaggcatttctctgaggtttttgacgacttcaaggagatgggaatgcgaggggtgaagaaggactgcttcacgttttctagtgttctcaaggcatgtgggaggatgctgaatcaggaacgatgtggtgaacaagtccatgttgatgctatcaaacttgggctggtctcggatcactatgtgcagtgtagtttgattgccatgtacggaagatgtgggttattggaagatgcaaaacgggtgtttgagatgagccaagaggagagaaaggttgattgttggaatgctatgcttatgggttacatacagaatggtttgtacattgaagctgttaagtttctgtatcagatgcaggcagccggaatgcagccccgggaatctttgcttaaaaaattaagaatggcttgtggaagtattagctactcaaacatgaattaa

SEQ ID NO: 64832 - DNA, 936 bp, Glycine max
  Peptide Sequence Number=SeqID_181610
gcttcaaccaggagctgtttctttgctggttttgctgctcaaaggaattttgctgaggtaattgctaaaggggaggtccaaggaatggcaagcaggtttattggtatagggctcggtataggattgggtaactgcataggctcctccacaccccttgttcttgcttcatttactgtcttgacctggatccatatgtactgcaatctgaagtcgtatcagtccattcaattacggactttaaatccttatcgtgcaagtttggtttttagtgaatatctactgagtggccaggcacctccagttaaagaggtcaatgatgaggagccactatttccagcagtacccatattaaatgcaacttttgcaaacaaatacttctcagttcaggctggtgagtatcaggcacaatcaattgttttatcatctgaagcaaaagatgcagctgccgaaattgaacatcgtctgcagcttggatccaagctcagtgaaattgtcaacagcaaggaagatgtgcttgccctctttgggctttataaaaatgaaggctacatcttgtcagagtacatgggaaaattctgtgttgtgctcaaagaaaactgttcacagcaagatatgctcaaggcattgttccaggtcaattacctttactggctagaaaagaacgcaggaattggaggaagaggaaccctcaatgattccaaacctggtgggaggctgcatatatctctggattatgtggagagggaattcaaccatgtcaaaaatgatggagaattggtagggtgggtcacagatgggcttattgcaaggccattgccaaataggattcgcataggagacacaccaccctcaaactcactgcatgaggaagctagttggactcgagatgtctcggagattgagggcaatggtttgttctttgccattgattgttga

SEQ ID NO: 64833 - DNA, 966 bp, Glycine max
  Peptide Sequence Number=SeqID_181611
atgggcggcacttgcacgcccttctccgcctccttcctcacctctcttcctcttcaccaccgccttcaaccgtcgccgccacatttcgccgccgctgtacccctttgttccaaacaacaaaccccttctcacacctttcgccttttagccctccctctattatcccatggcaacaacaacaacaacaacaacaacaacaacggtggtagttggggcaacccctttgactcctccgattccaattcaaattcccaccacacccttttcctctccctgctatgctcctccgccctctgcttcttctgccacctcctccacgccaaactcgcaaaggccaaaactttgtctccctccaccaccgccgacacctcacttttctccgaacctgtttatgaagtcaaaggtggcaagtggaccaaactcgtccccgacctcaccaacgatgtctttgtctccgcacaacaaggcttcttgtcggagctatcatccctcaaagtaccttcacagctcgcaaccttcgtgtggctcaagtgcagtgacatcttcacgcgcttgatgcttccagaagggttccccgagagcgtgacgagtgattacttggagtattctctgtggagagcagtgcaaggtgtggcttgtcaggttagtggtgtgctcgcaacgcagtcgttgctttacgctgttggattgggaaaaggggctattcccactgctgctgctatcaattgggtgctcaaggatggaattgggtaccttagtaagatcatgttgtctaactttggacgccattttgatgttgaccctaaagggtggagattgttcgctgatcttcttgaaaatgctgcctttggtttggagatgtgtactcctgctttccctcagttttttgtgctcattggtgctgtggctggggcctctcgctctgctgcttctttgattcaggtgatgcaagtttttagtgtatga

SEQ ID NO: 64834 - DNA, 168 bp, Glycine max
  Peptide Sequence Number=SeqID_181612
atgattgaccccaattttgaggttgaacgaagccaatttcatcgcgtcagaatcgatgtcagcgatggaatagaggtcgacatggctttcgatggtggtaggcagtttgaagggaagacgagaaagacaaaatcatgggatggggtgcaattgggagtgcagaagtaa

SEQ ID NO: 64835 - DNA, 1020 bp, Glycine max
  Peptide Sequence Number=SeqID_181613
atgaattctcgtgaacagcctcagccacaacagccaccgcaaccacaaccgccaaacatgacggtgggacccaccatgtacccttcgatgttgtcccccgtcaccgccagattcccattcagcagcagcagcaacaacaatcctcctccttcggagcctctcaacaacgacaccaacgacaatgataacagcgcgttcgaggcgttgaagccttgcgcgctggccgcctcggaatcgtcgaagaagaagcggggccgcccaagaaaatactcgcccgatggcaacattgcgttgggcctcggcccaacccatgctcccgcttcctccgccgatcctcccgccaaaaaacatcgcggtcgcccccctggttccggcaagaagcagatggacgctcttggaattcctggaactggttttactccccatgttatcaccgccgaagttggcgaggatattgctgcaaagcttgtggccttttgtgagcaaggacctcggacagtttgcactctttctgctaatggtgcaacccgcaatgtcaccattcgagcaccagacatgcccgcgggtactgtggcctatgagggtccatttgaaattatatcacttaaagctgctacgctacaatctgacaataacagaatggctgcattgagtgtgagtttagcaggtcctgatggacgagtattgggtggtgaagttgttggagcccttactgcagcaacggcagtgcagatcgttctgggtagctttattgctgatggaaaaaagtctagctcaagttacctgaaatctggacgttctttgacaccatcatcccagatgttagcctttggtgcttctcggactccaactactcctacctctcaagggccttcaactgagtcatctgaagataatgagaatagtcattttagtcaggggccaggaggccctggactatacgataataatgctagccagccgattcataccatgccgatgtaccaacatcaattatgggctggccatactcagcagtga

SEQ ID NO: 64836 - DNA, 375 bp, Glycine max
  Peptide Sequence Number=SeqID_181614
atggaggaggcccgtgaagagcatcgggatcatgctctgggtgactttgaaccataccctatgttcaccgctgaggagccggcatgtagtggtatgccccaacccaataccacgggggctcctcaacactgcccgctgcaacctctgcacttctcagtggggagactccctccgaccgtggaaggaagggagaaattggatctcatcaaggagaggataagggccatcgaagggattggtgattacccattcgttgacatggcagagttgtgtttagtgcctaacgtcatcatccccctgaagttcaaggtaccggattttgataagtacaaagggactagttgccccaagaaccacctaaaaatgtattgttag

SEQ ID NO: 64837 - DNA, 972 bp, Glycine max
  Peptide Sequence Number=SeqID_181615
atgaccattgatgtgccaccatccggtgcccaaagtgtgaggacaaatagaccttcctttagttctagcaatggcattgaggctaccccagtacacaactatgcatctgttagcaatggtgatggttatgatagtgatggctccaattttgcgccacttacaccaacaactctatcaatggctattccatcagaacttgctggagctgttcccttgattgataaattccaggtggaaggattcttaaaattgatgcataaacaaattcaatctgctggaaaacgtggattcttttctaaaagatccgtgggccctcaagttcgagagaagtttacatttgaggacatgctttgtttccaaaagattctagaaaaactaactggcaaattactgcaggatccaatacctacatcaatgcttaagctgaatggtgacttggcaagccgagcaacaaaattatttcaaataattttgaaatatattggagttgatttatccgatcgtgtaactccaataagcttagaagaacaagttgagcttgttggtaaactatacaagcaaagtttgaagcgttcagaactccgagatgaactctttgtccaattatcaaaacaaacgagaaacagccctgagagggaatacttgattaaagcatgggaactaatgtatttatgtgcttcatccatgcctcctagcaaagacattggagcatatctatcagaatatgttcacaatgtggcatatggtgtgactgctgatcctgaaatccgagcccttgcattaaatacattaaatgctttgaagcactctgtcaaggctggtcctagacatataatacctgggcctgttgagatcgaagctctgttgacagggaaaaagcttacaactatagtgttcttcctggatgaaacgtttgaagaaattacatatgacatgtcaacaacagttgctgatgctgtcgaggttctttaa

SEQ ID NO: 64838 - DNA, 285 bp, Glycine max
  Peptide Sequence Number=SeqID_181616
atgtcccagctggggttgctagccctcaaggggaatgagaacggcgtggttagcgttcttgttgggcatgtccactgcattgggtggtgtatagttgggggtaaaccatatgggaaagcattcctattttaccctatcgcaacctacccatcggcgggagggcgatgcggggctcacgggtgcgtcttccaagaaaggaaaatgcacggagtcgccaccaatgtttatttaaggaaaatgttgaaaaaactggaaagctgtggtctacgaactttaagcgtgtaa

SEQ ID NO: 64839 - DNA, 414 bp, Glycine max
  Peptide Sequence Number=SeqID_181617
atggtcgatgcttttcggacacatataatgcaaacaaaagaacttggtacttgtcctgtgaagcagattggtggctgctctttcttttacatgaggatcagcaatgtttacatcgtgattgttgtcagcagcaatgctaatgtagcttgtgcttttaagtttgttgttgaggctgttgcactattcaaatcatattttggtggtgcctttgacgaggatgcaattcgcaataattttgtactcatttatgaactcctagatgaaatcatggactttggttatcctcaaaatctttcaccggaaatcttaaagctttatatcactcaggaaggagtgcgttccccattttcttccaagggagtagaggggaaacagctcatcacagatattcctgttcagaatgtgacttcacaa

SEQ ID NO: 64840 - DNA, 2495 bp, Glycine max
  Peptide Sequence Number=SeqID_181618
ttgcagcatgattatattttgggtaattaccctattggaagggatgatgctgcccagctttctgcattgcaaatcttggctgagattggatttgttagaagacctgaatcatgcgcacaaatagcaatgactcgagcaagacgggaatgggagttggacattctttcttgttatcattcactggcgcatgtgacaaaagaggatgctagacagcaatttctgcatatattgagaacacttccctatgggttttctgttttcttcaatgttcgcaaaattgatgatcctattggactattgcctggacgaataatattgggaatcaacaagagaggagtccattttttccgtcccattccaaaggaatatatgcactctgctgagttgagggacataatgcaatttggaagcagcaatactgcaggagaagaaatttgtgtagctcttcagacacacataaatgatgtaatgctgcgccgctattccaaagctcgatctgctgcgggtggtcctttgaatgaagacatttctaatgattttaagccttctaatttggaattatacgaaaaacgtgttcaagaattatcaaaacttgttgaagagtctcaaaggaatgctgatcaattgctggataacttgcgtgagaagcaaaaacaagaagaggaaatgctacaagaattagagggcttaaaaagatctttaacagctggcaagcagagtcttgcagaagttacaaatgaccgtgacaagcttaggtcattatgtgatgaaaaagacaaggcacttcaggctgaaattctagagaaaagaagcatggaagcaaagatggccgagttgagtaatctggttacaaagaacactaccaaaaaggactgcactcaaacaaataaccaagtgtcacagaaactcgaagatgacctaaaactatgtaaaggtgagctgcgtgtaactgaagaaactatcaaaagcttgagaagtgataagttgattttggaacagaagctatctgagcttgagaagaagagtgctgaagagattaattctcttcaatggaaacttgagcaagaacgcaaaactctgaactctaaagtgtatgaccttgaacgaaaactggatgtgtttagacaagaattaactgtagctgagtctacactctcggtcaaggactctgaattggctgcattgaagaacaatttagatgaactagaagaattgagagaaatgaaagaggacattgatagaaagaatgagcaaacagctgccatactgaagatgcaagcagttcaactagctgaaatggaattgctttataaggaagagcaggttctcagaaagcgatattttaataccatagaagatatgaaaggcaagataagagtttattgtcggttaagacctcttagtgaaaaagagattgcaagcaaagaaagagattctcttactactactgatgagtttactgttgagcatccttggaaagatgataaaccaaaacaacacatttatgaccgtgtgtttgatggtgatgccactcaagaagatatatttgaggatacaagggcaatgcaatctgctgtggatggttataatgtttgcatatttgcttatggtcaaactggttctggaaagacttttacaatctatggagttgaaaacaatcctgggcttaccccttgtgctactgcggaactttttagaattttaaggagagatagtaacaagtattctttctcgttgaaggcatatatgttggaattatatcaagatacacttgtagatcttctgttaccgaagaatgcaaagcgtttaaaattggatattaagaaggattccaagggaatggtagcagtagaaaacgtaacaattgtgtcaatttctactatggaggaattaaatagcataatacagaggggttctgagcagcgacatacatcagggacacagatgaatgatgaaagttcaagatctcatctcatactatcaattgtcattgaaagtactaaccttcaaagccaatcaactgcaaggggaaagttaagttttgtggatcttgctggctcagaaagagtaaaaaagtcgggctcttcaggtagtcaacttaaagaagctcaaagtatcaacaaatcattatcagcactaggagatgttattagtgctttgtcttctggtggtcaacacataccttacagaaatcacaagctaactatgttgatgagtgattcactagggggtaatgccaaaactctcatgtttgtgaatgtatctccggtagagtcaagcttggatgagacgcataactctctaatgtatgcatcacgagtgagatcaattgtgaatgatccgagcaaaaatgtttcttccaaagagatagctcgactgaagaaattgattggatattggaaggagcaagcaggaaggagaggagaggatgaagatttagaagaaatccaagaagaaagaccaactaaagagaggactgatggccggcattctat

SEQ ID NO: 64841 - DNA, 456 bp, Glycine max
  Peptide Sequence Number=SeqID_181619
atgtttgcactaggggttgttgttaaaattcctgtgccaaaacatactgccaaaacgagtttcacagtaacatctggccgagcaaagtataatgcgtctattgattgtttggtttggaaaataagaaaatttcctgggcaaactgagccaaccttgagtgcagaaattgaacttatttccacaatgacagaaaagaaatcttcgactagaccaccaattcagatggagtttcaggttcccatgttcacggcatctggtttacgagtccgttttcttaaggtgtgggaaaagagtggatacaacactgttgagtgggttcgttatattacaaaagcgggatcatacgagctcctccctgaaaaagataaatgtgggagtgatagcaatactataccagcacataatatgcccaagaggatagtcaataagccaacatacctcagagattacgagtga

SEQ ID NO: 64842 - DNA, 1951 bp, Glycine max
  Peptide Sequence Number=SeqID_181620
ctctgctccgcttggtggttcagtctatgtgaagaagaagcggaagaagagcattgcagggttgagaaaagccttccagaggagtctctccgagaagaagcgcccggtggggaggaaggggaagacggaggcgaagaacgagcgcgaaaccggtagcaatgtgcagtgggcgctgggaaaagcgggggaggatcgtgtgcatgtggttgtatcggaagaacagggttggctgttcgtggggatttatgacggtttcaatggccctgatgcgcccgagtttctcatgggtaatctttaccgtgcacttcacaaagagctccagggtttgttttgggaacttgaagagccagaaccagagccgcagccgcaggtgcaggcagtagagcataatgaagctgaatcccacaatgactgggaggttgaacaagagtctaattctaattctctccaaggatcggttaagagagtgacgtttcatgcggaggggactgagagtaggagaaggaggttgtgggagtttctggccgaggatgatgatgatgctgaggacggccttgatctttccgggtcggataggtttgccttttcggtggatgatgctctcagtgttagcaaggagggttctggaggtagtagacggtggttgattttgtctaagttgaagcatgggttgtcgaggcataaggagggtcatgggagaaggttgtttccgtggagcttgggcgtgggggcggaggagaaggagaaggttgaggaggaaaatccggtggcggaggaggaggaggaggaggaggagaagggtcgcggtgggaggaagaagaaggtggggcctgtggatcatgagttggttttgagggcgttgtctcgggcgcttgagatgactgagcttgcgtatttggatatgacggataagcttattgataccaatccggagcttgctttgatggggtcatgcctgttggttgtgttgatgagggatgaggatgtctatgtgatgaatgtcggggatagccgtgccattgtggcacattatgagtgtgaagaggttcatgctagtaaggaatccggaggcggtgcagacgttgagtcaagcggggagtgcatagtggaggagaacttagctcgggatgaaggtggtgtggtgttgaggaatgagggtcctgctcaggaaaggaggtttctggaatttcatactggtattcatctactgttaatgatacttcattttcccattaagttttactactcctctcttcatgaagttgttaggattaagaatgagcaccctgatgataaccaatgtattgtaaatgatagagtaaaaggccgtcttaaggttactagagcttttggagctggatttttgaaacagtataccgaacttcccactctggctatggaagagatgtttcatgcaacctcactttttttagtgtggcactgctgcacatgtccattctcatccacactcagaaaatggaaccctgcttgtttatcatgcctcttgttcaaggcttcaatgcataaacttcttaaatattgtatgcaaatgtatgctgacttgatgtggaatgatgtagtactagaaatgtttcgaaatgaatatattggcactgctccatatatatcctgctgtccttcattacgtcaccatagattatgcccaagagaccagttcttgatcctctcatctgatgggttgtatcaatatcttagcaatcaggaagtggtttctgaagttgagagtttcatggaaaagtttccagatggagatcctgcccagcatttaatagaggagctgctcctacgtgcagctaaaaaagctggaatggatttccatgagttgctggatatccctcaaggagatcggaggaagtaccatgatgatgttaccgttatggtggtatcacttgaaggaagaatctggaaatcatcagggaagtatccgtga

SEQ ID NO: 64843 - DNA, 1497 bp, Glycine max
  Peptide Sequence Number=SeqID_181621
atggttcccaaagtttatgctggtcaggaaatggcagtggttgagaatgagaattgcatgatgaatgggaagtggaagaaacgtgtgcatgtttttggtgagagggtgatgagatttcctaacaaggcttggcagactacgtggaaagtgggacgtgaagacccaagaaggttgatccatgcattcaaagtgggggcaactttatgcaaaggactcaacagaggattggggacattgttagcgggattattggcatttcttgttgggtatattgcaagtgcatctggccgagtctgtcaagctattatcatcggagctgcagttttttctataggagctcttgctacttatatgaggtttattccctatataaagaagaattatgactatggtctagttatatttctcttgactttcaacctgattgctgtgtcgagctaccgggctgaaaatgtcttgaaaattgcacatgatcgcgtatacaccattgccataggctgtgctgtttgccttctgatgagtctactggtatttccaaattggtcaggcgaagatctccataattccacggtttacaagctcgaaggccttgccaaatctatagaagcttgtgtgaatgagtacttttacggagaaattgaaggctctggggatatgaaattatctgaggatccaatatacaaaggttataaggctgttttggattcaaaatccattgatgaaacactggcattgcatgcaagttgggagccaaggcattcaaggtactgccacaggtttccatggcagcaatatgtaaaagtcggagctgttcttcgtcaatttggttatactgtggtagccctacatggctgtttgagaacagaaattcagacacctagatctgttagagccatgttcaaggacccctgcattcggctagcagcagaggtatcgaaagtactgatagaactttccaacagcataaggaatcgccggcattgctctccagaaatactctcggatcatctgcacgaagccttacaggacctaaacactgccataaaatctcaacctcgactcttcttaggccccaaaaacaggcacaaccaagccaccaacatgctcaaaatagctgccgaacaagttggacaagaaagacatggaaagacctccctttcaagtgttaaaaccgactcttcggcgttgctggaatggaaaacaaaaagggtttcagttgaacagacaaaggaatcagaaaggaagtctttgaggccgcaactgagtaaaattgcaataactagccttgagttctctgaggcgcttcctttcgccgcctttgcgtctttgcttgtggaaacagtggctaaactggaccttgtcatagaggaagttgaggaactggggagactagcatgctttaaagacttcatacccggggatgactttgttgtcacttgtcaggagcctcgaattgacgtgtcacagaaccatttaccttctcatggagccgactaa

SEQ ID NO: 64844 - DNA, 279 bp, Glycine max
  Peptide Sequence Number=SeqID_181622
atgatgtctctgatgctatcggacttgatcgtttttggacagcagaagaggttcttggcgtgtcatcttactggattgtccttggataacaaaaagtggttggccgcctactggtggcgacgtgtcataagcaacgctctaacctctgtagacgagctgaggaggactctggaggtggtggcgatgcgtctgttgcctactgctgatcatccccaggctgctgtggtgcctcaccctacgcctgctgatataaccctatcccccaagggtattggatag

SEQ ID NO: 64845 - DNA, 309 bp, Glycine max
  Peptide Sequence Number=SeqID_181623
atggcttttcttttagatgaagattctaatggggcaatagatcaagaggacttgaaaaagtgtacgtccaacgatgttctaatggctaatagctgtacaactttcagcgtatcatcatgtgtaactcaagacaaaaataacaaagacaagttaaatgagcaccttaccttattccaatcgaatagcaaggggcaccaaaatagtgtgcttcatggctgctacaaatgcgtcaatttttgcatcttcaacgcaaccatacttgctatcctcgtacaccttagtctgaacaagttaattagttatagatga

SEQ ID NO: 64846 - DNA, 363 bp, Glycine max
  Peptide Sequence Number=SeqID_181624
atggagaagtttggagatagattgatacttttctttttggatctggcatttgatttgtccctttacgcttttcttggggataacatctacagtttcggagagctacttgcccatcctataatacgtaatgtttctgttcctaaacttacaagacagctacccctccgagaccttcatgagcttttgtttttactgcaacaaaaatcttgggcacgatatggacatctacatgtacagttgccttggcttgattcattttggggacataaaagtggtcctttccttgaagatcctagatcactgtacatggttttgttctttctttttctcagtggtagtcctgtagaaggtagaaaagattga

SEQ ID NO: 64847 - DNA, 441 bp, Glycine max
  Peptide Sequence Number=SeqID_181625
atgcaggttgatagtcggagtcattggtcttggatgttcaacaatatcttggatcaaagagagaaagtcagactgaaacaggaatggaataatcagatacagagagataaattctcgatgaaaactatgtataacctgctgatggataaatctgatcggattcttgaatggattgaagttactcatgaacctagaacttgggatgtagaactcaagtgggctattcgagaaactggaaagaaagggtggaaagctaaactcctgaaactagcattcactgaaactctttacgaggtgtggttatatagaaatgatgaagttttcaagaataatgtgaatagaaatatagttgataatatcatagataacatagtatacaggggctggatgctggtgggatctcatgagatcgccatgtacttatctgactttttgaattaa

SEQ ID NO: 64848 - DNA, 366 bp, Glycine max
  Peptide Sequence Number=SeqID_181626
atggagttgaacttgcggttgcattctaaaccttttaacagtgtaaaactacatatcttcattaaaaagaaagttttaaaagccaatgctgagaaggaacactatgccggtagggaccccatcactgcattgaagaaatacctttttgagaacaatttagccaatgagcaagaattgaagaccatagagaagaaaatcgatgagatcctcgaggacgctgttgagtttgcagacaaaagccctcttccaccccgcagtcagcttctggagaatgtctttgctgatccaaaaggctttggaatcggaccagatggaagctatagatgtgaggatccaaagttcactcaaggcacagctcatgtctaa

SEQ ID NO: 64849 - DNA, 1119 bp, Glycine max
  Peptide Sequence Number=SeqID_181627
atggctacgacggaagaaactcggaagaaggaagggagcaacttgctaggctccccgaatttcacagaattaggaaacgggcgtttcaagtgcttagaaacagggcacgaggtcctctcgaaggacatagcgttctactctcacagcaaaaaatgccgtttgggtctcatcgatttcgccttgtccaataacaaaccccctctcaacatgttcaaacaagaccctctctgccgttcaaagttgatatgtaagctgactggagacaatgtcaataagtcagaggaacatatctggaagcatatgagtgggaaaaggtttctcaataaattagagcaagaggaagaagaaaagttgttgtgtcatggattggaaggtggagagagcttacatgagtcaaaaagtgcagatggtggaaaaaaggatagaatgatgaagaagaaaaagaataaaaagaataaggtcaaggaaattgatgaggagaaatcgcaggtgtcaaaaagtgcagatggtgcaaaaaaagatagaatgaagaaggaaaataataaggacaagggaattgaagaggttatatctgaagttaggaagtcttccaatgagaatagtgacacagaagaagacttctggatgcctcctgctggtgatcgttgggacaatgatgatggtggcgatcgatggggttcagagtcagagtcagagcagggaactgaagagggagatgtaattgtagatgatgttttcctcatagatggtgatgctgctgaggattgcaaggagtcggaagagttgtcatcaaggacgaaaagaatgtcgatagaaattggaccaagcagctttgctacaagaaaaaagaaaatcgtcaaagaggttctcttcaatgacgctaggaacaagtggtttctcttcggtgacgatgacaacgttcctttaggcggcggcggggatggtggtggcgagcttcttggcaaaatccggcgacgtttgcgcggtcttggagacgtagccagtgaaattgaggaagatagagaagacaaaatcgatgtcgaacgggtgtggtcacaaggattgaatgaaggaatggggaacaaagaacttttatttcagaataattatcaagcatga

SEQ ID NO: 64850 - DNA, 828 bp, Glycine max
  Peptide Sequence Number=SeqID_181628
atgccacctaacagtaacactctctttcacactcacgccttcgttgttacaccctcttcttcttactcttccgtgcacaccctgaaactgcaaaaacctcaagtgaaacgattcgttttgctgttcgcatacccaaggcgttcgcgcacgtttctagaaccttctacttcttcttcttctttctctcctgtgaggaaaactaaggaagtggctgaagaatatgtttaccctcccgaaaacgatgacgttttggaggacgaagaagaacgagagaagaggcttggaaaagcgtgtgaagtgtacgtgtgcaacctgccccgaagctgtgacgcagcatacttacttgatatgttcaggccttatggaaccattctatctatcgaggtttgccggaatgctgagaataatgaaagtaaggggtgtagctatgtgacactgggatccatacactcagcaagaaatgcagttgctgcattggatggatcagatgttggtgggtgcgaattgcgggttagattttcaattgagatgaattctagaaggaggagttttaacaaaatgaactcttcaaccaagagaatttcatattatgaatctcctcataagctgtatgttggcaatcttgcaaagactgttagacccgaacagttgagagatctcttttgcagatttggaaatatagttagtgcaagagtgttgcgtgattttaacaagggaacagccgagtctatgcctttctctcctttcaatcagaggcagaaatttgttactgaattttatggtcgtacactaatcgttaaagagggtgtagagaggagtgaggactga

SEQ ID NO: 64851 - DNA, 2079 bp, Glycine max
  Peptide Sequence Number=SeqID_181629
atggatgagttgaactgcgcgatgacgacgacgacgacggagaatagcaatgcggagctggttcaatgggagaggtttctgccgcggatggtgctcagagtgctgcttgtagaagctgatcattccacgcgccaaatcatcgccgcgcttcttcgcaaatgcagttacacggttccggatggattaaaggcatgggaaacattgaagaagaaggcatctgagctagatctcatattaacagaagtggagctaccagcaatatctggatttgctcttctttctttaatcatggagcatgacatttgtaaaagcattcctgtcataatgatgtcttctcatgattcggttaacatggcgttgaaatgcatgttaaacggggcagttgattttcttataaaacccattcgcaagaatgagcttaggaacttgtggcaacatattatcactcctactcaaaatacaacattttcaccgaaaaaacttaaaactgcctcagaagacaattctgcaagcaataaatctaatggttctgtggcttcctcaaagaaaaacaatgaatgcagcgagagattaagtgaggctcaaagcacttgtacatcaccaattatggaagctgcgagtacatacatggaaaatatgcaggatgtgtcccaggatgtacattgccaagttatgcaaactcatgtgcagagcacttgtgcatccccaatttttgaagccgagagtacatttgtggaaaatatgcaggatgtgccccagctggaaagttctaaactgaacaaaattgatatggtggaccatgaaaagtttgccaaatttgaaaggaaatcagctaagcataatgatgaaacagaggaggctgcaaggtgtgacaaaagttttgaattgacagatttaatgctagaacaagactgtggtgttgctgaacctgaaactgaaaacgaggatgaaatcttaaaatctgagttaggcagagacaattctcatgtttctatattgcatggatgcaatgctgagcaggtgaaaccttctaaaggagctattgacttgattgccacatttggaaatcttccaaagcaccctaatgaaaactgtagtctcaatggtggtaatacaaccaagtttgattgtgaaacgcaattggaactttccttaagaagtgattttcctggcagctcaggtaaacaagcaagtgaatcaactgaggaatctcaaagattgaaccattcaaatacttctgccttttcttggtacagtaatagtaaattgttgcagcctcttttttcaccaccatcgattacatctcctaaagtaaactggctcaattgggattctcatgaatgccttaaattatctggaaattgtcagtatgacgactcaaatcagaacctggagaatatgatcagtacagtcattggtcagtatggactcttacctgtttcaggagttatctccaagcttaagtctgagggacatggtcatgtttttacttctgttttctatgcacaatctggcattcaccccatgttgagtccaaaaccagtctgccagaatgagagttctccctttcccacaagtacctcctcccagtccaatcctgaaagtcactgctcagatcaacctcatgactgttccaatgatgctacttgtcttgatcaaaatgtaaaggataatactgattcagatcacgcaaggcatgagtctcctgctgctgatcagagtgctggtaataatttatgccatgatgctgcaaatcatgttaatagtagtgcatatggaagcatggacagtggaaatgatggacatgctacttcagctatagtatccaagaacacctcagatggtttcagtgatagtggttgtcataattatgatggatttagagtgacagattctcatcgctccagtcaaagagaagcagcactagtgaagtttcgactgaagcggaaagagagatgcttcgagaaaaaggttcgatatcaaagccggaaaagactggcagagcagcggcctcgggtgaaggggcagtttgtacgacaacataatcatccattcgctgaggctggtggtgattcatga

SEQ ID NO: 64852 - DNA, 231 bp, Glycine max
  Peptide Sequence Number=SeqID_181630
atgagccccaagagagaagatgctaaagatgaacaaccagaaataaccgaaggtgatgtggctcgatttgagacctttcatggacgtttggataaaattaaaacgatcaagtttctgcttgcaatgcaaaggagatacttgttaattcaattcttttcggagtttggatcatgcatcttcaagtcccacatcaacctagacatggtgtgtcccacaagtgcacattattga

SEQ ID NO: 64853 - DNA, 759 bp, Glycine max
  Peptide Sequence Number=SeqID_181631
atgtggagaaagattagttgtgaggaaggggaatgcaagaagctaagagaagcatgtgaaagatggggttgtttgaggatcattaaccactctattcctgcaatcctcatggctgacatgaaaaaggtcgttgaagctctgcatgaacttcctatggagataaagaaacgcaacacagaagacattgctggaggtgattacgtgggaccaaatgcattcagccctttatatgaggccttgggcctctatggcttgtgttcctcacaagccatgcacaatttctgttctcaacttgatgcctcgcccaaccagaggcaaatagtggaggcatatggcctatcgattcatgatctagcagtgaacataggacaaaagatggctgaatctcttgacctagttgttgctgatttcgaggactggctattcgagtttaaatttaacaaatataacttcaccccagaagcaatagggtccactggagttccaatacacacagactcaggcttcctaaccattctcaaagatgatgaaaacgttggtggtcttgaagtgattaagagttctggctcttttgtgtcaatccctcctttcccaggaaccttcctagtcaatcttggagacattgcccgtgtatggagcaatggaaggttttgcaatttgacacaccgtgtgcaatgcaaggaagggagcaaacgtctttcaattgctacattgatgttagcacccaagaataggaatgttgaggcaccagccgaatag

SEQ ID NO: 64854 - DNA, 1497 bp, Glycine max
  Peptide Sequence Number=SeqID_181632
cccttggggttcgagatcgcgcccaacgtcacgcgcttccacgtgctgtgggtggattacgacggtgaccggaaggagattgacgtgtacatcgcggagcagccagataaggatgttcccattgttgcgaaaccggcaaagccggttttgagttcccctctagatcttaaacaggtcctgaacaaggtttcttattttgggttctcagcttccaccggtgacaacgttgaactaaactgcgtgctgaggtggaacattactattgaggtgtttcctaaaaagaatggaaatggaaaagcatataagattggtttaagtgtcgggttgactctgttggttcttattgtggcgggtgttgttgggtttagggtttattggatacgaaagaagaaaagggaaaatgagtctcagattttgggaaccctaaagagtctacctggaactcccagagagtttaggtatcaggagctgaagaaagcgacaaataatttcgatgacaagcataagcttggacagggtggatacggcgtcgtttatagagggacacttcttcccaaggagaatcttcaagtggccgttaagatgttctccagagataagatgaaaagcactgatgatttcttggccgaactcaccattatcaatcgcctccgtcacaaaaaccttgttcgcttactcggatggtgtcacagaaacggggtgttgctcttagtgtacgattacatgcctaatggaagtttggacaaccacattttctgtgaggaaggtagcagcactacaccactaagttggcctctaaggtacaagatcatcacaggggtggcttctgcattgaactacctacacaacgagtatgatcagaaagtggtacacagagaccttaaggccagcaacatcatgctggattcgaacttcaatgcccggttaggcgacttcggcttggcgcgggcattggagaacgataaaacatcatatgcagagatggaaggagtgcatggcacaatggggtacattgcgcccgagtgctttcacacggggagggcaacaagggaatctgatgtatatggttttggagcagtgttacttgaggtggtgtgtggtcagagaccatggacaaagaatgaggggtatgagtgcttggtggattgggtatggcacctgcatcgtgagcaaaggatacttgatgcagtgaatcctagacttgggaatgactgtgtggttgaagaggcagagagggtcctgaaattgggactggcatgctctcaccccattgcaagtgagagaccaaagatgcaaactattgttcagatcttatcaggttcagtgcatgtgcctcatcttccacctttcaagccagcttttgtgtggccagctatggatctttcaagccttgcaagtgacctcacaacacaaactacaacaactgagtacacacccatgagcagtgacacacattctatgcatgttcaattctctgatagcagctctctggtctaa

SEQ ID NO: 64855 - DNA, 543 bp, Glycine max
  Peptide Sequence Number=SeqID_181633
atggcactcaggatgtgggcttcttccactgccaatgcactcaaactctcttctgtctccagacctcatctcttgcctcctttttctttctccagatgcttatcttccgtcttggatggacttaagtacgctgattcacatgaatgggtcaagcacgaaggctcagtcgccaccattggtatcactgaccatgcccaggaccatcttggagaggttgtgtatgtggagctgccagaaccaggtggcacagtttccaagaagtctggcttcggagccgttgaaagtgttaaagcaacaagtgatataaactctccaatctcgggggagatcgttgaggttaacaaaaagctcacagaaacgcctggcctgtttatatacagctcatatttatttttctacttttcccactttaaggtcaactcaagcccatacgaagatggatggatgatcaaagtaaagccaagcgatccatctgaattagattccttgatgggtccaaaggagtacacaaaattttgtgaggaagaagatgcaagtcattaa

SEQ ID NO: 64856 - DNA, 285 bp, Glycine max
  Peptide Sequence Number=SeqID_181634
atggatagcaaatcaccgagcaataaggcatctgaggagctgtcacgtgagttgcttattgctatatctgattctttaccagataaaattctggattcagattttgtgcctgaaagcaaggacacagacggatttgcaagaccaaaaggtgattggcatgacaaatttaggatggagagaattaatccagattgcccagtcacttacctaccagttccaaggccttcagacaactggtctgcaagaattataaaaggcacacaattaaatcatgggattcattag

SEQ ID NO: 64857 - DNA, 1057 bp, Glycine max
  Peptide Sequence Number=SeqID_181635
ttactgtgtggatagttccctggataagaccaaggccaaaggaaaggttcttgtgtgtcgacatacagagtattcaggggagtcaaagttggaaaagagtaagatagtgaaggaggcaggtggtgttgggatgatactcattgatgaagcaaatcaaggtgtttccaccccatttgtgataccttcagctgttgttggaacgaaaacaggagaacggattctatcctatatcaataggacacgtatgcctatgacaaggatttccagagccaagacagtactaggagttcagccggcaccctgtgtagcagcattttcttctaaaggccccaatacattaaccccagaaattttgaagcctgatgttacagctcccggattaaacatccttgcagcatggtctccagcctcagctggaatgaagtttaatattgtatcaggaacttctatgtcttgtcctcatgtaactggaattgcaaccttggtcaaagctgtgcatccttcatggtctccttctgctatcaaatctgccatcatgacaactgatactgagcaccaccactcaaaaactaacaggtttgtgaacccctcaagagttctggatcctggtcttgtatatgattcgaatccagaagattttgttgcgttcctttgttcacttggttatgatgagaggtcactccaccttgtcacaaaggacaacagcacatgtgatagggcattcaaaacaccatctgacctcaactatccatctattgcagtgccaaatcttgaagacaacttttcggtaactcgagttgtgactaatgttggaaaagcaagaagtatatataaagctgtagtggtgtctcctactggagttaatgttactgttgtgccaaatcggttagtcttcacaagaataggacagaagatcaagttcactgtgaatttcaaagtggctgctccctcaaagggctatgcattcgggttcttgtcatggaagaatggaagaacacaggtcacgagtcctttagttgttaaggttgcaccagcaagtcatgggttggtgagataa

SEQ ID NO: 64858 - DNA, 694 bp, Glycine max
  Peptide Sequence Number=SeqID_181636
atgccaggagtggtatctgttttccccaattctaaaagaaagctgcacaccactcattcatgggacttcataggacttttggacaacgaaagcatggagattcatgggcattccaccaaaaaccaagaaaatataatcattggtttcattgatacgggaatttggcctgaatccccaagttttagtgacaccgacatgcccccagtgccccggggatggaagggccattgtcaattaggagaagcattcaatgcttcatcatgcaacaggaaagtgataggagctagatactacatgagtggacatgaagcagaagaagggtcagacagaaaagtctctttcagatctgccagagatagctcaggtcatggtagccacacagcttccacagccgtgggacgctacgtggcaaacatgaattacaagggtctaggagctggaggagcaaggggaggtgcccctaaggccaggattgcggtgtacaaagtatgttgggactcaggttgctatgatgtggacttgttagcagcatttgatgatgccataagggatggtgttcacattatgtctttgtccctgggtcctgaatctccccaaggtgactatttcgatgatgctgtatctgtggcttcattccatgctgctaaacatggagtgctggtggtagcatcagttgggaatcaaggaaatcctg

SEQ ID NO: 64859 - DNA, 195 bp, Glycine max
  Peptide Sequence Number=SeqID_181637
atgttccgtatagccattcttagcccaatcaagttcaaccgccaataccaatcaattgcctgcttgaatcgttgttttgaggttgggagagcgagaacacctgttcgcggatcaagtttgttagcattgtctcccacgtgcatgaatggctctaacagaattcctatagtgcctatcccaccccctcagatataa

SEQ ID NO: 64860 - DNA, 216 bp, Glycine max
  Peptide Sequence Number=SeqID_181638
atgcatgtcttcaaggaagaaaatgagaacttaaagaacctttttccattggggctttccaatccaacaatgttcatcatttgggatggtcatcgccaaggagtcgcctttcaaacatggaatagaaagttgactcaatcaaatggtgcaggcattgttgagggctttggcagaggaaatcttttgttgtttagggatcgacaaggatggggttga

SEQ ID NO: 64861 - DNA, 414 bp, Glycine max
  Peptide Sequence Number=SeqID_181639
atgagccatgggcgtttgtatcaacgaaggataaagaacgcattcgacaagaaggtacgcccgcgcaagttcaacgagtgggacctcgtgttgaagaagatgtcccacgctgttaaagatattcgaggcaagtgggccccgaattatgaagggcctttcgtggtgaaaagagctttttctgggggtgctctgatactcacccacatggatggcgaggaattgccttcgcccgtgaactccgatgggcagggccttcttaggtcaacagttaggagtcaagacaaattgactgcggaaatcaaccaaggtacatggggacagatgcaagtggggatagggtcacgaccgaccggtcgttgccccttcccggcggttagctcgcctgggcgagcaacccctgcacccaaattataa

SEQ ID NO: 64862 - DNA, 699 bp, Glycine max
  Peptide Sequence Number=SeqID_181640
atgatgcaatcctatcctggaagggcattggatagaagactccaagtagattgggccagagatgcaagagaagaccctagggttctcatgtgccttaaggtagatttcgggcccatggctaagtatgagcccacttatctttgtacatattcgatcaagcataattacctaagacggtttactactcccgaccctcacccattctctgagccatcgtgttgttcctcaaccattctctcctcacctcacgcacattctgtccctcaacctcaactatcaattaaaacaaagcttgttcctcagccattcctcaacctcacgcacactctgaactcagtgaaccacaccacacaacagagacaatatctcaatctcaatctcagcagaactacctcagacagtggaggagtgattgcactagtagaaataggaagtacaaaagaggaagaggaagatgcaaccattaaacagttgagaaagaacctcatcgttaaggcaaaactagtgccaagcttctactatgaggggccacccccaaagattgaactcaagaagataagtgaagacgagatttcttttcttacaaaaggtgaggacccatatgatgatgctgtcgttcataaactattccatccaaacctcaagctactcctagttaccgaaggtgcagagggttgcagaagagtctcaaagttttaa

SEQ ID NO: 64863 - DNA, 249 bp, Glycine max
  Peptide Sequence Number=SeqID_181641
atgagagaggtcattgcaatgttaattgatgctagggaatatgtcagcaagtcaccaacctctcctacatcagaatctccattggatgaggatgatgacatttcttccaaagatgagtttgtgaatttaatcgattgttttgcagacgaggttatcattgaggcatgctttggtgtttgcattaattggggcgttgtggaacttgtagagggctgggggctaattctccctagcattacggcgacgaag

SEQ ID NO: 64864 - DNA, 285 bp, Glycine max
  Peptide Sequence Number=SeqID_181642
atgacaaaggtgcagaagacgatgttagtctctgcgtgtcaacggctcgtttgtctctggttgacaaaaggtgcggatgaccataaggactcgccatctctggatgacaaaggtgcagaagacgatgttagtctctacgtttcaacaggctcgcttgcccctgtgatgcaatcctaccccccaagggcattggatagaagactccaagaagattgggccaaagatgcaagagaaggccctagggttctcataagtcttaggatagatttcgggcccatgggctaa

SEQ ID NO: 64865 - DNA, 249 bp, Glycine max
  Peptide Sequence Number=SeqID_181643
atgaaatttcaacacggcattaaggatcaccacaaacccagccaccgaccaccgttggcaccgccagtcgcgatgccatcagtcaccactcgcgccattgttagtcgtcaccaccatcttcctccaactctcaaacctcacttctctccaagtctctctctcacacttgaccctgaaatccacttgtgcgttgtaggtgaagagaaggaaaggatgaaaacaaagaggagagacatatttgtcatataa

SEQ ID NO: 64866 - DNA, 333 bp, Glycine max
  Peptide Sequence Number=SeqID_181644
atgtttactggagataaaattgatgaagctattcatcattttttggtggtgcttttgggcataatatcttgtatattgggtgggcctgcttttgcagagcttgaagcactctttttgctttgtggtggtggtggtggtggttttgaagggtccgggcaaaggccttttgcagagcttgaagcactctctttgctttgtggtggtggtggtggtggttttgaagggtccgggcaaagagctctttggatagtaaatttattgggtgcttccatgaacactacacttaaacctaaagctcttgtgtcgtcgtgcttcgatagccacaatttatag

SEQ ID NO: 64867 - DNA, 798 bp, Glycine max
  Peptide Sequence Number=SeqID_181645
atggcggcggaaccggtgagtgacggcggagccgcggcggagaaattgatcagcgggagagaagaatttggtgattcgtccaacttgttcagcgcgattctagcaatggtgctgtggctgggagctattcatttcaacatcgccctgatcctcctcgccgtgttcttccttcctctctccaaatcgctcttggttttcggttttctctttgggtttatggtgcttcctatcaacgagaagagcagatttggccgaagattgtcgaggttcatatgcaagcacgcttgcaattactttccgatcacgcttcacgtagaggatatgaaagcctttgatcctaaccgtgcttatgtttttgggtatgaaccacattcagttttgccaattggcattgttgcattggctgaccacacaggtttcatgcctcttccaaaagttaaagttcttgctagcagcacggtgttctacacaccatttttgagacacttatggacatggttgggtcttacaccagcaacaaagaaaaattttatctccctgttagcatctggccatagttgcattttaatacctggtggagtgcaagaagcatttcacatgcagcatggcactgagattgctttccttaaggcaagaagaggatttgtccgcgtagcaatggtgaaaggcaaacctttggttccagtcttctgctttggtcaggcaaatcaatctgactttctactttggatgaaattcatttctgatgcactagcgcctattggagaccctaccctgtctctcctcttgatcacctag

SEQ ID NO: 64868 - DNA, 306 bp, Glycine max
  Peptide Sequence Number=SeqID_181646
atgaagaatcagttgatttatgaacagaacttgcccattccccatgacaacttgatcagatctacacaagggagtgctttgaattgggttgcatgggacagatatgacatgatgggtggtgcaaaagtcaagaatccagataccaagtgtgagcctcaaagccagttagtaaggcctgtaacgattgtggagatgcagcaattgattgcttgtgactttggtcagcatttctacaatactggtgtgaaggaacagcttcaaactatggaaaggggcatcggacatggaatgaaagcattaagatag

SEQ ID NO: 64869 - DNA, 258 bp, Glycine max
  Peptide Sequence Number=SeqID_181647
atggagtttgagcctttgagtctcagcaacaagagcaactttggtagagaagaatcaaacttcttactatatctatacaagcctaatttcatcattctgcaactttgtccatgcatggcccttgtttcgccagtggtaatggcgaaacctgctacattgcacatgcaagcacgcgtttcgccaatggtgatggtgaaatccatggtggatagtggaatgtcgacatgtcatgcatgggcatggtgtaaggatgcatag

SEQ ID NO: 64870 - DNA, 1683 bp, Glycine max
  Peptide Sequence Number=SeqID_181648
atgagtgatgcaaaagaaaacgaggtagctagccagggcatgccctcggtcgtggaagaaaaccaacagttggttgatgctgaggttcaagatcaacctgaaactgcctctgctcctgttccagtagaggaaacttcaaatcatgttgaaattacaaaggaagaaccacgtgccgaggataaaaatgcagaacttgaggctgtttcagagggaattccacaagaagatgttcaaaatactcttctctatgtcccagtagagtctgatgctcagattttggataggactgagtctgaagaagcttctgttgcgaaggtggaagctgatgaattagcccagaataataaggaggccgagaataatgatgatgttcatcaaaatagtaatggtaatgttgagatggctttggaggtgaagcctgaagcctgtggaatggctgatagtaaagcatgtgataatggtgaccctgtgcctgcaagtcataatgagcttgctacgcacctacctgctcctgcagatacaaacactgaaattatgaatgtattagaagttgagaataaggctgacgaaaagcaagctactgaacctgcagataatgggaaatcaaattcaaagtacatgcttttcttggatgctgaccattcctatgatggtaatgagtcaggaacagaggaggagcagtcagcatttatgaaggagcttgaaaacttctttagggagaggagcatggaattcaaacctcccaaattctatggagaaggattaaattgccttaagctgtggagagctgtaacgagattgggtggctatgataaggtgacttcatgtaaattatggcggcaagtgggagagtctttcaagcctccgaattttgatatgagggcgagccctggtgcagcggtaaagttgtgccttggtgacttgttggtcatgggttcgaatccggaaacagcctctttgcatatgcaaggttctctgtcttcaacctatgcaggacatgtaccactgtctcatggacttttcggggattttatgagaagtttatatctgtgctttgatgatgttcctttaaagcttacaaataatgacattcatgctatgaccctattggagaagatttcataccatttacatagtttcctcgtgcccctaaattttatactaacttattacttggctgcacttcttgattatgaaagacataaaataaaaggtggtgagctgaatgttcctgttgcttctcatccagagcctataaatattgaaaatcaggcctctgtatcaggtagagcacggagagatgctgcagcacgagctatgcaggggtggcactcacaacgcctcctaggcaatggtgaagttagtgaccctattattaaggataggaattctgtgtctgtgcaaaagcgtgaaaagcagcttaaaagcatcaatatacacaaacgtaagaagccatcttcaccttacatggataatgcagtcaaagctgcacgcagtaaaccgtctaaaccacagttaagatctggttgcttcattttcaatatcgcttttcttaaagattgttttgaggtatatgctttagttcctggcctgctgagggaagagcatattatttttgccatttctccccttcctttgagaggaagttgcaacatgggagacaggcaaaagtcatggcagtga

SEQ ID NO: 64871 - DNA, 3312 bp, Glycine max
  Peptide Sequence Number=SeqID_181649
atgaacgaagcttcgatcaataatacagaaagctacctataccttcatccaagcgagaacccggccatagctctcgtttccccagtattagactcaaccaattaccattcatggagtaggtccatggttactgcgctgagtgccaaaaacaaagtggaattcattgacagaagcgcacctgaaccgttgaagacagatagaacctatggagcttggcgccggtgcaacaatatggtcgtatcgtggatagcacactcggtggccacatccatacgacatagtatactctggatggacaaagctgaggagatttggcgggatttgaagtcacgatattcacagggagatcttctgcgaatctccgaccttcagcaagaggcatcaacaatgaagcaaggttcactttcagtcacggagtattttactcgtttgcgtgtaatctgggacgagattgagaatttcagaccggattcggtctgctcgtgcaacatcaggtgttcatgtgctgctttcaccatcatcgcacaacgcaagcttgaagatagagccatgcaattcttacgaggtttgaacgaacagtacgctaacattcgttctcacatgcttctcatggatcctatacccgccatatccaaaatcttctcttatgtagctcaacaagaaagacaactgctagggcacgcaggaccaaacattaacttcgaacccaaggacatctccataaacgcgacgaagacgacttgcgatttctgtgggcgcattggacatgtagaaagcacctgttataagaagcatggggtgcctgcaagttatgatggaagaaacaagaataacaatggaagaaagacgtgtacccattgcggcaagttcggacacatagtagatgtttgttaccggaaacatggatacccgccgggatataaaccctatagtggaagaaccaccgtaaataacatgataacaatggaagataaagctgcaaatgatcaagctcagcaacatgggtcacaagaggttgttcacttttctcctgagcagtacaaggcattacttgccttaatccagcagccgtcggcaggaagcacggcgcagtccaaacaagttgcatcagtttcctcgtgcactgttaacacacccttaaacccagtgaagcttccaaatggtaatctcgttcatgctactcacacaggaaccgtacatctttcacccaatttaatcttacataacgtgctctacatacccactttcacattcaatcttatttcaatatcaaaactcgtatcatctaataattatgaactaatcttttcttctacatcatgcattttgcagaaagcgaacaatcatatgaagattggtatagttgaagcaaggcatggtctttatcatttgataccaaaccagataactaccaaggccatctactctaccattactcatcctagttgcagcatcatccccatagacttatggcattttagaatgggacacccatcgaatgaaaggctacaatgtatgaaaaactattatcctcttttaagtaatgataacaattttgtttgcaacacatgtcactatgcaaagcacaagaaaatccctttttcatctagcaactcgcatgcatctcattcttttgatttactacatatggacatatggggtccatgctcaaaactgtccatgcatggtcacaaatacttcctaaccattgtagacgatcactcgagattcacgtggatacatcttatgaaatccaaagcggaaacgcgacatataatcattaacttcatcgttttcattgaaagacaatataacggcaaggttaaaactataaggagtgataatggcgtagagtttctcatgcatgaatattatgcatcgaaggggatcgtacaccaaaccacgtgtatcgaaaccccagagcaaaatggtatcgtagaacgcaaacatcaacacttgctcagtgtcacacgagcactcctctttcaggcaaatttgccacctgctttttggtgttatgccttgccgcacgctgcatttctaatcaattgcattcccacaccattcttaaataacatttcaccttatgaaaaattgcataaacacccctgtgatatatccaatctccgtgtcttcgggtgtttgtgttatatcaacacaatcaaagcaaataggcaaaaatttgatcccagagcacacccatgcattttcataggcttcaaaactcatacaaagggatatcttgtgtatgatttgcattctcacgatgttacagtatcaagaaatgttactttttacgaaaatcattttccatacttacctaatacacaacatctaaacttagataacaccattccgtctccatctctgacatccttctccggcaaagaccatgaccaaccagaagaaagccactcatctcaacccacaaagccaatacactcttgtgatgaacattcaaccaaaccagacccttcacaccttagacgttcaacacgatcaagacattccccaacataccttcaggattaccacagagttcttgcttcatctacaccagaagcttcagtgattgttcgttatccactaagctccgtactttcatactcacgcctctcacctgctcataggaacttcgtgatgaccatttcatcagccacagaaccttcatcatacgccgaagcctctcgccacgactgctgggttaaggcgatgaaggccgagttacaagctttgcagatgaataacacttggagactcacacgtcttcctcctcacaaggtagctatcggatgcagatggatttacaagattaaatatcgggctgatggttccatagaaaggtataaagcacgcttggtggccaaaggttacactcaaatggaggggttagactacctcgacacattctctccggtggcaaaactcactaccgttcgtgttcttctcgcgttagcagcacaaaatcactggcacttgcgacaattggatgtcaacaatgcgttcctccatggagagcttgaagaggaagtatatatgcaaattccacctggacttgaagttgaaaacccaaagcttgtttgtcgtcttcaacgttctctctacgggcttaaacaagccagccgacaatggtttaccaaactatcaagtttcttagtctcccatgggttccaacaatctaactcggaccactctcttttcttaaagctcactaagtcagccactactatactcttggtgtacgtcgatgatatcatactcacagggaacagtatgctggaaatacaagatatcaccaccctcttggattaa

SEQ ID NO: 64872 - DNA, 756 bp, Glycine max
  Peptide Sequence Number=SeqID_181650
atgggacttgtggagctttttggggtggcatctatgcccgtgatcaaagtactactaatcactgctgttggcttgcttcttgcactggacaacgtaaatttgttgggaaaagatgcaaggatacaagtgaatcatcttgtgcattatgtgttcaatcctgcactggtgggtggcaatttggccgacacgattacttttgagaatgttgttttattgtggttcatgccggtcaatatcctcttgacgtttataataggctctgccttaggatggatccttatcaaattaacaagggctcccaaacacttggaagggctaataatgggtgtctgttctgcaggaaatttaggaaacttgcctataatcattatcccggctatatgtaaagacaaaggtagtccttttggagactccaatgtctgctatcaatatggaatggcttatgcttcactttctatggcggttggagctgtttatatatggacttatgtctataacataatgagagtttccgcaagtgtagtaccaaaagatgcttatagaactagctccttcagactggaggcttcaggagagttcctagaattcttaccagaggaagaatcctcagaacctgaaaatccatcaaaggacaacatggatgattacacacttctgctttcttcaattgaatctgaggagaatgtgaaggttgctaccgataacccaataacccctttcaaaagatatcttgtactaatcaaagggaaatcatga

SEQ ID NO: 64873 - DNA, 429 bp, Glycine max
  Peptide Sequence Number=SeqID_181651
atgggtcatatgagttacaatagagttagcagtgggagaggatcatcatcttgccatggaaaatgcagagggtttaggttaaacctcagaaggctttacttccttcgcctaaggaagaggttcaccttcttactcaggctctttgatatgtggaaactctcttattctcaggctcttcagcttctgaagaaggtgttgagaagaaaaagtggattcaagagaaactacagcaacagcagcagaagtggtttagtgagggatgaaagaatcaagggtcatgctgattgtagggtatcatcttatggaaggaataattctttctatgcagaagccattgctgattgcttggagttcatcaaacgaacatctatttcttccatggaccaaattcaagacccagtttgtcatattcaagatagaaactcgtga

SEQ ID NO: 64874 - DNA, 1356 bp, Glycine max
  Peptide Sequence Number=SeqID_181652
atggtgacagttttgtttactactactatcggcaatctcaatggcagtgcggtgcgaggtcgtgcagtgttaatctccactatgagtttgcaaatccacacatcctctagtgctagagacatggtaagtcttgataaatctcgggcttctttttcatcgcaagtttttcactcacttggaacccagagaaaaatcactctttgtctctctcccacttccggggttgttcaacttgggaaagtggtgcatgaatcccaacctgggtctgaaatttttagatctcttattttaacagaattgtcacttggaggaagagtgagacactacaagtttgatgtggagtacatgatcagaaagccagattgcttggaacacgttgtgatgggaatcaacggccagtttcccggcccaactattagggctgaagttggtgacattcttgacattgctctcaccaacaagcttttcagtgagggaactgttgttcactggcatggaatcagacaggctcttgttggaactccttgggcagatggaactgcttccatctcacagtgtgctataaacccaggagaaacttatcattacaggtttacagttgaccggatttgccaaagggacaaaacgaaccgttttcattacgatggtgaattcaaccttcttcttagtgatttgtggcacacaagctcacatgaacaagaagttggtctctctacaaaaccattaaaatggattggtgaacctcagactctgctcatcaatggaagaggacaattcaattgttcccttgcatctaaattcatcaacacaaccctaccccaatgccatcttaaaggtgatgaagaatgtgcccctcagattcttgatgtggagccaaacaagacctatagaatcaggattgccagcaccacttccttagctgcactcaacttagctatttcgaatcacaaacttgttgtggttgaagttgatggaaactacgttacaccatttgcggttgatgacatggacatctactctggtgagagctactcagtgctccttcacacaaaccaaaatccaaacaaaaattattggctttcaattggggttagaggaagaaagcctaataccccacaaggcttggccattctaaactataagaccatttctgccttaatttttccaacttctccaccacccatcacacccctttggaatgattttgagcatagcaaagccttcaccaaaaaaatcattgccaaaatgggaaccccacaacctccggagcattcagaccgcacacaatactcctcctcaacacccaaaatcgagttgatgggtttaccaaatggtccattaataatgtatccttaa

SEQ ID NO: 64875 - DNA, 255 bp, Glycine max
  Peptide Sequence Number=SeqID_181653
atgaagttgaatcaccaaccggatattggtaaaaaatttgaggttgagcatgcttggttgttgttgaaagatgaactcaaattcgatgcaaaatttatgtcaaagtattcaaaaagaagaaaggtttttgctggtggaaattactcatcatcttctaacccagagaatcccattgaaggtgaagaatatgatacgtcatcgccaatgccttacccaattggacaaaaagtagcaaaaaagaaaagcaaaggttaa

SEQ ID NO: 64876 - DNA, 177 bp, Glycine max
  Peptide Sequence Number=SeqID_181654
atgggaatgataataggatggtgggccagatcatcctctgcagttgcatggagagctactgggtgtcattcaggaggaaattggtcagaactaagaaaggatggtgggagagaggaagggggattttggcaggagtatgtcttgttgcaggattttagggtggaagaaggtctctga

SEQ ID NO: 64877 - DNA, 1632 bp, Glycine max
  Peptide Sequence Number=SeqID_181655
atggaagttcgccggcgagtcctccgtcccgctcccgccggcgaacccttgaagcccaaacaggacccacacccacactcccagcagcaatcgtacctcaccaacgccgtgttcttcgggctgttcttctcgctggcgtacttcctcctccaccgatggcgcgagaagatccgcacctccactcccctccacgtcgtcacgctctccgagatggctgccatcgtctccctcatcgcctccttcttctacctcatggccttcttcggcattaccttcatcctccacccattccttaattaccgctcttcccccgaggacgacctcgacctccacattcccaaacctgtccccactccctcatgccctgctgccctcccccaccacgacgaggacatcatccttgccgtcgtgtctggctccatcccctcctactccctcgaaacgcggctcgacgatactcgtcgagccgcattaattcggcgcaaggcggtggaacacatcaccgggaggtctctggaaggcctcccggtagaaggctttgattatgattccattctcggtcagtgctgtgagatgccgatcgggttcgtgcagatccccgtcggtgtcgcggggcccttgctcctcgacgggaaggagtacactgttcctatggctaccaccgaaggttgcttggtcgctagcaccaacagaggctgcaaggcaattcacgtctccgggggagcttcctccatgctcctccgtgacgccatgaccagagcccccgtggttaggttcaactccgccaaacgtgcttctcagcttaagttctacctggaagaccctctcaatttcgattcccttgccgtcgttttcaacaagtcaagcaggtttgcgagattgcaagatattaaggcagcaatagcagggaagaatttgtacattagattcagttgcactacaggggatgccatggggatgaacatggtttccaaaggagtccaaaacgtgcttacttttctccaaagtgattttccagatatggatgttattgggatatctgggaatttctgttcggataagaaggctgcggcagtgaactggattgaggggagagggaaatcggttgtatgcgaggctgtaattaaagaggaggtggttaagaaagtgttgaagaccagcgtggaggctttggttgaacttaacatgttgaaaaatcttactgggtctgctatggctggtgctcttggtggcttcaatgctcatgctagtaacattgtttctgctgtttacttggccactggacaggaccctgctcagaatgtggagagttctcactgcataaccatgatggaagctgtgaatgatggcaaggaccttcacatctctgttactatgccttcccttgaggtgggtacagttggagggggcacacaactggcgtctcaatcagcatgccttaatttactaggagtaaagggtgcgagcaaagagtccccaggtgcaaattctaggttactagcaaccatagtagcaggttcagtccttgcaggggagctctcactcatgtctgcaattgcagcaggccaacttgttaatagccacatgaaatacaacagatctagcaaggatatcaccaaaattggatcctaa

SEQ ID NO: 64878 - DNA, 705 bp, Glycine max
  Peptide Sequence Number=SeqID_181656
ggtggacagggtgaccacattgctcaggccctctgcgccgcagaaacgggactgcgcgaacggcaggtcagcggagatgcacagcaccacggtgttgttcagctcagaagccagttggttgaatttgcgaaccgatgccgcgcagacgccggtatcgatgcttgggaaaatattcagtactttacgtttaccagcgtattggctcagcgtgacgtcagagagatctttggcgaccagcgtaaacggctgcgccttcgcgccagcctgcggaatggagccctgaacggacactgggttaccctggaaatgtacggtttgcgacatggttatcttcctgcccagggaatgcgcaacctgcgagtttttgaagaatcatggccgcttcacacgccgtttgttatctctcgcggcagccgcagcgaggccaaagtcgtggtggtggaaatagaagaggatggggtaaaaggggccggagaatgtacgccttatccgcgatacggggaaagcatcgcctcggtgatggcgcagattatggcgatcggcgagcagcttgagcgcggcgctacccgcgagcaagtgcaacagctactgccggctggggccgcgcgcaacgccgtcgactgcgcgttgtgggatctggaggcgcgccgcgcggggaaaacgttgccgggatccttggcgtcaatctgccgcgcgaagtcgtga

SEQ ID NO: 64879 - DNA, 927 bp, Glycine max
  Peptide Sequence Number=SeqID_181657
ctacaagtcctcccctcagacgactacacatcctcgccttcagagggtagcacgccctcgccttcagaggactacacgtcctcaccttcagaggactacacgccctcgccttcagaggactacatgtcctcgccttcagaggactacacgccctcgcctttagagggctacacgccttcgccttcagaggactacacgtcctcgccttcagagggctgcacgccctcgcctttagagggctacacgccctcgccttcagaggactccacgtccccgcctttagaggactgcacgccttcgcctttagagggctacacaccctcgcctttagaggactacacgtcctttcctttagagggctacacaccctcgtctttaaagggctacatgcccttgccttcagagggctacacgtcctcaactttagagggttacacaccctcgcctttagaaggctacacgttctcgcctttagaggttccttggccaccccctgatcccggaggagggccaactgtgcgagcacaaccaaagagggaggctatcatgcagctactatacatgccgggggaagatttcgcccagaccgcgacaggaagacgagtgtggatcatgcgcaccaccacaactctgatctccccctaccgaattggatcgcacccacaggacacccagtggacccggagaagtccaatagggccctggggttttcggctctggtcatgggcctctgtcaatcctacagggtgcctgtcccccccagcaaggtcatgccatcgtgacataggtaagaattgcgcccgcaagacacccagtggacccggagaatttcaacagggtcctggggtttccagttctgattacgggcctctgttagttctatggagtgcccgtcgcccccagcaaggtcatcaggccccctactaa

SEQ ID NO: 64880 - DNA, 321 bp, Glycine max
  Peptide Sequence Number=SeqID_181658
atgaaagataaaagggatgaggaagaaaaactagaaaaccaaaataaaaagaaggacagtaaggcctcatcttcaaaggccaaggggaaggaaaaagaggaaaaggattcctccaagaagattgttaagaaggaaaatcattttgcaacaaaatgtgatatcaaaaaagcactcctttttaaacaatatttctaccttcttctatcaagggaacatcccttagcatcaccatacatcttgagcttgaggtattatgaggcaccaaattcctatgataggtggtatgatgaatgtgtcgagtggtgcaaccctcttttgtaa

SEQ ID NO: 64881 - DNA, 420 bp, Glycine max
  Peptide Sequence Number=SeqID_181659
atgaattccaattctgaaaattcaaatgtcacagagttctcgcttagcgagacactcgcgcttagcgagcaaatcgaaactgcaaaagaagaacataactgccttaggcagttacattttcattcctataactgcatctcattccaccttctatttgcactattcatcactctacttgcctttcattgtccactctactcttgcaattccaaatggcctcaaagaagagacgtgcttcatcctctcgaccataggagccttatgacacatctcgatttgtgtcagagacagcttgggagcgatacgagacgaacgtacataataggaacatcctcccaaagaggaacatggagttggcatactcccattatggtgagttcctcagggagctggagagacgctaatggcacaggaacctga

SEQ ID NO: 64882 - DNA, 474 bp, Glycine max
  Peptide Sequence Number=SeqID_181660
atgcttcgaagcatacatcaggggaaaattattttgctgcaaagtctccagctgatagcacctccagactccatccctacagtagagcaatttaatgaatgggtagcctggtcagggactcagcctcctcctcacagggacgacgaggatcccgccgctcaggtaccacatcagccaacggatgagtcattagagtcttccactcctgagcccttgatcaggaagaggagggtagttgtaactcaggaagccgcagctactcctgaaaagtctcctgaggccattccagagcctctggcaccaaaggcagataccacttctccacagcaggcagcagatccttcaacgcttgaagttcaaaccaccccagtcctgtctccaaacacctctcctgtagatactcatgtactgcatttgactaacaaggaggaggttcagacacaggacacccatgaccaatcacaggacttttaa

SEQ ID NO: 64883 - DNA, 375 bp, Glycine max
  Peptide Sequence Number=SeqID_181661
atgaagcttgcttctacaaggccacttgtaaagcaagtcgaactcgcaagtgggatcgtgccatcgtctgttattgcttcatctgctggagaaaagggtcatcctgctagcgaggtaggccctattgttgttgttgttgaggtcactcctagcacttcttcctatgttttgcctttggctccaccaaccgttgaggctcctactgctgatgtgactcatgttactcctgttgtgactcctgctactcttgctcattcacctcctcctgctattgttgttcaggaggttgctcctgctgctactgaagttgttgcgccatccactaaggctgactctgttgtggttcgtcctccatcattgcggcccctttgctaa

SEQ ID NO: 64884 - DNA, 1926 bp, Glycine max
  Peptide Sequence Number=SeqID_181662
atgaagtttttgctgagttatgcaagtaacccatttttctcttcagaaggcaacagtctcaataaaagagatcttgttgaatcatctgttagaaatctatttggtgaacttttcaagctgaattatagtgcacctggaccaaatgcttttgattcagtgcaaagtcaaatggctggcagatttggactgacaaagcctcctggacaaaaaattgaaatgaagaggggtgattggctttgccccaggtgtaatttcatgaattttgcaagaaatatcaaatgtcttgagtgtgaggaagcaaggccaaaaagacaactggctggaggtgaatgggaatgtcctcagtgtgattgcaagcgacctggacaaatatctctgggtgccaccaataccatgccaaatatggggtacgaaaatggaaacaatcctaatacttcagacattgatgctaggttagctgctaatgaagaaaaagcacaacgttggtttagcaaggtttctcaactagacagcagtgctgatattaacagtgtcatggcagatgaagattttcctgaaataatgccattgaggaaaggagtgaatagatttgtcgtgagcacaagaaagactccactggagaggaggttggctaatgctcaatacaagagaaacttgtccaataatgacattcccgggattgaggattctaaagctggggagccaatcaaatcccatgacaatctggatgaaatgctaagacgttcaggtggccttcctcaatttgacaataacaactttgttgatgaacaaaatgccagtggagacagccatccttcatttgctagcaatacttcacattttaacaatgtgaaagggagctacactagtactgttcctcccattccattgtctgcagatgcactttcccaaaagtctgagaacttgctagcagaggagagcaaaaaggtggtattagacgctgatgttggatatgctagattgggagactgttcacaactttctaataattctactagccaaaatatcacagaggaggacaaggagaaagagcaaggtgaaaaatctgagaggtggtttagaaaggttgctgagctgaatgattttccagatataccaagtgcaatatctgatgaggatttccctgaaataatgcccatgcgcaaaggagaaaatcgatttgttgttagcaagaaaaaagatcgttctttgactacaccagcatataagagacttgcggccatggaacaatctggcaaaaccaactttgtcccctttgttccctttccccctgattattttgccaaaaaggacaagcagcaggaagatggaacagattcatcagtggcagatgcaactgctttgacggatagggctgatgatgatacatctttcatatctgaggtggtgcagcagcctccagagatgtcagttgatgctagagctcaacgtggacagagtccaaatccttctgaacaaagctcaaataacaatgatgttggttctatgtatggggcaacaaccagtggaaattcaaggcagagtttcaatcaagatcaggttccaaatttgactgggagttcatccccggaaccagcatctgagacccagagtggtagagcagagtggacaagaaagagtttggaggggtcagctgtgaaggaaccagatcctttggacatgtcagaggaggcaaaggctgagaggtggttccgtcgcattgcacagattaaggatatttctgagctcagtcaaattccagatgaagattttccttcaataatgcctatgcgcaaaggggtgaacagatttgttgtaagcaagaggaaaacaccattggaaaggagattgacgtctcagcagtacagaagaaatcttccaaccgcgagctcagatccaattaaaaaagaaaatgaaggtagctga

SEQ ID NO: 64885 - DNA, 174 bp, Glycine max
  Peptide Sequence Number=SeqID_181663
atggatttcttgcaagcaccagaaaatcagatacttgtgggtgtggccgtggccgttgtagccattgggcttggtgctgtctatctctattcatctaagaagcgcaaagggattgttcagcagaattatatggtcaggactcagagtccatcgttaattactgttaatgtctga

SEQ ID NO: 64886 - DNA, 270 bp, Glycine max
  Peptide Sequence Number=SeqID_181664
atgacacttatggaaggggcttttgaagagcttgatggtcttgcttctaactatccagatcgattcaaaatatactatgtgttaaatcagcctcctgaggtatgggatggtggtgaaggatttgtgtcaaaggagatgattcaaacacattgccctgctccagcacaagatattaagatattgagatgtggccccccacctatgaacaaggccatggctgctcaccttgaagcccttggatatgctcctgagatgcagttccagttctga

SEQ ID NO: 64887 - DNA, 1140 bp, Glycine max
  Peptide Sequence Number=SeqID_181665
atggttgagagaaccgtgtctggctccgccatcaaggttgtttccaagaagtccttgtgtggattcttcacaatgacaacgttgttgttcatgttgtcatggttgttcgttctgcgttccactcgctccgaggcttcgcctaactcaaaccttttctcttcctacagcaactcagattttgatcattcggtgcagcaacaaaaaaacgtggaagaagaagtggaaccatcatttggtaatagagcaatactcgtggacaacatagaagcagcagcagcagcaacaacaacaacaacaacaacaacacatgatgataaacaacaagtgcttgaagaacaaggtgtgaaatgcaaagcacatgacaaagctgttttaagagttttcatgtatgatttgcctcctgagtttcattttggactattggattggaagcctgaggagaatgttaacaatgtttggcctgatatcaaaactaaagcaccccattaccctggagggttgaatttgcagcatagtatagagtattggctcactttggatcttcttgcttcagaactacctgaatctgaagcaccatctaatgctaggagtgtgatcagagttagaaactctagtgaagctgatgtgatatttgtgcctttcttttcctctctttgttataaccggttatcaaaaactggcccacatgagaagaggagcaggaacaagctgctgcaagagaagttggtgaagtatgtgacagcacaagaagaatggaagaggtcagggggcaaggaccatgtgatattggctcaccatccaaatagtatgttggatgcaagaatgaagttgtggcctggcactttcatactctcagattttgggaggtatcctacaaacatagccaatgttgagaaagatgtgattgcaccttacaaacatgtggttggatcctatgataatgatcaatccagcttcgatagccgtacaacattgctgtacttccaaggagctatatacagaaaagatttacataattgtaaacaaatattagatgtaggcacctttaaggagaaaaaagttaagaggcaagagttgtggtttactgataaaccagaaattcaaatagtttgtcttgtaaaccacctccaagctctgtag

SEQ ID NO: 64888 - DNA, 219 bp, Glycine max
  Peptide Sequence Number=SeqID_181666
atggtcccatcataccgctctaggttgagtggtttccaacctaggggtatgtcaactttcatgattcagtcgacgaagaggtgtcgacaactagtctgccctcctttagccttctcaactcctactcatggcgttgctccatctttgcaatgcgattttggagttagtggagagtatcagtatttggcatggttgctgaaggaagagttgagcttttga

SEQ ID NO: 64889 - DNA, 447 bp, Glycine max
  Peptide Sequence Number=SeqID_181667
atgcgttcttccaagttctgcctcaacatagcaggtgacaccccttcatcaaaccgcttgtttgatgccattgccagccattgcgtccccgtcatcatcagcgacgatatcgagcttccatacgaggacgtcctcgactactctcagttctgcatatttgtgcgcacaagagatgctctcaagaagaggtatttgataaacttcatcaggagcattgggaaggaagagtggaccaggatgtggaacaggttgaaagaggttgagagtttctttgagtttcagttcccatctaaggagggtgatgctgtccaaatgatttggaaggctattgcacgtaaagttcctttcatgaagctgaagactaataggtctagaaggtttttgaggtctctttatgggaatgacatggggaacaaatcaataactacaccagctaatttttggtga

SEQ ID NO: 64890 - DNA, 2178 bp, Glycine max
  Peptide Sequence Number=SeqID_181668
atggtagacacttgctacaagaaacatggttaccttcctcacttgcatagaggaggtgttatcaaccagtattctatggatgatcaagaaattgaagatgatctacaatctctaggacagaaaaaggtatctgtagatgcttcatttgtagctttcacaccaaagcaacataaggctcttatttccttgttgcagcaaacctctcaagcccctccctctcacaccattaatcagtttgttagttatcataagaatgataattcagtttcaaaactaattgccaaccttcattgttgtctaaactttcaccctactggttgttccatacaagacaactcctccttgaagacgattggagcagctgaattgagagctagcttatacatcctatcttcaccaacaactcagttctcctataattgtaacatcaatatcattccttctaataaatgcaatgtttggcataatagtcactcaccaccatctgctgactccacacagcctattaagcctgttcctccatcatctccatatgattttctgcttgatatgcctcatccaccagacccttccccacctgagataccaatatcaaaccctccacttgatccacaccatcaatcagccttacctcaatcctctccccacagatcacaaagacagaaacaacctccttcataccataaagactaccactattctctaacttctgcaacaactcacaattcaatctctccagtttcctctaccatcaggtatcttatttccaactacatttcttacctcaaactttcacaccatcacaaacatttcacacttaatcttactcctttacctcccaataaaaagccaattggatgcaaatgggttttcaaagtcaagttcaaagctgatggatccattgacaagcacaaggctagattagtaaccaagggttttacacaaactgctggtctggactacattgaaaccttcagtcctgttgtgaaaatgaccacagtaagacttgtgttatcactagctgcttctcaaggttggcatctccatcaacttgatgtcaacactgcctttttgcatggtgatttgaatgagaagcaagccaacagacaatggaatgccaagcttacttctaccttacttgattcaagattccaacaatccaaggtagattattctcttttcactaaaaggtctcccattggcctcactattgtccttgtttatgttgatgatttggtgtttactggcactgatcttgctgaaatccaacaattgaagcactccctggatgcaaaattcagcattaaagaccttggaatgctcaagtacttccttggttttgaagtagcccgatccaactcaattattcccttgtatcaaagaaaatattgccttgatctcctacaagacattggtctgcttgctgccaaaccctgttccacacctatggatcccacactaaaacttcacaaatcctctggtgtccctttctctgatccaactgtttatagaagacttgtggggcgattattgtatcttactcacacaatgcctgatatttgctatgctgttggaagattgagccaatatttacaatctccagtagatatccatatgcaagctgcacaacatactctcaaatatctcaaagaaaatgctggaaaaggcctatttttctcctcttcatcttccacttctttaactggctttagtgactcggattggggagcttgtcctgacactcgaagatccataacagatttatgcttcttcttaggtacctccctaatatcttggaagagtaagaaacaatccattgtgtccagatcatcctcaaaagctaaatatagggctctaactcaagcatcttatgaagcaaaatgcttattgttcttattaaaggatcttcatattgagtatcctaaaccagttgttctatattgtgataatcaagctgccctgcacatagcagcaaaccctgtattccatgaacggacaaaacatatagaaatggattgtcatgtggtgagagataaagttcaatccggtatgattcatcttcttcccatctcaacttatgagcaattgacagatattctcaccaagtctttacatgttgatctcttcaaccatattcattccaagttaggaatgcttgacattcacattccagcttga

SEQ ID NO: 64891 - DNA, 129 bp, Glycine max
  Peptide Sequence Number=SeqID_181669
atggagaaggggtttaaatacgaatttgaaaattttgttcctcttttgacgctgaatcggacatatatagctaggtacgggagtgttataatacaaaaggcttcagcacaaagtgcacgaaatgcgtag

SEQ ID NO: 64892 - DNA, 294 bp, Glycine max
  Peptide Sequence Number=SeqID_181670
atgaagggaggaggtcgaaccgtgctgataactggagtcggaaatggctgggaagagccctggctctcgaactcgccaatcgaggtaaccctaaccctaaccctgaccctaaccctaatcactgcagtgatcgcactcaacccgggcgtgatcaacgccgacatgctcgcctcctgcttcggcgcgtctgcttccctctatcagccgcctcaggcgtgggctctcaaggccgcaaccatgattctcaatctcaccccggcacacaatggtgcctctctcactgtctcaacttaa

SEQ ID NO: 64893 - DNA, 954 bp, Glycine max
  Peptide Sequence Number=SeqID_181671
atgtgttggcttcttctccccgacgaactgtggaggcgaattctggagatcggaatcgagagcaacggtttcagttacaaggatctctgctgcgtctcaatctcatgccgccgccttcatcgcctctcctcggaagaacctctttggaaccgtcttctcttctctgactatccccaatcccaatctcacccttcttcttcttcttcttcttcttcttctaaatctctttacagattaaggtttgagagagacaaggagaggagaatagctgctcataggagggctgtgctgagaaaggaaagccaggttgccgaacattccagaaggctcaaagatatgaagacacgtctcgctcaagaaaccaccaaagccacgcaaactgctcaagacttgtccaatttgcgcaggctcagacaagcctttgtagctttgaatgtgtggcaaccagaggttgtccggggtaggcaaaaacaaatggtagagcaaagtgttgtgcctgctgaatgtcggatacatgcgcttgagatggaattcaagctttgtaagcaacagattctgggattggagaagtcctatgttcattgggttgttacttacacaaaattgtaccagaaagatgaaaagcgcagacttgatactgcaaaagaagagttggcatctatgaagtatcaccctgtacaggagcataagcccacaagtggaggggagaatgaacatgtcaagcggaagaagttgaaaatatgcaatagctgtgagtctctgacaagaattcctcccaatattacaagaaaaatgaaacaaaacaacatatatggatatgcatcttgcaatcattctctagtggtaggagcaaacgatatggaagacgttgcattggatgatgagcaatgttctagacagatgaattttgctggtctttcttccattgaaactgggaatttgtttctgccatga

SEQ ID NO: 64894 - DNA, 834 bp, Glycine max
  Peptide Sequence Number=SeqID_181672
tgcattggaatggaagatcagggtcagcagcagcaacaacaggaggcaaagagtccaaggcaaggcaccgagaggagtgaagcggttcggtcaaggtggactccaaagccagaacaaatcctcattctcgagtccatcttcaacagtggcatggtgaaccctcccaaggacgaaaccgtcagaataaggaggcttctcgagaaattcggcgccgttggcgacgccaacgtcttctactggttccaaaaccgccgctcgagatcccgccgccgccagcgccagatgatgcagcaggctgctgccgccgccgccgccaccaccattgaccaccctcaggctcaggctcagactcttgttggtggtgcaattccacttgatcacaccactcaaggaaaccttgttgttgcaagtagtgctacttcaaccatggggtttggttgttcttcttctccatcttacgctttccttggttcctcttcttcatcttgtggtggtggtgtaattggtggccatcaacaaggcatggagggtttcttctcagtttcttctcaaatgggtttccctgatcaccacacttcacctgcatcatcagctttctaccctcctcttgatccaaatttgacgtaccaggctggatatgggggcactaatatttcgggattcatcacagtgtttctcaatgggattgcaacagaacttccaaaggggccaatagacctcaaaaccgtgttcggagaagatgtaatgttagttcattcctctggagtgccagttcccaccaatgaatttgggttcttgatgcagaaccttcggcatggcgaaagctactttctg

SEQ ID NO: 64895 - DNA, 393 bp, Glycine max
  Peptide Sequence Number=SeqID_181673
atggtgatgaggagtgagttcacacttgtaatcttcactgattgcggagtatctaactatgcaagagttagatgctgcttcactggctacttcaaatgtaacgtcgatgctgctctcttcaatcatcaacaatgctttggaattgatatgtgtatacgtgatgagcgtgggcaattcatcaaggcaaaaactgcactacacaatggcattcctgaaccgagagaggctgaagcatggggtctaatgcagctagaccattttattcctagtgttcctaattcaatccctaatttcctcaagtcacaagatctgaagctggctctagaggaggcaattgcacggtggatggtggatgactatgaagtggactgcatgcctaagttgaaagaatag

SEQ ID NO: 64896 - DNA, 1156 bp, Glycine max
  Peptide Sequence Number=SeqID_181674
atggaatcgagcgttctggaatggctgggcgtggagataattggcgtgatgagccccgtctcgatctgcatgttccttgtggtcctactggtgtactccctctcctcgccgtccaccaccgccaccaccatcgccaccgccgccaacctcgtctacgctgagaacccctccgacaccgccgcgcagaagctcgagggcgcggtcctcaacgccgtcgtcttcatcgtcttcatcgcgctcgcaaccttcctcctcgtcctcctctactactacaactgcaccgccttcctcctccactacacgcgcttctccaccttcttcgtcctcgccgccatgggcggatccatcctcctctccctcctggaacgcttctccgtccccctcgacgccgtcacctcctttctcctcctcttcaacttcgccgtcgtcggagtcctctccgtctttgccggcggcggcctcccgatcctgctccgccagtgctacacggtctgcctcggcatcatcgttgccgcgtggttcaccaagcttcccgagtggaccacgtggacggtcctcgtcgcgctcgcgctctacgacctggtagccgtcctcgctcccggcggcccgctcaagctcctcgtcgaattggagtcgagccgcaacgaggagctcccggcgctggtctacgaggcacggccgacggtgaatacgcgaaaccacgccgcggcggttgggtttatcgtcgccggggtttcggattccgaaacttccagaattgagcttcaggtagtgtctagggttaatagtaataataataacaatttgagtagtaacaatgataatggggagaatgggattaacgatgaatgggaaaggtcgccgttggttggtggaatgagatttggtgaggttgttgttgatgagggaatgtcgccacttgttgagatgagtggtgtgggggaaaatgaggaggaaggggaaggggtgaggaggaagattggtgaaagagggattaagtttggacttggggactttgttttctacagtgttcttgtgggctctgccagcccttccgatttcgatcgcattgggggttctgttctactttttgacaaggctgctcatggagcccttcattgttgggactgcgaccaatttgatgatgttttgagag

SEQ ID NO: 64897 - DNA, 1320 bp, Glycine max
  Peptide Sequence Number=SeqID_181675
atgccatccaccactaatttcctctccacatctcatatatgccaaaaagtccaaggaagacatttgatcaagataactatccatttagttttagaatttacagactccagagcaaagggaagggaagaggccattcctaaaccctacctctcaaaacatcatcaaattggtcgcagtcccaacaatgaagggctccatgagcagccttgtcaaaaagtagaacagaacccccaatgcgatcgaaatcggaagggctggcagagccttccggcacatggacaacaaaatgagcgtgcagccaagccccgaaataatggcgaggtagcacgcatacacagtcatcaaatcatacatagccgctctacccacaagaacactgtagaaaacaaagtccccaagtccaaacttaatccctctttcaccaatcttcctcctcaccccttccccttcctcctcattttcccccacaccactcatctcaacaagtggcgacattccctcatcaacaacaacctcaccaaatctcattccaccaaccaacggcgacctttcccattcatcgttaatcccattctccccattatcattgttactactcaaattgttattattattactattaaccctagacactacctgaagctcaattctggaagtttcggaatccgaaaccccggcgacgataaacccaaccgccgcggcgtggtttcgcgtattcaccgtcggccgtgcctcgtagaccagcgccgggagctcctcgttgcggctcgactccaattcgacgaggagcttgagcgggccgccgggagcgaggacggctaccaggtcgtagagcgcgagcgcgacgaggaccgtccacgtggtccactcgggaagcttggtgaaccacgcggcaacgatgatgccgaggcagaccgtgtagcactggcggagcaggatcgggaggccgccgccggcaaagacggagaggactccgacgacggcgaagttgaagaggaggagaaaggaggtgacggcgtcgagggggacggagaagcgttccaggagggagaggaggatggatccgcccatggcggcgaggacgaagaaggtggagaagcgcgtgtagtggaggaggaaggcggtgcagttgtagtagtagaggaggacgaggaggaaggttgcgagcgcgatgaagacgatgaagacgacggcgttgaggaccgcgccctcgagcttctgcgcggcggtgtcggaggggttctcagcgtagacgaggttggcggcggtggcgatggtggtggcggtggtggacggcgaggagagggagtacaccagtag

SEQ ID NO: 64898 - DNA, 735 bp, Glycine max
  Peptide Sequence Number=SeqID_181676
atgaacatgaacatgaacatgaacactaagagcaggttgatcaccctttgggttgtgctctatttttgttccatcacaaactcactagctgcttcaaagcagtgccatttccctgccatcttcaactttggtgactccaattcagacactggaggtctctctgctgcctttggacaagctggtcctcctcatggagagtcctacttccatcaccctgctggccgttactgtgatggccgtctcattgttgatttcttagccaagaagctggggctgccttatttgagtgcatttcttgattcagttgggtcaaattatagccatggagccaactttgcaactgctggatccaccattagaccccagaacacaacccttcatcagactggtggtttcagccctttctctttggatgttcaattcaatcaattcagtgatttccagcgcagaacacaattttttcacaacaaaggtggagtatataaaacattgttaccgaaagcagaagatttttctcaagcattatacacgtttgatattggtcaaaatgacttggcatccggttacttccacaacatgtccacggatcaagttaaagcttatgttccagatgttttggctcaattcaagaatgtaatcaagtttttcttaatggggagattccgagattcaaaactacaacctctccccttttactaccaagccaaccttataacccctgtttggtattgttag

SEQ ID NO: 64899 - DNA, 867 bp, Glycine max
  Peptide Sequence Number=SeqID_181677
atgctggtgatcttattcaatagcatgcttgatcacatgaccatatttgcacatgacattaatcagtacttcttttccccgagaactacctcattgggatcaacagacagcaacctgtcatacttaagatcttacagttctggtggtttagttgattttttctcagaaccattccaagcttctggaccccatcaaaataaagtgtcttgtactccacaaccatttgatctgggaagtactgttagttcagatctttctgaggcaccagtggcacccaaacaattctcttcgtttgctttgtctattggccttttccagtttccagctgcaccctctcaggcttcatcagtggatctgtttcagtcatctgctttatctgcaatcccttctttcaatgagcttcaaccagtgaaagcattccaatccttatctgttgactttatggatctgtctcagcagccatctgctgcaatgccaaatgagaagtcactggagttgtctgtccctaaaaatgaaggatgggcaacatttgatacgcctcagcacacaacatctactggacaaccatggaatgcatttaaatattctgccacctctgttcctgtggatgcccttaatcaagggttacaaatgcatgatcttccatcaactgatgatcagttttttgatttaagagcttctaagtgccaattgcaattccttgatgtcagcactctacaagctgctctgccagattcccagctatcacccaccttccaaagtggtattgctgaaccatggctccctcagaatacactaaacccttatgtctcctctgcaggacaaggtagtccttcaagactcatactggatgttcaaacattttaa

SEQ ID NO: 64900 - DNA, 402 bp, Glycine max
  Peptide Sequence Number=SeqID_181678
ggttcccaaacgttagaggaaggagaaggaattgaagtttcattccatagtctacatgcgatgagtatttctccctccacagacattattttgcaaatcccaacattgaagatgtgtggcgcgaaccacatatcaaaattttacaacaatccaacgattaacaagtccggaatcgtagttttactgagacgattttgggtttctgcgagaaaagaaaaggctatggttcaaaagatatttctctcaactccaacatgctttcataattccaatggtgagaatgttcagaaatacgttccaaacctggtgctcaaatttcacgacgattcaacggttaatgagtccaagatcgacatttttctgataaaggtttggtggtatgctagtgtactcatagcctaa

SEQ ID NO: 64901 - DNA, 285 bp, Glycine max
  Peptide Sequence Number=SeqID_181679
atggccactgttttcagaacccccactttccggcctccgcctccgcctccgccgcgcgctgccaagtcgccgaagccctcgcgcttcaccgtcgcgtctttcggacagagcaccacctgcaggagaaaacccccctcgctcctctcctccctgcggttccctactgttccctctccacggttcgtcaggttcgttcccttcgctttcgatggcgacaccgaggccccgcaagttcaggaaccggaggttcaggttctgccttttttgcttgaagaggcgcattga

SEQ ID NO: 64902 - DNA, 261 bp, Glycine max
  Peptide Sequence Number=SeqID_181680
atggcctgggcctttcctttggaaatggctcggtcgctactattactactattaagaatgggtcatccacatctgttcttttgcagcctcttgttaatgatatccgaaatcaactacagggaagcaaacagaagtgtggatttcttagccaatcatggagattttcagttgactgttcttgattctcctcctccttttcttagatctattatagctgaggaggccagaggtgttcttttcaagcgctttgttgcgttgtag

SEQ ID NO: 64903 - DNA, 810 bp, Glycine max
  Peptide Sequence Number=SeqID_181681
atggagtctagatttagcattagaagttttggctccataccaccttttttggacccttcagatggtgctgttggtgtaaatgatagtgcaagtgataatgaggttagcgatgctgatgaaacatttgcttcacctttcttagtgatacttcaatcgtacagagaagcattggctaataatgacgaagtcaaaattgctgagttggaatcgtcattaaaatccattgaagatgagaaaatagaacttgaagggaaaatagcttctttatcagaggagttatcaatagaaaaggatcggattctaaggattagtgcagactttgacaattttcggaagaggacagagagagatcgcctttcattggtcacaaatgctcagggtgaagttgtggagagtttgttgcctgtgttggataattttgagagagcaaaaacccagataaaggtggagacagagggagaggagaaaataaacaacagctatcagagcatatataaacaattcaatgaaattctaacttcacttggagttgaaccagtggagacagttggaacaccctttgatccattgctacacgaagcgattatgcgtgaggattctgatgaatttgaagatggcatcataattcaagaattcagaaagggttttaaacttggtgaccgtctcttgcgtccatcaatggtaaaggtatcagctggtcctggacctgcaaagcctgaacaagaagcaccgcaagaagagcaagtcaacactgaaatttctgaggacagtaaagaaaatgagggcagcacagaaacagagtcttcttga

SEQ ID NO: 64904 - DNA, 383 bp, Glycine max
  Peptide Sequence Number=SeqID_181682
gagtttctgtgggtgctgggtggcaaagcgttgtagcatatgtaaacataggctgctattatcttattggtattcctgttggagtgctgcttgataatcttttccatttggaagttaagggtatttggattggaatgttgtttggaacatttgttcaaaccgtaatgcttattacaatcacatttaaaactgattgggacaagcaggtagagatagctcgaaatcgtgttaacaaatgggcagtgacgacggagaacgaagaatcaaacagtaaaattattgatctgatagggttttgtatgtactacaacaaggccaaagaagaacgttattttcctaaattcgaggccaataaagatacctccagaaatacgagggaataa

SEQ ID NO: 64905 - DNA, 956 bp, Glycine max
  Peptide Sequence Number=SeqID_181683
atggaggggcatctaaagcagaagctgttgagaaacaaagagagaagaacatcatcagagcaagaagaagaggagctatcattagtgaagagggtgtggaatgagagccaggtgatgtggatagtggcggcaccagccatattcactaggttctccaccttcggaatcagtgtcataagccaagcctttgttggccatattggctctaaggaattggctgcatatgctctcgttttcaccgttctcgttaggttcgccaatggtgttctcttaggaatggcgagtgcgttgtcaacactttgtggacaagcatatggtgcaaaagaatatggcatgatgggagtgtatcttcaaagatcatggatagttttgttcctaactgcagtctgtcttcttccggtgttcatcttcacaagcccaattttgatgctcttgggccaagatgagagcatagcacaagtggcaggaaacattgctctttggtcaattcctgtcatgtttgcctccattgtctcgttcacttgtcagacattccttcaatctcaaagcaagaatgtcatcattgcgttcttggcagcattttcgatagtcattcacgtgtttctatcgtggcttttgacaatgaagttccagtttgggattcctggtgcaatgatttcagcaggcttggcatactggattcccaacattggtcaactcatatttgtcacctgtggttggtgttctgatacatgggaaggtttctcatttttggcattcaaagacctctggcctgttgtcaagatgtccctttcagctggtgctatgttatgtcttgagctctggtacaacacaatattggttcttttgactggtaacatgaaaaacgcagaggttgaaattgatgctctatccatatgtctcaacatcaatggatgggaaatgatgatatcacttggtttcatggctgcagcaag

SEQ ID NO: 64906 - DNA, 348 bp, Glycine max
  Peptide Sequence Number=SeqID_181684
atgatgctaattaatgtcattgagactgtagaatcgacgatgaactgtaataaaggactttcaattgttttttattttaataataagaaaaaaagagcaccttccattgaattagattatccttcttcaagcacaagtggcatgtttcccacggtgttaaaggtatgtccattgtatgaagaagatgatgtctatgaaaataagtttgaagatgctctttctgacgatgatctagacaacattaacgaggaagtttgtcttgatgatattgatgctttgctagcagtgggaaatattctacatcatgagacaaccattttagaaaaagcattcttttttggacaataa

SEQ ID NO: 64907 - DNA, 1137 bp, Glycine max
  Peptide Sequence Number=SeqID_181685
atgagttcttcacagcacttgaacaatgttggtgaaggtagcaatagagacatgagtttcttccctccttcttctctttatgtgggttcttcacaaactcctcctttgtctatgggacatgaaaatggggtagagggttcaaagcctgagatgggtcttcagatttttgggtccacagtgtttcagccctcggagtgcaggggaacaaagagagccagtgatgaagaaggggttgagattgagaacaggaacttgtgtttaaaacttgctgatgaagcacaagctaagagctctgcttcagggaaaatcaagctttgtgctagaggtcattggaggccagctgaagatgaaagactcaaggagcttgttgctcaatatggccctcaaaattggaacttgattgctgagaatttagaaggaagatcaggaaaaagttgtagattgaggtggtttaaccagctagatcctaggatcaacagaaggtccttttctgaggaggaagaggagagacttattactgcacacagaatgtatggtaacaaatgggccatgattgcaagactcttccctggaaggacagataatgcagtgaagaaccactggcatgtgatcatggctaggaggcagagggagcactctagcagtgtgtatagaaggagaaaacttgtcgttaatgaaacccttccaaagggtttggatctgactctgtctaacaatgcagggagtgaatcaaccatctcaagcaccattgatgaatctgcctcaacttgcactaacctctccctaactccctcctcagccaaagttacccctccttttcgaagactctttgaccatcctggtccatctcagaatcaccaagcctttggatcattaattgggcaagctagaggggatgtgagttttaacaagttttgtggtgcttcttggaaaggggtagcatataaaaaggcagatcaagtgggaaagcttaagggtgtggaccagtctaatttttcagatgcaaattcagaagtatcagtatctgagtcagttgccaccaataggtccaatgtctcaatttctgaagagagtgaaactgtgggtgataagattaacatgccattcattgattttcttggagtaggagctacctag

SEQ ID NO: 64908 - DNA, 423 bp, Glycine max
  Peptide Sequence Number=SeqID_181686
atggagtgctcctcagttgagttcgacgtcagcgagcaccgcttcctaagttctggtaggaacaaatgctctatgataggctctggtctttattcgttgaacgataatgggaaagacaaaaggggggggcatgggggaaaaagatggaaaaagtgcaaggaaaaaggctatagaaaaaaggggctacaaaggaggcatatcttgataatgaagacacaacatcccttatcttttttacttgagagaagatatagagattgtttagcaacacctctaggcagtcatgaggtagctaatggggtgacaagagatccacttggacaaaactactcagaagaaagctcacaagtccatatggggaaggggaagaagatacaattctcacctagtagaattttgaagggaaataaagataagggataa

SEQ ID NO: 64909 - DNA, 237 bp, Glycine max
  Peptide Sequence Number=SeqID_181687
atgacatgggtgcatgttatccattttcaagagaaagacatctattttggcttccatggaggcttaggtggcagtgaagtgggcaatggcggcctcaagtcagtcaaggatgggattccatcggtcaggttccaccattggagctcaatgaaagcaccaaatgttatgaacctgaatagaagcagaaatgcaaaatgcaaaagcagagagaagagggtagaaaagcttaagacatag

SEQ ID NO: 64910 - DNA, 327 bp, Glycine max
  Peptide Sequence Number=SeqID_181688
atgccgatctccccttgcggaagtatcagttgggatcgcgcccacaagacacccagtggacccagaggagtccaacagggccctggggtttccagctttggttacgggcctctgtcagtcctacaggatgcttgtcccccccagcaagggatcacgcacgcaagacactcagtggacctggagaaatccaacagggtcctggggtttccagctctgattatgggcctctgccagttcaatggagtgcccgtcgcccccagcaaggtcatcaggccccctactaaccaagctttcatcaaaaagtactacgcccccaggcaggcgtag

SEQ ID NO: 64911 - DNA, 453 bp, Glycine max
  Peptide Sequence Number=SeqID_181689
atgtcgatctccccctgcggaagtatcagttggtctgtgccgtcccgacatagggtagggggttgcgcccacaagacatccagtggacccggagaagtccaacagggccctggggtttccagctctggttacgggcctctatcagtcctacagggtgcccgtaccccccggcaagggatcgcgcccgcaggacacccagtggactcaaagaagtccaacagggtcctggggtttccagctctgattacgggcctctgtcagttctacggagtgcccgtcacccccaataaggtcattaggccccctattaatcgggctttcctcaagaggtactgcgcccccaggcaggcacagggcgaaacaccacagcagcctggggatggctggcagcgggcaacaaacgcaccgccaccacctttagagttcatctcagctcattcacaaaaaggctag

SEQ ID NO: 64912 - DNA, 153 bp, Glycine max
  Peptide Sequence Number=SeqID_181690
atgacaacaatagagtatgcgaaatgcccacttggccgacacatcttgtcaagcgtttctcaaaacaggcatatgactgagacaagtatgcaagtggggaatgccaacgtctacgaattcctcaagctgcagtccatacagagatctgggtaa

SEQ ID NO: 64913 - DNA, 825 bp, Glycine max
  Peptide Sequence Number=SeqID_181691
atggatcgaagttggatgaacacaagtcacatgagccctacgtatgaggaaggcgtagaacagttcttgcaatttgcttccgaaagaagtcgaccagatgaggatgaaaaatatttttggcgttattgcaaactgattcaaaaagtcattgtatcttgggtgcaacaatctatttacgctgttgtcagcggtgttaagtctgtgcacgatatgcttccagagaaaaacacgctgccaacaagttactatcagacgaagaagatactgtgtccgatgggtatagagtatcacaagattcatgcttgccctaatgatttcatactatacatacatgaatttgaagaaatgcacaaattccctcggtgtggggtatcatggtacaaagtcaaggatgatgatgaatgtagtagtgatgataacttaaagaaaggccccccagcgaaggtggtgtggtatcttctaatcattccatggtttaagcatctattttctaatggggatgacgcaaaagaccttacatggcatgcaaaggggagaaactgggatggaatgctccatcatccggctgattcctcccagtggaagaaaattgatcgtttgtatccaaaattcaacaaagaggcaagaaatcttaggcttggactttccattgatggaatgaacccatacggtagtttaagcactcaacacagctcgtggctagttttgctagttatttataacttatctctatggttgtgcatgaagcgaaaatacattatgttgtctatgatgatattgggcccaagccagggaatgagattgatgattatctcagtcccttga

SEQ ID NO: 64914 - DNA, 447 bp, Glycine max
  Peptide Sequence Number=SeqID_181692
atggctgagataaattccgaggagctttgtggggcagcaacaatgagctcaagcttcggagagaggaaagagaccagtcacggatccaagaggagtttggctcaacacttggaagccacggagcaaagcatgctagctatcatagggcagtacaaggaagagttaaaccagtcgttgacccatgaacaaaagctagtagaggatttcgcacaagcgtacaccgaaaaggaagcaagagggagggtgattgatgcattgcatcaagaagcgaccatgtggatggataggttcgccttgaccttgaatggaagtcaagacctcccgcggctactagccaaagtaaaggccatcgccgaagtgtgttcagcccctgaggaaattcacgggctaatcaattactgtcaacacatgatagatttgatggcccatataattagaaaccgttag

SEQ ID NO: 64915 - DNA, 918 bp, Glycine max
  Peptide Sequence Number=SeqID_181693
atgaaattcattgacatgggcaataaccaactttctgacgcaataccagattggatgtgggaaatgaaatatctaatggttcttcgtctaagatccaacaatttcaatggcagcattactgaaaagatttgtcaactttcttcccttatagtgctggatcttggcaataacagcctgtcaggatccattccaaattgtttggatgacatgaagacaatggctggtgaagatgacttctttgccaaccctttaagttattcatatggctctgacttcagttataaccactacaaggaaactcttgtcttagttcccaaaggagatgagttagagtacagagacaatctgatattggtgagaatgactgatctttcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtgacaaaaaattgcacagacaaggaagagttgacagagagtgcttctgttggacacggtgatggtaatttctttggaacatcagagttttatatcggtatgggagttggatttgcagcaggattttggggtttttgcagtgttgttttcttcaacagaacttggaggcgtgcttattttcattatcttgaccacttgagagatctgatttatgtgataatagttttgaag

SEQ ID NO: 64916 - DNA, 378 bp, Glycine max
  Peptide Sequence Number=SeqID_181694
atgcacgaacaacgcaaggcaatcaattcgtggggctccggactcaatggtggaggatgcatgaactgcattcaattcatgtggcttcgaataagatttgaggatggaggatgcacgaacagcgctaggcaatcagttcctgggactccggactcaatggtggaggatacatatggtggaggatgcacgaacagcgcatggcaatcaattcgggctccggatcaatggtggaggatgctgggcaatcaattcgtggggctccgaataagatttgatgatggaggatgcacgaacagcggtaggaaatcaattcgtggggctccggactcaatggtggaggatgcatcaataacaatgaattcatggggcttcgaataa

SEQ ID NO: 64917 - DNA, 520 bp, Glycine max
  Peptide Sequence Number=SeqID_181695
atgagggagcggcggacatcgcagtgctgggccgtgcgctggccagtgctgacccgcaggccagcatcgagaaggtggcaccgaacctggaagacgtgttcgtggccgccacccgtggtcgtggccgggagccggcggaatgaacctgcgcaggctgtgggcgatcatgctcaaggaactgcggcagctacggcgcgaccgcatcacgctggcgatgatcgtcggcattccggtgatgcagctgctgctgttcggctatgcgatcaatctcagcctgcgtcacctcgacgccggtgtcgccgatcaggccaacagtgccgcctcgcgcgcgctggtgcaggacatggtcgccaccggcgtgatcacgccgcgcagcgaggcgtacacgcccgaccagctgatgcatgcgctgcgccgtggcgagatcagtgtcggcatcgtggtgccggccgacttcgagcgtcgccgcttcgacggtcgcgaagcagtgcaggtgctggtcgatggcagcgacaccgtg

SEQ ID NO: 64918 - DNA, 243 bp, Glycine max
  Peptide Sequence Number=SeqID_181696
atgacaactaattcatggggctccggactcgatggtggaggatgcatgaatgacaatcaattaatggggctccggataagattcattggtggaggatgcacgaacagcgctaggcaatcaattcgatgcatgaatgacaatcaattcatggggctccggataagattcattggtggaggatgcagaaactgcgctaggcaatcaattcgtggggctccggactcgatggtggaggatgcatga

SEQ ID NO: 64919 - DNA, 495 bp, Glycine max
  Peptide Sequence Number=SeqID_181697
atgaccctttcatcatggcagaacaagctagacaagtattttacgtgcaagacccttgtgatgaaaaggtggtgcgtggttcagcagggcaaaacaattggtgttaatgtagaagatgatgattcatacatggacacctatgttagtcctttgaccacacaaatcactcctaacattgtcggagaagaagaagctggcgacgttcatgctaatcataatgatcatgatgaaggagaattgattaacatcgttgtagtttacaaaagcaaaggtgaaacgaaagatattgagctggtagaggaggaagaggcacggattggtgctgattcttctagtgcaacctctaataaatatgagaattataaggaggaagcacggaatgcagcacagaagcataaagcaaagagggtggagagtgtcaatgctgatgcagaagcctttggtgatcactggaaagttcagattgctctatgcattctgaagctgaagcactag

SEQ ID NO: 64920 - DNA, 1197 bp, Glycine max
  Peptide Sequence Number=SeqID_181698
atgaaacaatttttactggccccatcaatccttgccgctgattttgcccgcctgggcgaagataccgctaaagcgctggaagccggtggcgacgtggtgcatttcgatgtgatggacaaccactatgttcccaatctgaccatggggccaatggtgctgaaagcgctgcgcgattacggcatcaccgcgcccatcgatgtgcatttgatggtcaaaccggtcgatgcgctgattccggaattcgccaaagcgggtgccagcttcattactttccatcccgaagccagcgagcacgttgaccgtacgctgcagctgatcaaagagcacggctgtaaagccggtctggtgttcaatccggcaacgccgctcagctatctcgattacgtgatggataagctcgacatcattctgctgatgtcggtcaacccaggcttcggcggccagtcctttattccgggcacgctggataaactgcgcgaagcgcgtcgtcgcattgaccagagcggttaccaaatccgtctggaagtggatggcggcgtgaagatcgataacatcggtcagatcgcggcggccggggctgatatgtttgttgccggctcggcgatcttcggtcatccggattacaagaagctgccgcccgcgggcgttgagcgcgtctcaacctggattggcaacggtgcggacatcatgatggcgcgggcgctcagctgggcgctgggccgtgagccgcaggccgacgagcagcgcgacgcgcgtgcgctgttcgacaaacattacgccgcaacggtggaagccggcagtacgctgtttccacaggtgcaggagacgctggctgcgctgcacgccagcggtctgccgctggccatcgtcaccaataaacccacaccgtttgttgctccgctgctgcagtcgctcggcattgccgactacttttctctgatcatcggcggcgacgatgtggtggtgaaaaaaccacatccggcggcgattttcctcgttctcggccgtttcggcgtgcttccaggacaattgctgtttgtcggtgattcgcgcaatgatattctcgctgcccaggcggcgggcgtgccaaacgttgcgatgaccttcggctacaactacggtgagccgattgccaccagccagcccgatttaactctcgatacttttagcgaacttttgcccgttctcgggctgtga

SEQ ID NO: 64921 - DNA, 705 bp, Glycine max
  Peptide Sequence Number=SeqID_181699
atggtttcgagaactttcggtgagattttgcagccgcagccagcgccatggctggtagcgcttgccgaagggattgataagagcaggtcgcctataagcgaacggcctgctcagaaaccatgcgattttgcggggtttggcgcattttcgccgcgccccgcgggagaaaactcagaaatagctgacgaaaggcgtgctgtccggcggcgtcaccttggtggcggccttcagctgcggcgtgcccagatagaggaaaccgacgatctcgtcctgctcgcggcagccgaaggcttcgcgcaccagcgcatgctcggtccaggcgccggtgcgccagatgccgttaaagccctgcgccagcgccgccatctgcatcgcctgcaccgcgcaaccggcggaaaccacctgttcccagcgcggcaccttggtctcttcagtgcagtgcgcaatgacggtgatgatcagcggcgcgcggaacggcgccttggtggccttttcgatcgccgcttcgtccagctgatcctgtttcgccgccgcctgcagcagctggctgaagcgctccagaccctgattttcgatcatcacgaaacgccacggctgcagcgcgccgtgatcgggcgcacgcaggcccgcgttgatgatattttggcgcacttcccccgccggcgccggttccgccaggcgcgaagccgagcggcgattcaataa

SEQ ID NO: 64922 - DNA, 702 bp, Glycine max
  Peptide Sequence Number=SeqID_181700
atggcaggtgcacaaagcagcaacctaatttgggtcattagatttcaagtttcatgggcaactatgatttatcaaccaccacaaccgagggtgatgctaggtgcaccagcgttattgcttgtgcacccaacaattttaattaattctgtaaatgcccctgtgctttcttcttcctttttaagttggtttcgaaggttttttcatttacgcctccatgctttgttcttcactttctccctttcatgttggtttttcattgttgagagaggttccgcttcggtcgaggtgaaagtgttacgggtcggtggtgattgttgcggtggttcgttcgtcgtcggaggtacaccaaatcaatggatgtatgataatataatgtctgaagaaattgatatggatgatcaaaatgaacaagaatgtggtgtgaatgaacaacatgttgattgttcggatgcgttcaataattctcaggatgaaaagacaattattgctgatatgacaaagtcaatggtcaaaccaagaaacattctgctaacgttgaaggagcacaatgccaatacttgtacaacaatcaaacaaatatacaatgcaagaagtgcataccgttcttccattagaggaagtgataatgaaatacaacatctaatgaagcttcttgaacgggatcaatatattcattggcatagattaaaggatgaagatgtg

SEQ ID NO: 64923 - DNA, 429 bp, Glycine max
  Peptide Sequence Number=SeqID_181701
atgaagcatgaatttgacatgacagatcttggaaaaatgagatattttttggttcttgaagtgatgcaacgaatagatggcattttcttatgtaaaaaaaatgcattagagatgctacaaaggtttggaatggatataagcaattcggtgcaaactccaattgttcctagcattaaactcacaaaggacgacactggtgcaaaggtggataagacttactataaacaaattgtgggaagtcttatgtatctaacatctactcgacctgatataatgtttgtggtgaacttaattagcagttgttgtttcttggtcatcaaagaaataaccaattgtgagcttatcaactacagaggcagagttcataggtgcagcatcgtgtgcttgtcaagccatatggttgaaaatggtgttgggaaaattgtgtaa

SEQ ID NO: 64924 - DNA, 303 bp, Glycine max
  Peptide Sequence Number=SeqID_181702
atgttggggaagcttgggaggattgatggggacccggtgttgagagaaacgaggataggggctacgtgggagtacgtgagctcagttggaggtgggcaacaggggatggtggagtggtacctggagatatgtcgcgggggtcaggagaccttggggatgtcaggtggggtgctattgcccaaaaccaagcttgaccaatcccgacccaacccgggcatagtcagcttgaaaacgaggtcaggaagctatgagggcttctgggtaatcgattaccaagggggtgtaatcgattacccagcttag

SEQ ID NO: 64925 - DNA, 219 bp, Glycine max
  Peptide Sequence Number=SeqID_181703
atggagaattggcgaacagcgctaggcaatgacattcgcggggctccagactcgaaggtggagtggagaatggagaattggcgaacagcgcttggcaatgacattcgcggggctccagactcgaaggcggaggacacatgcacagcgctaggcaatgacattcatggggctccaaaaaaagtggagaatggagaattggcgaacagcgcttggcaatga

SEQ ID NO: 64926 - DNA, 447 bp, Glycine max
  Peptide Sequence Number=SeqID_181704
atgccgatctccccctacagaagtatcagttggtctgtgccgtcccgacataggggtcgcacccacaagacacccagtggactcagagaagtccaacaggaccctggagttgccagctctggttacgggcctctgtcagtcctacagggttcccataccccccagcaagagatcgtgcccacaagacacccagtgaacccggagaagtccaacagggttctggggtttccatctctgattacgagcctctgtcacttctacagagtgcccgtcacccccagcaaggtcatcaggcctcctactaaccgagctttcatcaagaagtattgcacccccagacaggcagagggcgagacaccacaacagcctggggatggctggcagcgggcaacaaatgcaccgccaccacctctagagttcatctcagctcatccacaaaaaggttag

SEQ ID NO: 64927 - DNA, 340 bp, Glycine max
  Peptide Sequence Number=SeqID_181705
atgccgccttcccagccaccgaacacggcgaccaccagggccagctggatgaacttgtcagtcttggcgtgcatagctcttctccacttcgccgcgcaggcaggcccagatatcgcggtacaggtcggtgaaacggtcatccagcttgatttcggccacattgcgcggccgttccagatccacatcgaaactgcgcaccacacggctggccgggccggaggacagtacgaccacgcggtcaccgagcgcgatcgcttcttcaaggtcgtgggtgatcaggatcaccgagcgccggtcttcctgccacaaccgcagcagttcgttctgcatgaggtggcgg

SEQ ID NO: 64928 - DNA, 1035 bp, Glycine max
  Peptide Sequence Number=SeqID_181706
atgacaactgaattaaccctgattcgccctgatgactggcatttgcacctgcgggatggtgagggcttgaaggccgtgctaccagatacggccagacaatttgcacgagctattgtgatgcccaacttgcgcccaccagtgaccacggctgaagcagcactcgcctattatcaacgcatcaagcaggctgtgccggctgggctggtatttgagccactgatgacgctgtacttaaccgataatacgcccgcacaggagattgctgctgcccgtgcgagcggcgtcgtgcaggccgtaaagctgtatcctgcaggtgctaccacgaatagtgattctggtgtcaccagtttgcataaatgtgcagccgctttggctgagatggagaagcagggcatgcctttgctgattcacggtgaagtgactgatggcgatgtcgatgtgtttgaccgtgagaaggtgtttatcgagcgtcatttacagccgctgttaaaggactttccaggcctgaaagtagtgtttgagcatattacaactaaggatgccgttgagtttgtcgctgcaggccctgatacattgggggcaaccatcactgcgcatcacctgctcatgaaccgtaacgcgatgttcactggcggtatccgcccgcaccattattgcttaccggtactgaagcgggagacccacaggcaggccttggtgaaggcgggtatttcggattccggaaaattctttcttggcaccgacagtgcgccacatcccaagtctgccaaggaagccagctgcggctgtgcaggcatgtatactgcacatgcggcgattgagttatatgccgaggcatttgaagaggctggtgcactggataaactggaaaactttgccagtgtttatgggtcagatttttacggtctgccgcgtaataccgacaaaatcacactgcgcaaggaatcctggctcgtgccagacagtattccgtttgcagatgatgtattggtgcctttgcgtgccggacaaacaattgcttggagattggtgtaa

SEQ ID NO: 64929 - DNA, 294 bp, Glycine max
  Peptide Sequence Number=SeqID_181707
atgagtggaatacaacaagtcctagaggcaactgtggacatggagttcaagcaactcgatgtaaaaactatctttctccatgggagactagaggaagacattctgatccaacaacctgaaggttttgaggtggaaggaaaggaaaattatgtcggtagattgaagaagtctctttatgggctgcaacaatcaccaaggcagtggtacaagagattctatgactcatgtgtttatcatagcaaggtggaggatggttcccacatcaatctactacttaatgtggatgacatgtag

SEQ ID NO: 64930 - DNA, 330 bp, Glycine max
  Peptide Sequence Number=SeqID_181708
atggtttacataggtttattcatgattggagtgcgagcattggttatggagcattgtatgggtttcttgaacctcagtgtatccacaatgcaagcagtagacatcaagagtgtgaaaattacattggaaggcccattggcagctcgttgtattgtgcccaggcgacaatctagtggtttggttttgttctttgcgaaagaagtcggatgttgccatcaagggtgcagtaaacagagtcatgttcaaacaggaaattacgagtgtgaatactatgttatgcaatggatatggtgcatcgtaagtggtggattgaaggatgactggattcac

SEQ ID NO: 64931 - DNA, 291 bp, Glycine max
  Peptide Sequence Number=SeqID_181709
atgacaaaaagggagatgataaccgtgatagtagacacaataccagtgttctacaatgaaaagatgttttcgttgatcgaagtgggtctgaaaagaggcaaatttaatcatcctgcttggatgaatgagaaaactggagcaaatgaagagggtgagaatgagggagaaacccgtgctgtgactgccattcctatacggccaagtttcccaccaacccaacaatgtcattactcagccaataacaacccttctccttaccaccacccagttatccacaaaggccatccctaa

SEQ ID NO: 64932 - DNA, 732 bp, Glycine max
  Peptide Sequence Number=SeqID_181710
atgtcatcaagcaaaggtccccggacgaaattagggtatgacagactgcacgtgctcgcctttagaggactacatgtcctcgactttagagggctacactttctcgcctctagagggctgcacaccctttccttcagaggattgcaaatcctcgtctttagaggattacatctcctttactttagagggctacacctcctcgccttaagagggttgcacatcctcgccttcagaagactacagagggctacacgtcctcgtcttaagcgggctgcacgttctccccttaagagggctgcacgtcctcgccttaagagggttgcacatcctcgccttcagagggctgcatgccctcacattcaaaggacttcacatcctcgccttcagagcactacatggctgcacgccctttccttcagaggattgcacatcctcaccttcaaaggactacatctacttgactttagagggctacacgtcctcgccttaagagggttgcacatcctcgccttcagaggactacaggtcctctcctttaaagggctgcaagccctcgcctttagaggactggatgtcctcgccttcggaggagtacatgtcctcgactttagagggctacacgtcctcgccttaagcgggctgcacgttctccccttaagagggctgcacgtcctcgccttaagagggttgcacatcctcgccttcagaggactacacatcctcgacttctaa

SEQ ID NO: 64933 - DNA, 622 bp, Glycine max
  Peptide Sequence Number=SeqID_181711
agggctgcacgtcctcaccattagaggactacatgtcctccccttcagagggctacacgccctcgccttcagagggttgcacgccctcgccttcagagggatgcacgccctcaccttcagagggctgcacgcccttgccttcagaggactacacgtcctcgccttcagagggctacatgccttccccttcagagggctacacgccctcgcctttagagggttatacgccctcgccttcagaggactacacgtcctccccttcagagggctacacgccctcgcctttagaggactacacgccctcgcactcactactcggttacacgccctcaccttcagagggctacacgccctcccactcagaggactaatcgtcctcgccttaagagggctatatgacctcacctttagagggctacacgcccttaccttcagaggactgcatgtcctcgcctacagagggctacatgtcctcaccttcataaggctgcacgtcctcgccatcagagggctgcacgtcctcaccattagaggacttcacgtcctccccttcagagggctacacgccctcgccttcagagggttgcacgccctcgccttcagagcgacggggatcctctag

SEQ ID NO: 64934 - DNA, 195 bp, Glycine max
  Peptide Sequence Number=SeqID_181712
atgtatgaaaatgacttacagaatccacaattgtataacaacgatgctgagacattgaccaccgtgtgctatttcagaaagatattcatgctttatgtacaagtggaagttatcattatacaccgcaaatatgatagcatcccacatcacttgcaacaacctgaggaaaagctatgggatggtcaatgtcatcag

SEQ ID NO: 64935 - DNA, 225 bp, Glycine max
  Peptide Sequence Number=SeqID_181713
atgactatggaaggtctctttttgttatcttttctgatcttcaaaagccagccacaaggagagcttgatggaaaagcatgcgcggctattggacagagtagtctcatggctctctataatacaatgttcagccaggttggcacaaaactaattaagttgcatattcattatcatcacaactttcaagggattctagcttcaaaaaacaacttgcagacacggtga

SEQ ID NO: 64936 - DNA, 411 bp, Glycine max
  Peptide Sequence Number=SeqID_181714
atggactatgatgaaatcttggtgtttaacaaagagaacatagctactgttgtgtatgatgatgtagctgtggctttctactcttatgcgggtacaacttggatcgggtttgatgatggaccatccataaagaagaagggctatttcttttgggctgttgggaaagataaggattggactatctcaagacaaggagaggtgcctttgacaggaggggggacctgcgaaacaaaggactccgacgctcaaaggggtttgatggaaccaacatttatattagttgagcatggttgctggtccttgtttgtaggggctgttgtagcctttgtagataatttccggcttgtagataatagctgggagcttatagataatgttaaagataaaaatttgcttatagataaaaggtag

SEQ ID NO: 64937 - DNA, 957 bp, Glycine max
  Peptide Sequence Number=SeqID_181715
atgtatgttaatctgatcggtttggggccagcaacgaccggggtggatgatgacaacctagcacacaggctacgctgcacgtggggagatgccctcacatctctgcctccactacctctcctcacacccctgaaaggagaaggggagaggatcacaataaccgggacaagctacttgacagcaacaaaaggtcgcgcccttccacaagggcaagaagcgcccccacctgcacgacacaaggccctcaccctttccggagaggaggacttgctatcggaggcacctcaacaagtatccttagacgaggaaccacctatcgagatgacctctcgatccatgatgggttgctcaatcgatcccccagaatcactgccacctagactgatggcggaattaaacggaaaggaatacattatggtggatggaagtaccttcaaaaaccaaatgaagaagaaagggaaaccgaaaagaagaaagcaaggaagcaagaagacaatgaacagtgacccgaaatcaaatagtactacacgtgcaccacaaccgcctgttgcaatagacggatgtaacgtctatcttcaatgtctccaacggtcagaaaagggcagagttatcaaatccgatgacttaccttacctgacacaccaaagacatgtccatcacggacagcttgacagaagtagcccagacaacacttgtccaggctcaggggcctggcaaaccacatcgacctgcaattttctcacactcgtcgaggttaccacactcgacaccagacaatattcgtccatacttaggggctcaacaaactcatcaccctctacttgtcaagaatactaccccagatatcaaacagactctctcaccacgggacaatctctttcaacactggacaacctctttcgcctacaagctggcttagagcttggggggcttatgtactgtctaggacctacatga

SEQ ID NO: 64938 - DNA, 744 bp, Glycine max
  Peptide Sequence Number=SeqID_181716
atgaagagcttaggggaagcaacaacggtgtcatcggcggctatcataagtgagcttgaaagaatgagagtagtcaaggaaaagctcaagacaggagtcactagggtcagaaaagagtgtgacgatctaagggatcttaacatgactacagtcgaagcgggtagtaacaatgagctcaagcttcgaagggccgaaagggacgagtcaagggtggaaagcatgtacaaggaaaaggtaaacctagctgctagtcatgggcaaagactagaggacgagcatgcaaaggtaccagctttgcaaatggaaaaggaagcaagagagaaagtgatagaatcattgcacggggaggcgatgaaatggatgggcagattcgctctcactctgaatgagagtcaagagcttccaaagctattagctagagccaaagcaatggtggatgtatacccggctcccgatgaagaagtgcaagagcagatgaaggccgacatggaggccttaaaggaccaaatgacctccatgatggaggccatgatgagtatgagatggatgatagaggacaacgtgatcgtcgttgccaccaccagcatcgccgctgaggcgaatccgacccacctatccggcataaaccaaacaagtcgtccaaccctagacatgtgcacgtgcccaacgagaacgccaaccactctgttccccgttctccttgagggccagcaaccccagttggggcatgcacccttggcttag

SEQ ID NO: 64939 - DNA, 552 bp, Glycine max
  Peptide Sequence Number=SeqID_181717
atggttagcactcggtctagcctcagacgcgagacccccttcgcagactcccatcttcatcctgcagctatgacaaacgtagatactttacaactccaaaaccgcatcgcgaagatggaaaaacgtcacgaggaagagttgactaagctaaagaccgaacatgcccagctggaggctcgtgtcaaacgtccccagggtgacgagcaatctgcccacaccttgcttgaatgcacacaaggggaatcacacccccgacgcacaggcaacactgcagatgatttgagtctctcccatatgcactgttcagtgtggattgtccatcagcatccttttgtcgaccatattatggaggcgaacctctacaccaacgacgacgcgattctatgttgtgtcttccctacatgcctcaagggagcaacattgaccaggtatagtggactcgcacctaggtccatagacagcttcgacaccctcgttgaacaattcagtgtgcagtacaccactagcaggtctcgccgcataacctcaaccgccttggccattctacgataa

SEQ ID NO: 64940 - DNA, 594 bp, Glycine max
  Peptide Sequence Number=SeqID_181718
atggagtcgccaactgtcacaacctaccctttactgggagggcgatgcgagactcaagggcgagttgttgcttcaacccgaagtaaccttgctcacccagctcgcccaagcgagctggttacttcacccctaagctatttggggagcccaggcgagctagaggctagcctggggtctgacactcagcatctggaatctaaacaatccattgaccaaccagtcgatgttgggcagagggtatgcgtctttggggcatgccttattcagatcagtgtagtcggtgcatatttgtcatttgccattggtcttttttaccatgacaacgttggcgagccaaatagcaagtttgtggcagattatgccaggatagattctcggcatttgcaactggacaagctcttcgatgggtttcaggcctttgtcgaaggtgtcatctcacagatctatgtcaaattcattgccttggctggattggtagatggtcaaggctcgaatttgagacccttcatccactatcatgacttgagtgccttcagccactatggggtgacacctagtgggctcccagatgggaggatacggagctacctttag

SEQ ID NO: 64941 - DNA, 501 bp, Glycine max
  Peptide Sequence Number=SeqID_181719
atggaggaagatcgtgaagatcctaatgaagatgattcattgggtatagatgcaaaggatgaagattgggggcccaagcatgaacggatggatttcaagtgttgtcaaaaccaaatatgcaagcatgaaagagacgacaactccaaatttttccattcaaccataaattggaggaggaggtctaatggggttaaaggcctatggaaggattacagttggttagatgacttgaaatatgtaaagaaagagataaacaatttctttcaacaaaaattcaaagaacatggggatgttgacatgaatttggatggggtgcacttcaaatcaattggtgatgctgagaatgagcaacttacttgtcctttctctgatgaagaggttaagagtgtggtatgggattgtgagggcaaacaaagttccaacccatatggatataaatttagctttatcaaagctttttggcatatactgaaggaagacatttgttttgccttaagataa

SEQ ID NO: 64942 - DNA, 228 bp, Glycine max
  Peptide Sequence Number=SeqID_181720
atgttgaacccactcaaaattaagcagtttcaggaaagcttcatagttcagggatttaatctgataatccctacccaaatcatggaagaaacttcgttagatgaaaactcttttaaatgcacaagatgtggaagaggggatctatttgatgactttgcctcaacggaatcacttgaagggaaagataaaggctcccctatgtcaaaatgggatgacaatgtaggttga

SEQ ID NO: 64943 - DNA, 1956 bp, Glycine max
  Peptide Sequence Number=SeqID_181721
atgaccgtggtggaggatcatagaatggatgatctcagagaccagttccctattggaatgcgtgttcttgctgttgatgatgactcaacatgtctcatggttctggagactctgcttagaagatgtcaataccatgtaaccactactaaaaatgcaataacggcattgaagttgttgagagaaaacaaaaccatgtttgacctggtaatcagtgatgtccacatgccagacatggatggatttaagctgcttgagcttgtggggcttgagatggacctaccagtcataatgttgtctgtaaatgatgaccctaagatggtgatgaagggaattacacatggagcttgtgattatcttctgaaacctgttagaattgaggagctacagaacatttggcagcatgtaatcaggaggaagaagatcgattcaaaggagcggaacaaaaccagtgaccatgacaaacctaatgctgataatggcaatggaagagtgtcagcaggaacaggaaattcagatcaaaatggaaagccttccaaaaagaggaaagatcaggatgaagatgatgaggaggagaacgaggatggccatgacaatgaggactcatcaactctgaagaagcctcgagttgtttggtctgtggagctgcaccgcaagtttgtttctgctgttaatcaactaggcattgacaaggctgtacctaaaaagattcttgacttgatgaatgttgaaaagcttacaagggagaatgtggccagccacctccagaaatataggctttatctgaaaagaattagctgtgtggcgaaccgacaggctaatctggtggcagccttaggcactgcagattcatcttatttgagaatgggttctctgagtggggttggacatatgcagacattgactggtcctcaacagtttcataacaatgctttcagaccctttccacctggtggaatgattggtagattgaatgcttctgttggtctgaatatgcatgggatatcttcttcagaagctcttcagttgagtcatgcacaaaatttaaacaaatccataaatgatccacttaagttccaatcagccatagcttgtggtaatcaaaatggtatccagggaatgccaatgtctataggccttgatcaattgcaacataataagggtgttagtgttggtcctattcaaaacatgtcctccctaattgatgatagaccaacttttggcgtgtcaaagaaactctcagatcaaacacaaaaagtaacaattggttgctcaccctctccggttttggacatctcaaacaatgacttggtattgaaagcagatagtgaaaacacacaagggggcggagtatatgagaatttaacttcagtagcctctcagcattcccaattttctctccctttgttggatcatggtaggtgtagtgatatttggtcaagtcctatgcagtcatctgggacaaattcttaccctccaagtgaaactttgcaaggggggaatctgagtggtcaatcatccattacttcactgtttaatcaatcccatgattcaccgacagatatgcactctcaaggactcatttttacaaataacttgggacaaatgagcaataatgtgccatttcaaggctgggatgacaataatcatgatagtaattacgatgcaaatgttattggtaattcaatagacactctgattgatccagaaggccatacttctatcaactcaaactataatagaaatctggacttcaatttctgtaatcccttacagatgaagcatgatggaattatgggattgagtgaagaaaactcattgaaacaacaatatgggtacatcatgaaccggcagaagtctcaaaacagtagtgccactaataatcttggttcattggaagactttgccagttcaatgatgaaacagaattttctcaactcttgtttgcgtattgattaa

SEQ ID NO: 64944 - DNA, 198 bp, Glycine max
  Peptide Sequence Number=SeqID_181722
atgcatatgacacagatgcaatttacgaatacgggagtccaagaaattgtccccttcttggatacaacgtttgggcagtatggcacccaacaggggatcaagacagaacccatgtgcgatgcatatgcgaaaaggcgcaacacagggaatgtacatagtatgacaatactcactgaatataagcaaaagggtatatga

SEQ ID NO: 64945 - DNA, 317 bp, Glycine max
  Peptide Sequence Number=SeqID_181723
gtgctccagtggtttctgtttctatcagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagaattcgataaatcctcaggtttccaatcctccagcaaatggctgacaaaggttgtaactagtgatatagctggtctagctgtggctaggtgtgaagtctag

SEQ ID NO: 64946 - DNA, 247 bp, Glycine max
  Peptide Sequence Number=SeqID_181724
atggcctttttaggagaaactagcagtcagacgattgtcaactcaaggttggctttcatttttccaaatggatcgattattcacaatgatactggggtttacttccaaactttgattccggtgcccattcgagtaccaaacaactatgattttgcaagcttaaaaatcagaatacacaatacccttcagctatccaacaaacaatttttggatgaaattcactaccggaagccattcacccatacag

SEQ ID NO: 64947 - DNA, 615 bp, Glycine max
  Peptide Sequence Number=SeqID_181725
atggttgattatgagtatttgaagatcgttgttaggggtggagtttctaacgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgggactattgctgtgaattttgaaaaaatatccaacatgatggagaaaagagaaaaagatagagatagagatagagagctcgagggtattatttgggatgttataaaagaaatttcaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 64948 - DNA, 453 bp, Glycine max
  Peptide Sequence Number=SeqID_181726
atggagttctcatcagcagttgccttcatcttttctattttacctcttcttttgctcttgaaactaacgttttcttggtgggtttcaccaatcctgaaccatcttaagcttaaaagatgtgggtttggagggccactcccaagttttcctcttggaaacattcaagagatgaaaaagaagaatagcctgagttcttcattagggtcctctaatctcacccatgatatacactccactgtcttcccctatttttctcgctggcaaaactctcacgggaaggtgtttatctattggcttggtacagaaccgtttttgtacattgcagatccagaattcttgaaaaaaatgtccactgaggtcttggccaagagatggggaaaacctagagtgtttagacacgatagagatcctatgtttggaaatggtttggttatggttgaaggcaatgaatgg

SEQ ID NO: 64949 - DNA, 851 bp, Glycine max
  Peptide Sequence Number=SeqID_181727
atgggagtcgctgcaggccgaactccacggcgagccggaaacactgcgcggccgtctgcgggtgatggtgccgcatgccttcggccaggcgcagctgctgccgaccatgctcgcattcctcgcccggcatccgcagctgagcctggaaaggcatcgactgcgcggtgcgggtgggcccggtcgacgaaccgcgcatggtctcgctgccgctggccgaagtaccgcgcatcgtcgtgtcgtcgccctcgctggtggacgccacagcaggcgcgcgcataccctatcgatcagcccgcgcctgctcagcgacaacctgttcgtggtgcaacaggccgcatgtgccgggctgggcgcagcggtggtctcggcctggctggtggccgaggacatcgcacacgggcggctggttcagctgctgccggactggcaggcaccggcactgccggtacacgtggtatttcccgccgcgcgccagcagccgccgcggctgcgcgccttcatcgatgcgatgaaggccgcactgccgcagttgcacggaatgcggccggcaccgcgttaggccaacggccgcgtcatccacgcatggcgtggatgccgtccaaccccatagggtcggatcccttcccaccgggaagggctctgaccctccaacatcctgtccagcgcagcgcggtcatacacgctgccacgcaggatcacgctgtcgatcttctcggtggcggcgatgtcctgcagcgggttggcggtcagcagcaccagatcggcggccttgccctgtgcgacaccaccgtagcggtccatctggccgaaccaggccggaccggaacgggttgcggccgacagcgcctgcg

SEQ ID NO: 64950 - DNA, 240 bp, Glycine max
  Peptide Sequence Number=SeqID_181728
atggcgctggcagcgcaggccatcctcggtcagttgcaggccatgggtggagcgcagcagcaggcgcaggccgagctgccgctccaatgcctgcaggcgtcggctgaccgttggctgggtggtgcccagctgagcggctgcggcagacaggctgccggcatagacgatgcgcaggaaggtgcgcagcagatccaggcgatcggcgccagcggtgaggtcggtcatgcgtatggcgtatga

SEQ ID NO: 64951 - DNA, 180 bp, Glycine max
  Peptide Sequence Number=SeqID_181729
atgacacgatccctcatcagcttacagggaatagaagagaagactaccaagttgaaaggaagtgagaaggctctagttgcacggcatgaagttagtcatgctgtagtaggtactgcagtagcaaaccttcttgctggacagccacatgttgaggctctggttatcagactcctggtttaa

SEQ ID NO: 64952 - DNA, 399 bp, Glycine max
  Peptide Sequence Number=SeqID_181730
atgatggcacatcactttgcatttgatgttttgatgatgccatatgatcgtgatgatttgatgtcttatgaaaatgcgcttctcaagtttaattcaagacaacaatccaagaatacaagatacaacatcaagaagatctctagtattttaggaagggaattccaaattgaaatagcaaaaggtttggccaagaaatttaagttaaaaagtctttttcaagagatttactctctgttactaaacgttattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactctttaagtga

SEQ ID NO: 64953 - DNA, 1398 bp, Glycine max
  Peptide Sequence Number=SeqID_181731
atggctgcaccacatgatgatgatcctagaaatatggtttccatttcaaggattgtttctgtgcatcccaagcttgtgcaacctcagagggttttgaccctttcaaatttggataggcagtgtccaaacctcatgcaattggtgttcttttacaataaccttcctcaccaaactctgaaggacttgtccctcaattcagtgttctccaacttgaaatctggcttggaagagaccttcactctatggtatcctagtgcaggtaggcttgggccaaatcaaagtgatggcaagctcaatttgtggtgcaacaaccagggtgcagttctggcagaggctgaaacctctgttaaaacatcacaacttggaaacctctctgagtacaatgaattctttgagaagctcgtttataagccagcttttgatgggaatttctcaaacatgcctctgattgttgctcaggttactaaatttggatgtggagggtattcaattggcattggaacaagccactcgttatttgacggggcagcaacctatgacttcttgtatgcatgggcctcaaattctgaaattgtgaaaggaagaagcagatctgatgagcttccaaaaccagtgcatgagagagggatacttctcagtggtagtcttcaagccccaagagggactatgaattttccttcagattcaagttcaaatgctaagcaagctagggccatggcaatagatcacttatatcaacttataatgcaaacagctagtggacaaaagggctttcctatgcaaattggaggaacctctaatccaaagaagtgtgtgcttaaaacctatcatctttcaggtgcaatgatagaagacttgaaaaggaaacacttttccatgcaaagaggttctcttcctttctcaacctttgaggttcttgcggctcacctttggaaggcaaggaccaaagcattagagatgaagaaagagaagctagtatgcctccaattcgcggtggacataaggaacaagatgacacctccattgccaaaatctttcagtggaaacgcctacgttctcgcctccatcatgatgtcagtggcagaattggaacaaacaagccatgaattcatcattgagaaaataagagaagccaagaacagtgtaaaccatgactatgtaaaagcctacgttgatgccctagatgggccacaacaatgttcttcactccctccactcaaggagctaactttggtctctgattggacaagaatgccctttcacaacattgagttctttcgtggaaaagcaacctatgcatgccctttggccactcctatgccacaggttgcatatttcatgcaaagccctagtgacaacaagggcgttgacgtgaggattggcttcgaagcggaaaac

SEQ ID NO: 64954 - DNA, 387 bp, Glycine max
  Peptide Sequence Number=SeqID_181732
atgctgataggatttgatctccgagacctttcaaagattgaaagaaaaagtttttggaagaccaataacaacaaagtcttatcttacaaggttggcgagtctgtgatagagaggggttacggtgtggtgagtagggaagttgctgttagtaggcaaagcatgcgtgcatttcaagcccaggccttgtcttgttgtccctcactttacatacatttcccttatttccagcttatatgcaaattcatattcacaattaacatgcatttgaagtacaaggaagttatgctagctaggtataccatgcaatgcatgcatgaggaagtacgtactatccaatccttgcattttttatatctggcatatggtacatgttcgtctacgcaataa

SEQ ID NO: 64955 - DNA, 576 bp, Glycine max
  Peptide Sequence Number=SeqID_181733
atgactaatgcaaactgtccgcaagagtcattgcattcagtctcaaacgggaatctaaggttccttcaggtttcttcttttttcgaggacaagggtgagagccccgccgagtctgatgaaataaaagtccaaacttggagcaaccaacactacaggaacgaacatgtggttgttgttgctgctccacggttgcaaaagtattatagttttcatgaccagagtggggagcaacctctgcttttgcccattcgaagcttgaaatctcgcttattcgaagaagatattgatgttcaatctctgaacatgttaatgagttctaaaaggttttcaagcaattcaaatagaaatgcagaagttgaagctgatgttgttgatacagatgttcaatctctaaataggtcaacaatttctcaaggattttcaagcaattccaatagaaaagctgaagttataatgttgtcttcaaacacttatgttataatgttgtcttcaaacgcagaggattcggtgaggaagaagggcttctacaagtcttgtcctccaccacctccgccaccgccaccaacaatgttttag

SEQ ID NO: 64956 - DNA, 453 bp, Glycine max
  Peptide Sequence Number=SeqID_181734
atggatgccttagaaatttacttgaatgaagtagaaagacaattagacagaaagtggagtacagttccacgagatgtggaaattaaagaagttagagtgcaagtccctctagcttgtgcctctagcagtaaggtgattgctcctttggttgttgttccaaacaataatgaagaagagcaacataataatgagtccatgatacatcataaacctattgtggaagaaccacaagaagtagcattaaggaggtctcaaagagaaaggagactagctattttgaatgactatgtggtagacttgttgctaagtgtcgcaacctacccttcggcggaagggcgacacgagactcacgggtgcatcttccaaggaaggaaaacgcgcggagtcgccaccaacgtttattcgaggaaaacgtcggaaaaaccggaaaaaggcatggtctacgaactttaa

SEQ ID NO: 64957 - DNA, 450 bp, Glycine max
  Peptide Sequence Number=SeqID_181735
atggccccgaggaagcttgcctcaaagaggtccaggaaggataaggcggccgaaggaactagttccgctcctgagtatgacagtcaccgttttaggagcgcggtacaccagcagtgctttgaggccatcaagggatgggcgccgacggtggacatcactggttactcccatggccaatggatcccgttcgatgcatatgctatcggtcagctcctgggatatccgttagtgctggaagagggccaggagtgtgagtatggccataggaggaaccgggaggcgagtgcgaatcatgcgcaccaacatgaccaccctgacccagatatggatgacgttgctcctcagcaacatcctgcccaacaatcattccgacctccccctaccgaagtgtcagctggtgtacgccatcctgacgcggatgagcgtccatgtggctcagttaatcgctga

SEQ ID NO: 64958 - DNA, 408 bp, Glycine max
  Peptide Sequence Number=SeqID_181736
atgggtacaactgatattggacttgtctaccatggagacacgtcttgtgctcttgctggttatttagattttgactatgctgtagatttggatgcaaggagaactatgacaaggataagaggtgagatgaggcgccatctactagaggataagccatggaaggagaagcttcaccaccaaaagagtgccttggataagaagcttacagaggaagcttcaatgaaggaagagaatgagagagatagagtgatgcaatcctaccccttaagggcattggatagaagactccaagaagattgggccagagatgcaagagaaggccctacggttcttatgagccttaaggtagatttcaggcccatgacatgggctaagtatgaactcacttatctttgtatattagattaa

SEQ ID NO: 64959 - DNA, 183 bp, Glycine max
  Peptide Sequence Number=SeqID_181737
atgacaacgagggttaggcaacaacgtcctagagtagcagcgactgagaccagcgaaagacaaagggtgagagtgtcgtgggcttacctgttggcggcgtgggctgatagcggaggcacaatggaggcccgacgtgatgtggcttcacctgtcaccttattgcttgagaaatcatcatactga

SEQ ID NO: 64960 - DNA, 450 bp, Glycine max
  Peptide Sequence Number=SeqID_181738
atggcagaatcgttgaagaaacataaggggtcctcctccaccaccaccgctataggccactgccaccatggaactccaatgacccaccaacaccaattcctccctccttttcatctcccagatattgaattctttgatggtgaaacatttgattgctaccaactgagcagtcaaggtgttccttttgagggcactctagttgatgactggaaacatgtttattctagtcatgatgctcgaaaaatggtctgccatgaccatgctgacatgacaggcagattgctcgctgggtcatttacctttgagtgtcacatcatgcactgtattctttgtcgaattttgcttcctaggtccattaatcttgcccaagcctctgaggaggatttaatcttgttgtgggctcttcaaactggtcgtcagattgactgggcccatcttgttcggcactga

SEQ ID NO: 64961 - DNA, 162 bp, Glycine max
  Peptide Sequence Number=SeqID_181739
atgaatgatgaggttcctagaagcagtggtagtgtacctagatttaggagagatgctagagatgacttaaggaggatgccaacatctgaggaaatttatcatgccaggtctaaatggttttcaagcagttttctttcagaagtattggactatggttggtga

SEQ ID NO: 64962 - DNA, 292 bp, Glycine max
  Peptide Sequence Number=SeqID_181740
gtgggatgataggatgacaccaattacacctgacgaagatgttttctacgttgtagattttttgcgtgttgctaaaacgtttgatgtggtggacaaactacaggttcaaaacaaacagatactgcggttttgtaatgatgctggtattaagatcacagagtatcttatcgggaacaaaactcatcaacaatgggtggaacactttggcccaaaatggaaactttttgcagatagaaaaactgaatttgatcccaaaaaaatattgtcacctggacatgggattttccagtaa

SEQ ID NO: 64963 - DNA, 405 bp, Glycine max
  Peptide Sequence Number=SeqID_181741
atgcatgaacggaaacgcaattcatggggctccgaatcaaaggcgaggatggagaattgcaatagagggtcctcactagtcaatcatgaagcatggctccaaactccatggtggaggatgcatgaacgcaaacgcaattcttggggctccgaaggaaaggcgaggatggaggattgcactagagtagtcaatcatgaagcatggcttcaaactctttggtggaggatgcatgaacgaaaacgcaattcatggggccccgaaaaaaaggcgaggatggaggattgcactagagggtcctcactagtcaatcatgaagcatggctccaaactctttggtggaggatgcatgaacgaaaacgcaattcatgcggctccggaaaaggcgaggatggaggattgcactaa

SEQ ID NO: 64964 - DNA, 2883 bp, Glycine max
  Peptide Sequence Number=SeqID_181742
atggagtggaaccctcagaccctccaattcctctcggaatgcttcctccacactctctccccctcgccggagccccgccgccgcgctgagtcctccctcgccgaggccgccgaccgccccaactacgccctcgccgtcctccgcctggtcgccgagccctccatcgacgaccagatccgccaggccgctgccgtcaacttcaagaaccacctccgcctccgctgggcctccgaggactcccccgtccccgaccccgagaaggaccagatcaaaaccttaatcgtccccctcatgctctccgcctcccccaaaatccaatctcagctcagcgaagcccttgccctaatcggtcaccacgatttccccaaatcctggccctctctcctccccgaactcatcgcaaatctccaaaaagcctcccagtcctccgattacgcctccattaacggtattctcggcactgctaactctattttcaagaaatttaggtttcagtataaaaccaatgacctattgctcgacttaaagtactgtctcgacaacttcgccgctcctttattggagattttcctcaagacggcgtcgctgatcgacgccggcgccgccaacctgcgcccgctcttcgagtcgcagaggctgtgctgcaggatattctactcgctgaattttcaggagctgcctgagtttttcgaggatcacatgaaagagtggatgggtgagttcaggaagtatctcaccactagctaccctgctcttgagagcagtggtgccgatggtgttgcgcttgtcgatgagcttagggcctcggtttgcgagaatattaacctctacatggagaagaatgaggaggagtttcagggattcttgaatgatttcgctcttgcggtgtggactttgcttgggaatgtgtcgcagtcatccagcagggaccggcttgcgattacagcgattaagtttttgaccacagttagtactagcgtgcaccatactttgttcgcgagtgatggggtgataccgcagatttgtcagtgtattgtgataccgaatgtgaggttgagggaggatgatgaggagctgtttgagatgaattatattgagtttattaggagggatatggaggggagtgatcttgatactaggaggaggattgcttgtgagttgctcaagggtattgcgacgtactatggggatgctgtgaaaagcattgtttcttcgcagatacagagtttgttgagtttgtatgctgctaaccctggggcgaattggaaagacaaggattgtgctatttacttggtggtttctcttgcaaccaagaaggctggggctagtgttgtctccacggaactcgttgatgttcagagcttttttgagtctgtgattgttcctgagctgcaaaatgctgatgtgaatgggtatcctatgctcaaggcaggtgcactcaaattttgtactatgttccggacacaaatttcaaagcctgtggcattgaaattttttccagatttggttcgttttcttgctgcagagtcgaatgttgttcattcttatgctgcaagctgtattgaaaagctcctgttggtgaaggatgaagggggtgcagcacgttatacttcagctgatatcaatccaattttccccgtgctgatgaacaatcttttcaattcctttaagctcccagaatctgaagagaatcaatatgcaatgaaatgtattatgagggttcttgccgttgcagatatatctgttgatgttgcacgagtttgtgttgaagggttgggctctcttcttactgaagtttgcaaaaatccaaaaaatcccattttcaaccactatctctttgagtcggtagccattcttgtgaggcgggcttgtgagagggacccatctcttgtatctgtttttgaagcaagcctttttcctaggcttgaaataatattgaccaatgatgtgactgagtttttaccatacacgtttcagttgcttgctcagcttgttgagttaaacaggccacccatcccaccaatctacatgcagatatttgagcttctattgtcacctgaaacatggaaaaggtcctcaaatgttcctgcacttgtgcgtctgctccaggccttccttcaaaaggcaccgaatgagatcacccaaggggataggctgaccaaagtgcttggaatatttgacacactaatccaagcttcaagcacatctgaacaaggattttatgtgcttaacactgtcattgaaagtcttgagtataatgctattaaaccatatatttctcacatttgggctgcacttttcagagagctccagaaaaggcggacagtaaaactcatcaagtctctcttgatatttatgtctctcttcctgattaagcatggtgctgcaaatgttgttgatactatgaacagtgtccagcctgatatttttgttgtgattttgaatcagttctggattcctaatcttaagctgattacaggagctatagagctcaaattgactgcagttgcttcaaccagactcgtatgtgagtcaccagttcttttggatcctgcagcttctgtgtcctggggtaagatggtggacagcatagtcacactcctttctcggccagaagaggatagagttcaggaggaacctgacatgccagatataacagaaaatgcgggttatagcaccacctttgttcttctttacaatgctggaaagaaagaagaagacccacttaaagatataagagatcccagggagttttttgtggcatcattgtcccgactttctgcactttcccctgggaggtatcctaaggtcatcagtgaaaatgttgatcctgcaaatcaagcagcattgcttcagctttgcaacacttataatctttcaata

SEQ ID NO: 64965 - DNA, 195 bp, Glycine max
  Peptide Sequence Number=SeqID_181743
atggaagtggcatactgcgtttacttgattgaccaatgggactttgtgaattctcacctttcttgtatccaaggaaatacccatggagttcgaagatttttcttttccatgaatgataagttggatcaatctttcgtggagcattgcaagaatgctgccatcgccgaatacaagcttgttcgtggcgataattaa

SEQ ID NO: 64966 - DNA, 914 bp, Glycine max
  Peptide Sequence Number=SeqID_181744
ggggcgcagtgcgtcaacgaaggttgcctaacctggcggtattacgggctttcgaagctacggtgcggtacggcagcgtgtcgaaagctgccaaatcactcaacgtcaccgacggcgccgtcagccgtgcggtgcgcgaattcgagcagaccctgggattcgcgctgtttcaacgcaccagccgcatggtgcatccgacgccgcaggcgcaagagctggcgagcgagatcggccgggggctggacaacctgcagtcggcgatcgaccgcgcctgtcggcatcatcagaatcgcccgttggtgatctcctgcgagccgacctttctgatccgctggctgatcccacgcctggccggtttgcagcaggcggtggggaaagagcgcgatctgcagctggtctccgccggcggcgccgtcgccttctcgcgcgaaggcatcgatctggcgattcgccgcaacgatttcccgatcgccgacgacgtggtcgcccgcccgttcctcaaagaacgggtcggcccggtatgccgccgggagcatgccgcggcggggcgtgaactgcgcggcaccctgctccacaccgagacgcgaccgtacgcctggcgcgactggtgcgcccacagcggcttcgagatcgggccgggcaacgagctgcgtttcgaacatttctatctcagcctgcaggcggcggtcgccggcgccggtatcggcatcggccctttggcgctggtggcggatgacatcgtcaacggcgcgctggtggcgccatatggctttgcgcctgacgggacggattacgtgctgatgacccaggccgacggccaggaggatgcgatattctcaacggtgttggattggctgatcgccatgggggaagaaaccgaacgggcggtattggcgggcggaaagaaagcgtaa

SEQ ID NO: 64967 - DNA, 363 bp, Glycine max
  Peptide Sequence Number=SeqID_181745
atgaagcttgagatgtccttgaagataaaagaagaggtgaaaaagcaagctgtcactggctttttggctgtggctcgatactcggaatgggttgccaacattgtgtcagtccctaagaaggatgggaagatagcgtcagaggacatggaaaagatgaccttcgtcgccctgtggggaacattctgctacaaagtgatatcctctggggcaacttaccaaggggctatggtagcattattccacgacatgatgcacaaagaaattaaggtctacgtggatgatatgttgccaagtcaaaaactgaggaggaacaccttgtcaacttacaaaagttgttcgcgaggctgcgtaagtaccgattaa

SEQ ID NO: 64968 - DNA, 153 bp, Glycine max
  Peptide Sequence Number=SeqID_181746
atggagacactggtggcggcaattgcggctgcgttgttctccattattcatttcatacttaacagggcctacatcatggaggccaaaatcatgggccaaagcgtttgtctccaagggagaaaaggagaggagtcgccaccaacgtttatttga

SEQ ID NO: 64969 - DNA, 132 bp, Glycine max
  Peptide Sequence Number=SeqID_181747
gggaaagtgtctgatcctttcaatcaagcgatagaggcagaggctttacttcaatcgcctacgctaggacggagctgctgtcgagtgacgattggccgaggggagttccatcatgaagctgggtacaaataa

SEQ ID NO: 64970 - DNA, 504 bp, Glycine max
  Peptide Sequence Number=SeqID_181748
atgaagaagttcatcgatcgtgggcatgggaaaacagtccttgactattaccgcattcagggctctatattccacgcaacaggagaagatgaatttggtaagagatggaatgtggttggggtaattcagtgggttcctggaagaggtggtcaaaacagtagaggaggggccaaggaggaagacaaagtgggttgggccggtttgagtaagatggataactggaatatggcagagatgttgtatgtgtgtgctaagctcctgagctgttggcctgagaagttaatgggacgaatcaggatgtctacatgcaaggatgactggaacatggcaaagatgttgtgtgtatgtgctaacctcctgagcttctgggctgagctattaatgggacgaatcaggacgtctgcatgcatcctagacatcgcattaaggctaagttgtggggaatcgcttgatagtggcgtcggaggagagcaaagaagtgcaagccttgaaagtggaacttga

SEQ ID NO: 64971 - DNA, 282 bp, Glycine max
  Peptide Sequence Number=SeqID_181749
atggtatcaaggtacgctttaaatgaaattgctggtgagtttgagtgtgtaccttatgcaagcaagaactcttcacgttgtggatgtgtcatgaggactacctacggtcttccatgttcatatcaagggttatgtgagactgaggtgaccataactgaggagatgaaaaccatatcgaaacgatttgagcaactcgatatttgcggcaaggtacatttgaagacaaagcttcgagaaattgcttatccagatctgaactttatgtgtcctcctccagaaaag

SEQ ID NO: 64972 - DNA, 414 bp, Glycine max
  Peptide Sequence Number=SeqID_181750
atgtcgcagaggagcaatgcatcatcatctcgaacaagagtttcatcacaagttgttcttttttgtggttgtggtagaagggctgttaggcgtattgctggaacaaatattaacagaggaagggcgtctttcacttgttcaattaataaggatgaagttggatattgtgggtactttatttgggttgatcaattgatcgaagcacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatgttcttaatccaattgttgtcaatggtggtgtttgtatgtattcacaagtactag

SEQ ID NO: 64973 - DNA, 300 bp, Glycine max
  Peptide Sequence Number=SeqID_181751
atggtgcttacatcagcacgtcttaaaaggtcagcattcaaagatggtgcttacatcagcaccgtcttagaaggtcagcattctaagacagtgctaacatcaacacgtcttagaaggtcagcattcaaaggtggtgcttacatcagcaccatctttaaaagaaggttcaaagagttattacaatatttgcatcctggtgtgaaggggttggaagtagctgatcttgctataaacaagattagagaaaacattaagtatgttaaaggattagagggtagaatgaaaacttttaaagcttga

SEQ ID NO: 64974 - DNA, 315 bp, Glycine max
  Peptide Sequence Number=SeqID_181752
atgacttcctcaagcaatgtttctacaagcatcggttcaatctacaacaatgtccaagttcctttatttgaaggagaaaattatgatatttgggcagtaaaaatggagactttgttcacttctctggatgtcttggagcttgtcaaagaagggtatgaagaactagcagccacaacagaagctacagtcacacaacgtgaagaattgaagaagaaaaaaatcacagatgttggagttctagtttttctagaggtgatagctttggatttggaagaggctgaggaagaggttgaaactcccatggaagaggaatag

SEQ ID NO: 64975 - DNA, 700 bp, Glycine max
  Peptide Sequence Number=SeqID_181753
gggtcctaaagcacttgaaggccttcaagattttcattttgagactattccagatggtcttcccctcacagatgaagatgctgatgttactcaagacatagtgtccctttgtaaatcagtgagagagaacatgctcataccctttcatgaacttcttgctagacttcatgattctgacactgctggccttattcctccagttacgtgcttggtttctgatgttggcatggcttttactatacacgctgctgaagaacttgcactccctattgttttgtttccatcagccagtgctggttccttattgtcttgtttgcacctccgtgctcttattgataaaggtcttataccactaaaaggttccaatctttggaaggaaaacacggagggccatggatggcttgaatctgaggaaccaaagtctgttcactctgttgtttatgtgaattttggtagcatcacggttttgtctcctgagcaacttttagagtttgctcgggagagatggaactcaacaattggtggattcttgactcattgtggatggaactcaacaattgaaagcatttgtgccgtaaacaagatgaggataaaagtaatggagttgaagaaaaaggttgaggaggacaccaaacctagtggttcttcatacatgaacttggataaagtgattaatgagatattcctcaaacaaaattag

SEQ ID NO: 64976 - DNA, 528 bp, Glycine max
  Peptide Sequence Number=SeqID_181754
atggctctagatagaacacaattgcaaaacatgtgcaagaaggagcatgagtcttttaaagaatacacccagaggtggagggatttagcaactcaggtagcacctccaatgatggagagggagatgataacaatgatagtggacacattaccagtgttctactatgagaagatggtgggttacatgccttcaagctttgtggatctggtatttgcgggtgagaggattgaagtaggcctaagaagaggcaagttcgattatgtcgcttcaacaagtgcgggaaataagaagaccagtacaggtggagctaagaaaaaagagggagatgcccatgctataaccgcaactcccacatggacaaagtcccaacaaactcctcacaaccccacttaccaatatcccccaccccagtacaattactcaaccaatatcggatctcctcccattccgatgcccatccaacagagaatgcccactcaaccacaaaggcctcccccacaaaacccatttcttgcacaacctcgatga

SEQ ID NO: 64977 - DNA, 621 bp, Glycine max
  Peptide Sequence Number=SeqID_181755
atggaggccatgaaagatcaaatggccgccatgatggaggccatgttgagcatgaagaagataatggaggtcaacgcggctgtagttgctaccattagcgtcgtcactgaggtagatccgacttacctatctggcataaatcaaatcagtcttctagtccccaacgtggtaagtcagggaggagaaacattgggaagtacagatggtcccgatgttgtgcaaagcaagaactccttcccaccatacgacttgcctcccaactatgcaccacccaatgttgtacatgtgcccgacgagaacgccgaccactccgctcttgttccccttgaaagccagcaagcccagttggggcatgcacattttgctcagcccatggggggcatactgtctcctgccatggaagaaagagaaaaatttgatcttatagaggaaagactgagggtcattgaggggattggagattacccttttgccaacatggcggaactgtgcctagtgcctgacgtcgtcatccctcctaaattcaaagtgcctgactttgacaggtacaaggggactacttgtcccaaaaaccacctaaagatgtattttgggaagatgggggtgtacgccaaaagatga

SEQ ID NO: 64978 - DNA, 327 bp, Glycine max
  Peptide Sequence Number=SeqID_181756
atgacactttccaaaattaaagcaaggctcgattattttaacctaaacaaaagccaagcaaagttgcaagttgtattgacaaagaaacgtgaatttcaaaacgagggggaaacaaattggacccttcatgatagtgaaccagggcgtgagacccacacttgcaaactgtgcgtggtgaaccctacaaaatttatgacaattgtctccaagggtcaaggcctcacgattattctcttcaatttaaatggaatgggtcaagaaaaagagctagggcataaacacaaacacgatggtgacatgagaaatgaccaaagtgcccttaagtga

SEQ ID NO: 64979 - DNA, 219 bp, Glycine max
  Peptide Sequence Number=SeqID_181757
ctgatagaagatgctgcagctagagcatggagacagggggagcagaaagctgatgtcacaagagatgtcttaacatcctggaaaaggctagtagctgatagaagagcatggagacagggggagcagaaagctgatataccgctgtgcttgattactctgataatgaaagttgctgatcccacttgcataactgctcgtaccagctcaggaagtgtctaa

SEQ ID NO: 64980 - DNA, 318 bp, Glycine max
  Peptide Sequence Number=SeqID_181758
atgtggcctttggtagtggtcccagtatgtacattccccacatggccaaggctaaggggagctcaagctattgagattgtcaagagggatgcatggaacattagcaaattcttggcatcatttgcatcgcttggtgaagtcgagggcgttaaccctaagcgtcggccaacagtagccagcatgcaccaatttggtggcaagggagcgtcccccgatatgaaggccgtagatcccttcatgaacttcccgcatgacatagtctgcctgttggctattcaagtatttgagaaagggtgttgtcgaccttcttttgaatag

SEQ ID NO: 64981 - DNA, 141 bp, Glycine max
  Peptide Sequence Number=SeqID_181759
atggtcatagctccaccgactcgtcaaactcaaggttcgtctttcgtgagtctcacttctccaaaggctcatcaaacccgaggtccttccttggtgagtctcgcttctccaaaggctcatcaaacccaaggttcgttcttg

SEQ ID NO: 64982 - DNA, 261 bp, Glycine max
  Peptide Sequence Number=SeqID_181760
atggaattcatcactgaagatgccaacttctactatagggtcatgccctttggcttgaaaaatataggcgctacataccaaagattcatggaccgggtctttaagcagcagatcggaaaaaatgtcaaggtctatgtcaacaacatggtcatcaaatcccatagcatagcccaacacgtggcaaacctggaagaaggaatagaagctaaccccgacaaatgcacaatcatactggagatgcgcagtcctaccaatgtctag

SEQ ID NO: 64983 - DNA, 147 bp, Glycine max
  Peptide Sequence Number=SeqID_181761
atggagtatgcggctggtgaagtagatgagaagttagagcttccctttctcttgagtaggggtacccctagcctgggtcgactcaagactggtgaacggcttcgccttttcggcgagcttggggaggaaccacaacagggatgctag

SEQ ID NO: 64984 - DNA, 459 bp, Glycine max
  Peptide Sequence Number=SeqID_181762
atggtagcatggttcgtaaaaatttcagagtttgatctccagtacgaacctcgcagccccatgaagatacaattcatggtagaatttctggaagaatttgctggaaacgaccaaaccatcctagactgcaaggcaggaatcatccttgaaggccctggcaatgtcactctagagcaagccctcaagcttaacttcaaagcctcaaacaatcaggctgagaatgatgcacttatagcaagtctaaaactagcaagagacattgggtcaagaagctacgatgctacactgactcgtagcttgtctaggggcaaggagagcaatactagagcatacctgttctccaagctggttagcaccaaaaagactgggcacctcaagactatcttcttggagatacttcaaactcccactatagacactaaggaggttatggatggagaagaggaggaaccagactag

SEQ ID NO: 64985 - DNA, 243 bp, Glycine max
  Peptide Sequence Number=SeqID_181763
atggtgcagaaagaagttgagaaaaagaatatgtgtttggttcaaataaattttgttgtggttgggttaaagcaaaagtgtcttgggttgcatcgtatgtgtgcgaataatggaactgaggataatattgaggttcatgagatattggttgagggtttggggtgggaagtgtattggtcagggtttagggtttacgaccgagggttagggttacggtttgaggcattggattccctagcataa

SEQ ID NO: 64986 - DNA, 297 bp, Glycine max
  Peptide Sequence Number=SeqID_181764
atggagaaggaaacactgccaatgccaccacaagaggtcaagaaagctggagttgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatttgttatatctttaacagattgtgcaggatccacgatgtcggatacaatgtccaggacatcctgcccgaaaatactggacacataa

SEQ ID NO: 64987 - DNA, 102 bp, Glycine max
  Peptide Sequence Number=SeqID_181765
atgaagcaaaatcttgagaatgaagtgaagcgccaaattgtaggcatattggaagaactgtcaacctctgaatcacctactaactcaagtgctcaggattga

SEQ ID NO: 64988 - DNA, 1278 bp, Glycine max
  Peptide Sequence Number=SeqID_181766
atggagttaaataaaatttggatgcaaataactgataggacgactcctctatatgacaaaggagttcaagaatttattgattttgcattcaatagttttgaaaaaggaaagttactttgttgtccttgtagaaaatgcataaatgatcttttttgtggtcagaaagttatgtacgaacacttgatcataaatgggataaaaagggactatgttatatgggagcatcatggagaagtgattagtgagcctgatgaatttgatgatgatcaaaataattgcaatgatgggattcgtgatatgttacatgatcttggaagtgctatgaatattgagaacatcacaggagctgaggaaataaattatacaactggcacggacactaatagtgtgaacgaagaagaagataagttttctaaactatttgttattgccgaacaagaactatatcctggttgtgagaacttctctaagctatcatttattgttcaactattgaatatcaaatgtctctttggcttgagtggaaaagcaattgatgccttgctttctttgttggcaaaagcatttccacagggaaataaagttcttgtgtcttactatgaggctcgaaaatttattcgtgaacttgggctagattatgtcaaaatagatgcttgcttgaatgattgcatcctttaccgagcaccaaggttacaaaggttatatatgacttcacaaattgctacagagatgaggtggcacaaagagagaaaaattgaagatgggcaattgagacatctagctgattcaattacttggaaaactcttgactcaaaatatccatcttttgcgacggatctacgtaatgtaaggcttggattagctagtgatggtcctacggctcctggaaatgatattgatgtgtatttacaacctttaattgaagagctgaaggaattatgggagaaaggtgtagtgacatatgatgcatcaaccaaagaaacgtttaggttatatgcatcaattttatggactattaatgattttccgccatatgaaaatctatcaggatggagcactaaagggcgatatgcttgtccttgttgtaacatggatacatggtcttcatggttactaaatggaggaaaattttcttatatgggaagtcatcgatttttgccacatgatcattcttggagaaataatgcaaaagcatttgatggcaagaaagaaaaacaatttgcccctaaaccattgtccggggatgatataattgaacaatatcaacattttgaccag

SEQ ID NO: 64989 - DNA, 345 bp, Glycine max
  Peptide Sequence Number=SeqID_181767
atgctccaaccatatgggatcagcataggcttaaaggagcactcaaacccggtgacccccaaggcctacactccgaagagtccgtcagggcctcttcctcctgattcaggaaacctacactttctctttaacactgcgcatttacagttttctcaagataacactggtcagttattccctgagattccattagttattcctccgactgctccaatagaattcccaaacgtcagagagacggaaaagagattgaaacttccacttgtactgtcttcatgcgatccctttttctccctcgacgaatattatctcgaaaatctcaacggtggaagtgtgcgcaattga

SEQ ID NO: 64990 - DNA, 412 bp, Glycine max
  Peptide Sequence Number=SeqID_181768
atggatgagtgcaacgattactttctgaagctagagcttatctactattttatggaaagggagaaagaaaaagatagagaaattgtgttgcttagcgggaaactagacctctttgaacatgggaaagtgatagataagtttgaggagcatcaaagacatgagtatgaagaaatgcataaataccccaagtgtgggatatcatggtacaaagtgaaggatgatgatgagtgcaatagtgatgaactcacaatgaaaggccccccagcgaaggtgttatcaaattgcgatgaaatgcttcgtcatccgactaattccttccagtggaagatgattaaccgtttgtatttggatttcgagaaagaggcaagaaatcttaggcttggacttgccactgatggaataaatccttatg

SEQ ID NO: 64991 - DNA, 240 bp, Glycine max
  Peptide Sequence Number=SeqID_181769
atggaacccgcgacctttcttcaacagtacacgaaccagggtcggagcttcaatggaagaacaggtgaaggagcttcaatggaagaaggggtagggcttcaatgtcaaagaaagcgagggttcaaacgaaggagcaagcagaaagcgaaaatcagtagggttcatgcaagcagaaagcgaaaatcagtagggttcaaacacaaaggtctagggttcaaagcacgcaatcttgaaagctag

SEQ ID NO: 64992 - DNA, 198 bp, Glycine max
  Peptide Sequence Number=SeqID_181770
atggcaggaaacatggggtggggtgtgatagaagaggagggatggaggaagggaccttcgacttctgaggaggacattctgactgaaaagaaatgggaagagctgcagattaagatgagtgaattacctgaggccagacctcaagaagggtcaaataacaccacaagaagaaagcataattctacagctgcatgttag

SEQ ID NO: 64993 - DNA, 288 bp, Glycine max
  Peptide Sequence Number=SeqID_181771
atgcaggattctcttggcgaaaactcgaaaacaatgatcattgccaatgcggtggtgaacgaagattctactgcgcatgaagagctttctatcctcaaacgacgtcagaatgtctttaggtctttgtcattttctttgtcatcgatcagagatataaaacaatcactaaaactcgaagactgttgcctagaaaatgcaactgacatggttgaccaacatgaagataacatgtcggattatgaatccaagggcatcagaatgtcccacaaacaggccggcagagattga

SEQ ID NO: 64994 - DNA, 315 bp, Glycine max
  Peptide Sequence Number=SeqID_181772
atgaatgactctagacagcttgaggtatttgaccacgagaagtttaacaattgggtggagaagggtgtagctcttgccattgaacccagtttaaagctctatgaagatgttttgaatcggggattcaaggttattctactcacaggacggagtgaaaggcacaggagtctcactgttgataatttgatcaatgctgggtttaaggaatgggaccagctcatactaaggaggaatcttgcaaacaacccattgattccagcctccttttttcgatggacaacagaatctgcttacctgaaatcatcttggcgctaa

SEQ ID NO: 64995 - DNA, 276 bp, Glycine max
  Peptide Sequence Number=SeqID_181773
atgggtgccattctgcttagcgcagggactaaaggaaatagatatagcttgccaaattcaaggataatgattcaccaaccgcttggtggagctcaaggaggacaaactgacatagatatacaggtagaagtagaatggagccgtgcacgtgtgttttggcctatgtattcgtgtacgtctgcttcgggatttggattcgcacggctattggataaggtctctgcaattggattccctcataataataataatggaaatgatgcgaggcaaacgtga

SEQ ID NO: 64996 - DNA, 423 bp, Glycine max
  Peptide Sequence Number=SeqID_181774
atggcgaacgcaccctgccttcgttgcagctctcttgctcttcactgctcaacgcacacttcttcttcctctcactctcagagcctttctctttcttcacacacttctcgcctctcctgtactaagaaatctcctgggaaggtgaaggccgtgtatgctaatgaattttgggcgcctgagaggagttcacgagaaaaatataaggggagaatagtacgttgtgggggagctgtagatgatgatatgtctaacatcatagttgcccagcttctttaccttgatgccatcgatcctaacaaggatattgtcatgtacgtaaattctctgggaggatcagttgcagctgccatggcaatatttgatacgatgaggcatattcgacctgatgtgtccactgtttgcattggacttgctgctagctaa

SEQ ID NO: 64997 - DNA, 2367 bp, Glycine max
  Peptide Sequence Number=SeqID_181775
atggcgagcttgactcggagatcactgtctcaactcggaactatattatcgatgaagaaaattccggttcgtgctaaccatcttttgatatttggatcgaggggtatgtggaagggagttattcaaattgaaaatttaaccaacccaaattcaaaggtcaccagaaggagcgaaatgctagaacctggtcaggttatttttgcatgtgcaggtatattgaaaaaggttcaaggcttggtgcagaaatggatgcttatattatcttgcttggtatttgtgattgaggctggtgaaaatgataaaacaatggagcccccttctttatatgattctggatcacctttgccctttgttgttgttcatgatctacctctaccagcaaatctccatgtgtcgaagcatgtgctttctcatggtgcaccaattgctgcactgtcaccagtcaagcctccttcatatggtcctttcacaagtaatggtcacccccctgcaagttcacatttatccatactattcaagaagagtgaaatgaaacctccaatttctggctttaaagatattcatattgctcctgtgcattctactgcagctgcaggcccttccgctttggcccagccaccattgtctccttatgcttctaattgttgtaaacaagacatggtgctgaaaaggggcagtaaggattgccaatgtgcatatcccataaagctagacctttttctttcaaatgtctctcaaaatcctaattggaatgattttcttgatgaattagctacccagcttgggttgcgaaatacccagattgagctgataaacttttatgtactcagcttatcaacattaaatatatcgatgaatattactccacataaaggcatcagtttctctgccaatgaagtttctaaaataaactcttcgctttcaatgcataaggttcaactaaaccctggattagtgggtggatacaaacttctcaatttaacgtggtttgaaccacctcctccttctcaagctcctactttagctgcatcacctgtgaatacacctttgcatcattcacctactgctacatcatcatcgagttctccgaaaagaggaaggcattcaaatttgtttcttattcttggaattgctattggcataatcttcattgctatcatatctgtacttatattctgtttatgtacgttcctgccaaaagcaaacacacctcctatagacactgaaaagccaaggacagagagtgcaatttcaactgtgggttctcttccccacccaactagtacacgttttattgcttatgaagagcttaaagaagcaacaaacaattttgaagcagcgagcatacttggagaaggagggtttggtagagtttttaaaggtgtcttaaatgacggtactcctgtagcaattaagaggcttaccagtggagggcaacagggtgacaaagagtttttggttgaggttgagatgcttagccggttgcatcatcgtaaccttgtaaaactagtgggatacttcattaatcgtgactcatcacaaaatttactttgctatgagcttgtccctaatggaagtttggaggcttggcttcatggtcccttgggaatcaactgtcctttggattgggacaccagaatgaagattgcgctggatgctgcgaggggactttcatacctgcatgaagactcacagccctgtgtaatacacagagacttcaaggcatccaacatactgcttgagaacaactttcaagctaaggttgcagattttggtcttgctaagcaagcacctgaaggaagatctaattatttgtctactcgtgtcatggggacatttgggtacgtagctcctgaatatgccatgactgggcacctacttgttaaaagtgatgtttatagctatggtgttgtcttgctggaactgcttactggtaggaagcctgtggatatgtcacagccaactggacaagagaaccttgttacttgggctaggccaatccttagagataaggagcggttggaagagattgctgatccaagacttgggggagagtatccaaaggaagattttgtacgtgtttgcactattgctgcggcctgtgttgctccggaagcaaaccaacgacctacaatgggtgaagtggtacaatcacttaaaatggtgcagcgcgtcacagaataccatgattctgtgttagcctcatccaatgcacgacccaacctaagacagtcctctagcacttttgaatttgatggaacgtcttcgatgttctcttcaggtccttactctggtctaagtgcctttgacaatgacaacatttctaggaccgtggttttctctgaagatctttgtgaaggacgatga

SEQ ID NO: 64998 - DNA, 441 bp, Glycine max
  Peptide Sequence Number=SeqID_181776
atggattttatggctgataagtttgataaaggttgcattgaccatttgaaattggttacttccactccctttattcgagttacatatacagaagcagtggaaatactggaagacattgtgaagaatggtaagaaatttgaaaatgaacaaaaatgggtaattgacttagcatttgagcatgaaaggggtataatgttatgcagatacctaacaaagaggtttatcccatctaaatttgggttagatcctaccagggttcaagtatttgtgcttgaagatggctataatttttatgcacccaaagttgaaattcgtagacttgtggaggctgaaggcattccttacactttcatctcatgcaatttctttgtgaggattttgcttccttctcttgctcagccaagcttagatgctcctccaagggacaaggtgtcttcatga

SEQ ID NO: 64999 - DNA, 397 bp, Glycine max
  Peptide Sequence Number=SeqID_181777
gtattcattctacccaaaatcacaagacaacaagagtataatgcaaaacaatggggttagtctaagggctgaatctcaacagtttgctattgtatatgatgacaatccccatgtagcttccatgccttactttggagtcattgaagaaatcagggagcttaattatgtaaaattcactttctgtgttttcaagtatccttgtgatgaaaggtggtctatggttttacatggaaaaataattagtgttaatgttgaagatgatgattcaactgttgatacatgtcttagtcctttctccacacaaatgccgcttaacgtcaataaagaagaagaagttgacgacctcctcgcaaattgtaatgatcatgatgaagaagaattaatcaacaacgtataa

SEQ ID NO: 65000 - DNA, 1731 bp, Glycine max
  Peptide Sequence Number=SeqID_181778
atggaaattgaccaattttcttccacagatttaaatttcaaaggaacccagatgggttatggttctacacaagaggatgtgttccaaggtaaagagagtctctctggaatggaattgctgggagagattgatcctctccctgctgagaatggaaaaggagtcaaattgttcaaatatcaagatcagaaacagctacaagaacccaaagctgataacttgatgttggaagaggtcaactttgaccctgatgtccaaatgcaaccaacacaactatttcaggaaactgaaggactaatgaaacatggtgtggcaagtacagaaccagttgaatacaataagcaggtggcaccaacaccatcattagcatctttagaactcttgagaaattacggaagccggttcaagaggctaagcgagcaaaatataagcaccttaagcaatattgaaacttcctttgatcgccagaagatgtcaactgaagaaataataagagtggctggagcaaggtatatccaatattctgcgcattggaatgatagtttttacatccctatgcatccatacggattggatcttggtggtttgtctgaggaagaaaatagagacatagaacttgctcagtttctcctagctgcagccgagagggtaggctgccaacaattcgaacgtgcaaatgggttacttctccattgtgaatggagttcaaatgccagtgcaaaccctgttcaaagagttatctttcatttcgctcgagcacttcgagagagaatatacaaagaaacaggaaggatgacagttaagggatcagggaaaaatgaagaaagggagttacttcagaagatggacaccaacattgcccttaaatgccatctaaaagttcctttcaatcaagtaatgcaattcactgggatacaagctatagtggagcatgttgcatgtgagaccaaaatccatcttatagatcttgaaataagaagtggtgtacaatacacagctttgatgcaagcactggcagagcgccgggatcgcatagtgcaacttttgaagataactgccattggacttagttcattgaaaaccatgatagaagagactggcaaaaggttagctagttttgctgaatccttgaacttacccttttcatataagacagtttttgtgaccgacattgcggaaataagggaagatcatttcgaaattggagaggatgaagctgtggcagtctactctccatattttctaaggagcatggtatcgaggcctgattgtatggaaaacttgatgagagttataagaaatatcaaaccagttataatgatagtccttgaagtagaagcaaaccataactcgccctcctttgtgaaccgcttcattgaagcattgttcttctactcagcatattttgattgccttgaaacctgcataaaacatgagattgagtgcagaatgacaatagaagcagtattatctgaagggataagagacattgttgctatggaaggaagggaaaggacagttagaaatgtgaagatagatgtttggagaaggttctttgcaaggtacagaatggttgaaaccgggtttagtgagtcatctctgtaccatgctcacttggttgccaaagggttttcttttgggaaattctgcactatagaaaaaaatggaaagtgtcttatagtgggatggaaagggaccccaatgcattcaatctcagcttggaggtttctttga

SEQ ID NO: 65001 - DNA, 906 bp, Glycine max
  Peptide Sequence Number=SeqID_181779
atggttgctatgggtaatctgcagcaaaaagccaaagagctcttcaagttcaagtgcttaactccaaaagagatgttctacctcatcaccttcaccctcctctccctcctcttacccctctcgtttcttctcctagccaaattctccgatgcgcaatactatctccaaaccctcgcttggtaccattcaccacaacactttccctatgttttaactctcgcccttcacatcaaccctctcattctctacgttcttgtgtccattattagcatggcttccttaatccacggcttaacgggaaaaatcatcattttgagtgactcgttatcatcatcaagcacttttcttcaacctcgtatattgactgcgtggattgttctttgcacgttccaagtttgcgttggtttgggcatagaggggagcattgaggcggggctctatgactctaatgatgagtcgatgagttttaaatttggtgttgagagaatcttgttaagcagagttgtattcctcttggggttgcacgagaccatgcaggtttgggccaggatggtggtgaggcccgtggtggacgacaccgtgttcggcgtcgcggcgagagaagagaaatgggtggagagggtggtggtggcggcgagcttaggtgcattgtggtggtggagattgagggaggatgtggagagtttggtggttatggttgaggccaagacagagcaattgatggatgtgagagttagtgattttgtggggtggtggctttattatcttactcttacaattgggatagtaagggttctaaggggtcttatgtggatggtcactgtttgtctatgcagaagaagaagaagaagggcaacaggggtttcaacggtggtggaacattgtcagattgatgataaggtgtaa

SEQ ID NO: 65002 - DNA, 264 bp, Glycine max
  Peptide Sequence Number=SeqID_181780
atggacaataatacttgtgcctcctcccaacttgagtcagaagaagcatcttttgagcacaaatcagaaactcaaacatcaaagaaaaggaaaatggttgagaaaacagttgtggcagtgaggacaggagagaatgttggcaagctgaagaatgaagggctaccttcggatttttggtcttggaggaaatatggacaaaaaccgatcaaagggtctccatatccaaggtgtacattctttctgctacaagatggtggtctatag

SEQ ID NO: 65003 - DNA, 429 bp, Glycine max
  Peptide Sequence Number=SeqID_181781
atggcgaaggattgttctgaagcactacttgagctagatgaacgattctcctttccaaatttcgaaccagctacaaatccccacctttgcaaatctctaaccactactgcctaccaacaaactccttcaaataatcgcccaagaaatcgcagaacacaaaattgcaatgtcttcgtggcacaaccgtacaatagcagctgtgtcacctcacttcgggatcaaggatcgaagccctcctcaaggttcacacaacgagactgcccaaaaaatcgcagaacccaaaatcgtagaaccaagatcacaatgtcgtcgtcgcaccaccacatgatagcaacggcgtcgcaccacttcgggatcaagggtcgaagacctcctcaaggttcacatagcgccatcggagctaccatttttgcaaaccctaacacataa

SEQ ID NO: 65004 - DNA, 282 bp, Glycine max
  Peptide Sequence Number=SeqID_181782
atgtacatggtgaacaacattttcacaccatctaggtacaaagaaatcatcatggtgcagcccaaaccaagtgctggcctaaaggggaaacctcaccaacatgctctcattttcatgccttcttgcattcaaaaatcaaaggcttgggtccctaggcctaagtcattttttggcatttaccctagcccccgcaagctgtccacacctccaaaaatggaaatcatacatgcacaaacccaatctataagcaatattcgtaaacttatgcgcaaacgccattga

SEQ ID NO: 65005 - DNA, 2850 bp, Glycine max
  Peptide Sequence Number=SeqID_181783
atgcgacttgacaaactgtataatcgctttttgctcccttctaattcctctcttcttcctctcgctcctccgttgcgcctcacgctccgtcaccgaaccgctgccaacttcgcttccatggcttcctcgcggttgcgcaatttagcacctcttgccgctgctcccgctcaagacgccgcggctgcctccatttcttcctctgccaacgccgctgcttccgctgattacgatgatgagtcaactgtaggagtaagatatcacgtccctccatctgtgatcagtgatattgttgatgctccacctgtacctgcattgtcattttcaccacttagggacaaaattatttttctcaagcgaagagctttacctccactggcagaaatagcaaggccggaggaaaagttggctggtatacgtattgatggaaagtgcaatactaggagtcgcatgtcattctacactgctatagggatccatcaaattcttcctgatggtacattagggccagagactgaggtgtctggtttccccgttggtgctaaaataaattttgtttcttggtctcctgatggttgtcatttgtcctttagcactcgtgtgaatgaggaggaccatgatagcagtaaactcacagtatggattgcagatgtgaaaacagggatagctagaaagttgtttcagtcacctaatgtacatttgaatgcagtttttgacaattatgtttgggtaaataattgttcattgttagtttgcaccattccatcatcccgtggagctcctccaaagaaacctttggttcccagttgcccaaaaattcaatccaacgaggcgagaagcactattcaagtaagaacattccaggatttgctgaaggatgaatacgatgaagatttgtttgactactatgccacctcacagcttgttttggcttctttggatggtactacaaaagaaattggcccaccagcggtttatacatctatggacccttccccagatcagaagtacattttgattagttcacttcacaggccatactccttcattgtaacttatggaagatttccaaagaaggtagagttatggagtgctgatggaaaattaatcagggagctctgtaacttgccccttgctgaggacattccaattgcattcaatagtgtgcgaaaagggatgcgttccattaattggagagctgatacgccatctactctttactgggtagaaactcaagatggaggtgatgcaaaggtggaaatttctcctcgtgatataatttatacacagcctgctgaaccactagaaggtgaacagccaacaatattacacaagcttgatttccgctatggaggggtttcatggtgtgatgattcactggctttggtatatgaatcctggtacaaaacacggaaaataagaacatgggtagtctctcctggatctgaagatgtagctccacgcatcctatttgatagatcttcagaagatgtgtactctgatcccggctctcctatgatgcggagaactcaagctgggacatacattattgccaggattaagaaggaaagtgatgaaggaagatatattatactgaatgggattggtgctacaccagaaggaaacattccattccttgatctgtttgacataaacactggtaaaaaaatggagcgaatctgggagagcaataaggaaaagtattatgagactgttgttgctctaatgtctgaccaggaagaagggtatttgtatttagataaactgaagatactgacttctaaagagtcaaaaactgaaaacacccagtattattttgttagctggccagataaaaaagtagttcaggttacaaatttccctcatccatatcctcagctcgcatcattgcagaaagagatgatcaagtatcaaagaaaagacggggttcaacttactgctacattatacctgccaccaggttacaatccatcaacagatggccctttgccatgcctggtttggtcttacccaggagaatttaaaagcaaagatgctgctggacaagttcgtggttctccaaatgaatttgctggaataggatccacatcagcccttctttggctggccagaaggtttgcaattctatctgggcctaccattcctattattggcgagggtaatgaagaggcaaatgataggtatgtagaacaattagttgcaagtgcagaggctgctgtggaggaagtcatccggcgtggggtggctgatccgaagaaaatagctgttggcggacattcatatggtgcattcatggctgctaacctcctggcacatgcaccacatcttttctgttgtggaattgctcgttctggtgcttacaacagaacacttactccttttggttttcagaatgaagacagaactctttgggaggccactaatacttatgtagagatgagtccttttatgtcggctaataaagttaagaagcccatcttgcttattcatggggaagaggataacaatccaggaacattaaccatgcagtcaggcaggtttttcaacgctctaaagggtcatggtgctctttgtcggctggtgattttgcctcatgagagtcacggttacactgccagagaaagcatcatgcatgtcctttgggaaacagatagatggctgtataaacactgtgtatcaaacagttctgatgcagtagaagaccatgctactggcacagtcaaagaacaagttagcaaaggaaccatagatgctgaaagcaaagtggttgcaacaagcggaggtggcagtggagaggtgtctgatcttgagtatgaagaatttcattctctgccaagatcatacttgtggtaa

SEQ ID NO: 65006 - DNA, 1596 bp, Glycine max
  Peptide Sequence Number=SeqID_181784
atggctgaagaccaatctatcattggaaaaatgcagatgtactatgacaaaaatggtggtgaaatgatgatatgcagtgacaatgaggaagaaatggtgaatcccaaagatgccaaacatgactttacggaggctgaagatctaattttgcggatgacacttgaggaatgcaagtcttctgaggaggcattgagtatcatacaagagtttgttaagactactgattcacaaattcaggaaaggtataaaaaactcaagaaaaagaatatggaaagtctagatgatcattctgaagattgtcattgtaaaggatgcaagtgtcaccttggaatatgtttggagaaaagcttgagtgctactttagaatcttttgataacattttttgtcgtcagtgcttgagtgaaaagcaacaagtgtggtctgaacatgaaggtgataagcaaccatgcagtgaccagtgttacctactggacaagggagttatggaaggacaaaaagatattcagttgtctaattcaacgaaagtgcaagctgatgagatgacaaataactcaaattggaaacagctagagaaaaatttatatttgaagggagtagaattgtttggaaaaaatagttgccttgtagctcgaaacttacttcctggctttaagacttgcttagaagtagctaggtacatgtttgctagtggagagtcaatgccttatgaatccataccaagttcaatcacagacataaatgataagattaatgcagagtacatagaccaagaaatgccatcaagatcacggttgttgcgaaagaagtgcaagactagaaagtttagttattctcataaatctattgctctctcatctagatgcagaagaattgatcatgggaaagaccaatgtgataagcaatatactccatgtgggtgtaagggaatatgcatagagggatgtccttgtcttagtacgggaacttgtgaaaaatactgtgggtgttcaaagttatgcaataatcgattcaaaggatgttattgttttaagagtcaatgtagaagccaactatgtccatgctttgcagcaaaccgtgaatgtgacccagatgtctgtcgaaattgttgggttagttgcggtgatggttcattaggggagccacctcgacacggagatggtcaatgtgcaaacatgaatcttcttttagggaaaaaagaaaggaacccaattataaaaaatacttgtctaggagagtacacaggtgaactaatcactcacagagaagcagagaaacgtgggaaactatatgaccgtataaacaattcatatctttttaacgtcaatgataagtgggttattgatgcacgccgctttgggaataagttaaaatttgcaaatcactcatcaaaacccaactgctatgcaaaggtgatgttggttggaggagatcatcgagttggcatatttgccaaggaaaacattaaagccggtgatgagcttttctatcattattactataatgaagagtgtgcaccaccatgggctcttccaccaaaagtcgaggcttctaagacacataaatatgtttctcagggcagggcaaagaaacattga

SEQ ID NO: 65007 - DNA, 423 bp, Glycine max
  Peptide Sequence Number=SeqID_181785
atgacttctacaagtggagatgctactccaccatctccaaaaacaacaaggatcatggcagagatgattaaacatggtaatcaaatgagaagaatgatttatgaagataaagaaatgatggagagaatgagaaagaagaatggggagagttttagaagaatacacaagagtaacgaacctttaattgtaagggttgaaaatataaagcggagagaggatagatcatctaattcttctcatgcaaaagatgagggatatgaagaggatgagggaggaaggaggaatgagaggtatagggagagaagaaatcatagaagatatggaggtagacaaagagagaaagggattgagggagtgaaggtgaagatccctacttttaaagggacttatgatccaaaagtgtatcttaagtgggagatggag

SEQ ID NO: 65008 - DNA, 282 bp, Glycine max
  Peptide Sequence Number=SeqID_181786
atggaggaaaatatggaacaatttcttgaaaagataactgtacaatcaaggagtgacagtgttaacccttctccatacaaaaacagggagcatatagagaaaatgtaccagacatgcaatcttctttttaaaattcaggtgaaaaatttgaagacaaagctactagataagttggagctttcccttgcaaacattcattttatcccaaaaataatggataatgcttctccctgtactcacgagattttgttcaaatgccccgtgtgtggatattgtacgtaa

SEQ ID NO: 65009 - DNA, 360 bp, Glycine max
  Peptide Sequence Number=SeqID_181787
atgggttcacaaattggttcaacggatcagtttggctggcaagtgatccattccgataaacactcctaccacctccacataaatctgaacatagaattgagaacaaattacaaatcagtgtattgggtcgaagtcgcattgaggtcacaattgaagtcgcattggaaaagcttgtttctaaaatccattgtcaccacgctcaggaagccatcatcaatggagaagaaggtaagaaagagaagaaaaggagaaagagcacggaggaaggaagaaaaaaagacaaaacggtatatggtggttctgatggatgcttgcagtgacactctcctcgacaaaacagaaaaaagtatgagagaatag

SEQ ID NO: 65010 - DNA, 264 bp, Glycine max
  Peptide Sequence Number=SeqID_181788
atgttggataaacagggagctatgggactggtgaaacctacaaataggccggatcatgatgtcgatgatcacctatatcttattttgaccatcccacaactttttttgaagccgttgcagcatgaagatctatttgaaatagcacatggtggtcaatgcctcagcatctcagttatacaattgtggattctgcatatgactaagacaagtatgcgagtggggaatgccgatgtgtatggattcctcgagccacagtccatatag

SEQ ID NO: 65011 - DNA, 351 bp, Glycine max
  Peptide Sequence Number=SeqID_181789
atggctccacctaaagaaattgtgatcgtcatttaccaccatggtcacattgcagacgacccagttcaaggatcggtgtacacatatgcgaatccaatacttctatacacgagtcgttctgttacgttaactcaattaattcagaacattaacaattgtctccctactcagaacaactcaagtgaatcaagaacaattcaagagttcaagataagaattaagaagaattcaagactcaagaagaaagttcagagtcaagaatcaagattcaaggttcaagatctcaagaatcaagattcaaggttcaagatctcaagaatcaagaatcaagagaaggctcaatcaagataa

SEQ ID NO: 65012 - DNA, 492 bp, Glycine max
  Peptide Sequence Number=SeqID_181790
atgcggattgttgaaaaccacgttaatgggggtaaatgtacgccttgttccacatcacacatcgaggccaagcggattgttgagaaccacgttaatgcagtaaacattcgcatgcctccaattccactttttcatcctttattgcttctaacctttgtccattgtgcttctcgttttaaggaaaaaacaaaactccaaaactcatttagggaaaaaccagatcgagaaaactccacaacaaaaatgttcataactctcaaatcacgactccaaagaagggcaatgagttcttcctatcaaatgctattttctgttgcaatgaatcagagaaaaacaacagaacatggcacagattttggctccctttatgcaatggaagatgagaatctcaaaatcctctcccaatgcaactctcattacatcaaacatgttttagaaaagtttcattgcggtgattatgtttcacagtgtcattgttggattcaacagtaa

SEQ ID NO: 65013 - DNA, 150 bp, Glycine max
  Peptide Sequence Number=SeqID_181791
atggaagttgatgggtctcatgactttcccttacaaacttacaatatcaataagaatgtgctcaagattgaaatagagagagtggaaactgctgctgttgttcatttcaatggcccaacaaagttgtggcttgaaattggtttagctgag

SEQ ID NO: 65014 - DNA, 288 bp, Glycine max
  Peptide Sequence Number=SeqID_181792
atgaaaccttctaccggtacaccaagcactagcagagctaggaccccaatcctttcctgtgggctacccccgagaaattcgaggccacagttgcgtggctgggagatgagcctgattttcagacaagggcaggacccgcgggggcccttggagacgaggatggagctcaggaggatgatgatatggctgatgtgctggagtacttcatatatccgacatagatcatatcctgccattcgtgggcctcttgagccaaatgtcaactttttggccataaccttgacctag

SEQ ID NO: 65015 - DNA, 189 bp, Glycine max
  Peptide Sequence Number=SeqID_181793
atgcaccaaggaattgagtctgagaattgggcgcgaaactatataaacaagaagacaacttggcgggaaaaagaacagcttctaggtctacgatacgctgcgatcgggtacacgtgccaactacagggttacgtaccgggttacgtactgagagaatacatagggattagtttattgtataaaaaataa

SEQ ID NO: 65016 - DNA, 798 bp, Glycine max
  Peptide Sequence Number=SeqID_181794
atgggcatatgtgccattgatgaatttgacaagatggacgaatccgatcgtacggctatacatgaagttatggaacaacagactgttagcattgccaaggctgggatcactacatcgctgaatgcaagaaccgctgtccttgctgctgctaatccagcttggggaagatatgatctgagaagaactccagctgaaaatattaatcttcctcatgccctcctatcaaggtttgatcttctgtggttaatccttgatcgagctgatatggataatgatcttgaaatggctaggcatgttgtatatgttcaccaaaataaggagtctcctgctctaggattcactcctcttgaaccatctgttctacgtgcatacatatcagctgcaagaagattgtctcctagtgtccccagggaacttgaagagtatattgctactgcctactcctgcattcgtcaagaagaagcaaggtccaatgctccacattcctatactactgtcaggacattgctcagtattctccgcatatcagctgcactagcaagactccgtttttccgagactgttgctcagagtgacgtggacgaagcactgaggttaatgcagatgtcaaaattctctttgtactccgaagatcgtcaaaaatctggtctggatgccatatctgatatctattccatactgcgagatgaagcagctagagaagatgatttttgcgtcaaacttgagaacggtctagattcaagtttgactgatgaaactgaggaactcaacaatcaaaaaagatcatggaacaattaa

SEQ ID NO: 65017 - DNA, 1236 bp, Glycine max
  Peptide Sequence Number=SeqID_181795
atgagcaccaaggacctcaatttcgatgcagacacagctctggcgaaggatttcctttccaactttgcagacgccaatggcgaagccaaatacatgaacatcctgcaagatgttgcaaaccacaaaactcgagcagtccagatcgaccttgaggacttatttaattacaaagatctagatgaggaatttctgagccgtgttactgataatactcgaaggtatattgggattttttccaatgcaattgatgaactcatgccggagcccaccgaggacttcacagatgatgatcatgacatattgatgactcagagatctgatgaaggagcagaaggcaccgacggttccgatccacgtcagaagatgcctgctgaaatcaagcgttactatgagctttatattaaagcatcttcaaaaggacgaccctctacaatcagggaggttaaagctttgaacattggtcagcttgtaagaatttctggtattgtgacacgatgttctgatgttaaaccattgatgaaagtggctgtatacacatgcgaggattgtggatttgaaatttaccaggccaaaattcaagaattagctgaacatgtcccaaaaggccatattccacgaacaatgactgttcatttaagaggagaactcacgagaaaggtggctccaggtgatgtggttgaattatctgggatttttcttcctataccttacactggttttcgagcaatgcgtgcgggcttagttgctgacacttacttagaggccatgtctgtaactcatttcaagaaaaaatatgaagaatatgagtttagaggagatgaggaagagcagattgcacgattagcagaggatggtgacatctacaataaattgtcacgatcacttgctcctgaaatatttggacatgacgacattaaaaaagcactgcttcttctccttgttggtgctccccatcgtacgttgaacgatggaatgaagattagaggagatttacatatatgtttgatgggtgatcctggtgttgccaagagtcagctccttaaacacataatcaatgtagcacccagaggggtgtacactactggcagaggaagtagtggagttggtctaactgctgctgttcagaaagatccagtgacaaatgagatggttcttgaaggtggagcattggtaatggaagcctcctttcttaagtacaacagttccttccatccttattgtgctgggatatgttag

SEQ ID NO: 65018 - DNA, 279 bp, Glycine max
  Peptide Sequence Number=SeqID_181796
atgacgagctgtattgtaaattatggcaatattaaggttgagctttgtcacagcttagagggcaatgttggtgcactcacaaattttgaggtccttgatttcttactagctaaaggagcttcaaaggatccaacaagagttattgccaaagtagcacagtctgaacacaaggtttatgattatttggttgacactgctgcctctgttcaaacaagagagaacatcaatgagttcttgacagtgttaaacaacatgacctggcaaaagctgaggttctga

SEQ ID NO: 65019 - DNA, 1038 bp, Glycine max
  Peptide Sequence Number=SeqID_181797
atggcagcagatgaagatatgtcagctttgaagtctaagctgagccaatcaaatgaaacttggaagaaggagatggaaagaagccaatctcaagtggatgtattgcaggcaaggataatggaggtaaaggcacaaatacaaggctcagaggaagatgcgaaaaaggagttagaggttctatggcgaagagtcaagactacttctaccctgttgacctacttaaaatcaaaagctagaatcatggctgttcctcatctagcccatacatcttgtggcataaaaaagttagatggagtagggcttgttgacaaagatgggattccattatcaggttggtctaggaatgttgatctttgttcctttgatgatccagatgaagaatcttggattggaattaaccgtcagcatggttccttggaccaacaagatgcagtttatataggtgagatactcaagtctgttcagatggtcacggatgtgatggaagcccttgtcaaaagagttttattggcagaatcagaaactacttttgagaaggaaaaagtgagtttaggtcaggaagaaattatgcgaaagtctgctcagttagagaatatgtccatgaaattggaggagatggagcgttttgctttgggtacaaatggtattttgaatgacatgcggcaaaaagttgcagatttggtggaagaaacaactagacagagacagcgtgctgctgaaaatgaagaagagctttctagagtgaaacgggagtttgagtctctaaagtcatatgttagtagtctaatcacagttagagaaaccttactttcttcagagaagcaattccaaactattgagaagctgtttgagcgggtaagggatcctccccttcatatcaagagcacggctcatccacatctggagttaaatgggactaaaccaccactcttacggctggcaattaaagcagccctaaagaggccgcaactaaggcgggcaattaaagcagccctaaagaggccgcaactaaggcgggctagggcataccggaattaa

SEQ ID NO: 65020 - DNA, 1200 bp, Glycine max
  Peptide Sequence Number=SeqID_181798
atggctccttcccgccgcaacaccaacggtcgatcaccgctcgtcaatcaacagagtcaaatcacttccttcttcaccaaatccgcttccccttcgccctctcccactctctccaaaaccaaccctaaccctaaccctaaccctaaccctagtcccacccctgctactccttctcctctcaatcccaaacgctccaagccccttcttgtaatcggcgcttccacttctccaccctccgcttcgccttctctctactttcaagagctcattggccgaaggatcaaggtttattggcccttggacaaagcctggtacgaaggctccgtcaaatccttcgatagcctcacctctaagcacgtggttcgttacgacgatggcgaagaagaatccctcgacctctccaaggagaagatcgagtggcttcaggaatcgtcttccaagaaacttaaacgcctgcgtcgcggcgtccccgccgttaggaagatgatgatcgacgacgacgacgaagaagttgaagaagaagaaagtcacaaaaaagatgatgatgatgatgatgattccaatgacgaagattgggggatgaaggctgcattggaggatgctggggatgccgaagaagatacggatttagaggatgaaaacgacgtggcagagagggctaaagggaaaaaggtagagactaaaaagcggaaactaagcggaacagagaaacaagagccggcaaaaaagagcaagagtggagtggaagttggtaagggagctttcaagctctcagtgttggagcctacgagtaatttggagattaaagagacatctaatggcactgacaatgttgcgattactgagatctctgaaagatttgcactgcgtgaagctcagaaattgcgcttcctgaaggaagatcgcagggatgccaagcgaaggcgaccaggggatgaaaattatgattcaagaacaatctacttgcctcctgatttcttaaggagtttgtcagatggtcagaaacaatggtgggagttcaagtcaaagcatatggacaaagttttgtttttcaagatgggtaaattttatgagctttttgagatggatgcacatgtaggtgcgaaagagcttgacttgcagtatatgaagggagaccaacctcattgtggatttccagagaagaatttctcaatgaacgtggagaaactagctaggaag

SEQ ID NO: 65021 - DNA, 270 bp, Glycine max
  Peptide Sequence Number=SeqID_181799
atgaccacaatgatggaggccatgatgagcatgaagaagataatggggataaacacggctgcaattgtcgctactagtgtcgttgataaggtggacccgaccccctcatctagcctctaccacataaatcatcccatctcggatatggtagtgcagagagccaaagaattgggaatcttgattcaagatttcttcaagatcaagccttgcctcacaatgaaaggtttcaagtcattcaaggcacatgtaatcgattaccaatacatgtaa

SEQ ID NO: 65022 - DNA, 267 bp, Glycine max
  Peptide Sequence Number=SeqID_181800
atgcccaacgaccacccgaagagtgtgaaaagtcaagcaatgaaaaacccttatgtcgattcgataatggatggatatgaggctacgagacagataagggagattgagaagtctcatggtgttcacattcctatttttgcattaacggctaatacacgggaagagacaaaattgtccattgaagctgaaatggacgatcacttaatcaaacccatcaacaaagaggctttgcttaaagccatcaaaagaatatatactaaagagtga

SEQ ID NO: 65023 - DNA, 261 bp, Glycine max
  Peptide Sequence Number=SeqID_181801
atggtgatatattaccaaacagtttttgacaagtccacttctaacctctttgtggcttctgatcaagctggtaagatttgcttaaaggttcttgtggcaagtcacttgcttctttccctcaaggagaatccaaagaataagattactgcagtacctgccgaggaagaggaaatccggggtgcattcttcaaggtaatcttagagcttaagaagttagagttgaatatccattatgtaactacgattgctagttgcaactaa

SEQ ID NO: 65024 - DNA, 144 bp, Glycine max
  Peptide Sequence Number=SeqID_181802
atggagcgccctaaggtagctaatgccataatcgccttcgctaaagctgtgaattcgaaccatcaactatcttccaagggcgaaaaattgttggctgacaaggtgaagagcattgtggctgaggaggatgctggcgaggagtag

SEQ ID NO: 65025 - DNA, 177 bp, Glycine max
  Peptide Sequence Number=SeqID_181803
atggaaacacgttctacaaactcccaggtggttgtctcaaaccaggagagaatgagaaagttgactagcaagcttggtgctaattcatcagcttttgtgcctaactggcagttggtgtctatttgtgtctttattgttgtcatttgcatgtatccttggaaaactgcagataggtga

SEQ ID NO: 65026 - DNA, 834 bp, Glycine max
  Peptide Sequence Number=SeqID_181804
atgctggtggaggcacttcttactttcatgggagggtgtagccttccgctgcttctccggtcggggaacttgtttgatcaccataatttgtctcccttctgttcttcggggcaaggaagagtggtggtagggacgatagggcatccccctatgtgcggcgtaaccacagtgctgggtcaccatcgtccttttactgttgctggctatgaatgggactcttgcaagatagccatccaagcttgtgggagtgacgatttcccttttctgagggcaatgttgggtagtccacccttcttttttgtgtaccgttgtttctttgatgttctggacaagataggctgggtttccttgaacactctgtccaagaagttgtttgagtttgacttgaaaatattttgccacttcaaggaccatttcttcaaggccttggctactgacatcatggttgatggattgccattgatgttcaacagggacagggagcctcgcttcccattctaccgacagtttgaccccaccaggttcaagtatttcgacgaggatctattgacccttgtggagagggtcgacaaagttatattggagcaactaccgaccttgctgggtgtgtgggccattttgtctcttccttcggcggatgatcctttcgctatcttggatggaaaaatgccttaccttgtcctcttttgtgtcagaggtgggactgtcccatcgtctattgttgctccttttgttggggaagagggtcaacctgctgttgaggttggccctactgctaaagttgttggggtcattgccaacattccttcctctgttttggctaataggaaatga

SEQ ID NO: 65027 - DNA, 2202 bp, Glycine max
  Peptide Sequence Number=SeqID_181805
cttgtaaggcgtgaaatatgttcagtggttacaaaaggtacattaacagatggggagttgctgtcagcaaacccagaagctgcatatttaatggccctgacggagcatcacgaaaatcacccaactgaagtttcagagcatctctatggtgtttgtatagttgatgttgccacaagtagagtcattcttggacagtttaaggatgacttggagtgcagtgtcttgtgctgtatcttatctgagatcaggcctgttgaaattgtgaaacctgctaaactactcagtgctgaaacggagagagtactgctgaagcataccagagatcctttagtgaatgaattagttccaattgtggaattctgggatgctgacaaaactgtggatcaattaaagagaatttatgggaactctaatgatgttagtgttaacaataatgagttagattgcctgccagatgttttactggagctggtgaaaacaggtgacgacagtagaagtgcactttcagcactaggtggtgctctgtattatctgagacaggcttttctagatgagagattgcttagatttgcaaagtttgagttacttccttgttctggttttggtgatcttgcttcaaaaccctacatggttcttgacgcggctgccctggagaatcttgagatttttgagaatagcaggaatggagattcttcaggcacgctctatgcccaactaaaccaatgcgttactgcttttggaaagagattgctaaagacttggcttgcaagaccattatgtcatgtggagtcagttaaggaacgccaggaagctgttgcaggtttgaagggagttaatctaccttctgcactagaatttcgaaaagcattatacaagctacctgacatggagcggttgcttgcccgcatcttttcctctagtgaagctagtggaaggaatgctaatagagtggttctgtacgaggatgcttctaagaagcaactgcaagagtttattttagctctgcgtggttgtgaacagatggctcaagcatgcttttcacttggtgtcattttgagtcatgtaaaatctagacaacttcatcatctgttaacaccgggtaaagttcttcctgatgtttgtatggatcttaatcatttcaaggatgcctttgattgggtggaagccaataattctgggcgtataatacctcgtgaaggagttgacacagagtatgactcagcctgtaaggcggttaaagagattgagtccagtttattgaagcatcttaaggaacaaatgaaactacttggaagcacatcaattacttatgtcaatgttggaaaggatacatacctattggaagttccagaaaatttgtctaagaatattcctcgagattatgaactgcgctcatccagaaaaggcttctttagatactggtctccagatattaaagttttcttaagagagctctcccatgctgaatctgaaaaggagtccttgttgaaaagtacattgcagagattaattgggcgtttttgtgaacatcacgctaagtggaagcagttggtgtctacaactgcagaactggatgtcttgatcagtttagcaattgctggtgactactatgaaggaccaacatgtagacctagttttgtaggcacattatgtacaaaagaagctccttacctccatgccaaaagtttgggacacccagtccttaggagtgataccttaggcaagggtgactttgtacccaatgacataaccattggtggttcagatcatgctagctttattcttctaacaggtcctaacatgggtgggaagtcaacccttcttcgtcaagtttgcttgactgtgattttggcccaggtaggagctgatgtcccagcagaaagttttgatttgtcccctgttgaccggatttttgttagaatgggggccaaagataatataatggcaggccaaagtacatttttaactgagctttcagaaactgcatcaatgctgtcatcagctacttgtaattcattggtggctctggatgagcttgggcgagggactgcaacttctgatgggcaagccattgcggaatcagtattagaacatcttgtgcggaaggtgcagtgtcgcggattgttttctacccactatcatcgattagctgttgattatctcaaagatccgaaggtattaccagttttttatccagtgtaa

SEQ ID NO: 65028 - DNA, 1503 bp, Glycine max
  Peptide Sequence Number=SeqID_181806
atggctggtaagctggagaaaaagagggtttggtggagaggggattcggggctacgtgatgggagtgaagagaatttggatttatcgaaaggaatgtatgatgctggtgaccacatgaaatttgggttccctttggctttcactgcaaccatgttctcttgggcgattcttgaatatggagatcgcatggatgcggtgaagcagctacactatgcacttgactcgctgaagtggatcacggataatcttgttaacgcacacccttttccagaagtgctctacattcagagctttttactatgtcttagttgcagacaagcagccggttttacaagggatcttgagttggatcataattgctgggaaaggcctgaagataaaaaacttcgtaccccattgtccagaggctcttggctatgcgaaggtatgggggagggatgttgtacgcagccttacccttgcatatgcaaagaggttgtttccggattcgaacccatgaccaacaagtcaccaaggcacaactttaccgctgcaccagggctcgccctctgggaaaggcctgaagatatgaaagaaaaaagaccacttactcaagttaactcatcttttccaggaacagaagttgcggcagaaactgcagctgcattggcctcagcatctcttgtttttaatgagatcgattttgcttactctaggattctcctacaacatgctcaacagccgtttatttttgccgatacatatagagtttcctacagtgtcggcatccctcatctggttttggggatgaactcttatgggcagaatgagaaagcatttggcaatttagaaattcttagttgggatgataaacatgctgcaactcaggttcttttgtctagagtgaatttctttggtgcaagtaacatcccggatgcggagaatctcgaccttcagatgtacagagaaactgctgaaatcctcatgtgcatgcttctacctgattcaccaacagccaccaccaacagaactgaaagtgggctgatatgggtggtaccatggaactctttgcaactgtcagtggcttctgtattcttagctgttctttatagggactacatgctgacatctcaaactgaaatactatattgtagtgggaaattgtataagccagtagatcttcgcaaattttccatttctcagtttcaggcagattatgttttaggtgaaaatcctatgaagatgagttatcttgtgggatatggaactcaataccccaaatatttacatcacagagggtcttccattgcagttaatgctacaactggttgcaaagatggattcaagtggtttgagtcacctcaccctaatccaaatgtagcatttggggcactagtaggtggtcctttctttaatgagacatataatgatttcaggaacaactcaatgcagtctgaaccaaccacttataatggcacctcttggttgctctcttatctggcttggttgctagttcctccgtag

SEQ ID NO: 65029 - DNA, 219 bp, Glycine max
  Peptide Sequence Number=SeqID_181807
atgacccacaagcaacctagcagtgaaggtagaggaatttggaagcattactttgatgaaagtggacataaacatagagtgataagagttattccatgtttggacattattatacaagaacaaagaccactaaatgcagattccccacaccacatattttgcgagttgctctcacctatgacatctccaccgccccatcaacctcattacttgacctga

SEQ ID NO: 65030 - DNA, 471 bp, Glycine max
  Peptide Sequence Number=SeqID_181808
atggtgcaacgaaaaaggaaatacaacctgcaatatgaacccggatatacagctcctccgccaaagaagtctaagataaatgatgaaacaatgtccattagggaggaggaagaaccgtcaaacgcaagaatagagattatggttgaaggagtggaaatggaaagcgattactctgaatgcagttctgccgctgacagaagcgcgtcttgctgtcgatcacttgcaatagcttttacactagtcttacttgtaaggcatcttttcgcagtgctcacatatggaacggaagattacccatttacactactaactgtaattatattaaaggctagcggaattattataccaatgtacatagttattaagattatcggagccattcagaacagtattcagcactatcaggattctgactatgacgaagatgacgaaaatgatatacagcataatgtaaattcaagacatttctag

SEQ ID NO: 65031 - DNA, 1929 bp, Glycine max
  Peptide Sequence Number=SeqID_181809
atggctgcttcaaggttaacctcatgcgtggcggtaacttccgctgcggtggtttccatgtccaccttctccgatcgtgcctacgccgattcttactttcgactcccgttcttctcttctaaatcttccagtgagccctcgccgccgaatcagccctctgactccaattccgagcctccgccgcccgatgaacctaacaaatcgggtttcgacccggaatcgttagaaagaggagccaaagctctccgcgaaatcaatagttctccctactccaagcagctgtttgatttaatgcgaaaacaggaggaaactcgcctcgctgaattagatgctgagaaagtgcattacgaacttattcaatctcaaggagatattgaaaggcagcgtaaaatggctgaagaacaacgcaatcttatacaggaccaagcccagagacaggcccaggtgttgcgatatgaagatgaattggcaaggaaaagattgcaggatggtctaactgtttgtgagtatttggatgcccaaaggcaacataatgttgaattggtcaagatgcaagaccagtcttctttcagaatggagcaggcaagacaggctactgaagaacagattcaatctcagcagcgtcagactgagagggagagagctgaaatagaaagagaaactattagagttaaggcaatggcagaggctgaaggccgagcccatgaagcaaaattgactgaggatcataacaggagaatgcttatagaacgaatgcaaggtgaaagagataaatggcttgctgcaattaacacaacttttagtcatattgaagggggcctaagggccttattgactgatagggacaaattgcttatgactgttggaggagctactgcactagctgcaggaatatatatgactagagaaggtagtaaagtcacttggggctatattaatcggattttggggcagccatctctgatccgggaatcatctatggcaaagtttcctgggtcaaagatcatttctcaagccaaaaataaagttctacatgatagtactttggctggggcagaaaagcctattgggagtaaaaatggtcttggaaatgtaatccttcatccatcgttgcagagaagaatagagcatcttgcacgtgcaacatcaaataccaaatcccatcaggcaccatttcgtaacatgcttttttacgggtctcctggcactggtaaaacgatggttgcaagagaaatagctagaagatcgggtttggattatgccatgatgactggaggagatgttgcacctctgggcgcacaggctgttaccaaaattcatgatatatttgattggtccaagaaatcaagaaaaggcctattgctttttattgatgaggcagatgctttcctttgcgagcgtaacagctcccacatgagtgaagctcaacgaagtgctctaaatgcattgctcttcagaactggtgatcagtctagagacatagtacttgtccttgccacaaacaggccaggtgatcttgatagtgcagttactgatcgcattgatgaagtgattgaattcccgctaccaggagaggaagagcgtctaaagttgttgaagctctatttgaacaagtatttatgtgatgacaataatggctccaaggggggtttctttctgaagaagcagcctcagaagatttccataaaagatttatctgaagatgttttcagagaggctgccacgaaaacagagggattttctggtcgtgagatcgccaaactcatggccagcgtccaagctgctgtctatgggcgcccagactgcatcttggattcccagccttggggtgatgatgtagttgaagatgccaaagccaaagcagaggaggccaagcattttgccgcagaagccgtgcatgatgccgaggaagagacccgctctctccaa

SEQ ID NO: 65032 - DNA, 228 bp, Glycine max
  Peptide Sequence Number=SeqID_181810
atggcatcatcttggacgccaaggcaaaacaaactatttgaagaggcccttgctatacatgatagggaaactcctgacaggtggcagaatgtggcaagagtagtgggaaaatccgttgaggatgttaaaagacactatgaaatcctcaaagaagatatcaagcgaattgagcgtggtcaaattccattacctaactatacaggtggaaagagaagggaaaagaaataa

SEQ ID NO: 65033 - DNA, 510 bp, Glycine max
  Peptide Sequence Number=SeqID_181811
atggagagaaaagagcgaaagataatggtgggtgtggatgagagcgaggagagcatgtttgcactgtcctggtgtatcaccaaccttattgccgatacccccaacgttaaactagtgctcctctatgtcaagccacctcctcctgttcactccttcaatgttgcatgcatgttttgctttcttcccactccccaatatatttggtattccagtcatgctatcttagctatggaacaacacggcaaggatttggctaattcagtaatggaaagagctgaagccatttgcaaggacttcaaaaccacaaatatgaaaaaggagagagtagttgggtgcggagatgccaaggatgtgatatgcagtgcagttcagaaacttgaggctgataccttggtcttgggaactcatggttatggattttttaagagggcacttattggaagtgtaagtgattattgtgccaagcatgcagagtgtactgttgtagtcgtgaagcaaccatgtccataa

SEQ ID NO: 65034 - DNA, 622 bp, Glycine max
  Peptide Sequence Number=SeqID_181812
aagtttgggggccgaagaggattatgaaaaacaagcgactcaaaacatgaaatatcaagctgaagatgctgcctcaagggccacagagacaatgaaatctgcagcatcaggagcctcggactacgcttctcaaaaggctacggatgctaaggtcatcaaaatgccaacacatagcattaacaatgcaaaagacacaatgggagatacctacgaggatgctaagcaaaaaatgaacacggcttcagataaggtttcaagtatggctcacaatgccaaagataacatggaatatggaagagatagagcagcaatgcctatgaccagggacaaagcaagtgatgtgtatggcgaagcaaggcataaagtgaaaggagcaatgggttgtggagaagataaggccgttgatgatgctaaagataacatgggcgtgaaaatggaacatggaagggacaaagtagccgaaacttttgaccaggctaaacgtgaagtgggtgaagcatatgtgtcagcaaagaatacaatgaccaaagaggccaaggctaagtacgaggctgcaaaggagaaagcttcagatgccacgggtgatttaggagctaagatgaggaacaccccaaacctataa

SEQ ID NO: 65035 - DNA, 216 bp, Glycine max
  Peptide Sequence Number=SeqID_181813
atgaaatccttgtcctttatatcaccagagcaatttattgcctttaaggtagcaggaaaaaagagaaataggagagcaatcaagcatattagaaaagagaaaaataggggagtgagctacttgcgtggggcaacagaggcaatggcatgtggtgacaaaggtgtttggtttgcttgtgagaaacatgaaggagaagaaaaaggtgcatgggaatga

SEQ ID NO: 65036 - DNA, 174 bp, Glycine max
  Peptide Sequence Number=SeqID_181814
atggtgtctgacgccagcaagaagaaggccgcacagaagaaggttgtctctgtcgccgttatggctgctgcgtctttcaaaggccccgacaaggtcgccaatggaattgcaaagattcaaatttcggattggacctgcacctctctccaaagatattcgattgaactgctttaa

SEQ ID NO: 65037 - DNA, 954 bp, Glycine max
  Peptide Sequence Number=SeqID_181815
atggcaatgagagggcaacaagataaggaaatagagataccaaccacaaccactttaggttacaaccttcttcccaaccgagattcttcttcttcctcttccaagctctcttctccaactgttggtgaaagaagtagcagtgatcatgatcatcaaactcacacattgatcttcaacgaaacacctcaccataatctctatccaccacctccttctcttgcaccgcctcaacctcaaagacccacattagatccagatctaagcaccccaattgctcccacatcgaaccccccaagaacctcgaccccatcgatcaggtaccgagaatgtcttcggaaccacgcggcgagcatggggagccacgtggtggacggctgcggggagttcatggcaagtggagaagaaggcacgccggaatcactaagatgcgcggcgtgcgagtgccaccgcaacttccacagaaaagaagttgaaggagaattacaaccgcaatcgctaccacaacaacatgttccaaattaccacagctactacaccaacaagcacaacggtcactttcactaccctacaccctcttcttcatcccttcatcatagattggttgccactactaccgccacaccgagcttggtccccccagtgatgatggccttcggaggcccagctgagtcatctagtgaagatctcatcaacaacactggagcccagttatcagtgcagcagcaggcaccactaacacactcttccaacaagaagaggttcaggactaagttctctcagcaccagaaggataggatgatggagtttgctgacaagattgattggaagatccagaaacacaatgagcaggaggtgcagcacttttgtactcaagtgggtgtcaagagacaggtttttaaggtttggatgcacaataacaagcaaactagtagtagtaagaagcagcaaatgtaa

SEQ ID NO: 65038 - DNA, 600 bp, Glycine max
  Peptide Sequence Number=SeqID_181816
atgggaaaccaaatagctagagatgcaactgggaaaatcgtttactgggatggttcggttcaagaattcgacgagccactgacagtggcagagctcatgttggagcacccgcaacaagtagtgcttgatttccattccgctgtgaaggagaaaaggccaacgccactaccagccgacgaaaagctagagatgaagaaaacctatgtgatggttccggtgaagcgagggaagcctgtgttgttgagcagcgaagatagtcgccgcattctcttgattgttaattcctctctgcattccaagtatttcgtttcttcttcggggtttcttccttggctttcacggttgttccactctgagggagaggttgtttcagtgttgcagagaaaggaagaggtggaggtggagaacacggtagagaggtatggtttttctgagtttttgccagaaatgatagaagggtcgaggccagagtatatgagtagacagttatcggggaaggggtggaagcctagcttggacaccattaaggagaagaaagttaagacaaaactatctcgctggttattgttcctcaaaggtttttctgctgcaaagatttaa

SEQ ID NO: 65039 - DNA, 591 bp, Glycine max
  Peptide Sequence Number=SeqID_181817
atgcatggccgcaatgcccttcacccggcgcaggcgtttcaggcgaatcactgcgtcacctgctgcgatctgcaacttatcggcttcgtcggcgctggcgcggctgtgctgatactccagcagtcgcgtctccgactgcagcaaaccgcccgctttgtcatgcagacgaaaatagtgaaagaaatggctgaggttatgcagcggcgcccagccggtcaccaccgtgccggttttgcgccggcgcatcagcatcccttccgtcgtgagcgccgccagcgccttgcgcaccgtaccgaccgagacaccgaacttcgccgccagactgttttcactgggcaaaatggtgcccgccggcagttcgccctgcaggatggattcactgatatggcgcttcactacttcgtacagcggagcgccttcgccttcgttcaggcgactgaattgtggaacgtcgaaaattcatcactacagcgcgctctgacccatatcgccgacgatcaggcgcagattcttgacgatctgcaacgcatgctgcggtggacacctgcttcccgcccggactgggttacgcagcattcgccgacctgctga

SEQ ID NO: 65040 - DNA, 632 bp, Glycine max
  Peptide Sequence Number=SeqID_181818
atggataggttgacgaccatgatgagtgcactcctgtcagcccagaactctcaagctgccgccgctactgtagagcagcccttggtgagcacaaccccgctatctacggtgacttctccacccctctttttgcctccaggttgtacatggggaatgccacctccagtctgtggaagcccccagcccgctgtatctgaagttccgcctccttttgctcagcagtcagcaccggttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaaatg

SEQ ID NO: 65041 - DNA, 345 bp, Glycine max
  Peptide Sequence Number=SeqID_181819
atgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcagcatctactataccaggaatatcaatgaaccctattattgaaattgctcaggatacccttttttag

SEQ ID NO: 65042 - DNA, 270 bp, Glycine max
  Peptide Sequence Number=SeqID_181820
atgtccctagtggagtcgccaactgtcgcaacgtacccttcggcgggagggcgacgcgtgactcgcgggatgcgtgttccacgaaaggaatacgcgcggagtcgccaccaacgtttatttgaggaaaacgtcggaaaaaccgaaggaaaaccggccaaaaagaaaattctaagttcgggagtggtatttacgcttgaggaaggtgatcattttaaggcgttggaccttgaaaatgatccattttacttagttaagcgagaaatgacttaa

SEQ ID NO: 65043 - DNA, 645 bp, Glycine max
  Peptide Sequence Number=SeqID_181821
ataaggaaggtccaagacagcctaaacctttggtattacatttcaccagggacacagctccccaaaagccccgacacccctcggcagtgtcgggtgttagacctatttcgtttccttacaagaacagccacgcagttccatggaggtatgcccctccgagcggtaagaaggaagaagctaccgacatcagctcgctatcggccaaagtaaccaatatcaccgggctaagcggcataacccgcagcagtcgcgtattcgcaccccctgacctgccaacgcagcccgtaaatgctaaagggaaagcaaggatgatggaaggacaaaacgtcaaagtgatccccacactggacgaggatgttccgacgaaggatcttttcgagggaagagaaggctgtggcaagaaagaggtatcactcgaggaggccagcgagttcctccatactatccaacaaagcgagttcaagtgtagacaaaggatcaagctgaaagttttgatgatcccaaaggattacatgaatcatatgcttctcaaagggatcaagctgaaagttttgatgatgccaaaggattacatgaatcatatgcttctcaaagatttactcaagacaaagcaattagagatattcaagatggataatcaagaca

SEQ ID NO: 65044 - DNA, 297 bp, Glycine max
  Peptide Sequence Number=SeqID_181822
atggtggtttccaaaactaagctttcaaagggagattctaaaattgtcatggatgcagctcatagtcttgatggtccacataatgagttgatggctatcgtaagtgaaaatctttgcaaagatgttgcaattgatatgcttcgtggaagtggacccaatgccaagctgaagaaggcggagatacttgaagctgcaaagagagaactcagtagatgtttattatcatatctagaggccccaaaatcagctgggtccccaaccatgacaaaaggtaaaagcaaaattggtaactcgtga

SEQ ID NO: 65045 - DNA, 130 bp, Glycine max
  Peptide Sequence Number=SeqID_181823
atgtctttggaagataaaaacgcaggcggccaacagttcatggaaaacggggacaaccataaagggctcaacaagtatgcctgtgcctctgtgttagctgccaatattgtctctgctatatttggttacg

SEQ ID NO: 65046 - DNA, 1761 bp, Glycine max
  Peptide Sequence Number=SeqID_181824
atgcatagattctggcctgatgccttcattgtgtaccatttcagagtgcccgagaatttagcaagagccttaagcaagccgagaaaggaaaagatgcaacaacctaaaggggtgcttaaagtgctaccagaagattgtgaagagagagtaatggacgaactcaactcagacttagatttgcatgtttcaatcacagggataatgataaatagagataagtacggtgcgaaaagagtgaggcggagaaaaatgaagtgcccgtactgttcggcggcgcaggggcgttgcgccaccacgagcagcgggcgttcgatcacggaatgcacgtcttgcgggcgcgtggtggaagagcgacagtcgcatccccaccacgtgttccacgtgcgcgcccaggacaaccctctgtgtctggtcacatcggatctcgctctccccgcgctcaatcaaaacaacgaggaggaggaccctttcgagcccacgggcttcatcaccgccttctccacctgggccctcgagcccagcccactctacctccagtcatccctctccttctctggctacctcgccgagctcgaacgcactctggaatcatcatcatcatcctcttcctccagttcttcttcttcgttgtcgtcgacggtggtggttgataatttgagggcgtacatgcagattatcgatgtggcgtcaattctagggttggactgcgatatctccgaccacgcttttcagttattcagggattgttgctccgctacgtgtttgagaaaccgcagtgtggagtcgcttgctactgcagctcttgttcaggccattagagaggctcaagagcccagaacccttcaggaaatttcaattgcagccaatgtgccgcaaaaggaaattgggaaatacatcaagatactgggagaggctttgcagctaagtcaacctattaacagcaattccatctcagttcatatgccaagattttgcacgcttcttcagctcaataaatctgctcaggaactggctactcacataggagaggttgtgatcaacaaatgcttctgcactcgcaggaatccgattagcatctcagctgctgctatatatttggcttgccaacttgaagacaaacgcaaaacccaggcagaaatttgtaaggtaactggtcttactgaggtcactctccgtaaagtgtacaaggaactattggagaattgggatgatttgcttccctctaattacaccccagctgttcctccagagagggcatttcccacaacggtaattgcctctggtcgttcttcaacagctaaggttgatgctgtagaggttatttcttctttggactcagaaaagttgccggatattaaacctagcaaacctagtgaggtctcaggcatggttcatcagtccagagggatggatgaggctgaaggtaaaagcaatgctcatgcaagccattccacactgaatcaacagtcaactttttggcaatcccagcttcgtagtgggacacacaatcatcagaatgttttgcaaggaatggatatcgatgtattgcagcgaaaccaccaacggccagaacacatggcagaggatacaaatggtgctgccaatggtagttctctaaaatcaaacaaccaactatgcagtcctcctgcttctagtgcaagttctgttatgaggcagttttcagctcccccttcatctgggccttcaaatgttagattagtacagtcacctaagataatgccaggttatccggagcactga

SEQ ID NO: 65047 - DNA, 123 bp, Glycine max
  Peptide Sequence Number=SeqID_181825
atggaggtttgggacgaaaccactacacattttgttattcttgagcctgtcaccaacctctgcaagcttagcatttgtcatgatgtaatcttcctcactgtctctcattacatgaactactga

SEQ ID NO: 65048 - DNA, 1383 bp, Glycine max
  Peptide Sequence Number=SeqID_181826
atgtactattatgcaggagagcaatccatgggaaaagggaataataataactattacaatagcgggcaacacccaaattattacggaggtccacatggggaccatgttgtgaggatgcaacaaaatggaatgggtcctggtggcggagggtggggtgcaccaccaccacctcctccaatgatgatgagtagtgctgagtttagctccaattactcgacgggaccggccccgttgcctcctccctcaccaaaccttgctctgggcctcaaagggggcaccttcacttacgaggaattagcagctgccaccaacggattcaatgatgcaaatttgataggacaaggtggattcggctatgtccataagggtgtgttgcctagtggaaaggaagtggcagttaagagtcttaaagcaggtagtggccaaggagagcgagagttccaagctgagattgacatcattagccgcgtccatcatcgccatctcgtgtcacttgttggatactcaatttctggtggccagaggatgttggtctatgaatttattcccaataacacattggaatatcacctccatggaaagggtaggcctaccatggattggccaactagaatgcggattgcaataggatccgctaaagggcttgcttatcttcatgaggactgtcatcctcgtattatccatcgcgatatcaaagctgcaaatgtccttattgatgatagcttcgaagcaaagctaatcaagtatgcggacaatgcattttttcaggttgctgattttggattggctaagttgactactgataataatactcatgtatcgactcgtgtcatgggaactttcgggtacctagcccctgaatatgcatcaagtggaaaattgacagagaagtctgacgttttctcatttggagtcatgctattggaactcataactgggaagcgacctgttgatcacacaaatgccatggacgacagcctagtagactgggctcgaccacttctgactcgtggactagaggaggatggcaactttggagagttggttgatgcatttttagagggaaactacgatcctcaagaactgtcaagaatggcagcttgtgctgccggtagcattcgtcattctgccaaaaaacgtccaaaaatgagccagattgtaagaatattggaaggagatgtctcactggatgacttgaaagatgggattaagccggggcaaaatgttgcttacaactcttcatctagctcagatcagtatgacacaatgcaatacaatgctgatatgcagaagttcagaaaggcagtgttttctaatagcgaggaatttggcaccagcagtggctccagtggtgaagtaagccagaagcagcaacggctctag

SEQ ID NO: 65049 - DNA, 549 bp, Glycine max
  Peptide Sequence Number=SeqID_181827
atgaccaaaataagaagcacgcttcctatgccaagcactgctccaactatggccttgctgctgtcgtcaccgccaccgccattgctatcacggctgccactgtcactgccactgccagagttccttgaggacggtggagaatctaaagatttgtgtggaggagacggtgattcaaaggagggcggagaacgtgatgatccgggtggagaaggtgactgtgaggacccattaggtgatggagggcttggattgtttgatgttggaggggaaggagagggtggtgatgatgaagatgatggtggaggcgacgagggtggtggcgatgatgaagaagatggtggtggtgacgacggaggtggtgacgatggtggtggcgatgatggaggtggtgatgatggcggtggtgatgatggaggtggtgattgtgatgatggtgaagatgagttgtcagcgtcatcaggggtggagttatccggggtttcattatcaggagaagagttatgtggagaagacattgttattgttattgtatctcagaattcacattaa

SEQ ID NO: 65050 - DNA, 1125 bp, Glycine max
  Peptide Sequence Number=SeqID_181828
atgaaacaaccagctgcaaagtcatccctgaggaggctttgtccgaacatcggtaaagaagatgggttggagaccgttcttgaaatacccataccggaagaaatgttctcaagcatgggcagcaacgtgaatttgcggtggcaaaacatgttagcgtggatgaaggcccaaacagaggacaaattatcaacccccacagttgcgtctcgcttaaacgagcttcgctttctgctttacctcgtgggatctcctgttatccctcttcaggtccagttaggccattccgtccatcgtccagtcagagattgttccattgaagcatcaacggcaaagtatatagtgcaacaatatatagcggcaacgggaggacagccagcattgaatgcagtggacagtatgtgtgtgacagggcagatcaagattagtgcgtcagattttcacctcaaccacactaatgaaaccatcgaggtgaagaaaacctccgaagagatgggagggttcgttttgtggcaaaaggaccccgatttgtggtgtttagagctccttgtgtccggttgcaaggtttgttgcggtagcaatggcaaggtctcatggcgccattcttctaaccaacaaacccccgtttcaagaaatgcccctagacctttacgtcgtttccttcagggattggatccgagggcgacggctaacttatttttggacgctgcatgcataggagagaaaataatcaatgatgaagagtgcttcatcttgaaattggaaacaagtccagcaattcgtgatgcccaaagtggcccaaactttgagattatacaccacactatatggggctattttagccaaagatctggtctcttggttcaatttgaagactcacgattacacacaaccagaaccaaagatgataatgacattttttggcaaacaagtttagaatcggtaattgaggattataagtacgtagacgggataaatgtgtcccacagtggcaaaactcgagttacagtttccagatatggcgaacaatcagctaaccataaaagagaattggaagagagatggaagatcgaagaagtagattttaatatttggggtttgaatgctgaaagctttctagctccctaa

SEQ ID NO: 65051 - DNA, 1341 bp, Glycine max
  Peptide Sequence Number=SeqID_181829
atgaccggagcactcatattcataaaggaagatcttcaaatcagtgacctacaagtacaactcctcgcaggcacattacatttgtgcgccctaccaggaagcatggttgcaggaagagcatctgattatataggtcgacgctacaccatcattctagcatccatcaccttcttattgggcacaactctaatggggtatggtccatcgtatctaatcttaatgattggaaactgcattgttggaattggtgtgggttttgccctagtagttgcaccagtttacagcgcagagatttcacctccttcttacagaggcttttttacctctctcccagaactctcctcgaacataggagtcctccttgcctttatgtcaaactatttccttgaaaatttgtcactgagacttgggtggaggatgatgatggtgcttccttcaattccttcatttggtcttgtcattctcatgttgaaattggtggagtctccaaggtggttagtgatgcaaggacgtgtaggtgaggctaggaaagtgcttttactagtatctaatacaaaggaagaagctgaacaacggttgagggacataaaaggtattgttggcattgatgaaaactgcaccctagacattgttcaggttccaaagaatactcgcagtggtgcaggagctctgaaggaaatgttctgtaatccttcaccacctgtgcgtaggatactgattgcagcgattggacttcactttttcatgcggattgatggatatggaggttttttgttatatattccaagggtgtttgagagaacaggaatcactgacaagagcacgctcatgctagccaccgttggtatgggaattaccaaagttgtatttgcattcgtatcaatgttcttgtcggatagagttgggaggaggattctcttgctgattagtgcaggtggtatggttgtgacccttttagggctaggtatttgtttaaccatagtggagcactccaaagaaaaattagtttgggcaacaaccttaaccgttatttttacctacatatttatgggcattgcgtgcaccggagtaggaccagtgacatgggtttatagctccgaaatacttccccttaggttcagagctcaaggccttggtgtctgtgtggttgtgaacagactcacaaatgtggtagtggtttcaagtttcatttcgatttataaaaccataacaatgggtggaattttctttgtgtttaccggtatcaatgctttggctttgttgttctactcatctttgcctgaaaccaaaggaagatcattagaagatatggagattatctttggaagaagttcaaagtaa

SEQ ID NO: 65052 - DNA, 714 bp, Glycine max
  Peptide Sequence Number=SeqID_181830
atgggggacaacaacagcaacaacgatgccttcatgcgcaaccaaaacgccgccgttcaggcccgcaccaaagcgcagaaccgttccaacgtccttcagctcaaactgattggacagagtcacccaaccggtctaacagcgaacctgttgaagctcttcgagcctaggcctccgttggagtacaagccgcctccggagaaacggaaatgtccaccgttatcagggatggctcaatttgtgagcaagtttgcccagcctggcgatccagaatatgctccacctgtcccagaaaccgagactcctgtagcacaaaaaagagccagaatacacaagctaaggctagagaaaggagctgcaaaggctgctgaggagcttgagaaatgtgatgagtcctatattgtgaatttgctaatatttcatgattttgtgttctctggatgccattcttatattggcttctatgcagatgatccacataatgacccaaatgtgtcgggagatccatacaagacattgtttgtggctaaactcagttacgagaccactgagagcagaatcaaaagggagtttgagtcatatggtccaatcaaacgggtaggtatttttgaatatccctcaggggattcggttcgattagttgctgacaaagatacaaataagcccaggggttatgctttcattgagtatctgcatacaagagacatgaaaggttga

SEQ ID NO: 65053 - DNA, 726 bp, Glycine max
  Peptide Sequence Number=SeqID_181831
atgaattttcatttttcagggagcaacagcagtctcgttctgaagaaccaagagtgcgggaggaccgacacagtgatagagacagggaaatatcacgtgaaagagttagggacaaagacaaagaacgggagcgatcacgtgaacattctaatgaaagggtcagggatcgcgatcagagagaggataggcaccacagagaccgagataggaccagggacagagacagggaaagagatagagatagagatcgtggacgtgatagagatagagcacgtgatcgtgagcgagggagggaccgtgaccgggatcgagaatatgatcgacatcgtgagagggatagagattatgaagttggcgaaactgatcgaggacgctcacgtgatagggagtctcattataatcgtgttgaatctaaacatggggaaaggaatcatgactatgagcctgaggatgatcgtggtaggcaaaaccagtatgagcatggacataggcatgcagaccctgatcatgacactactgagcattatgacccctacaatcatggagatgatcgtggtgaccattacaatcagtatcctgaccctgataggatggaagatgactaccatgcaggacgtgcaacatctgaatcacatgaaaaggagagaagtcatgatgtggaccgtgaatatcggcgctcagagagatcacattcccgggagtatgattattaggaattgggcatag

SEQ ID NO: 65054 - DNA, 216 bp, Glycine max
  Peptide Sequence Number=SeqID_181832
atggctaaattcgatccggagatagtcatggagttctatgctaatgcctggactaccgaggagggatgcgagtacagccaggggaggagtcaggcctctggctttgatgaggaggctatcacccaactgctatgcataccagggcaagatttcgctcagaccgccgcagggagacgggtgcagatcatgcgcaccaacatgaccacccttacatag

SEQ ID NO: 65055 - DNA, 1119 bp, Glycine max
  Peptide Sequence Number=SeqID_181833
atggcaccaacggccaagactgatctggcttacctggctcaggagaagaccctggaattgagcttcgttcgggatgaagacgagcgtccaaaggttgcgtacaatgaattcagcaatgaggtcccggtgatttctctggccggaatccacgaggtgggtggtcgtagagaagagatttgcaagaagattgtggaggcttgcaagaattggggtatcttccaagttgttgatcacggtgtggatcaacaactcatggccgagatgacccgtcttgccaaagagttctttatcttgccactggacgaaaagattcgctttgatatgtccggtggcaaaaggggaggattcaacgtctctagtcatctccgaggtgagtccgtgcaggactggagagagatagtgatatacttttcctacccaatgagagagagggactatacaaggtggccagacactccaaaagggtggagatcagtgaccgaatcatacagcgagaagctaatggctctagcttgcaatctcttggaggtgttgtcagaggcaatggggttggagaaagaggctttaaccaaagcatgtgttgacatggaccagaagattgtggtgaattactaccctaagtgcccacaacctgacctcactcttggcctcaagcgccacactgatcctggcaccatcacattgctgcttcaggaccaagtgggtggactccaagccaccagggacaatgggaaaacgtggatcaccgttcagcctgtggagggtgccttcgttgtcaatcttggagaccattgtcattatctgagcaatggaaggttcaagagtgctgatcatcaagcggtggtgaactcaaaccatagccgtttgtccatagccacgtttcaaaaccctgtaccaaatgcaactgtgtaccctctcaaggttagagagggagagaagcctgtgatggaggaaccaatcacttttgctgaaatgtacaggaggaagatgagcaaggaccttgagattgcagggatgaagaagctggctaagaaaaaggactttgagaatgaaaagcatttccaagaacttgagaaggcaaaagttgaggccaagcctttgaaggagattcttgcctaa

SEQ ID NO: 65056 - DNA, 327 bp, Glycine max
  Peptide Sequence Number=SeqID_181834
atgaagctaaaggcagaaaacgaaaatgaaactaaaggcaaaagaaggaacagaaacgaaattgcaattagaaggcgacgcgtgactcccgggtgcgtgttccaagaaaggaatacgcgcggagtcgccaccaacgtttatttgaggaaaacgtcggaaaaaccggaaaagacgttgtcataccctaatttcgtccgaggattattacttgatgatatgcaacctttgatcgaccgctttgggatacttggcatcctttgtttcagaatatgtgaagtcccgagacatgccggaaatcaaaaggaagcaggcttacgcgatccgtga

SEQ ID NO: 65057 - DNA, 108 bp, Glycine max
  Peptide Sequence Number=SeqID_181835
gaggaatcagggcccacgtatgaagggaactatgaaattgccccacttatcaaggcagcaacacctcatttccacgctaatccttccttctttgaggcgaagttttaa

SEQ ID NO: 65058 - DNA, 1008 bp, Glycine max
  Peptide Sequence Number=SeqID_181836
atgtccacagatcatttagatgggtcaagatcaggaattaatctagaacaaacagttacagttgtactccagcctaatgatcagaaagcaggtcctgaggattttagaaggaatgctggctttgaattatctgttactcccaaaagggtgcatgcagaaatggaaacgagctcctcaattctgtatgaatatccaatcaaagaatacacagagactgaacaatttgatttaggcctaacgtggaagcatccaattgtttggtatagcccacatgcacctttatatgccagtagattttcgatgggaagtgggaatgaaaggggtgctattgcaatatccttgaaattgatccagggacttgttgcaatcaataacgttaaagagaggttagttgatgaaaggcctcaagcactcacagattttgttgagagaatgcgtgtttcgccttccgaagacaaagtatcacccggggtgatggagatgggcttcttacacattgatgaataccctccagatgttaatcaaggatttggcattccatcagcaataataagctttcctgacttccatgatggtttgcaattttctgataaatctcgaagcaagtcaccactgttgtttacagaacttttacttgtacccttgacgactcctgatttcggtatgccatacaatgtcatcacaattacatgcacagtttttgctttgtattttggatctttgctaaatgttctctggagaggagttggagaggaggaaagacttttgaaaaacaaagtttttgctttgtattttggatctttgctaaatgttctccagagaggagttggagaggaggaaagacttttgaaaaacaaagctgctaacgtctttgttcttctacctgtagatgccaacaaagcagtgttccttcaccaagtgctatctaaactatatctgccaagcttagaggcagaccattggaatcaactatgccctctcccttgtcatcgtcctttgttagtctaa

SEQ ID NO: 65059 - DNA, 174 bp, Glycine max
  Peptide Sequence Number=SeqID_181837
atggttaaacagggaaacaagggcttagccaagaaatcagttatgagagaacaaaaaaaatccattgaggcactctccgtcttcaacggccaacatcacgatattgttgaaatgcagatcaccagcggggaagaagaatcaaattggccaaataaaagggggaaaactttatga

SEQ ID NO: 65060 - DNA, 207 bp, Glycine max
  Peptide Sequence Number=SeqID_181838
atgtgtatggattataccaacctcaataaggcatgtcccaaaaatgcttcccttttgcctaacattgacagactagtcaatggggcatatgtgttcaaattgcttagcttcttggatgcttactcgagctataatcagatcaagatgtatccacttgaccaagaaaagacaaacttgatcgctaatggagccaatttctgctacaaa

SEQ ID NO: 65061 - DNA, 153 bp, Glycine max
  Peptide Sequence Number=SeqID_181839
atggtacattctactcaccagatacagctcatcggagaaaaaagcagtttcacagattggtataagaagaacctgggttattccaagttctttgaaagaacttgccctgacatggtgccatcaactctttcctcggaagatcaacttgtttga

SEQ ID NO: 65062 - DNA, 405 bp, Glycine max
  Peptide Sequence Number=SeqID_181840
atgataggaacacacaagccagaagcgttcacagatagtctgtgtaaaaagaggtcggctaacatggatgaattgagacgtcatgcggtcagttttatccaaatggaagagttgtctgagttctatgacaaagttaaaggagaccagaagaagcttgattctcataaagaaaaactaaagcctccaaagtatgcaacatatatccctcttactgaaagtcaagcatgtatcttggagaaggcattcaactcgaaaatacttgcattacctctgccaacagttatagaggagaaggaagaggtggccatagagacgattttaaaggaagatatattggtggataaggcaacaacaatcaacaaaggagaacaaaggcaacaagaaattcctcaaggcatcgtctga

SEQ ID NO: 65063 - DNA, 243 bp, Glycine max
  Peptide Sequence Number=SeqID_181841
atgaaaccggaggtgctaaaaggaagcaaaaacaaaagtagcaggcgacgcgaccagaacccgaggtcatggttcttgaagacattgtcgatcaaacttggcacggttaaccgtgaggaagttccatcttcagaaatcgattgcgaaaaagttttgcttcgatcattgcatagagagatatgctgtgtgttgggagatccatgttggtgccttagcggcggtgccgtggaggtggtttcgtga

SEQ ID NO: 65064 - DNA, 708 bp, Glycine max
  Peptide Sequence Number=SeqID_181842
atggcacaagaagacattgcaatggatagtacttgtgagagaaaagaaccagtgaacagagctggttcctctcaggagtctgtttctaaatcaggaagtgaaaatgaaacatcaacaaccaggcaatgtaacaaatccaacaaaaagctaaaagtagtcaatggtcccagctctcacttcggtcatttttccagaaaagtgcaaatcttgacaatggaaactccaacagtatttgctcatagtagcagtcccaagaaatatgggttggatactgatacatgtgatcaggatttagctggaccaaatggtagttccacaaaagaagaaatgagtaatgtggcttcactagagtggcaacgaatacaacagttgatgcagaacagtatacctatttgcaagggctataaggaaccttgtattgctcgggtggtgaagaaacaaggacctaattttggccgcagattctatgtttgtgcccacgctgaggattttggaggaggtttcaaagcaagaggcagatttgttgcactgaaacacaaaaaagggaaacacaaagctaatggagattgtcaaatgggggtggaagaagatgctaggtggttgagggacctagcaaatggggcaaatgttgttggatttatcattacagaagaggataaggggaagtttccaaagatccaagtcatagttgaggagtttgttaagtag

SEQ ID NO: 65065 - DNA, 408 bp, Glycine max
  Peptide Sequence Number=SeqID_181843
atgcgtgagagaatgaagatagtgagttacaacgtgaacggtctgaggcagcgcatagcgcagttcgggtctctccggaatctgctaaattcattcgacgccgacatcgtttgttttcaggagacggaactgcggaggcaggaagtcacagcggatttggtcatggccggcggatacgaatcgttcttttcctgcacccgcacctcccagaagggtcgaactggctattccggtaacccctctctttcatcatctaaatggaaatgtaaacaaatacacggtattggaatgaaagatagcagcagaagacatattcaaggagaaagaaacaaaggtgcagacacaggacaaaggggtgcagatagcagcaaaggcaaagaggaccatcacaaggccctcttaccttag

SEQ ID NO: 65066 - DNA, 405 bp, Glycine max
  Peptide Sequence Number=SeqID_181844
atgggagaagaaggaaacggaaacaaacgcaatggaaaaagggagacagagagagtagtatcaattcgttcgaaacctaaagtgggagaagtgaagcagcagcgttatgaggaagaagaagaaatgatgaaagggtttggaaaaagtgaaagagagaaagagaaagagagaaggaatagagacaaaatgataagaaagaagagaagagaagagaaaagaagagatgagagggaagggaaggaaggagtagtgaaggaggaaagaataattttccttcacttccttcttttttcttcttcctatgtcattgcaacccacctgctttcacgcgctcttttgtcgcgtctccattacccgcgcgctctgttttatcttacagaatgttttggtcttgcattatactaa

SEQ ID NO: 65067 - DNA, 318 bp, Glycine max
  Peptide Sequence Number=SeqID_181845
atgcctcagctgcaacacaggatcataagttatgaagaacagggatcacaattgtttaatacagataatattcgaaaacatttaaataatgcatggaaattgttttattcgaatttcgatgaaactgatgaagaggaatcgaggatcaataactttcgaattgatgagttgcggaaacggaacaacggaggaattgcgagattctatgcgagaaaggtagcgaaaagaagggaaattgaaaatctgcaaaccctaacgcgatgcaaaatgatgaaagaagaagcaagatcgacgaagctgcatcttctgttcttctaa

SEQ ID NO: 65068 - DNA, 1176 bp, Glycine max
  Peptide Sequence Number=SeqID_181846
atggttgagagattgagtggctctgttggatttcgggatgcgtttctgcggtctgttgattgtgttggtttgttgagtgtggcgttaacgaggagacaagtggtagatgagaaatatacgaggccgcaagggttgtataatcataaagatgtggatcacaagaagctgaggaagctaatactagaatcgaagttagcaccttgctatcccggagatgaagaaaccgcatacgatcgtgaagagtgcccgatttgctttctgtatcgcggtgtgaaatctaaagaagagaagggattggaacagattgaagagcaacgtgttatagaggcaaaaattaggatgcggcagcaggaacttcaggatgaagaggaaagaatgcacaaaagactggaaatgagctcctcgaatgtgaatgtggcagttgcagatgttgaatacagttcaaatgcagtgtcttcatcttcagtttctgttgttgaaaatgatgaaattgtttcttctcaagactcatgtgccacatcagtggttagagcaaatgcaaccactaggaccaatagtgccacatacaaggagaatggcaggcggagaaatttatcttttgtcgatgctacttctggacactatgtagctgacggccgctatgtttcatccgtctcatctgtctcatccgtcatgggtccaccaacgggatcatcctcgtctccatctgggggtctcgcttgtgccattgcagctcttgctgagcgccagcaaatggctggagaatcatctatgagcctcaccaatgaaaatatgccatcattcaacaccctaccgggttccagaagattttataacagacttggtagggatatggctaattatccgcctggtgacaacctcaatgaggagccactggatgaagctgtgacaatgactaggagtcatggtgaatgggacatggaccatgggacacagttgactgaaacagcaaccagctatacaaactctgtcgcagcagaagatcgtggtgaactatcatctttgccacggtctgatgacaatgatggaagccttcaaagtgccacagaacccattgttcccgagagttttgaggagcagatgatgctcgccatggctgtctctttggctgaagctcgagccatgtcaagtggacagagtgcttcttggcagtag

SEQ ID NO: 65069 - DNA, 204 bp, Glycine max
  Peptide Sequence Number=SeqID_181847
atgggaattggtgcagccgcatctcaagacagatgcttcttgtattgcaatgctaggggagcatgtcatgcgttcatctgtaggttcagtagcttgccagtcattgcagaatgcaaatatctcctgatcagcactgtcaatttgttaccctactcagccattcaggcactgcctatctattttatcactttcacttggacataa

SEQ ID NO: 65070 - DNA, 606 bp, Glycine max
  misc_feature (24)..(24): n is a, c, g, or t
  Peptide Sequence Number=SeqID_181848
atggcgatcgcgccccgccagcanacgctgcacgtcgcgttcgtccggccaggcgccgatgccggcctgggccagctgccgccatgggaacagcgggccgggatcctgtttacgctgcggcgcgatgtcgctgtgccccaccacgtcctgcggctggatgccatagcgttggataatgtcgcggctcagcgggatcagcacggcgatctgctccgccgtatagggctgccagtgggtgaacagcatgctgcgggtgaagcccttgttgacgatttcgatgccgatcgaggtgtcattgaggttgctgcggccgcgccaggcgctggcgccggcatgccaggcgcgcatcgcttccggcaccaggcggaacaccgtcggtttaccgtgttcgcgctgcggatgcgccggcagcagataatgcgcgctgacgtgttcgtcgtgcatcaccagaaagcggatgcgttgatccgcgccctgcgcctgatgcagggtttcgagctggtaagcgccgcgatcgacgagcgtgtcctgctgcgggttttggcatcccgccagcagcgcggcggcgatgatccctggccaaattttcacttatcctccctgtga

SEQ ID NO: 65071 - DNA, 753 bp, Glycine max
  Peptide Sequence Number=SeqID_181849
atgactgctctaaatcaatatggaatgcatttggaaattacaccgcataatggatggtcacagcagttctgggatgacctgctaccagcgaaagaacgggtgagtaaacatccgtttttttcggaaatggccaatgggggattgagcctagatagtttccgttatgctttacttaatttctatccattagtcgcgcatttcccgtcatatatggcaggggcgttaggcaaagcaacggggttttctgaacctggcgttacagaagcacgagattggttaatccagaatattaagatagaagagcgacacttaaaatggtatcgcgactgggctggaggttttggcttaactgttgatgagcttgatcatgtacgaccgccagctgcgatgaatgcggtgaatcatttcttatggaatatgagtcatcgtggtaatttagcagagtgccttgctgcaacaaatcttgcaattgagtgggcaactggggattggtcgattcaggtctataagggtattcatacctatactgatcatcctgaagtaacgattgataaacgttctttagcttggttgcgtgcgcatgctcactatgatgatcttcatccttatgaagccatggagctgattaagcgtttatgtaatgatcgtcccgactggcagcaaaaagcttttcatgctgcggaagaagggctgcggtattatgaattagccttagacgattgttataaggtacagcttcaagcctctgcttga

SEQ ID NO: 65072 - DNA, 201 bp, Glycine max
  Peptide Sequence Number=SeqID_181850
atggagttggcgagatccatggacatggggatctcttgtatcaaaagtcttccgaccggagaagtccatacatggaggccaagcagcgtttctagtggttgtggaatatggcgatgcaaggaatcaaacaaggagatttacaccaactcagattctattcaaccaattgagttaatcttcgatgtttacaatcttaactaa

SEQ ID NO: 65073 - DNA, 1485 bp, Glycine max
  Peptide Sequence Number=SeqID_181851
atggccaacaacaacgaagaggaagaggaagcagtggcgccaatggtgaagttgggttcttacggtggtgaggttcggttggtggttggtggggaggaatccgctgcggaggagaccatgctgctttggggtattcagcagcccacactttccaaacccaatgccttcgtctctcaagcttccttgcaactctccctcgactcttgtggccactctctctccattcttcaatccccttcctcattgggaacgcctggagtaactggagcagtgatgtgggacagtggagttgtactgggaaagtttctagagcatgctgttgactcagggatgcttgtccttcagggaaagaagattgttgaattgggttctggttgtggattggttggttgcattgcaacccttttgggtagtgaggtcattgtcactgatctgccagataggctgaggctactgagaaagaatattgagaccaacatgaaacatgtttctctacggggttctgtaacagcaactgagctcacatggggagaagatcctgacccagaactcattgaccccaaacccgattttgtgataggatctgatgtagtgtacagtgagggggcagttgtggatctgctagaaacacttatgcagctctctggacctaatacaacaatatttttggctggagaactccgaaatgatgccattcttgagtacttcttagaagctgcaatggataatttcactattggccgcgtggaacaaacgctctggcaccctgattattgcagcaatcctgcagtggcatggggagctggggaagcattggtgatagaggaagtggaagtgagtcctcctcaaccaatggagattaggattaaggttgtctccacttctctctgtcgcagtgatctctccgcttgggaatctcatgccatatttcctcgaatatttggccatgaagcatcaggcattgttgagagtgtgggacaaggagtgactgaattcaaagagggggaccatgtgctaacagtattcattggagaatgcatatcatgcaggcagtgcacatctggaaaaagcaacacttgtcgttttgggattggaaaggatggtgaatacacagtagtccattctggatgtgcagtgaaactcagtccccttgcacctcttgagaaaatatgtcttctgagctgtggggttgctgcagcatggaatgttgctgacgtgtcaaaaggatcaactgtggtgatttttggtcttggaactgttggcctatctggatggggtttgactgtaacacttggtgtgccaaaggtgaagcttgagatgtcagctcgttatggactactcctaatgggaagaacattgaaaggatctctattttggggatggaaaccaaaatctgatctgccttcattagtaaagaagtacctcaacaagggaggaattgagaatgcaacttcaaatgcttatcagagctattttcttgcttga

SEQ ID NO: 65074 - DNA, 336 bp, Glycine max
  Peptide Sequence Number=SeqID_181852
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatgtacaaatcaagtgaacaagcagcagggactgagcctcagagtagaagaagaagaagcaactcagcgtgggaagaagaagcaaccagcagcttcataaaccctaatttttttggggaagaagaagcaaccttgcatgtgagagagattttatag

SEQ ID NO: 65075 - DNA, 627 bp, Glycine max
  Peptide Sequence Number=SeqID_181853
atgagcaacataagaaccacgaagcaaacagaagaagagcggaagaccgaggtagataaagacaacaacaacaacgacatgaacgacaacctccacaagaacaggaacctgcctagaacatcagaggctaggcaacaaatgcaggcaaaagcacaaggagttgctgatgctgtgagcgaagggcaatcttctgaaaagactgatgtatttggatttggtatactgcttcttgaattgatcactggccaaagggctctagaatttggaaaagcagccaaccaaaaaggagccatgcttgattgggtaaggaaactacatcaagagaagaagcttgagttgcttgttgacaaggatctcaagactaactatgacaggattgagcttgaggaaatagttcaagtggcactcttgtgcacacaatatcttccgggccacaggcccaaaatgtctgatgttgtacgcatgcttgaaggtgatgggcttgcagagaaatgggaagcctcacaaagtgctgacactaccaagtgcaaaccacaagaactctcttcatcagataggtattctgacctcattgatgactcttctttgttagtccaagccatggaactctcaggccctatgatgtga

SEQ ID NO: 65076 - DNA, 546 bp, Glycine max
  Peptide Sequence Number=SeqID_181854
atgggtacctccaagttgaaagcttcctccagaattgtggtgcgattggctgttagggactgcccgcgaacttgtcggggcctggagctaggaacatggaatgcaacactacctcgagacctactagtggcatactatgcactgaatcgtttgacgagggtgtcgaagctgtctgtggacctaggtagaagtccaccataccaggcatctagatgctcgtctggatctgttgtcccatcgtaccgcttgaggttgagttatttccaccccaaagtctgtcctgttggacattgcatgtgggagagacttaagtcatctgcagtgttgactatgcgtcgagggtgtgattctccttggcctttacctttcttagctcctcctcgtggcgtcgctccatctccgcgatgcgtgtttggagttgttgtacattatacgtgtctatcattgataccagatgaggatgggaatcttcgagaggggtctcgcgtgaggccaaaccgaatgctaaccatggatgaacaagagagagttgacaagagctgtgcg

SEQ ID NO: 65077 - DNA, 453 bp, Glycine max
  Peptide Sequence Number=SeqID_181855
atggcgtatgcatctcaaaaaatgaaaatcactttgcataggctggctttgtatcaaggagtctgtccaatatacatggaattctgtgatgattctgaggcaactttcagaagagccttcaatttgctgcaggatggatgtgtttatgctactggtcttaatgattttggacagcttcgtgtatcagaaaggaaaggtggtggagttatacagggaactgcaagtgaagctgtactagttgtcttattagctgcccgtgacaagatcttaaggagggttggaaggaatgcccttcctaagcttgtgatgtatgcatatgatcaaacacactctgctttactaaaagcttggcaggttggtaccacttcatcaacagctgttgatcctctgcttgcattgggaaaaattgccaagacattctacatcggttctaaggagactgatgtagaatga

SEQ ID NO: 65078 - DNA, 774 bp, Glycine max
  Peptide Sequence Number=SeqID_181856
atgacatttgaggttggtgcggtgcttgaggatgcaaattggcaggctccagtgaattgttttgatgagaatgacaaggaaaagaatatccccattttgggatctgctgttcgtggtggttctcttgggagttatgacgtccactttgttttaaaagaacttgtgcggaagtcaatttcagaaactgaggtcagcaatgtttcagcaatgtcccagcaatcttcagcattggaatctggaagctttcattctcctgttgatgaaaagttgattttgaagtttgtggttgaagagatgctgattggtcacgcagatcacatatcggagtcaagatcattgaaggatcagatacttggctactctgggtctgaattaagtgatgatgaagaggaagattgtttggaacagatactatactcagcatcctttgaagagcttgcaagcaattacgttaaatatgacacggtcatatggcttgctatatcattacttctagttttagcttggggaattggccttcttatgttgctttacctgcccatcaggagatatgtgcttcaaaaggatttgtcttctcgcagattatatgttacatgtaccgaagtagtttacaaggcactactacaaagtaggctttctacatcggttaaagaagtctttctacatcggtttacaaccgtcgttgttggaggtgtcgtaaaaaatgaaagattttctacgacggttgtagaagaccgtcttagaatgctgaaacattctacatcggtcgtctaa

SEQ ID NO: 65079 - DNA, 228 bp, Glycine max
  Peptide Sequence Number=SeqID_181857
atggccaaggagagaaaagacagtactgtcaaaatggttaatggattcaggaatcaaatgctgaatgctattaaaggcttctcaagatcacctcaaaatggattgttcataaattcatgttttgctcactgtcaatctgagaggcaggatacatggtttgctgacaattctcctgtcattgggaacaagaatattcaccttgagaaaaattctaggacatttacgtaa

SEQ ID NO: 65080 - DNA, 523 bp, Glycine max
  Peptide Sequence Number=SeqID_181858
atgatgaaacctggaaattgccttgctcctcgcattgtatcactcaagaggggcatgctaataggagaaaatgctataattgaggcagtgattgctattagaaggaaagttagagattttcagttagatgctatgaaagggtttgaaagtgttatatctgactctgaagaacttagccaaccagggacgaaaagtgttgtaacaattgcagggtcaccaaagataggtgcatatgagactgattttgggtggggaaagcccaagaagagtgaaatacttcacatagaaaattcaggatctatttcgctttctgatagtagggatcaggagggtggagtggaagtttggactacctatttccggaagacctttcttccggattacttccggaagactgcttttccgaaaaactttcggaagacacttcttccgaaagaaggtggacttccggaagaactccagaaaacgttttggaagaagtgtttttgggaagttttccggaaaaaaggtcttccggaagaag

SEQ ID NO: 65081 - DNA, 309 bp, Glycine max
  Peptide Sequence Number=SeqID_181859
atggagcatcaaatcttcacacaaccttatcttcaaaacacaaccgtgttacgacaactccaaaaaggggtactcattggcttcggcggtgccgccacaagacgagacgccggacgacgtgacgggggtgcgggcaaacgccacagttacctgcgcgccacctacaaagacgggcacccacggccaacgtcgttgaatgtgtcacgcgccacgcacgtggcacataaaatgctcacttatttacggaattgccaccgctactcctactacgacgtttttggcagaaacgatgtggaacgcgcgtcgtaa

SEQ ID NO: 65082 - DNA, 129 bp, Glycine max
  Peptide Sequence Number=SeqID_181860
atggatatggaattggctggcttttctcatcatgggacacaacatagtaaatatccacatcaaacttgtgttgcaaaaacagacagaaaccacgtttcggtttcaacagacttcacaatggtgatctga

SEQ ID NO: 65083 - DNA, 375 bp, Glycine max
  Peptide Sequence Number=SeqID_181861
atgggggagcagaataagggggtgcaggcgggggcggcggtgtgcatggccaagatggtggagtgtggcggtggcggtggaggaggggaggcggtgtcggtggcaacgtttcagaagctatgtccgaggatctgcaagctgctcaacagtagcgtatccgagccatattggagttgtattgaagtcgtgtctagccttaggaagccgtatctaagtcgtgttccagccgtgctagaagcccaagaaaaaaaaagtacaaaggaatactacgaaaaattgaaacacctattacatccgctactaacagcaattggctcaattgggcaagaggttgctcaaacaccagggatcctttatctatttgacaagcactga

SEQ ID NO: 65084 - DNA, 183 bp, Glycine max
  Peptide Sequence Number=SeqID_181862
atgaggaagcagggtgtagtgcatgtcaagatgggaacgaatggagtaactggagcagtgatgtgggacagtggagttgtactgggaaagtttctagagcacgctgttgactcagggatgcttgtccttcttcagggaaagaagattgttgaattgggttctggttgtggattggtagggtaa

SEQ ID NO: 65085 - DNA, 744 bp, Glycine max
  Peptide Sequence Number=SeqID_181863
atgggagagaggaaggtgttgaacaagtattacccaccggactttgatccctccaagcttcccagagcaagaaggccaaagaaccagcagatcaaggtccgcatgatgcttccgatgagcattcgatgcaacacttgcggcaattacatctacaaaggaaccaagttcaattccagaaaggaagatgttattggcgagacatatctgggaattcaaatattcaggttctactttaaatgcaccaagtgctcagccgaggttaccatgaagactgatccgcagaattcggattatattgttgaatctggtgcgaccagaaattttgaaccttggcgtgcagaagatgaagaaactgataaaatgaaggagaagagggaagctgaagagatgggagatgctatgaaatcgttggaaaatagaaccctggattctaagagggagatggacatccttgctgcattggatgagatgaagtcaatgaagtctaggcatgcaactgtcagtgttgatgaaatgctggaggctctgcagcgcacagcagctgacaagcctctttgcatatgcaagggtaaggctgcgtacaacatcccttccccataccttcgcatagcgaagagcctctgggcaatgggaattcagacggttttgtcagaagaattcgtgatgaagatattgaaacagaggaggaattggttcagttttcaaatggacatggcgaaacatccagttctaatcctaagttaa

SEQ ID NO: 65086 - DNA, 318 bp, Glycine max
  Peptide Sequence Number=SeqID_181864
atggctcttgatggcatggggtggtgtggatctcagcaggggcgaggtggtcggacgacatcgaagtgcaccacagtgctagaggatgacaatggtggtggcacgcaagagaggcatggggtgggggtggtgtggcaaggtgatgcaaggaagaagtttgaggggaaggggagggggtgtagggatttggagagtgggcaaaagggagatttcacaaaacttggtagtttagcaaattggacagtggaaatagtagctccctttgaaaagtttttttttggtgaatcctttgaaaagggtttggatttcctaatttag

SEQ ID NO: 65087 - DNA, 258 bp, Glycine max
  Peptide Sequence Number=SeqID_181865
atggagatagcgatcaacttctcagtaacatcatcgaagaggtcgtggattttgtcaaagaaggaggccgtatgcgacaaaattcactctaagttgtcgagtcaactcgttgagcgagtgattcaatttagagcaccgagtctagagctcaatggtaaagatgggagcctccgcgagaacgcactgtgtggagcctatggacgaggaaggaaagtgcagagggagagcaatgacaaggttttggatccacacgcataa

SEQ ID NO: 65088 - DNA, 132 bp, Glycine max
  Peptide Sequence Number=SeqID_181866
tttgagtgtgatgagtcttctgagacacaggatatcgataatgtttcagaatctgcacctgcagctgattctgcttcaactaacaattctaagcaagctgcgccttatgttacttgtgctgtgggccattaa

SEQ ID NO: 65089 - DNA, 720 bp, Glycine max
  Peptide Sequence Number=SeqID_181867
atgttactaaaacaaaatgcgacgtggcatcatcatctcaagctttattaccacttctcaatagggatatcatcgaagaccccaaagggcttaagctcattttgtggaaggagtagttatatatggaacactcctatagaaagcataataaaagaaccctccaatgttgttgatagcaatggcaaagttcgtcacggttttgtgctgagccgtgaccttgttgagaaactaaagaaatgggtgtcttttaagtgcaagaggtccaatcagaagagaccaataatgctagcactaatcctaataatgatgaaacctggaaattgccttgctcctcgcattgtatcactcaagaggggcatgctaataggagaaaatgctataattgaggcagtgattgctattagaaggaaagttagagattttcagttagatgctatgaaagggtttgaaagtgttatatctgactctgaagaacttagccaaccagggacgaaaagtgttgtaacaattgcagggtcaccaaagataggtgcatatgagactgattttgggtggggaaagcccaagaagagtgaaatacttcacatagaaaattcaggatctatttcgctttctgatagtagggatgaggagggtggagtggaagtttggactagtacttggaagggctcaaatgagcaaattttgtactatcttgggagaatatctcagaaatattga

SEQ ID NO: 65090 - DNA, 768 bp, Glycine max
  Peptide Sequence Number=SeqID_181868
atgagttgctaccatagaaacgaaggattggaggtggtggcgattagggtttgggggttcacaccgactattgtttgcacacggcttgtctcgtgtttgttgggggtgactgggtttgctttgcgtgttcttttgaccgaggatcaaaacaataccagaacaaatctctctctccccacttgtaaaattcggacctatcgccagattatccaatccggtttttctacggcaacacgtccgggttgggtttcggtgcgctcacgtgtacgaccacacctatgtcaatacatccctgcccatgcctatttatcatccacccctccatccttctctttcccttcaccttcctcggacctcctattcttcttccctcacgcaactcacgtcatccacaccaacacatcccaccggcgagctccaaacagagtcacctcctccaagttgcccccaaagacaaaatcgcacttgtgtcacaccccatcgttgagttcgaagcaaccattgaaacgttcccatcaaatcaacatcgccccacaccgaccatcacccaacaagatcggtgtcacgccgcatcgacctcctcgcccccaccatatctatgttgtggtgcatcaagatctaggtcaagccacctacgccatcaagatccgcttagcaccacacaccacttgccctgtcgagattcagcacccgtgcttctcgttttgggattttattaaaggttttgttgttattcaatttatgttgttgtcaatggttttgggatga

SEQ ID NO: 65091 - DNA, 2439 bp, Glycine max
  Peptide Sequence Number=SeqID_181869
atggatttggtaccgagcgtcaaggaaaaattaaactattttcgtataaaagagctcaaagatgtgctcactcagttacacctttcaaagcagggaaagaagcaggatcttgttgatcgcatattatctgttctctcagatgaacaagtttcaaaaatctgggctaagaagaatgctggtggtggaaaagaacaggtagcaaaattagtggatgatacatataggaaaatgcagatatcaggggccactgatctagcttctaagggacagggtgcatcagatagcagtagtgtaaaggttaaaagtgaatttgatgatgcctttcaaccagatgtgaagattcgctgtctatgtggaagtagattggaaacagagaatttggtcaagtgtgatgatgcaagatgccatgtgtggcaacacatcagttgcgttattattccagagaaacctactgaaggcatcccactagttcctgataaattttattgtgaactctgtcgtctcactcgtgcagatccattttgggtttcagtggcgcaccctttgcatcctgtgaagttgaccacaaccagtaatccaactgatggaaacaacccagtgcagagtgtggagagaacatttcaactgactagagctgacaaggacttggtatcaaaaccagaatttgatgttgaggcttggtgtatgctcctgaacgacaaggttccattcaggatgcaatggccacagtatacagacctgcaggtcaatggtgttcctgttcgtgcaactaacagacctggttcacagttgcttggggctaatggtcgggatgacggtccaattatcctaaactcaatcccaaaggagtctgatggtgagaaatttgaagacgcccttgcacgtgtctgccgttgtgttgggggtggaaatgcagttgatgatgctgatagtgacagtgatttggaagtggtttcagatactttcactgtcaaccttcgttgtcctatgagtggttcaagaatgaagattgctggaagatttaaaccctgtattcacatgggttgctttgatcttgaagtgtttgtggaaatgaaccaacgatcaaggaagtggcaatgtcctatatgtctcaaaaactatgcgttggagaatatcatcattgacccttatttcaatcgcatcacttctatgatgatgaattgtggcgaagaaattgcagagattgaggtgaagcctgatggttcttggcgtgttaaggtaaagagtgaaagtgaacgcctggaattagggaatctagcacagtggcgccttcctgatggaaccctctgtgtgtcaactgctggagatgtcaagagagtggatacattgaagcaggttaaacaggaaggtgtttcagactgtccggctggtttaaaacttggcataaggaagaatcgcaatggagtttgggaagtcagtaaacctgagggcacaaacacctcttctggtaataaattgaaaggggcttttggaaatcccgaacaggttgttattccaatgagcagcagtgccactggaagtggtcgggatggtgacgaccctagtgtaaatcagggtggtggtgggcatattgaccattccactacaaatgggattgagatggattctttgtgtctcaataatgttgatttagcatatgaatataatgaacccaacacttctgctcaggtgggtggtgcagaagttattgttcttagtgattctgaagaagacaatgatttgttggtatctcctgcaattgcttataagaacaacagaaatgatgctacagatggttactctgtaccaccacctgtaattgttgattcatatactgaagagcataatcttggtggaaattcatgcttaggactctttcctaatgatgatgaatttgggatgtcttccctgtggtcattgccttctggaagtcaggctggtcctggattccagttatttggttctgatgcggatgtgtctgatgcgttggtccatctgcagcatggtcctatgaattgctcctcgtcactaaatggttatgcattggctcccaatactgctttgggatctggtagtatcttgcaagagtcctctgctggtcggtcagatgctgatttgaatggtggtttggtggacaatcctttggcctttggtggagatgatccctcacttcagatttttctccccacaagaccagcagattcatccatgcacaatgaattgagagatcaagcaagtgtggctaatggtgtctgcactgaggaggattggatatccctcagtcttggaggtgggactggtggtaacaatggtgatgcttccactcaaaatgggttgaattctagacatcaaatcccaaccagagaaggtgccacgaatactttggatgatactggtttgttgctctctgaccttgctgaaatgttccttattttttag

SEQ ID NO: 65092 - DNA, 810 bp, Glycine max
  Peptide Sequence Number=SeqID_181870
atggatgatattgtgaaccaactgcttgcagttcctttaattggttcagaggcattgttcaacatggttatatattatttcactcaggcacggaaattgactagagctgtcaatgtgtttaagcacatgaaaaggagcaactcttatataaaccatgtgtatatggaaacaattaggtgtttgttcaggcaaatggtcaaggatggcattaagcctgatattttttcattgaattctatgatcaaaggatatgtgctatctcttcatgttaatgatgcgttgaggatatttcatcagatgggtgtgatctatgattgcccgcccaacgcactaacatacgattgcttgattcacggtttgtgtgcccaaggcagaacaaataatgctaaagaattgtattctgaaatgaagacgaaaggttttgttcctagtagtaaatcttataattcgcttgtcaattctttggcacttggtggagagattgaggaggcagtaaattatctgtgggagatgactgataagcaaaggtcagctgattttattacatataagactgtactggatgagatatgtagacgaggaacagttcaggagggcacgaggtttttgcaggagttgcaagaaaaggaccttgtagacgggcatgcttataggaagcttctatatgtgcttgaagatgactatgggaattcagtgagcagaattgattcagctgaacatgctgaggctaatgttgacaatcaagtcctggatcagatcaaatgcctcagaatggagtcaaatgaaataggttcaaaccttaatggatga

SEQ ID NO: 65093 - DNA, 1296 bp, Glycine max
  Peptide Sequence Number=SeqID_181871
atgagggaggaactctgccgtcggatccacgacgagaaggtggcgagggagatttccacgattcccgagaaggactgggagcagtggggcgacaacttcgagaaaccgttcagagagggctcgtcctcttcgttggggagtagagaggagggcgttgttagggtttacttcaagggtttggtgagcgaggaaaacgtgagggggcagaatgtcgtgttgtctgggatcggggttgcgatttgtgacctaggcgataatctgatattcgaggtttctaagtcgctcgttgggaatgacactagcaaggtcgctgcagagattaaggctttaattgaggctttcaatgccgccattgctttggacttgaagcgcgtcgtttattgctgcgattattatccccttttccaatttgtgagtggaaaatggcctgcaaaacagcggaagattgctatgttggttgatcaagtggatctgcttcaaaggaagttttcatactgcaatccaaggcttgtggccagacataatgtcaagtttgcatttaagcttgcaagagatgccattgagtctcagtccacgaggcctgcggaatctgggagtaggaggagtttgaatgaaacttgtgtcatatgtttggaggaaactgatgccagtcagattttttcagttgatggctgtcaacaccgctattgcttctcgtgcatgaaacaacatgtggaggtgaagttacttcatggaatggtgccaaagtgccctcacgaggggtgcaagtatgagcttctagtcaacagctgccagaagttcttgactcaaaagttaactgagaccatgcagcaacgaaaattggaagcttcaattcctgttgctgaaaaaatttattgcccttatcctagatgctctgcattaatgtcaaaaactaaggttttagagtactcgagaaatatcatcgatcaatctgaacaatctggagtcaagaaatgcctaaaatgtcatggtcttttctgttttaattgcaaggtcccttggcatagtggtatgacatgtaatacttacaaaaggatgaatcctaatcctcctgcagaagatttgaagctgaagtttcttgcatcaaggagcctatggcgacagtgtctgaagtgtaaccatatgattgaacttgctgaaggttgctatcacatgacttgcagatggattgtggcaaatggtggaagcgcttgtgtgtgtgtattgtcttactcccacttaagcaaaaactctttgattccaatgcctatctctaaggctcaagtttacagataa

SEQ ID NO: 65094 - DNA, 243 bp, Glycine max
  Peptide Sequence Number=SeqID_181872
atgtatgaagctagaaaaaagatgtttaatgaggaagaattcaaacaacatatgactacaacaactggtttgttgcatgtcattgaaagatatgctcacgaagatagtcagttgcaaactaagctaactagtgagaagagaatttatagcgatgatgagtcagatttggatttggaagacaagctcctttggatgaacgaaatacagtcatgtcagccaaacttgcagtgcttcaggctatga

SEQ ID NO: 65095 - DNA, 1218 bp, Glycine max
  Peptide Sequence Number=SeqID_181873
atggagtgggtgaagatgaaggagtacgcgagagagttcatggttggagtggcggagatgacggtggagttcggaaaaggttgcagagacatagtcaaacagagtctggtcaacgacgactcctacatcgtcaaaaacttcggaagagactcctacattggaaaaacagtgagagaacctttcgctaagcttttcgccaaattgagtttcttcaacgagtacttacctgaggacaaggatcctctccacgcttggtccgttattttcttcgtttccatactcgccttcttagctttgtacgcgaattttgaatgtgatccgtacgccgccgcggcgccggtgaagcaagtgttcgtgcatcctcctagtgccactcgcgtagtgcttcctgatggaaggtacatggcgtataaggagcaaggcgtttcttctcacaaagctaggttttcggtgattgctccccacagttttctttcttccaggcttgcagggattcctggagtgaaagattcgttgttggaagagtttggtattcgtttgttgacgtatgatcttcctggttttggtgagagtgatcctcatcccaaccggaatctggaatcctcggcgactgatatggcgtttttagcaaatgctcttgatgtggacaagttttgggtggttggttactcaagtggcagcatgcatgcttgggctgcgcttagatacattcctgataggcttgctggtgcagccatgtttgctcccatggtgaacccatatgatcctataatgacaaaggaagagagacgaagaacttggaacaaatggacacgaaaaagaaaattcatgtacttcttagctcggaggtttcctagacttcttgctttcttctatcggcggagctttttgtcaggaaagcatggtcagattgataggtggctgtcattatctctgggaaatagggataaagcactgatggaagatccaatctatggggaattctggcaaagggatgtggaagaatcaaacagacaaagaaatgtgaaacccttcatggaggaagctgctttgcaggtcgcaaattggggtttcagcctttcagacctcaagttgcagaagagaaaacagagcagtaatttgctcagttggcttaagtcaatgttcactgaaactgaggaatatatgggatttcttggccctatacatatatggcaagtgagtacatctatgttttaa

SEQ ID NO: 65096 - DNA, 609 bp, Glycine max
  Peptide Sequence Number=SeqID_181874
atgaaagatgaaaatctaacattatttatgtttgactacagattcaatactgcccagaaattggataaacttgggatgcgaggaagtgatacgtgtgagcttgtctttgagaattgctttgttccagacgaaaatgttcttgggaaagaagggaaaggagtctatgtcatgatgtctgggctggatctggagagacttgttttggcagctggtcctcttggtattatgcaggcatgtcttgatgttgtccttccttatgttcgacaacgagagcagtttggtcgtcctattggggagtttcagtttatacaggggaaaattgctgacatgtatacttcattacagtcctcaaggtcttatgtgtattcagtagctcgggactgcgacaacggaaaaattgacccaaaggattgtgctggagctatactttgtgcagctgaaagagcaacccaggttgctttgcaggctatacaatgtttaggtgggaatggttatgtaaatgaatatcccactggtcgtctcttgagagatgccaaactctacgagattggtgcaggaactagtgagatcagaagaatgattattggacgtgagctcttcaaggagtaa

SEQ ID NO: 65097 - DNA, 1869 bp, Glycine max
  Peptide Sequence Number=SeqID_181875
atggtttctcacccgaaatcgaagttcagtgtctatcaaaacccttccttttcggcggttctcacttccaacagtcttcaaccttccaagttcaccatcctctccttcttctctgcctccgcattcgcttttctcgctgtcttcttcagggaaaacggcttcgtccacattttgagcttcgcagctttttcccctgtcacagcttattggcttgccaagacgctacaagctatagtgggttttatcttcattgtttctgcactcttcaaagttgtgtttctgcgtagagttaggtatgctggtggaggtgttgttgcggctaagtctctgtctgatgctaacagcgttcataggaatgagattttgctaacaaaacatcaattagggcttttaggagtgaagccaaaggttgatttggctcaacctgattcagcaaagaagccccccaagtctaaacttcaactgccttcttcagatttgcttgttccccttcaccggccaattcccagtcccactcagggttcttcgtctagcattgatgccgatggttcaaattctaataggggtggtgctgctcgttctattggttcggtttcgcctccaaggggttcggctggagtggattcagcagtttcgagtccttggtctaacaggcaagcctcctctgttactaagataacggctgaagaaaagctggagaaattcatagctgaagtggatgaaaggatcaatgagtctgctgggaagatgtctaccccgcctcctattgtttctggttttggcatagtgagccctattacagttacaggctcaaccaatacctctggaactgctaggcgtacgtcattgaggcttgtgaggatgtctccgggctcgcaaaagtttaacactccccctaagaagggtgagggcaagtttcctgcaccaatgtccatggaagaatctgttcaagcttttgaacatcttggcatctatcctcaaattgaacagtggcatgatcaactctggcaatggttttctttgcttctgctcaatcctttgcttaacaagattgagacaagtcacattaaggtttcttttattcttcatttcttctcttatgttcaaagcaaggttatgcaagcagctgctaaacttggtatttcaatcacgattagtcaagtgggcagtgatatgctgtctactggcaccccttctgctttgccaacaattaataagaatcaagagtggcaacctgcaatgtctctcaatgaagatggattacttcatcagttacattctactcttgtgcaggccatagattcttccaaatcagtctccacagcagattctctagttcctgttatgcaggattgtgtggatgctatcactgaacaccaaaggcttcaaccattggttaaaggagagtggttaaagcttgcagaacgaacatgcttgaagaattatgagtacctgggaagtggtgaggtttatgataaaaagaataaaaagtggacacttgagttaccttctgatccttacttgctgttgtatctgttctgtgctttcctagaacatccaaaatggatgttacatgaggatgccatgtcatatgctggagctcaatctggcaaaaaccggctattcttgggagtccttcccccaaaggaaaggtttccagtgaaatacattgctgtagtgtctactgtcccttctgtgctgcacccaggagcatgtatactagcagttggaaagcagggtcccccaatttttgccttgtactgggataagaagtcgcagttttctcttcagaggcctttacaattcccggctcaaccattttactgtacctgggaatattgcactttgtcagaaatgaaatttggatag

SEQ ID NO: 65098 - DNA, 2721 bp, Glycine max
  Peptide Sequence Number=SeqID_181876
atgactctattggtggttcgtcacctcctcatcctctttctctgcaaggtatcttcttctccggctacgttctcacactccatctttgagaagcttacgacttccaattatcttttatggcatagtgtcaccggagtatctcagctaggagaagcaagatcagcttcttctttcctggttacaatcgacgatctctggatctgttcttcctcttcttgtaggatgcactacttcatggcatctctaggagaaacttcactcacatttccatttgattgctcgcacaaggaagcatcaatttcaacggagcttcgaaacctctctctcgacaatcgcaaaatcactgactatctccttcatgttcaaacgctggttgatgcgcttacttccattggtgattctgttttgcaaagcgagaaagttgatgtcattcttggaggattccgacagaaatcacttcttgctcatgaatcacgacttgacaaactcagcaagaagtctctaggtgctggaaatccaattccggcagaggtggtggcctatcgtggcagccatgatggaggtcgcagccgtggtgggggtcatggcaaatttgcagatgttcggtgtcaagtttgccataaattaggtcatgaagcatctttttgctatcatagtacctatccaccaccaccaccaccttttaatccctataatccttatccctttttcccttatccacctcaatacatgccacctcaatatcagtctcagcccatgaaccctacttcatcatcaccatctccacaggcccatgttgctagtgttcaaccagtgcagtctgcaaactggtatcctgattctggttcttctaaccatgtttctaaagaagttctccttcatggactggtgggtcatgatgggctataccattttcctgacttgcttcagtcttcaagacaatcttcttcatcaagtcctgcaccctttacttctcattctggttttaaatactatgtcacatttgtagatgctcattctagatttacctggatgtatctgttgaaaaacaatgttattcgtagactaatccttccacatactcatcaccaaaatggagttgtggaaagaaagcacagacatatagttgaaatggctctaactatgctttctcaagctagtttacctctagaatattgggataatgttgttgtttcaagtgtttacttgatcaataggcttccttcatctgccattcagaatgaagttccttatcaaaatctttttgacaagctgccagactacaagtgtctctcatctgatggcagaatctatatttctaaagatgttatattcaaggaggctaagtttccttatcctcaactctttgctgagccagttacttcttcaacacaagcatcaaacagcactttatctgttctgccttctgttttgaatcctgtagctcctgctatgtctcagtctacaggaaataattccacacatgaagtttcatctacttcagggactaattccacaaatgaagtttcatcttcttcaattagtcctgaaccagcagcaactagttatctatcagcatctactgatcacttaccatctcctcaaccagaggtatcttctaatcctgtgatatctgccccagtacctcctacttcagtgcactcccctgcagaatctcctcctttgctggtcagagctgataatactcatccaatgtgtacaagggcaaaagccggaattataaaaccaaggctgcaaccaactttgcttctcactcatgctgaacctaagtccaccaagtctcctattggttgcaaatgggtctttagggtcaaggaaaaccctgatggtacagtcagcaaatataaagctaggcttattgccaaaggctttcatcaaagactaggttatgattacaatgagaccttctcacctgtaatcaaaccaattacagtcagaattcttttgactcttgctgttactaacaaatggaaacttcagcaactagatgccaacaatgcttttctaaatggcattcttgaagaggaagtctacaagactcaacctcctggatttgaggactccaacaaacatctaagtttcaaatccagcaagtgtgatccttctttattagtgtattcagacactagtactgtggtttatatgctggtctatgtagatgatattattgtcacaggcaataatcacacctttattaaatctctggtttctaaactccactctgagttttctctcaaagatttgggtgatcttgactattttctgggaattgaagtcagctctcaacctaatggatctcttctactcactcagtccaaatacattacagatttattggcaaagactactatggatgaggctaattctatctcttctcctatggttggtggctgcaaactaactcaaacagggtatgaatatttttcagacccctctctttatagatcagttctgggtgctcttcagtatgctacaatagcaaggccagaaatcagtttttctgtcaacaaaggttgccagtttatgagtaaacctactgaccagcattggatagctgtgaagaggatacttaggtatctcaaagggactatcaattttggactagtatgcagcctaatttctctttctctcactattctgttcatgcctattgtgatgctgactgggcatcagatcctgatgatagaaggtccaccttag

SEQ ID NO: 65099 - DNA, 129 bp, Glycine max
  Peptide Sequence Number=SeqID_181877
atggatgaagtctctgcgagggagaaaggcacaacttcatggttaaatatctcgcatgaagagggtgaaagaagcatcgttgtggttgcggctctccgaggatttttgtcctctctcaaatctgactaa

SEQ ID NO: 65100 - DNA, 384 bp, Glycine max
  Peptide Sequence Number=SeqID_181878
atgacaagcagagaccaagtttggtcattctgcacccttgtatcatccagaggcggcgggcccgatgatacgcggaaatacccgagtgaggctgacatagtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgaggagcgacaagtcatggtcacccgcgactctcgtcaaccgagaggaacgaaattagtgtcatacactgattttcggggacctttgcttgatgacaagcgaccattctttggtccttgtgag

SEQ ID NO: 65101 - DNA, 259 bp, Glycine max
  Peptide Sequence Number=SeqID_181879
gtactttgactacctcttctatattgatattgaagcttctatggcagaacctcgtgcacaatatgctttaggacagttgcagaagttcagtgtcttaactaggagcaacagtcatgctgttcattttgctgataacataagtagctactaccccagaggttcatcttcaatcagagaggtgggcaagaagtatcctttaaaagcattgcccctgtcacctctttcaaaaatcttttcatctcctaaggaggtgctttga

SEQ ID NO: 65102 - DNA, 1305 bp, Glycine max
  Peptide Sequence Number=SeqID_181880
atgagggggggcttgtggcaacttgggcaatcgatcactcgccgtcttgcccatggagataagaaggctgttgctcgtcgatgttttgcctcagaagctgagctgaaaaagacagtgtttcatgacttccatgttgctcatggtgggaagatggttccatttgctgggtggagcatgccaatccaatacaaggactcaatcatggactctaccatcaactgtagggagaatggtagcctctttgatgtttcccatatgtgtgggctgagcctcaaagggaaggacgctgccccattccttgaaaagctggtcattgccgatgttgctgggcttgcccctggaactgggacgttgactgttttcacaaatgaaaagggaggtgcaattgatgattcagtaattactaaggtgacggatgaccacatatatttggttgtgaatgctggctgcagggataaagatctggctcatattgaggaacacatgaaagcattcaaggccaaaggtggtgatgtgtcttggcacatccacgatgagagatccctacttgctctgcagggtcctcttgctgcccccgttcttcaacacctgacaaaagaggatttgagcaagctctactttggggagttccgtgtgttggacatcaatggctcagagtgttttcttaccaggacaggctcagagtttctcagggacaccatgcctaatctcattgattgtaccaagcataataaccttttcttgattgggactttcaggtatactggggaagatggatttgagatctcagttccttcagagcatggagtagatcttgccaaagcaatactggaaaaatctgaagggaaggtaagattgacaggattgggagctagagatagtctgcgacttgaagctggattgtgcttatatggaaatgacatggaacagcacattacacctattgaggcaggactaacatgggctatagggaagaggaggagagcagaaggtggttttctaggagctgatgttatcctgaaacagcttgaagaaggtcctaaaatcaggcgtgttggtttcttttcttctggtccacctcccagaagccacagtgagattcaagatgaaggaggcaacaacattggggaaatcaccagtggtggattcagtccttgcctccagaagaacatagccatgggatatgtgaaatctggattgcacaaggcagccaccaaagtaaagattattattcggggaaaacccaatgaaggagtcgttacaaaaatgccatttgtaccaacaaaatactataagccttcctga

SEQ ID NO: 65103 - DNA, 1200 bp, Glycine max
  Peptide Sequence Number=SeqID_181881
atgtcttgttgggcatgcaaaaaatgcacctttgtgaatctcccttctcaaaaaggggaatgcgaaatctgcttttcccccgcgtccccattgtcaatgggtccttcttgttcttcgtcgcccccaaaatggtcgtgcaaggcctgcactttcttaaacccttacaacaacccttcttgcgaggtctgcgccactcgatgctccgttctctccctttccaatctcaccgacttgaatgacgccaccgatcacgattcttctgtcggttctgttttctttcctcttcgaacctgcaacaagagaaaggccattgatgatgacgattcttctgaggtcatcaatttcaaggtcaagccatccaatatcaccggtgatgagaatatcgacacaggaaaagcgtttaagatattgagttacaatgtttggttccgggaagacttggagttgcacaagaggatgaaggctattggcgaccttgttcagttgcattcacctgactttatctgtttccagttaagcaaactgcctgtgaaatcattcagcaataagcccttcagcaattctataatgggaagagaactttgcattgctgaggttgaagctgcaagtggcaagccattggttattgccactagccatcttgagagtccctgtccagctcctccaaaatgggatcagatgtacagcaaggaaagagtagtgcaggccaatgaggctataaaccttctcaagaaacagccaagtgttgtttttgggggagacatgaactggaatgaccaacaggatggtcaatatcctctacaagatggatgggttgatgcctggtctcagctaagaccaaatgaaagtggttggacttatgacaccaagtcaaaccagatgttgacaggcaaccgtactctccaaaagcgattagatcgctttatttgccaattcactgattttaagataaccagtgttgacatgattgggatggaagcaatacctggtgtttcatacaacaaagaaaagaaagtaagaaaggagataaaacaactggtactcccagttttgcctagtgatcattatggcctgcttttgacaatttctaacaacaaaaggatacttggcaggaatgtgaaagtcgggccaatctggggagaatgtagccatacagatgaccaacaagccccgcaaccctcgagtttcaagtcacagtaa

SEQ ID NO: 65104 - DNA, 876 bp, Glycine max
  Peptide Sequence Number=SeqID_181882
atggatggcgggagcagaaaagaaaaacgcaagaatgatagtttggatacagtacacgaaacagcagttctaaagtgccatttacaccaggattcagcttcttctcaacaaccatattcatatccatgcaagatcaataataatgttcatttggtgaattgtaatcctaaaccttttggcactccttgtactaatatatcgtttcatagttcctccttctctgggaaatgtgataagctacaaaagagccttcatctattccatcatgttgccacacataaatggctgtgtggattacaggattccatttcatctgatgatgagtatcgttcttcacgcaacatagccatcagcttgttcaggcgatacaggaacttcattgatcgtggtggaggggacaatctaaaagagttcatcactgccggggtaaatgcatatgcgctaggatgcactgatgaaggattaaggaaagaacttgtggatatgaagaattctgggatcgaaattgatgtaatgcaaagttatggtggaagcacaagcttaaaatctaagatcatctcagaggaggttgatgaatgcattctctggctaagcattatattcatcaccatcttgtgtacaccccaaccaactattgttagatggtcatctacaactccagtctcagatgaagttagacttcagtggaaaggcttttgtgctcttatagcaaatgcatattttatgaagggaatggcttggcttcctgtaaagactcttcaattagaacagacggctgtgatgggtcaggctgagaaaccgtcagttgttgctagccgaatgcgtttagtctttagcacacttgaggtagtgagtccacagtggccaagagcatag

SEQ ID NO: 65105 - DNA, 1950 bp, Glycine max
  Peptide Sequence Number=SeqID_181883
atggcggacgtggtgcagtaccggttggagcgcatggtggatgagctcgacgacctcgagcagcgtggtctcttcagccggcgcgagattgcggagatcgtaaagcagcgccgaaagttcgagtaccggctgaagcgtccgagtcctctgaagcaagacttcttggcctacgtggagtacgagactcagctcgacgccctccgcaggcttcgcaagaagtccgtggcgcgcgaattgatgaagcaaggcaacaagaagctcaagaagtccaagtccgatttcgctggattgctcaggattatggacatttacgagctagctttgaagcgctacaaaggcgatatcgatctctggttttgctacctcgagttttgcaggctcagaaagaatggcaggatgaagaaggccttggcgaatgttattaggtttcatccaaaggttccgggagtttggatttatgctgcggcttgggaatttgatcataacttgaatgttgcggctgctcgtgctttgatgcaggaaggtctcagagtttgtccaacttccgaagacctttgggtcgagtatcttcggatggaacttacttaccttaataagttgaaggcacgcaaggttgctttaggtgaggatcaaggaactctcacccgtgatcctaggagttctgatgaaaaacattggagggatgaaaacagtgagttgtttatgcctcttggcaaaagaggggatgatgatggtggagcaaatgttggaagtgatgaatcagaaaagaagcaggaactgtttgaagaacatggtatgaatatttttcaaactgtctatagtggagcagttgaagctgtcccctcaagtctcagtcttaggaagcggttatttgaaatattggagggtacaaacttgtcacattatgaagatatgtgcaaggagatattgaatgacatgaagagggatttttctacacaaccggaattttgggactggctcgcaaggcatgaatgtgatctggagataagtgaggagggcataattcctcaggtggaaaaggcagttcaggtttatgaggaggctttgaaaaatgtgccatcaggaactatgtttagtttgtatgcaaattttctaacagatattatagctcctaaggaaggagaaactgatataaatgggtcatcaggttgtgctgtaaactatatatcacatctcctgtcaatatacgaaagggctgaaagcatggggtgcattactgaagatcttgcatgcaagcatgtgtccttacatttgcaattgagacagctggatgaggcccaaaaactggcagcaaagctttgcagtggaaagcttgcagaatcggtagagttatggggattaaggattaccatagaaattagatgcatcacaggaagttcttcttcaccaagtgatgctgatttgcaatccctttttgagctccttcaacaaattttgatgaaagtgtctgtttcaagatcagagaacttgtggctaaaggctcttaaattctatgcaaatcaaagacgatattttgataaattggtggagatttctgttgttaccttggtcagagatggtggtagtgaaaatggattttccctttcttctgctattgtaagttttatacttcaaaaggatggaattcagaagaccagagatatctataaacgatttctagctttaccgcttcctggtcttgctttatatagacgttgcattgacctggaaacaaaccttgcatcaataggagataaagatggtcttataaatgccaggaaattatatgaatcttcacttgcaacatatgaccaaaatgtcagcttgtggcaagattactatcgcctagagatcaagatgggaacatcagaaaaggctactgctatctattggcgtgcaaggaaagtactcaaagatgctagtgaatttgtcactgccccagatatgtga

SEQ ID NO: 65106 - DNA, 1677 bp, Glycine max
  Peptide Sequence Number=SeqID_181884
ttggcacatgtcatctcctctactcgagctgaagcagggatgaggaagttaagtctaggctccttttcaatggcaaactctaatctcgtcatcatcctctacttctccttcttcaccttcgctgaagcagaagcactacattcccagcttaagcagcaaatccaagaccaagagaagcttccattcgtgggcgtcaacatcggcaccgacgtctccaaccttccatctgcctcggaccttgtcgcgttccttcaactgcagaagataacacacgttcgcatctacgatgcaaactcagacatcctgaaaactttgtcggggaccaagattcgcgtcatcatcagcgtccccaacaaccagctcctggcgattggttcctccaactccaccgcggcctcctggatcgatcgtaatgtcgtcgcttactacccccaaaccctcatcagcggaatctccgtcggcgacgaggttctgaccaccgtcccctcctccgccccgctgattctccccgccgtcgagtccctctacaacgccctcgtcgcctccaacctccaccaacatatcaaggtctcaacccctcacgccgcttccatcattcttgaccctttccctccctctcaggcttacttcaaccaatccctcgtttccgttattctccctctccttcagttcctttctcgaaccggttcccctctcacgatgaacctttacccctactacgtcttcatgcagaataaaggcgtggttcctctcgacaatgctctcttcaaacccctcactcctaataaggaaatggtcgaccccaacaccttgcttcactacaccaacgtcctcgacgctatggtcgacgccgcttatttctccatgaagaaccttaatatcaccgatgttgctgttcttgtcactgagacaggttggcctgccaagggtgattctaaggagccttatgctaccaaggacaatgctgatacttacaattccaatttgattaggcatgtttttgatcgcaccggaacccctctgcaccctgaaactacttccagtgtgtttatttatgaactgtttaatgaggacttgagggctccgccggtttcagaggccaattggggtttgttttatgggaacacttcgccggcttatttgcttcatgtgtctgggattgggacttttttggcgaatgataccactaatcagacatactgcattgccatggatgggtttgattctaagacgttgcaggccgcgctggattgggcgtgtggaccggggcgagccaattgttccgagattcagcctggagagacttgtttccagcctaataatgtgaagaaccatgcttcttatgcgtttgatagctattaccagaaagaaggcaaggctcaggggacttgtgacttcaaaggactggctatgatcaccaccactgatcccatcttgcttgctagctcaagcaagtactttttagagattgtatcagtgcaatatgggctccacggttgcgttttttctctctcttttggtctgttccaggtcacgggagctgtatatttcctggaagcctaccttagtttaattgattccacattcgatgtaatgcagcaagaaagtgagcaacaagacaaaggaagtggtcaactctactatctcaagcagtgcaggagagaagttgaggtttaa

SEQ ID NO: 65107 - DNA, 1163 bp, Glycine max
  Peptide Sequence Number=SeqID_181885
atgggttcaaacatttatgtatttggggggcttgataatgatattatcttttcttcctttcgtgtttttgacacaaacaatttacactggaaagaaataccagtttctggggactggccatgtgcacgccactcacatgctatggtggcatctggttgtcagattttcatgtttggtggatacaatggtgggaaagcacttgggaatttgtatagctttgatgttcagaaaggtcaatggatgaaggaaaggacagatggatggaatccacatgcaaggttctcccactcaatttttgtctataagaattatcttggagttcttggtggttgtcctgttagacaacattgccaagagctggctttacttgatttgaagcttcatttatggaagcatgttaccctcaattcagtaggtaaagattcgtttgtgtgcagtacagccaatgtcatgggtgatgatgttgttgtagttggtagtggtgcatcatgctatgcatttggaaccaagaatcatcatatgggagatgcatttgatgggaaaaatgaaggccccttttcaaaaccaattaaacgagacgaattcttattaaatgagctatcctgttctgaagtattgatacttctccatgaatatggtgccattgtgctgggagacaaggttgttgaagaaagaaaagcagccaaatctcctctgaaagtgatgactgaagcaataacgtctttgattgagcataagggcctaccagtacagcttctagaggaactgccaagaagatgggatctgcttggagatattgttttacttccaagtacttcttttaaagattccatgtgggactccattgcagaagagctttggtccattgttgccaaatcactcaaggctcaccgtctagctcgccaaggcccagttgctgcaactggtacaagagatagcacattgcagattcttgttggaaataatggctggttcaatcatcaagaaaatggaatactctattcttttgatgctacaaaatgcatgttctcatggggtaatctttctgagaagctccggatggccaggctagattgtaaaaatgagagcgtggctgatagagtctgtcttggtctcattccatctagtgagcttagctgggtcacagctgtaagggctttaag

SEQ ID NO: 65108 - DNA, 1161 bp, Glycine max
  Peptide Sequence Number=SeqID_181886
atgtcggcatcatcattgatagagtctccagttcttcaactccatgagatctcagctgtcaagttcggcaactttaagctcaaatctggcatctcctcgccaatctacatagacctccgcctcattatatcttacccttctctcctccagcaaatctctcaaacccttatttcctcagtctcttccacttcctttgacctcgtatccggtgttcctttcactgccttagccattgccacatgcgtctctcttgctcagaccattcccatggatttggttaccagtggcacatcagttttggaaacagcagcaccactgcctgcctcgggattgaagataagtgatgctgagaatcagaaggttgctgctttggcaaaggtggggaagcctgcaactaaggtcaaggctttgtcatttggggagagggctaagctgtcaaaaaatccaatcggaaagaggttgtttgagataatggctgaaaaggagagtaatctgtgtttggctgctgatgttggaactgcagctgaattgcttgaaattgctgggaaggttggacctgagatatgcttgctgaagactcatgtggatatttttccggattttacacctgattttggctctatgcttctctcggatagctcaagaaaccttttggttcctgatattattgacattagcacactagaagcaatcctttacatatctggtctagttgtatctaatatatgctttattttattgaagattgcagaaaaacataacttcttaatcttcgaggatcgtaaatttgctgatattggtaacacagtgaccatgcaatatgaagggggtctattactgcttgctgaaatgagttcagctggtaaccttgccaaaggagattataccactgctgcattaaaaattgctgagaatcattctgactttgtaattggcttcatctcagtcaatcctgcatcatggccaggggcacctataaatccttctttcattcaggcaacccctggagttcaaatggtaactggtggcgatgctttagggcagcagggcagtgacatcatcattgtggggcgtggcatcatcaaagcagtaaatccagaagaggcagctcgtgaataccgtcttcaaggatggaatgcgtatttggctaaatgtacttga

SEQ ID NO: 65109 - DNA, 243 bp, Glycine max
  Peptide Sequence Number=SeqID_181887
atgggtggtagggacttcattagaggcggatcaagttgcaagtggcaattggcaaagataaatctttctttacttttactttgcttctatttaaagcaacaacccctttccccatggcatcagcacccttgcaccaccaccgcaacccctttaaccccatggcggcagcgacaaccccgtcaaaatgcaatggagcaatattaccatcctttattatggaacggatattccaaaagtgtatag

SEQ ID NO: 65110 - DNA, 657 bp, Glycine max
  Peptide Sequence Number=SeqID_181888
atggcagattggggtggttttctggaccaaaacagtggttttggtggggggtcaatgaggaacgaagattttgatgaagaaaatgtgtggggtttgaccatggagagggagagagactttttaagtccaaaaatgagggtatctaaggagtcctatggttcttcctctgcatggctcgtatcaacctctccaagaaagattacaaggactaatagtgtcacactacactccttggaatctgattctgattcaaatgtggttcaaaggtcctcagcacctacgagcattcctggttggtctaaaatatatgggaaaaagggtgttgaggagggtgtaaacaacaagaagcctgattgtggttttggagatcattatggtgatgatgacgatgaggatgaggatgatatgattcctcctcatgaatggattgctaggaaacttgcaaggagccagatttcatctttctctgtgtgtgaagggatcgggaggacactgaaagggagagatcttagtaaaggaaatggaaaaggaggagtggcaacctctgaagctttgtctggatttgtattagacttaggcgaatggagtgcaccctctgttgttactgagtttaatagtcttcaagttttcacttctggctggttgatcattccttaa

SEQ ID NO: 65111 - DNA, 444 bp, Glycine max
  Peptide Sequence Number=SeqID_181889
atgtcagaaagaagacaggctgagtctgctcgcattagagacaagtatcctgatagaatacctgtgattgttgagaaagcggaaagaagtgacatcccagacatcgataagaagaagttagtgattttatctaattccacttacactgttgtattcaagtatagttttgctgtcaaatgggctgcttctttctttgttcccaaggcatatactttatatgcacgtgtgaagtaccttgtcccagcggatttgactgttggtcagtttgtttatgttgtccgtaaaaggattaaggtcagtgcggagaaggctatttttgtttttatctacaacactctacctccaactgccgctttgatgtcttctatttatgaggaaaataaggacgatgatgggtttctttacatgacatacagtggagagaacactttcggctcccactag

SEQ ID NO: 65112 - DNA, 705 bp, Glycine max
  Peptide Sequence Number=SeqID_181890
atgaagagcaagggaggtgtagaactgagtggaaggaatgtcttacataggaaatgggctcttctgctttgtgtggcaagcttctgtgctggaatgttcttcaccaatagttctacatctggtggcattcttgacaaagctattgaagcagaggagaggcttcatgctgactttttgaggctgaaccacattgagggatacctagaactatcagctaagacaaagatctacttttcaactgctgttgccttgtgggatgctgaattttatgtcaaagttgatgatgatgttcatgtgaatttagcaacacttggattgactctgtctatgcatcgtaagaaacctcgggtgtatattgggtgcatgaaatctggtcctgtccttgctcaaaagggagtgagataccatgaacccgaatactggaagtttggagaggtgggaaacaagggtatgctgcataaatatgctaatgaagatgtctcattgggatcttggtttattggtttagatgtggatcatgttgatgataggagaatgtgttgtggcacaccccctgattgcgagtggaaagcacaggccggtaacatctgcgttgcttcgtttgattggaaatgcagtgggatctgcagatctgttgagaggatgaaagaagttcaccagcgttgtggggaggatgaaaacgcattgtggagtggaaccttctaa

SEQ ID NO: 65113 - DNA, 2328 bp, Glycine max
  Peptide Sequence Number=SeqID_181891
atgccttctaacaaacaatcttcaatgccgtcaaaccctaatccaagaagttccgaagtcggtaaccctatgagaaggagtttcactggaaaccccttctccaaaccctcaattgtcccaaaccatggagtaaaaactcccgccaacagctcttctgcagatttttcgagaagaggctctgttgggattcgggaaagcggagggtcgttgagggactcctttgatgacaaagaaaacgggaaagatcagattttgaaaccgacaaaggttcgatcaccagctgtttcttcaaagggctcaaagaatttcatgtctccgaccatttctgcttcctgcaagatcaatgagtctcccagaaagaaagtcctgattgagaagaatgaggcagttccgagtcccgcagacaagaaaagccacgttcgcaaggtaacttttgccgagcccttggaggagaaaatgattgatgggatcatccccaattttgaggaaggtctcagatcttccctgagtagtgaagatttgagtggtgagagtgaaactagtgaaactcattatatggatgttcccttgatttcaaagaatgatacagatttgtgctttgaatctgtcaatgatgtgaatgtgaatgttcctttggttctagaaaatgacatttacactgaaccatcatttgaaactgagcctgattgtgttaaccttgaccctacttttaagcttagccccactgccactcctccgatttcattgaaagctaccgtcgtggctcctctggatgcggatcccttgatgcccccttatgaccctaaaaccaactacctctcccctagaccacagtttcttcactacaaaccgaaatctcgaatggaactctgcagggaaagggaattggatgacagcttcatatctggaagcttttcagatacagaagtcactgaggattcccagtctgaagtctcacagaaggaatcggaggatgtttcttcagatgaaactgttaaggaagaagagggtgaaatttctgaactaagtcctgctaggaggactctcatgccaggggaatctgttgaagcaaaacaagttccaaaaccacgcttcacagtgagagcaaaggctgttgctcttatcttgcttcttgcagttgcttttgtatcaatctcagtcacagattcacctgtgattgatcgaactgtgtttgaaggtttctacaaggtttatgtatcatctgaatttcctgagtttgcaagggctaattttgatctattcacccagtttgcaaaaacaaatttcaatgagatagctcgaaatttgcaaatttggtttaccaagttgctgtcttcaacttcagagttcatttcagatgttagaggaggacacaatttggccaagttgcaatattataacttgactattcagcacgattactccatggtggatcagtaccctatatttggtcatggagaaaatgaaataggtgagactcacgtaccagtatgggacgctgatgagagtgatgctgcctcagatattgacggtgatgaggatattgagggggatatttcggaggagcattatgaaatatatgaagagcaagttcagcaagatgttgcaacaattactggagctgaaaatgttttggatgctccagaatccgaggaagtacaatcagagcaactggctgaagcaggaaacttagaagcaacggttgcacaagaagctgaggctaacttaaatgttgaaaatcagccaagtttgaatttggaggttgctgaaatctctattgaagcgtatgaatcagatacaaagcaggcacacgaaaatgatgctgaactcaatgtcaacgaacaaagtgacataagtttagattcagatgttgctgcagcgaaagatgatgtagcagaggaaaaatcagaaagcatagatgctgcgattaaagggaatgaagggcgattaggagcaattgacattcctccacatgtggtgctatgtttgctgctcggtgcagagaaatcatctgggcccgtagaaatggacgtgcttgaagattcatcatgcccttcagaagcgagcagcattcagcaaagctcattctactgtgaaaaagaagtgaatgaaggtcacagactaggccctgagaagaagcgcaagaataactacaggagagaatctttggcttcttctgcatcagactattccatgggttccccatcctatggaagcttaactttgtatgagaaaattccaatcaagcagggacattgggaggacgagatcatcactcctgttaggcgttcaagtagaattagaaaccaagccacttctccttcataa

SEQ ID NO: 65114 - DNA, 1689 bp, Glycine max
  Peptide Sequence Number=SeqID_181892
atggccaagtccaccgctcctccggataattatggtcacagtccagttcactacgccgtcgcattgggcgaccacaccaccctctccagaatcatatcctcactccctcgtctccccgatccctctcttattcaaacagaatccgattccctcgctcaagaaaaaatcgccgatcagatctccctcgtcctcgaccgccgcgacgttccttatggagaaacccctctccacctcgccgtccgactcaacgaccttttttccgcccgcgccctcgccaccgccggcgccgacgtctccctccagaactccgccggctggaacgctttgcaggaggcgctatgccgccgcgcctccgacatcgcgctcgtcctcctccgccttcaccatcgcaacgcctggtccaagtggcgccgtcgcctcccgcgggtcatcgccgcgctacgccgcatgcgtgacttctacatggagatctccttccacttcgagagctccctcattcccttcgtcggaaagatcgctccctccgacacctacaaaatctggaagcgagacggcaacctccgcgctgacacctctctcgccggcttcgacggcctcaagatccagcgcgccgaccagagcttcctcttccttggagacggcgatcacacgcacgacgtcccctccggttcgctcctcgtcctcaaccgcgacgaccgcaaaatcttcgacgccttcgagaacgccggaggaccgatgaacgagtccgacctcgccggattctgctcgcagactagcgtgtaccgtcctggcatggacgtgacgaaggcagagcttgtaggcagaatgaattggcgaaggcaagagaaaacagagagcgtgggagagtggaaggcgaaggtgtacgaaatgcacaacgtggttttcagtttccggtcacggaaagtggccggcagcgagtctgacgtggcagggagcgagcaggtgctgccgttggaactggacgaagacgacgacggttttctcgttgcggagaatccgaatttcgggttcccaatgccagacaagagaagacacagtagcttcgttcgagaagagacagagtgggtcccaatgggaaggaaaagcctcgacctaacgtccgtaacggccccacagccgcgaagcgtgaccatgcctactcagaccaaggaaaaggagtacgttagaagcttacggccgtcagtgtggctaacggagcagtttccgttaaagaccgaggagcttctgccgttactcgacatactcgccaataaggtcaaagcagtgaggaggcttagagagttactcactaccacgttcccgccgggaactttccccgttaaggtggctataccggtggtccctacagtgagggtggtgattacgttcacaaagttcgtggagctgcaacctctggagcaattctacactccattctccagtccaaggcatttgctcagtgccgcaggggcaggcagaggagatgaggaacagagcaaagcagaaaacaggtgctcttcttcgagctcatcaacgtggctgagacgaaataatagcgtgtcgaataaacaacgatgtatggcatttgattcagacccttttaagattcctgcgggatacacatggaccagtgtggatgataaatctcgtaaaatgaagaaatccaagtccgtcagaaagcctaagtaa

SEQ ID NO: 65115 - DNA, 906 bp, Glycine max
  Peptide Sequence Number=SeqID_181893
atgggtggaatttatgtttttatgttaccagtagccaagccattaacagcaattgacatttcttcttatccaagagatggatcaaaggtgcgcgtggcttatcagggacttccgggggcatatagtgaggatgcagctttgaaagcatatccaaaatgtgagactgtgccatgtgacaattttgaagctgcatttaaggcagttgaattatggttggtgaataaaactgttctacccattgaaaattctgttggtggaagcgtccaccgtaattatgacttacttcttcgccataggctgcacattgttggggaggtgcagttgcgagttaaccactgccttttaggattgcctggtgtgagaaaggaggagctcagagctgttgtgagtcatccccaggcttttgctcaatgtgagacaacgcttagtgatttaggtgctgtcaagattgctgcacgtgatactgctgctgctgctcagacagtggcctcaaattgtgcaagagacactggagctattgcaagttcccgagctgcagaagtgtacgggcttgacattcttgcagaaagaattcagagaaaatataagacagatttcagtgatagcattattcattgtgcagatgatgatgagaatattactcgtttcttggtccttgcaagggagcctataattccaggaactgacaggccccataagactagcattgttttcagtctagaagaaggtccaggtgtactattcaaagccttggcagtttttgctatgagggatattaatttgtcaaagatagagagtcgtcctttgaagcagcgctcattgagggttgtggatcatttaaatgaagggagtgccacgagaatgaatggagtatacaacttaagggcaagaggcttgttagagtaa

SEQ ID NO: 65116 - DNA, 1746 bp, Glycine max
  Peptide Sequence Number=SeqID_181894
atggtagatgatgagaaaaatactgtgaaaagtgaaacggcccccgagtacaagcctgatactgaaggcattgtgcctaaggagattgatccagcaaagcgcttagttaattggatgagcatggacgatggccaaaatttgtatgctgaaaaatttaaaaactgcaactctgttgcagatttcaatgaaacagatagtgatgatgcttgtgatgataattttgatgatgatatggataataatcaaagacatgaggaaattgatgacacaaatgaaacggttagtgcacaaaaaggttaccatgctgatcatattgatgaggaatcaaatacaacatgcatgggaaatcaaaagacaagttgcatattaattgctccactatccgaaaacagtgaagtgaaaacacaccaagaccaagggaaagaaattaaggagactgcagcatttacagcaccacttaatgtcccttcctcaggatctgtacgtatatcacagaatagaaagcctctgaaggtagctttctgcccaaaagaagttcaaaggataattgagtctgaagcccttttgcaaaaaaatgctcagtcccacactataagaaaaatcatagtttttgcatcacttggcataaggcacggatgtgaggatatgtacgagctggaattcaatcattttagcattttgaagaaaggagaaccatatgtgtctccaaggaaccctggggagcatgttttatatgagaatcctggtgttcggaggaaaatattttatccaaatcgacaaaacccagtattatgtcctgttcagatgctagaagaagaaagagccatgcgtccatctgatgctagttgtccatcatgcttattcttgtgcatcaaatatggtggaaggacaagaaatcttcctcaaaatgaatatgtgaggcagccgatgggaagaaacaaactgaagtcttttgggccacttatgtgccgaatggcaacgttggttcataatcgcagtggaagctttttcttcaaggcattgggtatcaccctcctgtttatggcaggatttcctggtgatcaagttcagaaagaaaccaaataccgcaacttagacttgcttcagaaatattacagaactgatgaggatgctgaaggggaggagttgtttcttccgcatccaatctcatgtgacaatggtactcatgagccccacaatttaactaaaaagacacctcctgcaaaatccaagggaagaaagcacacaaatgccgtcatcaagtcacataattcacaaaagacaccatctcaacatgcaacaccaacaagttcagcagctactcaatttggtttaagtggctattcctcagcttacacatatgcaatggcagcatttcattcaatgccatctcagatttcctcccaagacactcctcacatgccaaatcctgctttttccccttccaacgcaaatcatcgtatgctgccgccaccaccacagccagcaagtacatttgtgccagtgatgtattggcctccaccaaatgcatttcttcccggaccctatccttccacatatggataccattcttttccttctgctgcaaattacatgtcattccaaacacaaccttattacaataacccaaagttgctagaaggcagtggaaagaaagatttagcctccgatgaaactgaaagtgacactgatagcagcagttctggctgtagtgagcacaagcagagacctgcgttccacaaataa

SEQ ID NO: 65117 - DNA, 216 bp, Glycine max
  Peptide Sequence Number=SeqID_181895
atggcgtctaagcgaaacaagcagcagtcgggctcgcggagaagagaaaacgtagaggctcgcggaagagggaagaaaaacagaagcaagaagaagaggcggcaaaatggcccattcaataaattgctgggtgcaccagcaatattgctgggtgcacctagcatttcccttcaagaggtagagaagctcttagaatgggctaggccaattatatag

SEQ ID NO: 65118 - DNA, 2007 bp, Glycine max
  Peptide Sequence Number=SeqID_181896
atggctgacatagtgaagcaactgttggcaaagccgatccagctggcggaccaagtggccaaggcagcggaagaggccagttcctccttcaagcaagagtgtttagagctgaaatccaagacggagaagctggccgggctgctccggcaggcggcccgtgccagctccgacctctacgagcggcccacgcggcgcatcatcgccgacaccgaactggtcctcgacaaggccctctctctaaccctaaagtgccgcgccaacggcctcatgaaacgcgtcttcagcatcatccccgccgccgccttccgcaagatgtcctcccagctggagaactccatcggcgatgtctcctggctcctccgcgtctccgcccccgccgaggaccgcgccgacaccgagtacctcggtctcccccccatcgccgccaacgagcccatcctcggcctcatctgggagcaggtcgccatcctccacaccggctccctcgacgaccgctccgacgccgccgcctccctcgtgtcgctcgcacgtgacaacgaccgctacggcaaattaatcatcgaggaaggcggcgtcggtcccttactgaagcttatcaaagaaggcaaaaaagaagggcaagagaacgccgcaagagcaattgggcttctcggccgtgaccctgagagcgtggaactcatgatccacgctggtgtttgctctgtcttcgccaaagtcctcaaagaaggtcccatgaaagtgcaagccgtggtggcttgggccgtgtcggaattagctgcgaaataccctacatgccaagatcttttcgctcagcataacatcgttcggttgcttgtaagtcatcttgcgtttgaaaccgttcaggagcatagtaaatacgccattgttagcaacaaacctacatcaattcatgctgttgtgatggctagtaataatagtggtaataattctaatggcaatagtagtgtgaagaaggatagtgaagatgaggagaagcagatgcagagtaggatgcagcatcccttgggtgataggtcaacaaatcagatgcatagagtggtcacaagtaccatggcaatgcatgctgccaacaagcagcaacagcccaatcaagggaatgaaggaactctgaacttgcagggtccgaaagtgaatggtaatggcaaacaaaaccatcagtctcaccagcaaagcttctcgtattccgggattaacatgaaggggagggaacttgaggaccctgagaataaggcctacatgaaagcaatggccgcgagggcgctccggcagctggccaagggtaatgtggccatttgccggagcatcacggagtccagggctctgttgtgctttgccatactgcttgagaaagggtctgaggatgtgaagtacaactctgccctggcagtgaaggagatcacggcagtggcagagaaagatgctgaattgagaagatcggcattcaagccgaattctccggcctgcaaggcggttgttgatcaagtgcttaagatcatagagaaggaagatacaaaactcttgattccttgcgtaaaggctattgggaatctggcaaggacgttccgagcaacggagacgaggataatcggtcccttggtccggcttcttgacgaaagagaggctgaagtgtctagggaagcagctatctctctcacgaaatttgcttcctcggaaaactacctccaccttgatcactccaaggcaatcataagtgccggtggtgcgaaacacttggtccagcttgtgtatcttggagaacagacagttcagatttcagcactagttctgctctcctacattgcattgcatgtgccagacagtgaggaacttgctagggctgaggtgcttggagtgcttgaatgggcttccaagcaaccaaacgtgacgcaggacgaaaccctcgaggcattgttgcaggaatccaagggtaggctggagctttaccagtctagaggttcaagaggattccaaaaattacatcaatag

SEQ ID NO: 65119 - DNA, 360 bp, Glycine max
  Peptide Sequence Number=SeqID_181897
atggctcaaaatctcaccaatgcatcatcaagaatcaacaatgtcaacagtgtctacactagggaatcagtgagagcaacaacttctccagatgacgaatcagaaagattagcaatttctccaactggggaagcaggggggtcagctgtttcttcagctggtgtatcaggaggggcagtagcttcatatgatgatgcatcagagatgataattagaggtggagataagggaactacttcaagcttaggagaaagaggtggattcaccactggagttcatggctcggctgacattggttcgacccgtgccggtgcaggcttcgaaggagcagcctcattggttctcaccaatggaagttga

SEQ ID NO: 65120 - DNA, 183 bp, Glycine max
  Peptide Sequence Number=SeqID_181898
atggacaaagcagagttggaattgaaggttattgagttgcgtcgtaacccacaactcacaagtgatgatgggtcgagagtgtcggaagtacttacttgtcaaaatggtatacaaaacttagacatcaaggtctccttaacgggccaaacatgctccttaatcaatttcatttctcggatctga

SEQ ID NO: 65121 - DNA, 945 bp, Glycine max
  Peptide Sequence Number=SeqID_181899
cacccaaatgagatcaataaggtgaaaacacaattaagtggtgaatttgagatgaaagatttgggtccagctaaaagaatccttggtatggagattatacgagatcgaaaaattggaaggttgtgtttatctcaaaagagctatgttgagaaagttctagagagatttggaatgcacaatgcaaaagcagttagtacaccttttgcggcccattttaagttatctgcaaatatgtcaccacaaacaaaagaggaggaagagttcatgtctcgagttccttactcaaatgcagttgggagtctgatgtatgctatggtttgtaccagaccagatatagcacatgcagtgagtgtcgttagtcgttatatggctaatccaggaaagtctcactggcaagcagtaaaatggattctcagatatttaaggggttcaactaatctgggtctagtgtttggcaaagcaacaaatgaatgcaatggtcatgtcattggatattgtgactcggattatgctggtgatcttgatcgtagaaggtccttgagtggttatatttttacgcttggaggtagtgctataagttggcgtgcgactctacagtccactgttgccttgtcgactacagaagcagaatatatggcagctactgaagcggtgaaagaagctttatggcttaaaggtcttgttggtgatcttggtgtaagtaaaaaggaagttgttgtgcattgtgatagtcaaagcgcaattcacttaaccaaaaaccaaatgtaccacgaaaggacaaagcacatagatataaggatgcattttattcgtgatgtggtaacacaaggtgatgtgttaatagaaaagatttctacttcagataatcctgctgatatgatgacaaaagctcttccaacattaaagttcaaacagtgtctggactcagtggggattaaaaattga

SEQ ID NO: 65122 - DNA, 702 bp, Glycine max
  Peptide Sequence Number=SeqID_181900
atggtaccaggcaaagccaacgattcgaagccaaaaatcaaccaaaagaccaaccaagcaaccaaaattggcacggctgaagcccaaagctttggtttcagacacaaccgggtttttggtaccgctaggaacacaaacattatcccaggaaaacccgtgtgggacaagtcaattaccaaaacaaaaattgatgtttcacagagaaaacccaaatccattagcacaactcaacttcccattgacacacataataaaaaatccacagaaaatgccaatctcggattgaacaagaaaagtcacacattcccacaacaatttgctgaaaaaacatcaaagaacagttcccaagagaagggttctgcttcagagccaaaaactccagtagcatcatcgtcccatgttagaaccaagtcaaccacaccattctactctgcactgaattgtagcaaatgccgttttgataggcttgagacatcttcttattgggttggccaaatcaaaatggctgagtccgtgggcaagcattttgtagcctctgaattctttaggcttgctttggaatctcaggctgagccaattaggaacctccggatggagcttaaaaggtatttgttaaggcatggatacctatcggagcagaaggaatggagggaagttgctgctaggtatgggctactgaaggttgaaagcaacaaacactag

SEQ ID NO: 65123 - DNA, 1182 bp, Glycine max
  Peptide Sequence Number=SeqID_181901
gcttcattgcaatacagagatgtttgtagcagtggaagggtagtttccatcagagctcaagtcaccactgaggctccagccaaggttgaaaaagagtccaagaaacaggatgaaggtgtggttgtgaacaagttcaaacccaagaccccttacgttggtagatgcctgctcaacacaaagatcactggggatgatgctccaggagaaacttggcacatggtcttcagcaccgagggagagattccttacagagaaggacaatcaattggggtaattcctgatggtgttgacaagaatggcaaacctcataaactgagattgtattctattgctagcagtgccattggtgattttggagattccaagactgtttctctatgcgtgaaacggctagtgtacacaaatgaaaatggagaaattgtcaagggagtctgctcaaatttcttgtgtgacctgaagccaggagctgaagtaacaataactggacctgttgggaaagaaatgcttatgccaaaagatcctaatgccaccatcatcatgttgggaaccggaaccgggattgccccatttcgctcatttttatggaaaatgttctttgagaaacacgaagattacaagttcaatggtttggcatggctctttttgggtgtccctacaagcagctcattgctatataaggaggaatttgagaagatgcaagagaaatatcctgacaacttcaggcttgacttcgctgtgagccgagagcaaacaaacgagaacggagagaagatgtacatccaaacccgaatggctcaatatgcagaagagctgtgggaattactgaagaaggataacacttttgtgtacatgtgtggactaaaaggaatggaaaagggtattgatgacattatggtgtcattggctgccaaagatggcattgattggactgagtacaagaggcaattgaagaaatcagagcaatggaatgtcgaacctcttcatacgaagcaacattgtacaaagaggctatgggaggagaatatggagcagtgtccctccgctgtgcatagccatgaagcgcctatggcggtgacgagggagaacagaagtgagagcaaggacaacatcaacactatggaggccatctcctactgtaaagaagagggaaaaatgaagaaacaatgggaaaagaagaattga

SEQ ID NO: 65124 - DNA, 291 bp, Glycine max
  Peptide Sequence Number=SeqID_181902
atggagaagtttgacaagaaaaatttcaaagacaacaaagcaaaaaaagcttacatcacttggaaagataaagatatagattcatcaggagattcagaaaatgaagtcgtgaatctgagtctcatggccaaaaactatgatagcgaagaagagaaaggacatagtgcatcaacatgttattttaggaaaaatagtagtaacattaaaatgatatgggttccaaaagaatctttgatcaaaactaacaatcaaggacccaagaaaatttgggtacctaagtcaaaaacataa

SEQ ID NO: 65125 - DNA, 1893 bp, Glycine max
  Peptide Sequence Number=SeqID_181903
atgtcgtctacaaagtttgacgttgagaaatttactggcaaaaataacttcaacctatggcgggtaaagatgctcgctctcctcacgcaacaagaatgtgagttggcgttggaaggagaagaaatgctgccagccgaaatgacagctgcacagaaaaagggtgatgaagttttgggagaagtctctggagaaaagactgttgacaagctttcggcaaagcttgaaagtagatacatgacaaagtctctccataatcgtctctgtttgaagaaacagttatatactatgcagatgcatgaagacacaataattttcggtagaagctcactatctatggaagaggtgaaaacagccttacaatcttgggaattgaaaaggcgaatcacagattcatatggaggtactagctctggtgaaggtctaatggtaagaggaagaatggatgaaagaaaaagtttccaacgaagacgatctaaatcgcacagcaagaataagaacaacaacaaatgtcataactgtcagaaggaagggcattggaaaaggaactgcccggagctcaaggaagataaagtgagtacttcagagtttggtggagcagctgttgtctccgaagaatcagatggtggaaatgttctctttgtctcatctaatgttaatgatgatgactggattcttgattcagcatgtactttccacatgacgcctaacagagactggtttgccacattccaaaatgttgatggtggcaaagttctgatggggaatgatggtgcttgtagtatagctggcaaaggtacggtgcagatcaagatgaatgatggtattgtaagaacattaactgatgtgaggtatgttcccgaactcaagaagaacttaatatctttgagcactttagactctcttggttgtacatatcgagctggaggtggagacttaagagtttctagaggttcattgatagttatgaaaggaaaattaaagaatggactatatattctgcaaggcagcacggtggaaggtacaactgcagtttcttctatttctaatactgaccaatcccgtttgtggcatatgaggttgggtcatatgagtgagtgtggaatggatgagcttagcaagagaggcttgcttggtggacgtcgtattgaaaaacttgacttttgcgaacattgtgtttatggtaaacaaagtagagtaaagttcagcactggtgttcacagaacgcgagggactcttgactatatccattcagacctatggcaaaagagcgatgtattccttaagttcaaacaatggaagtcactagtggaaaaacagacggagaaaaaggtcaaacgacttaggacagacaatggattggaattttgcaataatgagttcaatgagttttgcgcaaatgaaggaatagcacgtcatagaactgtaagacatacaccacagcaaaatggcgtggcagaacggatgaacaggacattactggagagagctcgatgcatgctctcaaatgcaggtttgccaaaacagttttgggcagaggcagttaatactgcatgttatttggtaaacagatctccttctacagctattgattgtaagactccagaagagatgtggtcaggctctacagcaaattattcaattctgcgtgtatttgggtgtccagcttatgctcatattaatgaaggaaagttggagccaagagccaagaaatgtatattattgggttatcaagatggtgtaaaaggatacaggctgtgggacccaaaggaatctaagctcttaattagtagagacgtgacctttgatgagacagctatgcttaacccaagaccacataaagaccatgataataaagttgaagttcatggtgatatcaagaaggtggagtttgaa

SEQ ID NO: 65126 - DNA, 528 bp, Glycine max
  Peptide Sequence Number=SeqID_181904
atggcaggaggaagcggaggaagaaacttggaggaaacgccaacatgggctgtctccgctgtttgttttgttttgatcttaatctctataaccatcgagcacatcatccatctcataggaaagtggctgaagaagaagcacagaagagctctgtacgaatcacttgaaaagatcaaatcagagcttatgttattggggttcatatcgttgcttctaacggtaggacaaggtccaatatcaagaatatgcatatcagaaaaagttgcagggacatggcatccctgcgacgatagtagcaaccatgagtcagatagtgaagaatcagaaaacagaaccaatagccgcagattattagcggcgttctatggttcagacgacgtaaatccacgacgtgttttggcgggaggaggagccgacaaatgtcccgagttgcactccgcttttattagacatgcacatgcggacgaaagtttaatagagattgagtgcgatatatgcgagtgttggttgagtcctatgattgcgtag

SEQ ID NO: 65127 - DNA, 246 bp, Glycine max
  Peptide Sequence Number=SeqID_181905
atgggaaagcacaaaaatcatgcctctcacagtttagctttaacctctgctaattcggctgcaaaagaacgaaaaagagaaagagaaagatcaagaagagcgtcggagagtgtaaatcctaagttactgattggaaagtgtgaagtagaaagcgtgacactgagatcgcacgacttcaagtgcagtagctttgagcgattggaggaagtttctgtaggaagcgatgaaagcgtcgatgttgtgtag

SEQ ID NO: 65128 - DNA, 1119 bp, Glycine max
  Peptide Sequence Number=SeqID_181906
atgggaaaagtcccgtttgtgtcatcggatggcattcatcaactccatatatttatcttcgtgctggctgtttttcatgtcctttactgcattttcactatggccctgggcagagcaaagatgaaaaggtggaagcgatgggaagaggaaaccaagacaactgagtaccaattttcacacgatcctgagagattcagatttgcgagggagacatcttttggaagaaggcatttgagtttctggaccaaaaatcctgtcctcatttggattgtttgtttctttaggcaatttgtgcggtcagttccaaatgtggattacttgaccttaagacatggatttataatgtcctccattctggttcttcgcagtgctgtttctcctcttaaacactcatgggtgataatcttgttagtgggaaccaagcttcaagtgatcataactgagatgggtctaaaaattcaacaaagaggagaggtccttaagggtgtgcccttggtacagccaggggatcatttgttctggtttaaccgaccaggccttattctttaccttatcaattttgtgctctttcagaatgcttttcagctggctttcttcgcatggtctgcacttcaatttggtattaaatcctgtttccattcgcatacggaggatgtagtgatcagaatcacaatggggtacatgggttcgacaatgaaaccaacgatattcaacgaacgagtagcgctagggctgcggaattggcaccagacggcgaagaagcacataagacagaaccgtgtggggccgctgtcgttgtcggggactccgacgtcgagcaggcccacaaccccaagtcataacttgtcgccggtgcacctcttccgatactaccgctctgaaatagacagcttccccacgtctccgcaaaggtcaaacttggacgataataatatggattccccttctccttcttattcgcaccatgaattggaaatgggacacttgtcacagcagcagcaacaacaacaacaacaaacaacaaccaatgataacaccaccacacaccatgagattgtcgtggcggtgcacagcaaggagttttcttttgataaaagacctacgagtagtaatacgtaa

SEQ ID NO: 65129 - DNA, 228 bp, Glycine max
  Peptide Sequence Number=SeqID_181907
atggttccccacatgtcatcgggcccgccgcctctggatgacaaaagtgcagatgaccataattgtctctgcgtgccattggacacgactgtgtctgaatggcgaaaaggtgagcagaatgaccataatttgtctccacgtgtcatcgggcccgccgcctctggacgacaaaagatgcagaatgaccataatttgtctccgcgtgccattggacacgactgtgtctga

SEQ ID NO: 65130 - DNA, 362 bp, Glycine max
  Peptide Sequence Number=SeqID_181908
atgcataaatgccccaggtgtggggtatcacggtacaaagtgaaggatgacgatgagtgtagcagtgatgaaagcacaatgaaagtccccccagcgaaggtgttatggtatcttccgatcattccaaggttcaagcatttctttgctaatgcagatgatgctaaagaccttacatggcatgcagatggaagaaattgcgatggaatgctttgccatccagttgattccttccagtggaagaagattaatcgtttgtatccgaattttgggaaaaagacaagaaatctcaggcttggacttgcccttgatggaatgaatccctatggtagtttaagcactcagcatagttcgtggcttgtttt

SEQ ID NO: 65131 - DNA, 270 bp, Glycine max
  Peptide Sequence Number=SeqID_181909
atggcgatggtggtaacagtggtggcggcggcggtggaaaaagcacgtgctttaactgtgggaagccagggcattttgcaagggaatgtgttgaagcttcagggtgagctatattgggtcgggcttgtcaccaagttagttctatctgtgcaaaatctagggacactatcaatattttgtgcctttgcaaaatctaagatccaaattacaaatctgttttgtgctctacctatacctaagaagcaaatggcaaaacagggatattattaa

SEQ ID NO: 65132 - DNA, 291 bp, Glycine max
  Peptide Sequence Number=SeqID_181910
atggaccaacccacattgagagtacatatagagcaaagagttctaaatagatcggtcttgatcaatcttcggtttgagaacagtgcaatgaacttcaccccctttggaaacaatagtaaactcatcacatttgctaaatgcttaggcaaacttgtatgcttaggagcatgccttgagcacaaacctagcttgaagagggtaggaagagttggcaaaggctcgaatcatagtgttgcaaatgaaggagttttgcatggaagtttgttggaaaagggaatgatcataggatag

SEQ ID NO: 65133 - DNA, 372 bp, Glycine max
  Peptide Sequence Number=SeqID_181911
atgcttttggacaagaatgatattcaagaaactcattatgaggttctccatgtcaaggaacatgcaaattatgaagaaattcgtgctgtaatcaaacaaccagagagatttctcaaagtacagaaggcgtgggagattctgtgtaattcaagctcccgctcattttatgataatgagctgcgaagttcaaggaaggatgtcttggctgcttacattgctgaagatttgagcttaaggaaggatgtcttggctgctgacgttgccgaagatttgagcttacaggatatgatgattgaagatgatggagaagcattggaactgttttatcaatgcagatgtggcgattacttctctgtagactcttggaattga

SEQ ID NO: 65134 - DNA, 900 bp, Glycine max
  Peptide Sequence Number=SeqID_181912
atgagtgcttcaactcatgaccaatttgctgccactctgatcttcctatttttctctcactttctaagagggtcaaattcagcgacattcagcatcgtaaacaagtgtagctacccggtttggccggggattttatccggcgccggaacggcgcaactcgccaccaccggcttcgccctgcaacccggccagtccaacgctgtcgcggtccccaccgcctggtctggccgcctgtggggccggaccctgtgctccacggactccgccggaaaattctcctgcgtcaccggagactgcggatcctccgccgtggaatgcggcggcggaggcgccgtcccaccggccacactggcggagttcaccttgaacggcgcggggggactggacttctacgacgtcagcgtggtggacggctacaacctccccatgctggtggaggcgcgcggcggcgggaactgcacagcgacggggtgcgcggcggacttgaatggagggtgtccggcggagctgaaggtgaagacggtggcgagtggtgagggcgtggcgtgcaagagcgcgtgtgaagcgttcggggatccgcggtattgttgtagcggacgttacgcgacgcctgagacatgcaaggcgagctcgtactcgcagctgttcaagagcgcgtgcccacgcgcttatagctacgcctacgatgatgccaccagcacctacacttgtgcctccgcggattaccgcatcactttctgtccctcgacctccaaaagttcgataaagtcagggagtgggaaattcccagtagcagtagatatctcagttggccatgcttatgctgacaaatcagccaatgtcatgctagtagctattagcgctgttttattaacaatattgtggcaacaactcaattag

SEQ ID NO: 65135 - DNA, 312 bp, Glycine max
  Peptide Sequence Number=SeqID_181913
atggatcttctgtgcaacgcttattcgaatgcctcagaccacgaagatgaagaagaagaaccaccaaaacgacagagagtatcactctcttcccctaacccgctaaaacgacaccttcctttgtcttctcatccttcgttcaaccaccaaacgcaagctcccatgcccggaagatacatttccaaacgacagcgcgcattgatggccccacccctgcccctcttcctgacccgttcctgttccgtctccattcacgctatctgtgttatcaatggtggatggtggtggcagaaggccaaaattctgccataa

SEQ ID NO: 65136 - DNA, 270 bp, Glycine max
  Peptide Sequence Number=SeqID_181914
atgacatcaaccgctgtattttctatgggttgtgaaaatcggatgaaaaggagatcatcgcatggtggtgtcgtggtcgtcctcggcgatgacatggttgtctgctgcaatcaacaacgtgttgtttgcgatagcattgtgttgtctatggaaactagagagtcaagtgatgaaggtgaagtggtggtaaacgacaaggagaaaaaatgtgcaaaagatataaaggaggagggtgggaaccagcaattgggaggggagttcaaagtctaa

SEQ ID NO: 65137 - DNA, 249 bp, Glycine max
  Peptide Sequence Number=SeqID_181915
atgttgaaatggccaactgctagggcaaatttgtgggctgattgtcttaatgctaagggtgttcctaatgccactatcacaattgctaatccactgctcacctgggtgtgcacattggacgacgaagatggtggcacagcgattctagatttgggttgggtgttcgaggatgacagcatggtggcacgcgacagaagcatggcgaggcactatggaggcttcgcagtgcatggcagttttggacgatga

SEQ ID NO: 65138 - DNA, 524 bp, Glycine max
  Peptide Sequence Number=SeqID_181916
ccattgtcccgttacccacttcagagattcagtatgtcagggatgtcgtgaactcattcattggatggcccagacatctagtgaaacctttatcttatgattctgaccttaatgtgtggaagccagttgaacatagtagtgatgcaaagcttgcaggtgaatccgatccattgggagagttgatgaagatattgttttatgtgtaccagaatccagtggaagtgccatgggaggcgaaccaatttggacttcctgagattggggcaaaattttacatcacacatgcagatctagcggaaataatatcaggtgacaagtgtttaaacatagcgatactacaattgtggaccatatttatgaatgagtgcggtagaagcaaagctgatcagtcactatatggtttgttggagcctcaatctatacaaaatgctaaggaaagacggcaacaatgccaacaatacattgaaacatgggtcaaggaatcacaaaggcagttgtatttaggagcttacttgaatcagtaa

SEQ ID NO: 65139 - DNA, 501 bp, Glycine max
  Peptide Sequence Number=SeqID_181917
atggggggtgagactgttgttaatgagcaggtagagcagaccttgttagactatctcactcctcaagtggagatagctaataacatattgttgccaactctgggggcagaagtcaattttgagctgagacatggcttcttgcagattatagaaagcaatcagttccatgaggcagactctgaagaccccacgtacctgaggttgactggcaccatcaatgtgcaaagcgtgcccacagagtatagggatattgggaatttagtgcaggagcaggagagtttggctgaagcgtgggagagtacaagcctcgatgctgcttgtgggggaaatcttatgctgaagccacctactgaagcaaccaagatcattgaagatatgtcctttgatcccaacaacaattctggggataggaggattgtgaggaggccagtgaatcaggtagaggtcgaagcatccagttcaggactattgtatttgactggctgctactataatgaatga

SEQ ID NO: 65140 - DNA, 783 bp, Glycine max
  Peptide Sequence Number=SeqID_181918
atgggttgtcaaggtagcaaggagaaaaaatcaaagacagaatttactacttcctatggatcagcagccactggtagtggtggtggtactagttacaacactgttcagcctccgccgccgccaccaccacctactactactgctactactactaatcaggttcaaacatcagcagcacccaaaccacaatcaaaagcttctcctacagtgcagcagaaagcagacacgaggattctggggaaaccctttgacgacataaaaaaatactacagtttagggaaggaattgggaagggggcaattcgggataacgtatctgtgcacggataatgcgagcggtgggacgtacgcgtgcaagtcgatactgaagaggaagctggtgtcgaaggcggacagggaggacatgaagagggagattcagatcatgcagcatttgtcggggcaacccaacattgtcgagtttaagggcgcctacgaggacaggttttccgtccaccttgtcatggaactctgcgccggcggggagctcttcgatcgtatcatcgcccagggtcattactccgagagagccgcttcctctctctgccgctccattgtcaatgttgtccacatttgccacttcatgggtgtcatgcaccgcgatctcaagcctgaaaatttcttgctctctagcaaggacgaccacgccactctcaaggccactgattttggtctctctgtcttcattgaacaagggaaggtttaccatgatatggttggcagtgcttactatgttgctcctgag

SEQ ID NO: 65141 - DNA, 642 bp, Glycine max
  Peptide Sequence Number=SeqID_181919
atgctcacagcttatgccaaagcaaaaccagaagaaaaagaagaagcgccaatggccaagggtcgcaaattccccaccacgacccgaaccgaccgcttcttgggaatgggaacctactcctcccaagcctccgccgccacagacctgtcggagttccgggaagaggacgtgtggtccacgtcggaagaccgtgacagagatgtgaatgcctaccccggcgagtgggaggcactcgcgccgccgcgtcgtcggagcagcagggagctgcaggggcaccgccacgtggggggtttgtcccttgcgttcgaggatgggtccggtggtgctggtacgaggatcgtgcaccaccagtaccgcgcgcagcacgacgccgtttcgcaccaacaccaaatggctacgtcagcacccgtgaacgttcccgactggagcaagatcctccgggtcgactcgctgcacgagatggacgacgtcttcgacgacaacaacaacgagtcggagatggttccgccgcacgagtacttggcgcgcagccgcaagatggccgcgaactcggttttcgaaggggttggtcgcacgttaaagggccgcgacatgagaagagttcgcgacgccgtttggagccagaccgggttcgacggctga

SEQ ID NO: 65142 - DNA, 1641 bp, Glycine max
  Peptide Sequence Number=SeqID_181920
atgaaaggctcaagtgtccctatgaacatagacaaaaggtggattccaaaccttaatttttttctacagtttgaaagcaaatacagaattagctcatcgacattgtgtgatataattttttttcacgcaggattacctgcggtggaggtttatcaaattaggattgttttcaaactcgacgaagccaggttccactacatggccatatctgatactaggcaaaggaacatgccatctatgagagatagattatcgggtcaaagcctggcgtatcctgaagctgttcttttaacccatgcatctgagccacaatttaagggagaggtggatgacaaataccaatactcgagtgagaacaaagataacactgttcatggctggattacccaggatgattcagcacccgtgggcttctggttgataacacccagtaatgagttccgccatgctgggcccattaagcaagaccttacctctcatgttggcccaactactctttccatgtttgtgagcactcattatgctggcaaggaggtagccatggtatttggtgaaggggagacatataaaaaggtttttggcccagtttttgtctaccttaactctgttcccaacaaatctcagtttcggtctctctggtcagatgctgtagaacagttatcgaatgaagtaagaagatggccttatgatttcgttggatcaaaagatttccttccacccaatcaacgaggaacagtgacaggacgactactagtcctagatgggggaaagagagctcaacctgctaacaatgcttatgttggtctagctttgccaggagatgcaggatcatggcagagagaaagcaagggttatcaattctggattcaagctgacaaagatggacacttcttgattcaaaatattgttcctggggattacaacttgtatgcatgggttccgggttttattggagattatagatatcaaactaaaattaccatcaaaccaggatgcaacatcaacttgaattcactggtttataaccctccaagaaatggtcctactctatgggaaattgggatcccagatcgctcagctgcagaattctatataccagaccctaaccccaagttcacgaacagattattccagaacgatagccaagacaagtttaggcaatacggcttgtgggaacgttacactgaactatatccaaaccatgatctcgtttacactgttggtgtatctgactatcacaatgactggttttatgctcaagttaccaggagcacaccagaaaagacattcgtgccaacgacatggcaaattcaattccaacttaaaaatatcataatgccaggaaattacacattacaagtggggttggcatccgccaataatgctagactggaggttaggttcaatgaccagaatgctaagcttccccacttctcaacagggctaacaggcgatgacaatgccatagcaagacatggaattcatggattgtataggttgtatactatagctgtaggcagcaatcatttggtgaaaggaaaaaacaccatctatttgacacagtcaaaaggcataggtcctttcatgggacttatgtatgattatgtccgcttagaaagtccaccaattaaaagtacttga

SEQ ID NO: 65143 - DNA, 156 bp, Glycine max
  Peptide Sequence Number=SeqID_181921
atgactgtcttcgacgatgagctcactgaagggcacgagttgggttcgggtttggtcgggaaggcgcaaggattttacattgccagcgctgtcgatggaacaagtcagcttatggctttcagcgctgtcgatggtgaaacttgggactgggagtga

SEQ ID NO: 65144 - DNA, 722 bp, Glycine max
  Peptide Sequence Number=SeqID_181922
atgaaaaagcgctggctgatgatcagggaagagtggggcgtgctcagcgacttgccaccaggtaacgagatgcttcgccagcagattgcgcgccgctacctggcgaatggcatggatgtctcaccagacgatatcgttattacgcatggggcgaccgaggcgattacactttgccttcaagccgtggccaaggctggggatacgattgccttggaatcgccaggctattatgcgctggcccataccgtagagcgcctgggcatgaaagtcgctgaaatacgaacagatcctgcgtctgggatagatctggatgccttgcgtgccgtgactgacaatgtgcatatcgccgcggtgatcctcaccagtaatttccagaatccgctgggctttgtcatgccggaagacaaaaagcgggccttggtggcatttctgacagagcagaatatcccgctgattgaagatgatgtctacagtgagctttattttagtgaagaaccgcctttgcctgccaaagcgtttgaccgtgcaggcatcgtgttgcattgctcgtcgttttccaaatcgctggcccctggctaccgcgtgggttggaccacggctggccgctaccggcaggaagttgaacgtctgatgtttctcaatagcctgtcactgacttctgcaccgcaaatcgccattgccaagtttatgcagcgcgacagtttcgagcagcatcttaaaca

SEQ ID NO: 65145 - DNA, 384 bp, Glycine max
  Peptide Sequence Number=SeqID_181923
atgggaaactgctgtaagccggcatcatcaacggagtgggacggtgaagactggagtgatttgacgtccaaaaagaccagatcaagcaaggtatttgacgaagctcatggccatggtcatgggttgagtttagggaaagtgcagaaggagaagcttatggaagcgctaagagttgtttctcctgatgccaacgggaaggtgaggataaagatttcaaggaaagagtttgcagaattgttggagaagcaacaacaggttaataaaaagcaagtagggagagcttctgcagaacaagttctgcttcgcttaataaacgccagagatgatgatgctcgtcacagattctggaggcccgagctagagagtattcctgagctaggttag

SEQ ID NO: 65146 - DNA, 668 bp, Glycine max
  Peptide Sequence Number=SeqID_181924
atgaacactcgcaaacactcaattccttcaccgcgcaacttcccttccgccaacacctctcccgtcaatttccgccgcagctccccgaagactcacctttccgccaggaagctcgcagcgcgtttatggcacttgcgctttttcaatcttgaatcttctccgccacgtgtcaagcgttcagcgcaagaggttaccagacgcgatagcaggaagcttctcggagaaaccaaattaataggtggtgagtctcttctcctctcagaactccttcgtgctcaaacctgcattaacaggctcaatgctgaaaagcttctctggaagcgtcgagaactcaagaagaatcaatcaatgctagaggacttaaaggataagttagccagggaaaggacaagtagggagagaatggaatcaatgaatgccaaattagttcttgagcttgcccaagcaaaactatatgccaagcaatttatggtttactacaaggaggaaaagaggaaaagagaaataatagagcaagtgtgcaacgaattggcgatgcaaataggagaaggcaaggctaagctggagggaatggaggaagagaggaacatgcttcacatagcagggctgctgcgtgaagagagcatccaaatgaagctactcgacgccaaactttccctggaagataa

SEQ ID NO: 65147 - DNA, 976 bp, Glycine max
  Peptide Sequence Number=SeqID_181925
aggactacacgtcatcgccttcagatgactacacgtcctcgccttcagagagttgcatgccctcgcctattatcaccttcagaggactacacgtcctcgcgttcagagggctgcacgccctcgcctttacaggactacacatcctccccttgagaggactacacgtactcaccatcagaggactacacgtcctcgccatcagaggactacaagtcctcgccttcagaggactacacgtccttgccttcacaggactagaaatcctcaccttcagcgggctacacgccctcgcctttagagagctgaacaccctcgcctgtcttcatcttcagaggacaacaagtcctcgccttcagaggattacacgtcctcgccttcaaaggactgcacgtcctcaccttcagaggactgcacgtcctcaccttcagaggactacacgtcctcgccttcagaggactacacgtcctcgccttcaaaggactacacgtcctcgccttcagaggactacacggctacactccctcgccttcagaggactacgcatcctcaccttcaaaggactacacatcctcgccttcaaacggttccatgccctcgccttaagaggactgcacgtcctcgtcttcaaagggctgcacaggactacatgtcctaaccttctgaaagctacaagccctcgccttcagaggactacacggctacacgccctcgtctttagaggactacacgtcctcgctttcagaggactacacgtcctcaccttaagaggactacacatcctctcctttagagggctacacgtcctcgccttcagagggctacgtgccctcacctttagaggtatagacgtcctcgccttcagaggacttcacgtcctcgccttgagagcactgcacgtcctcaccttcagaggactacacgtcctcgccttcagagaactgcacgtcttcaccttaagaggactacacgtcctcac

SEQ ID NO: 65148 - DNA, 667 bp, Glycine max
  Peptide Sequence Number=SeqID_181926
atgaatccaatcttggaaacacagcataccacttttttttactacccaaggtttgatatatttcgaaatcgagaaatttcaagtggagcgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtag

SEQ ID NO: 65149 - DNA, 282 bp, Glycine max
  Peptide Sequence Number=SeqID_181927
atgggtagtgggagatcgaggcgacggttacacagtaaacgtgcaattatgacgccatctcaggaaaactggctaagacaagaaagagggcttcgaaccattgggcgaatcgagctggcgtatggtcgaatcgaagtcaaggcaacaagatttctggacttagcgcaatttctgacaaaactccacaaaattagttcgacttcgagcaatatggataaccgttctaaggagcagttatgtgcatgcaaggtgtacgtagcaggacacttggcattaggatag

SEQ ID NO: 65150 - DNA, 231 bp, Glycine max
  Peptide Sequence Number=SeqID_181928
atggcttatggtagccactggtggtcgtgggtggtggagaagaaggtgttagggtttgggtgggcatttggagaggaggagagtgaaaaaatctcatttagcgagcttatctcgttaagcgggagtccattttttgcgcttagcgtgacaatttgtgctaagtgcgacaattctcgctcagcgcaattccctctcgagttggtattgcgcttagtgctcttctcacgctaa

SEQ ID NO: 65151 - DNA, 185 bp, Glycine max
  Peptide Sequence Number=SeqID_181929
ggctcttcttcattacagggatttctactttattagcgctattggtctcagaaactgttatatggcaaaagcccattttgatagctaaagcatacggtcagaggtatttgttcacggctccaccttctgcaaaaacaagtgttcctccaactcatgattcaacccacggaatagacgtcgtttaa

SEQ ID NO: 65152 - DNA, 4131 bp, Glycine max
  Peptide Sequence Number=SeqID_181930
atggcaattgagaagaacagctttaaggtgtccaggcttgattccgagtgctctcctcgaagcagggaaattatgtccagtgacgaagaggtgattcggcggcgtaactctgctgcggaatccgacgacgatgatgagtttgatgatgctgattctggggcggggtctgatgattttgatttgctggaattgggggagaccagggcggagttttgccagattgggaaccagacttgcagcattccgttggaactgtacgatctttctggccttgaagatgtgctgtccgtggatgtgtggaatgactgcttgagtgaggaggagaggtttgaacttgctaagtatcttcctgacatggatcaagagacttttgttcagaccttgaaggaggttttcactggctgtaacttgcattttgggagtcccattaagaagttgtttgatatgctgaagggtggtttgtgtgagccgagggttgcactttacagggagggcttaagttcttttcagaagcgacagcactatcatctgttgaggaagcatcagaacaacatggttagcaatctttgtcagataagagatgcttggcttaactgtaggggatacagtattgaagaaaggcttcgtgtcctgaacattatgagaagtcaaaagagtttgatgcacgagaaggaagatttggaagttgattcttcagatgaggagtctggtgaaggtatatggagcaggaagaacaaggataggaaaatctcacagaaaacgggtcgctatcctttccatggggtgggtcctggtttagatatccattcacaaggacgatcagtggttatggaacaagagaagtatgggaaacaaaatcctaaaggcatactcaagttggctggttcaaagccaccttcagcaaaggaccctattggtcgtgcgtcttctgtctaccatgctttggatgtgaatcctgggccaaatggttcaacttctgctctttctcatcagaataagtcagtgggatatgattcagggtcaatgctcaggatgagggatcagctatggaatggtgacaacgaggaaatgccatatggactgactgtccatcaagatcggaatttatcacgtagcaacatgatggacaaatctagttttcggaaaatgggaaagaggcaagaccttctgagaggtgatgagatggataccgacaatttgatgggtctgtctctgtcttcaaagattgatctacatggatacactagaaatgcaaaccaatcttctaagagaggtttgtatgaatattctagaaattctaagtatccagaaaatgttcaacaatttgttggtagtgatcaggccaagtctagattgaggagttcacagttaccacttaaaggcagtatggtggactcagcagattatgatgaacttttctgtagcaatgaaacaccaggacaggaatttggtatgatggattcttcatttaaatatgatgattggtatcgaaagggcaagaaatggaaggcagggagagagtctcctgatctcagttacactccttatagatcttcctcaccacaggtgagtgatagacttctatcctctgacttcagggcaaaatcattgcaggagaagacaagagggacttctatgcagaatggaggaaaagatactatgcctttgaggggaaaccatatgcttttaagaggtgaagaaaccgaatcagactcctctgaacagttgggtgatgatgatgataacactcctttgttacagagcaaatatgcttacttgatgggtactgctgctggttctcgcacaaaattgttgaagtctcacctagatcccaagaaggccaaatttgttacagatttgaagccacatgtaatagcacaatccaaaaagaagggtggatttgcagagcgggggcaaatgcatggtgtagaaaattacctttcaaaagcaaagcagaagggtgaaatacgcaatggtggtccttttcataaacaggctggtaaatttattgaagaaagctatccctctggatcagatatgctcaatgatggtgatgatgattggagacatgcatacaagacaggcaagaatggccgaatacgaggggatcctattgaaaggttagacatgccctcatcaaatgcatacacggctgagcaaaagaagaaagggagaactgaccttgatcactccattctgaggtctaaatatttgcatgattatgttggtgatcaggacgactcacttgaaagacggttagttgtggataataatgaagttggacaaagtaggtatgggaggaaaggacagaaatatgctgccacatacaagggtgatcaaaatgagagatctgaggcacctttgcttggttgcaactcagcaacgaagaagcgaaaaacgaaagatgaggtagtagatattggtggaagagatgaagatggcaatcttttgtcaaacaccttgacaaatgatttgacttattcaaaaagaaagtcgaagaaaaaaatagaggctgggatggttagttcagaaatggataattctgaattgcatcttactgatatgggtacagcagatatagaactggaaatcaagccacagaaaaagacattcactttgatcacaccaacagtgcatactggattttcattttctattatacatcttctttcagcagtccgcacggcaatgattagtccacatgcggaggacagtttagaaatggggaaacccatagaagagctgaacaaagcaccggaaggcactgcaaatggtgatctttctaacagtaagacagatgccaattgtgagtctgctgaccatccgaacatgccttctcttactgttccagagattgttaatcgtgtgagatcaaaccctggtgatccttgcattcttgagacacaagagccactgcaggatttggtcagaggtgttctgaagatattttcttccaaaacagcacccttaggagcaaagggttggaaggtactcgcagtttatgaaaaatctaccagaagttggtcatggactggcccagttattcataattcacctgactatgataccactgaggaggtgacatctcctgaagcttggggtcttccacataagatgcttgtcaagttggttgattcctttgccaattggttgaaatgtggtcaggaaactcttcaacaaataggaagtcttcctgctccgcctttggcattgatgcaagtcaaccttgatgagaaagaaaggtttagggatctgagggctcagaagagtcttaacaccataagccctagctcagaggaagtgaggacttattttcggaaggaggaggttctcaggtactcaattcctgacagagccttttcatatactgcagctgacggtaaaaaatctattgtggcacctttgagaagatgtggtggtaagccaacatcaaaagcccgagaccattttatgttgaaacgtgatcgcccaccacatgttacgattctttgtctagtaagagatgctgcagctagattacctggaagtattggcactagagcagatgtttgtactttaattcgtgattctcaatatattgttgaagatgtttctgatgcacaaattaaccaagtagttagtggagccttggatagattgcattatgaacgtgatccttgtgtacaatttgatggggaaaggaaactgtgggtttacttgcatagagaaagagaagaagaagattttgaggatgatggcacttcatccacaaagaaatggaagaggcagaaaaaggatgctgcagatcaatctgatcaaggaacagtaactgttgcttgtcctggaactggggagcaaagcggatatgatttgtgctcagatctcaatgtggatccaccaccatgcattgatgatgataagggaatggaacctttgtctactgatacaaggccaaatgcagaggcacatgttgatgtcaatcgagcttctgaagaaggcaatgtttgtgatggtaattcaatggcttgggaggctcttgatttaaatcctactcgagagttatgccaagaaaattcaacaaacgaagattttgatgaagaatcctttgggagagaaaggcccgttggactattaagtgcaagcttgttgtga

SEQ ID NO: 65153 - DNA, 3237 bp, Glycine max
  Peptide Sequence Number=SeqID_181931
atggaggcagctcagagaagattgggaggaggaatggtgccgttgtcgccgtcacagactccgcgctccagcgataagcccgtgcgagatctgcgatctgcggattccaattccaacagtcacagcaagtatgataaggacaaaggtgtcaatgtgcaggtcctcgtgaggtgcaggccgttgagtgaagatgaaacgaggctgcacacgccggttgtgatttcgtgtaacgaaggtagaagagaggttttagctgttcagaatatcgccaacaaacagatcgatagaaccttcgcatttgacaaggtgtttggtcctaactctcaacagaaagaactgtatgatcaggcagtgtctccaattgtgtatgaagtgcttgagggctataactgcactatttttgcgtatggacagaccgggacagggaagacatacacaatggaaggaggagcaagaaagaagaatggcgaatttccgagtgatgctggtgtcatcccaagagctgtgaaacagatttttgatatattggaagctcagaatgctgagtataacatgaaagtaacatttctagagctttacaatgaggaaataacagatcttttggcccctgaggaaacttcgaaatttatagatgataagtctaggaaacctattgctctaatggaggacgggaaggggggtgtttttgtcaggggcttggaagaagagattgtttgcactgcaaatgaaatttacaagatattagaaaaaggttctgcaaagaggcgtacagctgagactcttcttaacaaacaaagcagccgttctcactccatattttctatcacaattcatattaaggaatgcactccagagggtgaggaaatgattaaatgtgggaagctaaatcttgtggacctcgcagggtctgagaatatttcacgttctggtgcaagagagtcatggccgataagttattgtagtcaggctggtagagcaagggaggctggggagataaacaaaagcttgcttacacttggacgagtgattaatgcgctagttgagcactcaggtcatgttccatatagggatagcaaattaaccagattgttgagggattctttgggtggtaaaaccaaaacgtgcattattgccacaatatccccttccattcactgtctggaagaaactcttagtaccttggattatgcacaccgtgccaaaaatatcaagaacaaaccagagattaatcagaaaatgatgaaatctgcaatgattaaggatttgtattctgaaattgacagactaaagcaagaggtgtatgcagcaagagagaagaacggaatctatgtaccacgtgatcgctaccttcacgaagaagcagagaagaaggccatgactgaaaagatagaacgcatggaactagaagcagagtctaaggataagcaactagtggagcttcaagaactctacaactcccagcaacttttgactgatgaattgagtgttaaacttgaaaaaactgagaaaagtctagaagaaactgagcagtcattgtttgatcttgaggaaaggcacaaacaagcaaatgcaacaatcaaggaaaaggaatttttgatatcaaatctcctaaaatctgagaaagcacttgtggagcgtgcaattgaactgcgagcagaactcgagaatgctgcatcagatgtgtcaaacctcttttctaaaattgaagcacatccctctaacatcacggttgaaattgccgtttccaaccttttagagcggaaggataaaattgaagaaggaaacagaatacttatccagaaattccagtctcagttagctcaacaacttgaagtgttgcacaagacagtttcagcttcagtaatgcatcaagagcagcaactgaaggacatggaggacgatatgcagtcttttgtatcaacgaaagcagaggctactgaagatcttagacaacgggtaggaaagttgaaaaacatgtatggttctggtatcaaagctctggatgatttagctgaggagcttaaagtaaataaccagttaacttatgatgacttgaaatctgaagtagccaagcattcatctgccttggaggatctttttaaaggaatcgccttagaagctgattcattactaaatgatcttcaaagtagtctccacaagcaagaagccaatttaacagcttatgctcatcaacaaagagagtcgcatgccagagcagtggagactacacgggcagtatctaaaataacagtgaacttttttgagacaatcgacaggcatgcatcgagtctgaccgaaattgtggaagaagcacaattggtcaatgatcagaaattgtgtgaacttgagaagaagtttgaggagtgtactgcctatgaagaaaaacaactactggagaaagtggcagaaatgctagcaagttcaaatgctagaaagaaacaattggttcaaatagcagtcaatgatcttcgagaaagtgcaaattgtagaaccagtaaactgcggcaagaagcattaaccatgcaggaatctacttcttctgtcaaggctgaatggagagttcacatggaaaaaacagaattcaactatcatgaggatacttccgctgtagaatctgggaagaaagaccttgtagaggctcttcaaatctgcctcaacaaggcaaaagtaggttcacaacaatggagaaaagctcaagaatctttgcttagtttggagaagagaaatgctgcttctgtggatactattgttaggggaggaatggaagctaatcaagctctacgtgcccgattctcaagtgctgtatcaactacacttgaagatgcaggaatagcaaacaaggatattaactcatccattgatcattcgttgcaacttgatcatgaagcttgtgggaatctgaactctatgatcattccgtgctgtggtgatttgagagaactgaagggtggtcatttccacagtattgtggagataactgaaaattcagggaaatgtcttctcaacgaatacatggtcgacgaaccatcttgttcaacaccaagaaagagactcttcaatttaccttgtgtttcatccatagaagaactaagaaccccatcatttgaggaattgttgaagtcattctgggatgcaagatctccgaaacaagcaaatggagatgttaaacacatcggggcatatgaagccgctcaatcagtgagagattccagagtccctctcactgctattaattaa

SEQ ID NO: 65154 - DNA, 288 bp, Glycine max
  Peptide Sequence Number=SeqID_181932
atgggaatacctcaaacgcgtgagaagaagcgtggaagaatgaattgcggagaagaggaggaagtggaaggagacatggtgggagaaaagggttgcgcagtgcgaaatcggacaatggcttttggaaaccctaagggggtgaaaaaattgttatatacgaaaagaccaaaaactcccaccgcaccaaacagggatgaacgcaacacaacgcagagaaagaggccgcaaggaagaaaagtgagaaaaaaagggtttggttttagagagagagagacgatgactgagtga

SEQ ID NO: 65155 - DNA, 270 bp, Glycine max
  Peptide Sequence Number=SeqID_181933
atggagaaggagaagaatggggaaagaggaggggtgataaaaagaatggccaaaagaatggccaagagtgatagaaagaatggccaagagaatggccaagagggaaacaaattacaaattgatagtatggcacttaaatgcgaaaacaagatccccggcaacgacgccaaaaacttgttagctctttggcaagtgtaccaaatcgctcgtagtaataatttctcggtaatccgagtatcgtaccacagggattttgttgcacttatgtga

SEQ ID NO: 65156 - DNA, 2129 bp, Glycine max
  Peptide Sequence Number=SeqID_181934
ccgataacgggctaacacggtgcacgtttaccaggccacagacgataccgataccgagtgccacaatcagcggcagccatgacggcggtcgcggtgtcgccgatagccaatccgctgttcaccgagcccacggagagatcgacgcctgccgtgataatgacgaaggtcatgccgatcgccagaatgccgttgatcgagacctggcgcaggacgatcagggtgttttcattgctgagaaaatagttgctgctccaggccccctgagcgacctgatattcgccaatcagcgccacgatcaggcacagtgcgaaaaaggcgatgataatgccgtatttgtgcatacggcgcttattgcgggtgaaaatgaaattcctggtgataaggagtgggcgctgctcattttttttctctctctgttaaaccgcaagtttcatcagtgctgcctgggtcgcatcggctgccgaaagctcgccggccaactgcccgtcacgaaacaccaatatgcgatcgctcatgccgataatttccgaaagctcggaggaaaccataatgatccctttgttttgcaaggcgaactccgacataaatcgatagatctctttcttggccccgacgtcgataccgcgcgtcggctcgtcgagcagcaaaacctccggatccagcagcgcccaacggcccagcaccactttttgctggttgccgccgctcaggttgcccaccggctgttcgccgtcgtgggttttaacgttgaagcgctggatcatgtcgcgggttcgcgcctgctcccgtttctcgctgacaaaccccatccggctgatggcggcaaaagaggcgatattgatgttttcactgacggaacggcacagcaccaggccggtttccttgcgatcttccgtcacgtaggcaataccgctgtcgatggcctcgcgcggagagtggcggttcagcgtcttgtcgcccaggcgaatcgtgccgctgtcggcatgctgaatgccgaagataaggtcgagaaattcactgcggcccgatcccaccagcccatagatgcccaggatctcaccgtgcttcagctgcaggctgatatcttttatcttgctgcgccaacacaggttattgaccgccagcaagacctgtccgccgggctgattgaatttggcgaactcgctgtcgtactcgccgccaataatgtgttcgatcagctgttcacgggtaatgtcggcgatatagccttcatggatataggcgccgtcgcggaaaatggtgtagctttgctgaagcgtctgaaagattttctgcgcatcctcttcgccaatcgccgaggtgggttcatccatgatgatgatgtcggcattggcatgcgacagcgccttggcgatctcgaccagctgctgttcggcgacgctcaggttgcgcattttttctcgggcgtcgatcttgaaatcgagttctttgagcaggctggtcgtgcgctggttgagcgttgcgaaatcgacgaaccccaggcgtctcggctcgcggcccagccaaatgttttcggccaccgtcagatccgggatcgcgctcagctcctgctgcacgatggcgatgccggcattgagggcttcccgcggatgatgaaattcgcagcgttggccattgataaaaatgtcgccgccatcgggttgaataaagcccatcagaatgctgagaaaggtggatttacccgcgccgttgccgccgcacagggcatggatggatccgcgccgcaggcaaaactccgcattcttgagcgccacgaccgggccgaaggctttcctgacgccgctgacctccagcaggtagcgttgataaagcgtctcgtattgcgcctgcctgccggcgtttggcggcgtgcgcgtggcctcatccagcgcaacgaagcgttggcacagttcggccagcaatgcggcggcgttccggcgcggatcgtcggccaacatcgtcgcccacatcgcctgaatggcgccgcccagcgccgcggtctctttggctttcagacagaccaccgggcatcccattacgtccgcgacgatttgtcgccaggcggcgctgcgggcgccgccgccggtgaggcggatttcgcgcgcttcgatgccctgacggcgaaatag

SEQ ID NO: 65157 - DNA, 105 bp, Glycine max
  Peptide Sequence Number=SeqID_181935
atggccccttacagcaacgttttccgcttgtccagcgccgggaagggacgacgatttgtcggtcgtgaccctatcctccattttcatccgtccctaagtacctga

SEQ ID NO: 65158 - DNA, 519 bp, Glycine max
  Peptide Sequence Number=SeqID_181936
atgggctcagaaatctaccctgaggttcatgagaaccctagagccttcttcagcagctctagctcaatcttcttggagcctcttgctcatggttctagtgactggtcccttcctagggaggattgcatcaatctattcttgtttgtgcttttagaggaagctatgaaaattgctaaggatgaggatggacttaaccaagacggtgaagaaattctcttggcaagagatcgagcgctactactctcagggacagcggagaagacattgacgaaagtaataggcgttggagtggtagaggttttgatgagggtggcaaaggcacgactgttggaattgagtagtggaggggggcaagcaggcggagtacatgttctagagggagttggcacaggcctagagggtggaagagaacgtgtagcaatcagaaggggtgtcgaggtggacttcatttcaacatacaattggagggcttccaacgacatgtcgttgaagttgagggttttgatttatggattatga

SEQ ID NO: 65159 - DNA, 600 bp, Glycine max
  Peptide Sequence Number=SeqID_181937
atgagaaccctagggccttcttcagcagctctagctcaattctcttatagcctcttgctcatggctctggtgactggtcccttcctagggaggattgcatcaagaggttctagaaagactccctatagaatattagatcttatgaatttgaaaaaactaagacgattgaacatacttataaaaggtgagtttgttcttaaagatagggaggttgaaagcatggaagaggcattagaacttgagcatctcaaaatatcatggggtgtgtttgaaacaagtgacaacttggtgggttgccaagaactagacgtagaattagtgatagagacaaaccaatataaatccttgagtgcatatattctttctccttatctttttatattgaatagttgtgatggatttcatgtagcctacttggaaaccccgacaaatgtgagacatagttgcagtgctccattggagcttgtaggcctaggatcttcttcatcaatggattcctttgcttcttggaagatgaatggcagcggaatgaagaaggaagagagagaggagacgccacttcaaggagaagatgagtctagaagaagctcaccaccatag

SEQ ID NO: 65160 - DNA, 732 bp, Glycine max
  Peptide Sequence Number=SeqID_181938
atgtatgcaaattccagcactgcatcaccttcctcattcttccccaaactcactgaactcaacaattctgagaccaattactattattaccacaacaataacaataacaataacaatagtaattgtagcagtggctatagcagttacggtggatcaccctcacccacacctccttctgtgcccattcccaacttgatgcagaggagtgttagctcccattccttccactgcaacaacaatgccacccatcatcccttttctgctctctttgctcagctgctcgactccgacgactctcccgtcagaagagtttgcagtactggtgatctccagaggatcaatggaatgcaacataatcatcactcggatagtccgttatcaagcgaaagtagtatgatcatagaaggaatgagcagagcctgtcgatatagcccggaggagaagaaggtcagaattgagagatacagaagcaagaggagccagaggaacttcaacaagaaaattaagtatgcttgcaggaagacattggcagacagcaggccacgcattagaggacggtttgcgaggaatgacgaaattgacaagaacactacaattcaatggagccaaattggtgctggagaggatgaggatgaagaagatgagaattggatcactatgttagattccatagttgctgcaaattttgctcaagagtctcaaggaagttcctcctttggtttattctattag

SEQ ID NO: 65161 - DNA, 123 bp, Glycine max
  Peptide Sequence Number=SeqID_181939
atggagcattcaccggggcatgcatggtggaggaggctatggcagcagcacaagaaaggagaggtgcgatactgcgtccaagacggaatgtggtgccatgtaaataggaagaggaagatgtag

SEQ ID NO: 65162 - DNA, 927 bp, Glycine max
  Peptide Sequence Number=SeqID_181940
atgggttgctttcgttgcaccggcaaatcaagcaaaaaaaccaacaacattaatcacgccgagaagcacactcctgctgataaggtcaaagttaattcgaatttgaatggtaaaaaagaagataataatcctaagcctgatcagctatctctggacgtgaagtatttgaatttaaaagaggtttccaatgaaggaaaagttaatggttaccgggcacagacatttacttttgctgagcttgcagctgcaacagggaatttcaggttagattgctttctgggtgaaggagggtttggcaaggtttataaggggcgcatagacaaaataaatcaggttgtagcaataaagcaactagaccctcatgggcttcaaggaattagagaatttgttgttgaagtgttgacattgagtttggcagaccaccctaatttggtcaagttaattggtttttgtgctgagggagagcagaggctattggtttatgagtacatgtcattgggatctttggagaatcgtttgcacgatcttccgcgtggtagaaaaccgattgattggaattcaagaatgaaaatagcagctggtgcagctagaggtttagagtatttgcataataaaatgaaacctcctgtcatataccgggatctgaaatgctccaatattctgttaggcgaaggatatcattcgaagttatctgattttggcttggcaaaagtaggaccaagtggtgataaaacccatgtttcgacaagagttatgggaacatatggatattgtgccccagactatgcaatgacgggtcaattgacgttcaagtctgatatttatagctttggagttgttcttttggagatcatcacaggcaggaaggcgatcgacaatacaaagcctgctaaagaacaaaatctagtttcatgggtatgtaaatga

SEQ ID NO: 65163 - DNA, 828 bp, Glycine max
  Peptide Sequence Number=SeqID_181941
atgagtactacaccacaagagaagtttgttaggtttcaggattggaattcagagaagggttctgagagtaattatcctgcaattaaaataacacactcggagagatttagaactacattaagttcagtttctgagaagtttcaaaatggattggaatctggttctgagaggatgaagagatttagaacatcattcaaatcttttccctatggtagtgttctttctagaagctttagttctagaaagaaaatccttgatcctcagggtccgttccttcaaaagtggaacaagatttttgtattattatgtgtcattgctgtatcgctggatcctttgttcttttatgtcccggttattgaggatgcgaagaaatgtctttcactggacagcaagatggagattacagcaactgtcttgagatctttctctgatgctctttatataatccacatgattttccaatttcgtactggattcattgctccctcttctcgtgtatttggaagaggtgttttggttgaagattcttgggcaatagctaggcggtatctatcatcatatttcataattgacattcttgctgttcttcccctcccacaggtggtgattctagttatcattccagagatgagtggttttaaatcacttaatacaaagaacttgctgaaatttgttgttttcctccaatatgtgcctcgtctattgcgaataattccattatataatgaagttacaaggacctctggcattctcactgaaactgcttgggctggagctgcatttaatctctttctttacatgcttgcaagtcatattggacaagactag

SEQ ID NO: 65164 - DNA, 495 bp, Glycine max
  Peptide Sequence Number=SeqID_181942
atgtgggaggattggcacatcttgagtcaaatctggcatcttctatcaaccatcaacaaggtagtacaacacaagaacaagagtactcgtgagacaatggtgcgttggaatctcccagcgccaaattcttacaaactgaacactgacaaaagttcgcttggtaatcctaaaaatgctgcatttggagctctctcgctttcacacagtcacactgaccacgctggccccatatgcctcgaccttgccccaaatcattttggttctccacacgtcgtttctggcctgtctcgcgtcgccgtcgttgtccagcctcgacgtccagatcgtggtgctcgacttcaagcccttaatgttccacgagctcctccacgtggtcatggttggcgtcttgacgctcttgcatggcttcaaaggaagctacttcaaaagcacgtttgtagagttgataaatttggtttctcaagagtcgctgcttctgaaaccgtacatcaatga

SEQ ID NO: 65165 - DNA, 792 bp, Glycine max
  Peptide Sequence Number=SeqID_181943
atgcagaacagtggatgtctcatcgattgcttccagatggcctgcgagagcgaatcagacgatatgaacagtacagatggcaagaaaccagaggtgccaatgtttgagaaaatggacgaacaacttctggatgcaatgtgcgaccttctcaagccagtgctttacacagaagaaagctacattgtccgggagggagatccggttgatgagatgctcttcataatgcgtggcaagctattgaccatgacaactaacggtggaagaaccggcttcttcaactctgagtacctcaaggctggtgacttctgtggagaggagcttctcacgtgggctttggatcctcattcctcacccaaccttcctacctcaaccaggactgtccaaaccctttcagaagtggaagcctttgccctgaaagccgatgacttgaagtttgtggcatcacagtttcggcgccttcacagtaagcagctacgccacactttcaggttctactcgcaacagtggcgcacatgggctgcatgtttcattcaagcagcatggcggcgctatagtaaaaggaagcttgaagagtccctcgtcgaagaggagaataggctgcaagatgcattggctaaagcaggtggtagctcacctagccttggtgccacaatatacgcttcaaggtttgctgctaatgcactcagattgttacgtcgcaatggtacaaagaagggtagggtgccagagagattaccacccatgctgcctcagaagcctgcagaacctgattttactgctgatgaggaatag

SEQ ID NO: 65166 - DNA, 336 bp, Glycine max
  Peptide Sequence Number=SeqID_181944
atgaagaagatccaaggcctacaagctctacatggagctacatcagttgctgttaaagattctagtgtttatcataaagataccgaagcaaccctatgtggagtggatgatatgacaaaacttgcttatctacatgaacctagtgtcttggattatcttagatcaagccatatgatggcacaatataaaggattgggttttcgtgagctaactccacatccttttgctattgcaaatgcaacatacaaattcagacttatgattaatgagggaatcagccaatcaatattggttagtggtgaaaatggggctgggaaaatggaaagcaccaagtga

SEQ ID NO: 65167 - DNA, 774 bp, Glycine max
  Peptide Sequence Number=SeqID_181945
atggttggaacccagaggtccacagcgatgaagacagtttcagaagacaaaagcattggcgcccgcacgcgaggcgcgatccaacggggcgagaccggcgacaaggttcccggtttcgatcctgcggcagctcctatggaaacggacgccgaggcaggcggcagttcccagcctgctggcaagccccagccgcagcccgcgaaggctgatgacagcaacgcttccagccatgcatccggcctgcgggcgtggtcgtccgaaggaaacccgcaaaccgcaagaggaaaagccccactgagggaaggccctgtctatctcgtctggtggttcatcatcgcgatggtcgtcattggttatttcataatctcatggagccgaaccctcgcggacgctcggatactttccgcgcttcgccctggtgatattggcggttgtgctgcttctgttccttggatggagcctgaccggcggcggatcggtatcgcagcagcagggcatagagacgccccccgcgacggattccaacgggcacgggaggcgaccagccgaccaatccgtcagaagggcagaaatgaagggcggaaacggagatcagaaatgaggtcgatcatgaacaagcaaccaaccaccccgcttacggatgatgaagacgtaaagtttcttgccgagaattccgatgtttcaccgcttcaggcgcgccagctgatcgaacgtttcggcagggacagggaaaagctgcttgaagaagcgaagaagtttaaagcggaaggatag

SEQ ID NO: 65168 - DNA, 225 bp, Glycine max
  Peptide Sequence Number=SeqID_181946
atggaggctgcaatgaaacacgacccgaaagccggcaccacggaccagaagccgaaatgggaaggcccgccggaaaacaggcctcgcggctatgaacccgccgttgatgacccggcaaaaaagcgcgacgccgtcggacacaacctgtccgatcccgaccgcaagaacctttccgatgcgctgagtgagccgaagcatgcgggacggaatgacgacgacggatga

SEQ ID NO: 65169 - DNA, 132 bp, Glycine max
  Peptide Sequence Number=SeqID_181947
atggtgggcagaagaaacttttattttatcctggagaacatcaagaatagtttcatctccagcataggaaatatagcttggagcaggggagttcaaagaagttgttttccaggtcacacatgcagcctatag

SEQ ID NO: 65170 - DNA, 414 bp, Glycine max
  Peptide Sequence Number=SeqID_181948
atggttaaggaggagtgtaaggaggtaagtgtctcctccaagagacaaccttcacatcctctcctttgtaaaaagacacttgttagcactgccacacctcttgggcttgaggttattcctcaagtaaaggagttgttggatgagggtttggattcatttcatcatgtcttcactgttaggatttgcaaaataatgtatgtggagggagaaatatgcatcgcacgtaggatcatggaatggaggcttcaattcctatctctaacgtttgggaaccctaatagagcaaccagaggaggagctttagagagcaccaaaaatgccacaattgataacggagaacgcttgaacgactacattgaggctacggagatttggatgacgccactttcagtgaaggaagataagtcagggtag

SEQ ID NO: 65171 - DNA, 285 bp, Glycine max
  Peptide Sequence Number=SeqID_181949
atggctacagccaggacgacgttcctaaatgaaaaatctactcgattcggaatttcaacagacactattgacaacaacgaaacaagtactaacgtaacgactcaaacgatatataaaagaggaaacataaaagagaatatggatctggggatcccactggtcattgtggctccgcatgccaccggactcttgggtcacggtaacaaaaagtggggtggtcgacaaaagcagggcttttgctcctacgtatcctcaatttgtgatgaggaactcagacctacgtag

SEQ ID NO: 65172 - DNA, 414 bp, Glycine max
  Peptide Sequence Number=SeqID_181950
atgtctgttaattcaagcacaagggggaatcccacatcaaaccgtctttgctattgtcgtagaagagctaccattcgaacagcaaggatgacaaggaataatgggatactattttatgcttgtccattaccacaagtaagtaatgttaatgatattgatgttggtgcagttgaaataggtagaatagaaccaataccagactttggtctaagtgtcggttcaactacgctggttcaacacgagaagatcaaatgcagtgaaaaacaaaacccttacctctactggaaagcaccgattgcgtcaatcaacactggaggggtgacgaagaatgacaaccaccaccattgggagagcgatgatcgacgtggacctagcacaggaacgctatccttcaaccataggagggagaaaatg

SEQ ID NO: 65173 - DNA, 231 bp, Glycine max
  Peptide Sequence Number=SeqID_181951
atgacttattttctagattttgttattaatgattgtcgcaacctaccattctgcgggggtgtggaaaggccaagacatatgggccaaatgcatttgtctctgaggaagaaaatgagtggagtcgccaccaacgtttattcgaggaaaccgttagaaaaaccaaaaggacgatggtctgcgggttttgaaaatgagggttcgagagttgtttacgcatggggaaggtattag

SEQ ID NO: 65174 - DNA, 873 bp, Glycine max
  Peptide Sequence Number=SeqID_181952
atggagcagtcagaaaaatcgcccacgaaaatatcaccactaagatcatcatttccgagagatccacgtggctcactcgaagtgttcaacccaaacacttcagctttagcttcaacttcaaccaacgcccgcgtgcgttcacagcctctttggaaatcgtggacggagtcggaagaaccgcgcaatgaaatcgctgccacgtcgtggatggccatcaatccggcggccggagaaagcggcgaggcggcgcagagggcggcggagtgggggttggtgctccggaccgacaccgagaccggcaagccgcagggggtggcggtgaggaactccggcggcgaggaacctaacgccgcgaaactcgccgccgctgcttcgtcatccaggaagaactctcagaactccgccagaacttccggcgactcttcggacggcggcggcggaggcggagggattccgagaatttcggaggatgtgatgggagctttgtcggcttttcaacagactttcgtggtttcggatgctaccaaagccgattacccgatcctgtatgcgagtgctgggttctttaaaatgacgggttataagtccaaggaagttattgggagaaattgtcgttttttacagggtgcggacacggatcccgaagacgtggcaaagataagggaagcattgcaagctgggaaaatttactgcggaaggctattaaattacaagaaggatgggacacctttctggaaccttctcactatttcacccatcaaggatgaagatggcaaagttctcaaatttattggttggaagggttggttgggaccaaaattgacctatcatcagattgcgcatggcacacgaggtgtctgttgcaaattttaa

SEQ ID NO: 65175 - DNA, 1509 bp, Glycine max
  Peptide Sequence Number=SeqID_181953
atgcattgcattgcagcacggcagaaagagaaggctacaagttcagtaactgagttgctgcaggccatgaagcgcccccgagcattaagtgaatccgcaagccgtccctccatcagaaaatcaggatctagatcttcagacgaagaaaaattagaacaagaacaagaagatgacaaagagaaagcacaaaaaacattaagaagaatatctgagagtggagcttcatttggacgcaagtccgaaggatcaggaaatagaatttcaatggaaagaatcagtgaactgcccgaaaataaacacagaaactctcaacgacgttctttcatggggttcaggaggaaaagtcagtccaatgatgaaagcatggatagtgaagtcattgaggacgagagctctgagagtgaggatgatgagaggcctaatagttttgaattagatgacaaagaaaagcagagggaaaagcgaaaaggtcttgatcttgctaccacgcttgaacgtattgagaaaaacttcgtcattactgatccaaggcttccagacaatcctataatctttgcatcggatagcttcttagagcttacagaatatagtcgtgaagaaatcttgggaaggaattgcaggtttctgcaaggacctgaaactgatccagcaactgtgaacaaaattagagaggcaattgacaaccaaacagaagttaccgtgcaactaatcaattatacaaagagtggtaagatttctctgttcaatccaggaaagaagttctggaacctgtttcatttgcaacctatgcgtgatcagaagggagaagtgcagtattttattggtgttcaacttgatggtagtcaacatgtagagcctcttcacaactgcatcgcagaagatactgcaaaggagggagaacaattggtaaaacaaactgcagaaaatgtcgatgaggcagtgagagatcttccggatgctaataagagcatttggcttcaattgtggcatgaccatccttttggcgctctccagaaaccagatgatttatggacaaatcattcaaaaacagttcacccgaaacctcataggaaggatgaccctgcatggaaagctatccagaaggtcctagaaagtggagaacagataggcttaaagcatttcaggccaattaaaccattggggtcaggagatactggcagtgtgcatctggtggagctacgtggaactggtcaatattttgcgatgaaagctatggataagggtgttatgctcaatcgtaataaggtgcatagagcttgcgcagagagagaaattcttgacaagttggaccacccttttctacctgcattatatgcttccttccagaccaaaacacacgtttgtttgattactgattattgtcctgggggagaactattcctgcttcttgatcggcagccgactaaggttctcaaggaagatgccgtgaggtatattatcccaccattgacagatccagaatttctctttgatggtagaaaaaaatag

SEQ ID NO: 65176 - DNA, 261 bp, Glycine max
  Peptide Sequence Number=SeqID_181954
atgaagaagatccaaggtctacaagctccacatggagctacgtcatgccaggctcatgacattaaacaagcacttttcgggaggcatcctatgactttttctaagacaatatgtctgtcagtactatggtcgcggtcaattgaccatgacctatgcattcactatcagaatcgagtacagccatggtcaattaccatgactcaagcagtcatcatcaatgaccataacagtcgtggtcaagtccaccatgattgtggttaa

SEQ ID NO: 65177 - DNA, 279 bp, Glycine max
  Peptide Sequence Number=SeqID_181955
atggaaattttacggaagcattacggaagttccggaagcctcgaaagccattttttaacaaaacgggggaggtggttgccacccagctcacccaggcgagctagattacgtaacgacacttgttttctttccgtaatgtcacaaaactttaccgattacgcaaccatcccctctttgacttccagaatgttgcggaactttacggattgtgcgacaatgctccctttcgacttctggcatgtcgcagaacttcacggattgcctaacgatgggtgttaa

SEQ ID NO: 65178 - DNA, 141 bp, Glycine max
  Peptide Sequence Number=SeqID_181956
atgggtgttgaacattttgaggtggtcaaacaaaggtcgcatgccgacaaacaatggtccccagacgaaattaggatagtttacatacttgctcataaccacaatcatcttttcataccagacacctatttaccgaaatag

SEQ ID NO: 65179 - DNA, 171 bp, Glycine max
  Peptide Sequence Number=SeqID_181957
atgttagccgacgtcggccaaggaaagatgaccgatcgaggtcggctaggtttttttgtgcgagctcaaccgaagttgtttttcggccgacaccggcatgttctcatttactctgccaggaaaacattaacccacctcggcgaaaaatcattattctccgatactgattga

SEQ ID NO: 65180 - DNA, 360 bp, Glycine max
  Peptide Sequence Number=SeqID_181958
atgggcgacataaacgagcttgggaaaattgtggtcggcgcgtttgcacatcctgataacgcaggaaaaggcgcttacctgccgcttgtcggtgatttccttagtttcagggaaattgttggcacacttaatcagcttgggcaccccgtaacctttaaacaggttccacgcgaagtctatgcaggttttttcccgggcgctgaagcgttggcggatacgctggcctattacgaaaaatatacctaccttggtccgggttcgcacgaagcagccatagcacaggcagacaaaatcgctgaatttcagccagccacttttaaatcatgggccagagaccatttttcactgaacagcaaatag

SEQ ID NO: 65181 - DNA, 684 bp, Glycine max
  Peptide Sequence Number=SeqID_181959
atgtgggttttcctaaccgatcgtcaaatcgactgggcccttcttgtgagatatcccatgcataaggcattgcgatcaaatgctccactcccttatccccatctgatcaccttgtttctacaacattttaatgtccctcttgactctgagccctttgtcaaagtcaagagatccttctctatcggtgcgaatgtagtctcctttttcggataccgcaaagagagggatggctcttgggtgaagaaggatgctccagtacaggccgctgaagaccactctccatcaccatattctcagagagatgactcttcatctcttatgcacagcattcttgacaagttggatggactccaaaccttcatcggtgaacactttgactcgttggatagccgtattgatgccatggatgcacgatttgtagggatggacacacgtatcaccaaacttgaggaggatgattattatcatcaaaaagggggagattgtggaagcaatgccttccaagattattttgatgatgccaaagaatcaagagtcaaacaagtttcaagaatcaagatcaagattcaagattcaagaataattaagatcaagattcaagattcaagaataatcaagatcaagattcaagtaaagaatcaagaatcaagaatcaagagaaaactcaatcaagataagtattaa

SEQ ID NO: 65182 - DNA, 348 bp, Glycine max
  Peptide Sequence Number=SeqID_181960
atgctcgcccaggcgagctggttgcttccaccagaaggcaccgccttcttttggaaacctcaggaaggcctaagtgggcctggttgctatttgcacccccttttcactaaatacacctcacttttgtgtttttttattgatttctttccgaaacattgcggaactttacggattacgcaacgacacctattttccttccagaatgttgtgaaactttacggattacacaacgatgcttgtttcgagggttccgaaggtagcaaacaaggttcaaggaccaaccgcaagtactcccggacgaaattagggtatgacagttgcccctctttacttatcttttattggtga

SEQ ID NO: 65183 - DNA, 177 bp, Glycine max
  Peptide Sequence Number=SeqID_181961
atgccatatccctatatgaaagaaggacagaaattgaacattcacccttttatgagatattatagtcatgaatggctaagtaaagattcacatagacttccccaacatcaagatgtagaacttactcttgaaagtgttggatcgagtggcctcagaataattaagaaggggggttga

SEQ ID NO: 65184 - DNA, 1046 bp, Glycine max
  Peptide Sequence Number=SeqID_181962
atgagtggcgtgatgcaattgcagtgcgtcattatttgcctgctccggccttcgttgtctgcaattttgactgcgaaatgcgctgcttctgccaggtgcggcggtccttggaggaatcgtgcaattcttctccaagtcgtgattcttgtgattcataacaccaaagaggatgcacaatataaggagaatgaagatcccatggaaataaaggatattgtagaagatgcctatcatccaacggtggaagtgtccaatcctagatgcaaaatggaagaggagcatgcccttaatgatgctaaacaaaagagccttgttatcaagcttgagtgtgtatacactccttatccgagaatcattagacacaaaaaatctttaattctagaagaggttccaacctttgatgaggacatgaccaagagcaagggcaaggatccacttgaaggacttgaaggacatatgacaagggctagagcaaggaaagccaaggaaactcttcaacaagtgctgtccatactatttgaatacaagcccaagtttcaaggagaaaagtccaaggttggcccaattggcaacctaggcatcagccttttgggagaccaaatggtggctgacttgttggctgttggggaagctgaaggctctggtctttctcatgaagacagagatgagatccccactagtggagttgggcaagttcaacatcttaggttcattgacgctacacaagaacgaccggatgctactactcttcaaatcaatgaagtcctatctgatctacctgaggaagaggaagctcacttaaggcaagaagcatcccttgaagaggttcgacatgaagaacccaaagtcacttcttctgaagtcactttggaagatccaaagcctcaaccctctgttaaagcacaacaacaagtggcaagcccaatcagtgttcatcgtccaccacctgcattggatgtcaacaacattcaagcactcatagatcaatctcttcaagcccatgatgctactctttgtgcccaacttgaatcccaaaatgttgcttg

SEQ ID NO: 65185 - DNA, 207 bp, Glycine max
  Peptide Sequence Number=SeqID_181963
atgatagggagaggaaagaaagagaaccaacaaccactttctttaaccagtctcacaaacttgcatctagaatgtgattgtttcgagagtgagacagcctctagtgtaggagtcgttgctttaggagatctggtaacggcagcgacgctggtggcagtcgacgtcgtcgagctactcatagatggtggaggagaggacccagtttga

SEQ ID NO: 65186 - DNA, 277 bp, Glycine max
  Peptide Sequence Number=SeqID_181964
atgcccaagtccccatatttccggttccctacagaggcaatcctatccgaaagactgtcggacactaaatgtggaaacctctctacagggattcgaaccttcgttcgccacgttgctgggactataagcgcaagtccccaggtaccgaccggcgcaggatttgatggtgtggatcttgaggaggaggacgaggacgctggccaaatgggtcatgcgactaagggtgtgtgtggccgttgcatacaagcagagaagcagacttcagaacatgccccgg

SEQ ID NO: 65187 - DNA, 214 bp, Glycine max
  Peptide Sequence Number=SeqID_181965
atgatgctgatgttcgacaaatgttcaacatttttttacaacaacccatcactaccatttgtggagttatttgccataacctgtcacaataataacccaccaggcaaccaacatggctcaacctctaatcttgaggacttatcagatgaatacgagacttgttgggtcaaaaaccatgatagtgatactaactcctcttctgggcccgaaggaa

SEQ ID NO: 65188 - DNA, 475 bp, Glycine max
  Peptide Sequence Number=SeqID_181966
gcctaagaggcttagtggcagtgttgggcccaagaataaggactctgtgagacttgatgttcgtgattcgatgttaaacacaccgtcgaatctcccattcttcattgatgccattgagacacgatgggaacatgatgatacgcttcatatggatcatttctatgggttcctctattgtcgttgtgcgccaatagatgtcattattccttctgagtcacattcactacctacagatgatatgatgtccttttctagatctaactcttcatctaaggatacgaagaccatttctcctactctgatgtctcatagatcaatgttgcatgagtctcaagtacaacttggggacgagggagaggaattggatgaggacacatcttttgaggaggatccatcgatggatgaggaggaccctgtcacagagccggagtttatgaaggaggattcttcacatgattcctctaaggagtcttga

SEQ ID NO: 65189 - DNA, 258 bp, Glycine max
  Peptide Sequence Number=SeqID_181967
atggcgtcaacccaaaaactctacagcctgtatcaagcgatccgcgccccagcacgtatcgttgtgcgcaatatggctattacatctagtttctatgtaatacatcactataccaataatacaaaggagcgggttcctctaagttgcatcttgggaatatgtgtgcgaataagccaagtgcagctaaatgacttgatcaattacccaaacaaaattgggtacaatgcttcgatggggggaaacgttggggacatatga

SEQ ID NO: 65190 - DNA, 597 bp, Glycine max
  Peptide Sequence Number=SeqID_181968
atggctcaagcaattacattgctcatattccagttcaacaagatcgaactaaacacattgaggtggacagacagtttatcaaagaataacatccaagctgagaatggagaattcatgttcatctacttgagggggaacattcttggtaaatattatgtgctacaagttgtgaagtgtctgaagcatgcttctaccagtgatattccagtgtttgacaaattaatccagctggaaatttcattcggaaactattcatgggatttgttagcaagcttgcttcaacgttcccacaagcttgaagttcttacaatttataaggaaccacaaaaatatgcaaagggacaagagccaagatggatccatccactgcttgttcctgaatgccttttacatctcaaaacattctgcctaagagagtatcaaggattggaaactgagctggattttgtagggtatattatgcaaaatgccagagtgttagagacaatgacaatctacatatcaagttccttaggttcagaggaaaagctccaaattcgcaggcatttatctatacttcaaaggaactttgaaacctgtcaaattgtattccattga

SEQ ID NO: 65191 - DNA, 867 bp, Glycine max
  Peptide Sequence Number=SeqID_181969
atggcggaatcctccgagccaccgtcgcatcggcagaaaccaaccaccggcgatgacgacagaatcagccacctccccgatgtgctcctcctccaaatcctctccctcctccccaccaagcaggccgtcatcaccggcattctctccaagcggtggcgtccgctctggcccgccgtctcggtcctcgacttcgacgacgagtcctccccggagttccaccatcccggaggtctcactggcttcgccgaattcgtctactccgtgctcctcctccacgacgcgcccgccatcgagcgcttccgccttcgctgcgccaaccctaactactccgcgcgcgacatcgccacttggctgtgtcacgtggcgcgccgccgcgccgagcgcgtggagctctccctctcgctctcgcgctacgtggcgctcccgcgctgcctcttccactgcgacactgtctcggtcatgaagctcaacggcgtgttcctcaacgcgctcgcttctttctccgtctctttgcctctgctgaaggttctgcatgtcggggatagggttctgtttggttgtcacgattatgtggtgaagcttctcgctgggtgccccgcgctcgaggacttggtgctcgaatcaacctacaacgatgcctgcggaggtgtcgtttgcgccgaggggaactttcagctggatttgaagcacttgtccagtgccaaaattgggttttcttggaaggagaggtgcctcaagtccatgcttttgattttccgagcgctctctaacgttcgatgcctctcgctttcgacctccacggttgcgacagagcaagggcaaagaggggttgaagtgatgcaaaacagagttacagtgcaagcctaa

SEQ ID NO: 65192 - DNA, 622 bp, Glycine max
  Peptide Sequence Number=SeqID_181970
aggactacacgtcctcgccttcagagggctacacgccctcaccttaacagaacgacacttcctcaccttcagaggactacacttcctcaccttcagagggccgcatatcctcgccttcagaggactacacgtcctccccttcataggactagacgtcctcgccttcagaggactacacgtcctcgccttcagaggactacacgtcctccccttcataggactacacgatctcgccttcagaggactacacgtcctcgactatagaggactacacgtcctcaccttcagaggactacacgtccctgccttcatagggttacacattctcgccctcagaggactacatgttctcgccatccgagggctacacgtcgtcgccttcagaggactacacgtcctcgccttcaagggactacacgtaatcgccttcagagggctacacgtcctggccttcagagggctacacgtcctcgccttcagaggactacacatcctcgccgtcataggagtacacgtcctcgccttcagaggactacacgtccttgccttcagaggactacacgtcatcgccttcagaggactacatgtcctcgccttcagaggcgtcacctttacaggatga

SEQ ID NO: 65193 - DNA, 219 bp, Glycine max
  Peptide Sequence Number=SeqID_181971
atgtcgcagaggagcaatgcatcatcatctcgaacaagagtttcatcacaagttgttcttttttgtggttgtggtagaagggctgttaggcgtgttgctggaacaaatattaacagaggaagggcgtttttcacttgttcaattaataagggtttctatttggggcttttcaggatgaagttggatattgtgggtactttatttgggttgatcaattga

SEQ ID NO: 65194 - DNA, 228 bp, Glycine max
  Peptide Sequence Number=SeqID_181972
atggcagctcgcccaagcgagttgttgcttcatcctgaattaaccttctcatccaagctagctggttacttcacccctaagctatttgggggcccaggcgagccagaggctagcttgagtgagccagggttcagaaaaaagcttgaaatgacccttttacccctctctttcgctggcgttcaacattgtaagtcgactagcaatgatcaaaagatcaacaaacgatag

SEQ ID NO: 65195 - DNA, 243 bp, Glycine max
  Peptide Sequence Number=SeqID_181973
atggctcatggtggccaccagtggtcgtgggtggtggagaaggtgttagggtttagtgagatcgtctcgctaagcgggagtctactttttgagcttagcatgacaattcgcgctgagcgcaacaccccttgcgctaagcatgacaattctcactcagcgcaattctctctcaggaacctccagccaaaatctgaagacgatccaacggttatcgaatccaagatcgtgattttactgaaatag

SEQ ID NO: 65196 - DNA, 807 bp, Glycine max
  Peptide Sequence Number=SeqID_181974
atggggaaagcccgtctgatagcactttgtgtgtgtacttcgaaagggaattggtctgcccatcctagaaacagctcagccaaaggcaagggaagtcgacaaaatggatccataacctcgggggaaaaattggctctaaaggctaggcacgggggccctagtcccgaacctgtcaactttcagtggaccgctcaagttgcttccatggtgagagcgggttgtcacatgccggtcgggggacgaattgggaacggccccttcagggcctcttccgaaggcgtcaaacagccaactcggaagatgagtactgctactaatcaagcagcagaacaaaaggatgaaaccaaacctctatggagatatgtttcaaaatttagaaagactactggtggtggaaattttgagtttaaatgcaacatatgtgaagtttcattcaatggatcttacactaaagtaagggctcacttgctgaaaaatctcaagaataggatctctaatgaaggcaaagagacaaacattggtgctaatccaaaaatcaaaggtcctttagcaaattctttcaatgtgcaaggcagagatattcttgattgtgaaattgcaaggatgttgtactctttaggtctaccatttcatttgacaaggaatccttattataggaaggcattaaactgctctagtgaggtaaaagacaaggatttcattgataaacacatgagagatgtaaatatggaggttaggccatcaaatgtggtgcaaattgtgactgacaatgtagttgaatgtaaggcagcaatttttctcatagag

SEQ ID NO: 65197 - DNA, 216 bp, Glycine max
  Peptide Sequence Number=SeqID_181975
atggcttttcgcttctatcaaccttttgttttgggaattttgtttgttgctttggttttgggttcaggaccagtaacaggattaagtccaccaatcttttcttgcgtagggaaatgcaaaactgctgcagattgcaataatatttgtaagccaaattgtacctatccagatggggtatcatctaacagtagttcgtttctttcaaacattggatga

SEQ ID NO: 65198 - DNA, 1269 bp, Glycine max
  misc_feature (11)..(11): n is a, c, g, or t
  Peptide Sequence Number=SeqID_181976
atgccggaggngatccgccgctttcaggcgcgttacccgcgcgtgcgcatcattctgagggatagcagcgtcggaaacgtgatggatgcagtgagcagcggacaggccgatttcggtatctgctttgcgcgcaatttaccgccggagctcaccttcacgccgctggtggaagatgtttacgtcgccgcctgtcgccacgatcatccgctggcgacgcgccagcagctcagctggcaggagtattttgcgcaggattatgtggcgctggataagtgcgctggcgcatcttacgcccgcccggcaaagtatctgcgaaacgcgccatgtcacgacgctgctggggatggtagaagcgggcatcggcattgctgccgtgcccgcgatgtcgatgccggcgaacgggcatccgctgctgcgccagctggcgctgaccgatccgcaggtcacccgttcggtaggattaattcgccgcagcggacgtatgcaatcttacgtcgctgcggagctggaaaagctgattatcgaacagtctcagcacgcttaacgcgcggtttgcaacgtcagcgcgcggcggcgatacagcgcggtagacaccaccggcgtgaagccgccaaacagcgcggttgccaggctgtaggccagcgagaaaccggcgacgcgcacttctgccggcatcacttcggtcagcgccgggatcatcgcaccgttatacaggccgtaaataaacgacagccacagcagcacgctcagcatcatgctgaaggtcggcgtctgcgccagcagcgtcagtgccgggtaggcggtcgccagcgccagcagcgtcatcgccagcagcaccggtttacgcccaaagcggtccgacagcgcaccgccaattggcagccagataaagttggagatcgccaccagcagcgtcaccagcaggctgtccgaggcgctcagcatcagcacttttttgccgaaggtgggcgcatagacggtaatgaggtagaacgcggtggtggtcatcgccaccatcagcatcccggcaatcaccaccggccagttctgcaacagcgtgctaaatacctgacgcatatccagatgatgacggcgcgcgctgaactcctgtgtctcttccagacggcggcgcagaataaagataaacggcacgatcaggcagccaaacaggaacggaatacgccagccccagcgctgatggcgctctgctccagcgcggcattgagcgcgaagcccattgcggccgcgaccatgatggcaacctgctga

SEQ ID NO: 65199 - DNA, 753 bp, Glycine max
  Peptide Sequence Number=SeqID_181977
atggctccgaaaaagctttccgcgaagagatctaggagggacgccgcggctgaagggaccagtgccgctcccgagtttgatagccaccgttttaggagcgctgagcaccagcagcgtttcgaggccatcaaaggatggtcattccacagagagagacgcgtccagctcagggacgatgagtacacagattttcaggaagaaatagctcaccgacagtggacatcactggtcactccgatggctaagtttgacccagatatagtcctggagttttatgttaatgcttggcccacagaagagggagtgtgggatatgcggtcatggggtgacccgctagtgctggaggaaggccaggagtgtgagtttagtcagaggaggaacagggtcgataggttcgacgaggaggccattgcccagctattatgcatactgggtcaggatttcgcccggatcgctgccgagaagcgggtgcagatcatgcgcaccatcatgaccaccctgacccagatgtggatgacattgctgctcagcaatgtcctgcctagtgatcataactccaaccttcctctgtcgaagtgtcagcttgtgtatgccatcctgacacggatgagcgtccatgtggctcagttgattgctgacgccatctatttatttgcaggtatgccacccaccaggcaccctctagacccggataagtctaacagggccctggggtttctagcattgatcacgggcctctgccagtcattcggg

SEQ ID NO: 65200 - DNA, 470 bp, Glycine max
  Peptide Sequence Number=SeqID_181978
ctaaaaggaccaagtggggaagaagctaaggtccctaaggaaaatgaagaagtgcaagccttgaaagtaaagcttgaaagaaggagaatggtcaagaaaaagctaaagatgacagtcattaggggaagcaacaacaagctcaagcttagaagggccgaaagggacgagtcaagggtggtaagcatggcattaaaggataaattgaaggcttgtcataggtcaaagagaagtttgaccgaacaatcgagtggaacggaagagaatatgttgacgatcattgatcagtataaggagaaggtaaacctagctgctagtcttaggcagagactagaggatgatcatgcgaaggtattgactctacaaatggaaagggaagcaagagagagggtgatagaatcattacgctgggaagctgtgaaatggatggatagattcgctctcactctgaatgggagtcaagagcttccaag

SEQ ID NO: 65201 - DNA, 345 bp, Glycine max
  Peptide Sequence Number=SeqID_181979
atggtctctaatgaccatgctgatatgatcggcagattgcttgctgaggatgaaccttttgttaagcgaaaggatgtggatgtgcgtaaacacaaccttccacctccaattcctgaagaccacatgagcttaggtatcttcgggcttaaacacaacctgccaacaccctccccgccaccgcaatgggattcctcatcttccttattgaatgacgttctcactgagcttaggtatctttgggctttcgccggtgatcatttcaatgctatagactcacgcatcacgcgtcttgaagacgacatgagcttcattcatcgtttctttgatcctcctgcagatccatag

SEQ ID NO: 65202 - DNA, 537 bp, Glycine max
  Peptide Sequence Number=SeqID_181980
atggcttcccaaatgtttaaatctatagcctctatgaagatttgcatacgggacaacgatctcaacacagaagattgtgtgaagaatccctggaggatttgcaacattcaacaaatggaagaagtcaaatgtttgatcaaagtgcttccaatccgggctttaggcattctctgcttgattcccataacacaacatggtggccctaatcaccataggcttgctccccaatcatcattgttctacagcactgagtcaccagataaaatgaaaaggataggaaactctttgcaatatcttgtggtggcattttcaatttatgttggaaccttggcggttaatgttgtgcaccaactgactcgaaagcatgatggaattgattggttgaatgatgacatcaatgctggaagattggactactattgcttcctcgtggctaggttagctttgattaatctcgtatatatcttgttctgtgttaaacattaccgttataaggttaatgtcgaagaaaaagttgtggagaaacttgagccttga

SEQ ID NO: 65203 - DNA, 476 bp, Glycine max
  Peptide Sequence Number=SeqID_181981
gaccgtatctcgcaccatcgacgacccctagcctcttcactcccttccacttctcctccatcgatggaaaaacctcgtgcgccgctatcgacggtggcctggtgatgaacaattcggcagcagctgccgtcacgcatgtcctccacaacaagcgcgatttcctatcagtgaacaacatggaggatctcctcgtcctgtccatcagaaatggagctcaggcgaagagaatgaacaatgccggtgagtgctcgacgtcgatggtggttgacattgcgctcgacgacatttccgagactgttgaccagatgctaggaaatgccttctgttggaatcgtacggactatgtcaggattcaggatgaggagatcctccacaccattcatcgatgggaaatcgcgcttgttgtggaggacttgcgtgacggcagttgctgccggattgttcatcaccaggccgccatcgacggtggtgcatga

SEQ ID NO: 65204 - DNA, 354 bp, Glycine max
  Peptide Sequence Number=SeqID_181982
atggtcattctgcgccttttgtcatctagaggcggcgagcccgatgacatgcggagacaaattatggtcattctgcccaaaggcgattgcgtccgatggcgcgcagagacaaattatggtcattctgcgcctttccatccaggctcgatcgtgtctgatggcacgcagagacaaattatggtcattctgcgcccttttgtcatccagaggcgatcgtgtccgatgacacacagagacaaattatggtcatccgcacgcttttgctatctgagcagcgagtcgagtgataaacacgcagagacaaattatggtcattctacgccctttgtcattcaggagcagcaagtcgagtga

SEQ ID NO: 65205 - DNA, 165 bp, Glycine max
  Peptide Sequence Number=SeqID_181983
atggggcaaaacacaccgaataaaatagatgatgatggctcaaaatctcaccaaggagaaaaacaaggattttggaaattcaaatttaggcccttccggaacattttgaaaattgggttgcttaaggaggaagcaactgggcagcaagctcctccacgttgttga

SEQ ID NO: 65206 - DNA, 189 bp, Glycine max
  Peptide Sequence Number=SeqID_181984
atggatgaactgaaggatttgatcaagcaagttgcgcctcgtcggactcccccttatggtgttgatgaaacacaaatggtgctcattgagtctaactactggaaaaagattgggccaatagaaattttagctgtttttagtaaacctgtactgcaaatggaagacgagttgtccttgtcgcaaaattag

SEQ ID NO: 65207 - DNA, 2434 bp, Glycine max
  Peptide Sequence Number=SeqID_181985
gggttataaggttggcttggtggtgaagggagaagggaagggggggggaaggataaggaattgtttgacacagttgtatgctaaagacataacaccggacgataaacaggagcttgatgaggctttacaaagagagcattgcagaaatgctatgatattattatgctcttcttgcatgaagattcaagctgcatttcgtacggatgaaattcgaaggacccctcctacaccacaagatgagatgagagcaggaatgagctactttcacgagacgatctggaaaggcataccaaaatttttgcgccgggttgacactgctctgaagaacattggcataaatgaacgtgttccatataatgcccctgttattcaattctcttcttggatgggaggagatcgtgatggtaaccccagggtaactccagaagttacaagggatgtgtgtttgctggctagaatgatggctgctaatttgtacttctctcagattgaggatctcatgtttgagttgtctatgtggcgctgcaatgatgagctacgtgttcgttctgatgaactccttagctcctcaaagagagatgcaaaacattatattgagttttggaaacagattcctcccaatgagccgtatcgtgttattctcggtgatgtaagggacaaattatataatacacgtgaacgtgctcggcagttgttagccaatggaagctctgaaatccctgaggagactaccttcacaaatgttgaacagttcctggagcctcttgaattatgttatagatcgctgtgtgcatgtggtgaccaaccaatagctgatggaagccttcttgatttcttgcgccaagtttccacatttgggctttcacttgtaagacttgatatccgtcaagaatcagatcggcacactgatgttatggatgctattacaaaccacttagagattggatcttatcgagagtggtctgaggaacgcaggcaggaatggctgctatccgagctcagtggaaagcgccctctctttggtcctgatcttcctaaaacagaagaaattgctgatgtattggaaaccttccatgtcattgcggaacttccttcagacagctttggtgcctatatcatctcaatggcaacagctccatctgatgtgctttctgtagaacttttacaacgtgaatgtcatgtgaagcagccattaagggttgttccattgtttgaaaaacttgctgatcttgaggctgctcctgctgcggtagcccgcctattctctatagattggtacagagaccgtatcaatgggaaacaagaagttatgatagggtactcggactcgggaaaagatgctggtcgtttctctgcagcatgggcactatacaaggctcaagaagagctcataaaggttgcaaaagagtttggtgttaagctcacaatgttccatggcagaggaggaactgtgggaagaggaggaggtcccactcatcttgctatattatctcagccaccggatactattcatggctcacttcgggtaacagtgcaaggtgaagttattgaacagtcatttggagaggagcacttgtgcttcagaacacttcagcgcttcactgctgctacacttgagcatggaatgcaccctcctgtggcaccaaaaccagagtggcgtgccctcatggatgagatggctgtcattgctacagaggagtatcgctccattgttttccaggaaccccgtttcgttgagtacttccgatgtgctacacctgagctggagtatggaagaatgaacattggcagtcgtccgtcaaaacgaaagccaagtggaggaattgaatcacttcgtgcaatcccttggatctttgcttggactcagactaggtttcatctacctgtatggcttggctttggggcagcatttagccatgttattaagaaggatccaaagaatctccaaatgcttcaagatatgtataatcaatggcctttcttcagggtcagccttgacttggttgagatggtgttcgccaagggagaccctgggattgcggctctttatgacaaactcctagtgtcagaggaactgtggccatttggcgagcgattaaggtctatgtttgaagaaaccaagagccttctcctccaggttgctggacacaaagatctccttgaaggagacccctacttgaagcaaagacttcgacttcgcgattcatacatcacaaccctcaatgtcctgcaagcctacacattgaagcgaattcgtgatcctgactaccatgtgaagttgaggccacatttgtccaaagactacatggaatcaaacaagccagcagctgagcttgtgaaactcaaccctacaagtgattatgctcctggtctggaggatacccttattttgacaatgaagggtattgctgctggcatgcaaaacactggttaa

SEQ ID NO: 65208 - DNA, 603 bp, Glycine max
  Peptide Sequence Number=SeqID_181986
atggcttctattgatgctcagttgaggttgctagcaccaagtaaggtttctgatgatgacaagcttgttgaatatgatgctttgttgctggaccgtttccttgacattcttcaggatttgcatggcgatgatattagagaaacggttcaagactgttatgagctgtctgctgagtatgaagggcagaataatcctcagaagttggaggaacttgggaacatgctaactggtcttgatgctggggattctattgtgatttccaagtcgtttgctcatatgcttaatttggcaaatttggcagaagaagttcagattgcctaccgtagaaggattaagttattgaagaagggtgattttgctgatgagaattctgctatcactgagtcagatattgaagagactttcaagaggcttgtgaatcaactgaagaagacacctcaagaaatctttgatgctttgaagagtcaaactgtagatttggtcttaactgctcatcctactcagtctgttcgtagatctttgctgcaaaagcatggcagccagaggagtaatgttagtccatttgttaagcatttatcaattagttgtgctgaaagtcaatga

SEQ ID NO: 65209 - DNA, 906 bp, Glycine max
  Peptide Sequence Number=SeqID_181987
atggctataccactcaactccccttccacacctcctgagtcagcaacactttcttcattgtcttcgtcgaagaagactagaaaagcaacacgacttagattgttggctactagaccaactggggtggaaagaccagtggtccatgttgatcctgttgtttgggtggtcggcaagttcgctaagcgagattggctcgctaagcaagacacatctctgactgatcttcttctaaggttttccaacatgctaagcgagctgtatgcctcacttagcggatttcactcgctaagcggatctgcctcgattgtcactcgcgataaggtggatgttatatatgataattggaaacaagtcattgttgctcaaaaggatcaaatctggaggatattcaggaagtttaagtcaaatctgacctctaaatgggccctggcacacaacaagaagggcaaggatgacaaagtctacgagaagtacggaataagcaaagagaagatgttcgaacgaaggcataggccactcaaaaacaaaacattgcccctcacgtgttgtctcgcctcacgaggaagctttatcgcccatagacgtcaggatatattggctgctgctattgggcgaccagagcaccctagtcgtgtctgtgctgctagagccacaactgacacaaatgatcatagaccagtgggaggagttgattacacaaaagtgactcaacaactaatgatgtccttcagccagatgcagtcgcaaatgcaatcacaaggaatcgcactgcctcctgaggttaaggttggtccatctgcttcttgtgtcaacacaaagaaaagttatgtcgattcctcgaggcaggactcagaaacatgggactcgaacaaacgtggcttgtatgccgatgacagtcctccctga

SEQ ID NO: 65210 - DNA, 267 bp, Glycine max
  Peptide Sequence Number=SeqID_181988
atgggtgatcaagccacaagcatgcaagaaataacgagctgggcacgagaagggacaaatgactcactgagcaagcttgcagcacgctgggcccggtcatctgtgactggtcctcttctaggatttccccacgcgctaagtgggctgagtgcctcgcttagcggatgtcactcgctaagcgcatatgcctcacttagcgagacaccagctgcttcaccttcttcttctcttagcctgaaattgaagtttattcacattagttcataa

SEQ ID NO: 65211 - DNA, 871 bp, Glycine max
  Peptide Sequence Number=SeqID_181989
agaactacacgtcctctccttcagaggactacacatcctcacctttagaagactacacgtcctcacattcagaggactagacgtcctcacctttagaagactgcacatcctcaccttcagaggactacacgtcttgacctttagagggctacatgccctcacttttagaggactgcacgtcctcaccttcagaggattccatgtcctcacctttagaggactacacctccacgccttgaggactacactttctcaccttcagaggactgcacacgccttacacgtcctcacctttagaggactacacgtcctcaccatcagaggactacacatcctcgccatcagagggctgcacgccctcacctttagagggctacacgtccttgcctttggaggactgcacgtcctcaccttcagaggactgcgcgtcctcaccttcagaggacagcgcgtcctcacctttagaggactgcatgtcctcacctacagaggtctacaggtcctcatcttcacaaggctgctcaccctcgccttcagaggattacacgtcctcaccttcagaggacaactcgccctcgcctttagagggttgcacgcccttaccttcagaggactacgcacgctcaccataagaggactttacatcctcacctctaggggaccacacgttctcaccatcagagtgccgcacgcccttaccttcagaggactacacgtcctcacctttagaggacgacacatcttcaccttcacaggactgcatgtcctcaccttcagaggactacacgtcctcaccttcagagggctacacgccctcaccttcagaggactacacgtcctcgccttgaggactacatgccctcacctttag

SEQ ID NO: 65212 - DNA, 348 bp, Glycine max
  Peptide Sequence Number=SeqID_181990
atggtgtccggtgcgcccccggcggccctggaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 65213 - DNA, 801 bp, Glycine max
  Peptide Sequence Number=SeqID_181991
atggcttccaagaagcgtaagagcattggggcaaggccaactgctcagtatgacactagacggttccattcgcttgatgcttggaaccgttatatagataacgtcttaggaaggagcattttgccagagaggaagctagagatataccaaacagagtttgatgacttcaagacagagttggagaggcataatcttcacaaacgcctcaccaacttggcagatgggactattggtgttgctttgcaagccagagttagaggccacttggtgaagatagatgccgacaacctcaacacatttctggagactcctgtagtcctagaggagggggagacattacccacctactctaggtactgcaggttaccatcagaccacagagagattgaggttgctctttgcatagcagggataaggttcattttaaatgctgagggccatccggggaggattcttaggaaggatgtgactaccttggcccaggtgtggactgttctctattactccaacctggcccctacatctcatacatcagaccttactgtagacagagctaggttgatctttggcctggtctctcatatggacatgaacatcggcgctctcatctcaggacagatgacttccattgcccagtctaactcttgcagacttgggtttcctactttgattacaaccttatgccgagcccgaggggttgtctctgacaacctcacatttgagtgcctgagcccggccattaacttgacctacatcaggaagaactgttggaacgttgatgatctaacagttgctttttga

SEQ ID NO: 65214 - DNA, 270 bp, Glycine max
  misc_feature (91)..(91): n is a, c, g, or t
  Peptide Sequence Number=SeqID_181992
atggctctggaatggtggtctcagatgaagcatcctatacctgttggggtacttgggctgtgggaccttcaccttccatatcaagagaagnttgggccccaggccaggctaccctctctaagaactactctactaataggatggatcctggaggagctaccctctgtaggctttgcagcaatagaatctatccctgatggatactttgaagtatggcttcaaagcgctaagagtcaacataagctggaactgaaagagttgcagaagtag

SEQ ID NO: 65215 - DNA, 417 bp, Glycine max
  Peptide Sequence Number=SeqID_181993
atggagaggaagattataacaatgatagtggacacattaccagtgttctactatgagaagatggtgggttacatgccttcaagctttgtggatctggtatttgcgggtgagaggattgaagtaggcctaagaagaggcaagttcgattatgtcgcttcaacaagtgcgggaaataagaagaccagtacaggtggagctaagaaaaaagagggagatgcccatgctataaccgcaactcccacatggacaaagtcccaacaaactcctcacaaccccacttaccaatatcccccaccccagtacaattactcaaccaatatcggatctcctcccattccgatgcccatccaacagagaatgcccactcaaccacaaaggcctcccccacaaaacccatttcttgcacaacctcgatga

SEQ ID NO: 65216 - DNA, 693 bp, Glycine max
  Peptide Sequence Number=SeqID_181994
tgaagctggctatggcagctggaataggcaacgttacgtcgccgatctttctgcaccgctgtcaccggaaggcaacgtgcgcggtcgcctggtggccggctatgaagacaaaaacagcttcattgaacgctacggcgccgataagaagtttatctatggcgtggtcgacgctgatgtgacggacgccaccagactgtctgttggttatgaattcagccaggtaaataccgattcaccgatgtggggcggtgcgccgcgctggtacaccgacggcacgcagatccactcccgtcgcggctataacaccgcacctgaatgggcttacaacaacaaagaaaataaaaaggtctttgttaacctgcagcagaatttcgataacggctggaacatcacccttaacggcacgcataacgagatgttcctcgacagcaagcagctgtatctcgacggttacttcgataaaaccactggcgcaggcgtctctggttatgccggctatccggtggtgggcggaaccggctacaacaccggcaaacgtaaggtggatgcggtcgatgccttcgccagcggtccttatgaactgctggggcgccagcatgagctgatggtcggggtgaactacagccgtcaggacaacaaatattacagcgcctgggccaacatttcgtcagccgagctgggcaacttcaacca

SEQ ID NO: 65217 - DNA, 582 bp, Glycine max
  Peptide Sequence Number=SeqID_181995
atggcggtggtggtggtggggcagccgcatcctgctggccgatggccgtgcgtgatgcgcgaccagcagcactgcgtcgggctggcggtgaatcatttgctggcgcgcggcctgcgtgatatcgcgtttattggcggttcgcgcaaagtgtgggtgacgcgcgagcgcgtcagtcatttccacgccacgctgcagcaggccggcattacgccgcgcgacagctggatctgcctgaataacttctatcctgaacacggctatcaggcgattgatacgctgtggcagcaggcagagcaaccgcaggcgctggtggcaatcaacgatcgcgtggcgatgggcgcgatccgcgcgttacgcgatcgcggcattgacgtgcctgagcaggtagcggtcatcagctgcgagcgcttccccggcagcgagtattttatcccgcgcctgaccagtgtcgatcaccagaatccgcagctggggcaaaacattatcaccatgatgatggcgcagctggacggcagcttaagcccgcacgcgcgctgcagcacaccgctaaagccggtattgatccccggcgaatccgcctga

SEQ ID NO: 65218 - DNA, 322 bp, Glycine max
  Peptide Sequence Number=SeqID_181996
atttaagtttcgttcacaattacgccaatcatctgtgttggatgtgagtgaagaactccatcatattcaatcattgatagtcacccttgggttgaaggaacaattaagtaagggaaaaggaataactgttgagccagaaagttcaccaccaatttttgttcccacgccatcgttgtcacagtcttctgattacgatcctggaaattctacctgtttaactccaaccaaaaggattagttgtcagcaaaccagttctgattttgattctgatgagcatgcacagtatcagttatcaactaacaaacatatcaaggctgagtaa

SEQ ID NO: 65219 - DNA, 243 bp, Glycine max
  Peptide Sequence Number=SeqID_181997
atggcgggagatgcatcaaagtttcttcatacttctcccaaaaatagtgaacatgtgacctatggagacaacaacaaaggccaagaaatggttttgatgatgtcgaaaagaattcacttgataatgattgtcattatcaaaaaggtggagaatgtgaatgttaagcattgcttcaagattaattcaaggtcaagcaaacaagatcaagaaaaagataaggcctcaaacaagctcactggttga

SEQ ID NO: 65220 - DNA, 186 bp, Glycine max
  Peptide Sequence Number=SeqID_181998
aaatacgatttgttgattgatgttggaaatgcattggcatgtgcatgttgtgtatgttcgtggggggcactgttcactgaccttccagggtctttggcactagcttttagccacgttcatacgttggatgttgtgtatgatcgtggggggcactgtgcattgaccttccagggtctttggcactag

SEQ ID NO: 65221 - DNA, 264 bp, Glycine max
  Peptide Sequence Number=SeqID_181999
atgttgagaaaccaaacgtctctcttgctcgctaagcgcaacagtccgctaagcgaaagtatcgaaaaactgcttaagatcaagcatacaccatccaaaggcttgaaaagtgcaagaaaacgagctgcattttctggaaaacgcgatgaactcgctaagcgagcatgctgcactaagcgagttcatcaatactcattgtatgtaagcatttctctgaagatcacgctaagcgtgcttatcgcgctaagcgagttcatcttttga

SEQ ID NO: 65222 - DNA, 477 bp, Glycine max
  Peptide Sequence Number=SeqID_182000
atggcttctagaaagagaaagagcattggtacaaggcccacatctcagtatgacacaagaagattctcttcactagatgcttggactagatacgttgataatgtcctaggaagaaacattttacctaaaaggaaagtagagctatatcacactgagctagatgactttaaggtcgagctggaaacgcataatttccataaacgcctcaccaatttagccgatgggagcatagacctggctttggtgaaagagttttatgcaaatttattcaattctaaggaccgtccaccaaagcagtccagagtcagaggtcatttggtgaagattgatgttgacagtctcaacgcattcctggagacacctgtggtattagctgagggagagcataggagcgctgatttctggcctattctctcacttggatgtgaacataggagcgctgatttctggccagatgacttctatagcccagtctaa

SEQ ID NO: 65223 - DNA, 754 bp, Glycine max
  Peptide Sequence Number=SeqID_182001
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtactcattcagcggccgaaggggctcccaaaccccgctccagtactggtatgggcccacggcggggcttttgttcacggttccccacgcaccgtgctctcccgcacagccagcatcgcccagcgagcgggggtatgtgtcgtcagtgtcgattaccgattgctgcccgagcacaactaccccgagaacctacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 65224 - DNA, 222 bp, Glycine max
  Peptide Sequence Number=SeqID_182002
atgcagagttcaaaacgcgatgtctatcttggggcctacctgaatggcgaacactggcagatggtggccattgtgcccaaggaacaccgagttgtttggtttagttcattgcatattaggctagacagctaccttaaggaaataattaacagtgctttaaaaggtcttgatgatgctccacagcctaaatcaaaggttcctgctaggtggattatcgtcaag

SEQ ID NO: 65225 - DNA, 213 bp, Glycine max
  Peptide Sequence Number=SeqID_182003
atgcatgccaaaggagtagccgaaacacttaaattgaagtggccaatttgtacgattggtgaaggtacatttgcaaaggtgaaatttgcaaggaactctgagacgggagaacctgtggctcttaaaattcttgataaggagaaggtgctaaagcacaagatggctgagcaggttgaatacttgagtaacttaggatcttactctgccccttaa

SEQ ID NO: 65226 - DNA, 393 bp, Glycine max
  Peptide Sequence Number=SeqID_182004
atggccgagcatcacaagaagctccatattgttgtgtttccatggctagcctttggtcacatgggcctttattttgagcttgcaaaagtcatatctcaaaagggtcacaaaatttcattcatttccacacctagaaacatccatcgcctccctaaagtacctaaaaatttacaacctttcgtgtatctcatagaactcccactgccccatgttgatcaactcccagaaaatgttgaggccacagtggacattcctcagcacattgttccatacctcaagaaggcttatgatggtcttcaggaacctttgactaagtttctggagagatgcaaacctgattggatcatattcgactttgcaccatatggttgccaccaatatcttctaagctag

SEQ ID NO: 65227 - DNA, 585 bp, Glycine max
  Peptide Sequence Number=SeqID_182005
atggtaatccgcacacgttttcggcatccagagacgatcgagtccgatggcacgcagagacaaattatggtcattctgcaccttttgtcatccagaggcggcgagctcgatgacatgtggagacaaattatggtaatccgcacacgtttttggcatccagagacgatcgagtccgatggcacgcagagacaaattatggtcattctgcaccttttgtcatccagaggcggcgagcccgatgacatgcggagacaaattatggtaatccgcacaccttttcgccatccagagacgatcgagtccgatggcacgcagagacaaattatggtcattctgcaccttttgtcatcaagaggcggcgagcccgatgacatgtggagacaaattatggcaatccgcacaccttttcggcatccagagacgatcgagtccgatggcacgcagagacaaattatggtcattctgcacacattttcgtcgtcaagaggcggcgagtccggtggcacgcaaaaactaatgatggtcattctgcactttttgtcatccagaggcggcgagcccgatgacatgtggagacaaattatg

SEQ ID NO: 65228 - DNA, 246 bp, Glycine max
  Peptide Sequence Number=SeqID_182006
atgtatcaatttgggaacattgtgcacacaactacacagcctgtccagattgatagccagggcccctcttgttttgcctacagcaatgctacaccgggaagcactttggaagatgagtacttcctttctcagctgcctattgtggagaaaaggctggctcaaggtagtgtgcgacttgcagctatcaaacaccataattattgctcaagtttgaacacacatcttaaggggatcgttccatggtaa

SEQ ID NO: 65229 - DNA, 3358 bp, Glycine max
  Peptide Sequence Number=SeqID_182007
attctcctcgtgattctgtccagtttattgaatggtccccgtcctcttgtccccgtgcattactgattgcaaatttccatgggagggtaactatttggactcaacctcctcaagggccagctaatcttgtccatgatactagctgttggcagcgtgagcatgagtggcggcaagatattgcagttgttacaaagtggctatcaggggtgtctccgtggcctcctactcagaatggcacaacaccgaagtggttttgcactagtaaaggacttttgggttgtgggccaagtggcattatggccggtgatgctatcataacagacagtggtgccatgcatgtagcaggtgtaccaattgttaatccgtccaccattgtcgtttgggaggttgcacctgggcctggaaatggtttccaggtaactccaaagacaagtaccacttgtggtgtcccacctcttagccctcccaactgggatggttttgcggctttagctgcatatttatttagttggcaagattatctattatctgaagcaaagcaagggagaaaacagacagaccaaaaccttgttgatgctgtacctctatattgctcaccagtttcgaatttttcagcatatgtgagtcctgaagctgcagctcaatctgcagcaaccactacatggggttctggtgtaacagcagtggcctttgatccaactcgtgcgggttcagtgatagctgttgtgatagttgagggacagtatatgtccccttatgatccagatgagggcccatcaattacagggtggagagtgcaacgctgggaatcatctttacagcatgtggttctccatcctatatttggaaaccctacttctagtatgggtggacaaccgcctatgcaaactgtttggcagtccaaagtagacctgagcatacctccaacaaatgatttcaagaaccatcagtcacctgcaattggaatgtcttctgatgtgcaaaaggtatctgagtctgtttctgataaatcaaaaagggtcaattttgatccatttgatcttccaagtgatgtcagggcacttgctcgagttgtttactctgctcatggtggtgaaattgccattgcttttcttcgaggtggtgtccatgtattttcaggtccaaattttacacctgtagacaactatcagattaatgttggatctgcaattgctgctcccgctttttcttcaacaagctgctgttcggcttctgtttggcatgactctagcaaaaattgtacaatattgagaataattcgggttcttcctccttctattcccattagtcaagcaaaggccaattcatcaacttgggagcgtgccattgctgaaagtgttgattggtgggatgctgtgggctgcacacagagtgctgctgaggatggtattgtttcactcaatagtgttatcgcagttttggatgcggatttccattctctcccttctgttcagcacaggcaacagtatggtcctagtctagacaggataaagtgtaggttactggaaggatcaaatgcccaagaggtgagggcgatggttctggatatgcaagctaggttgttattggatatgcttgggaaaggaattgagtctgcattgataaattcttcagctttagttcctgagctatggcaagcatcaggtgaaacgttatccagcattgaccctgaatcaatggctgttgaacctgcactaattcccagtattcagagggagcatattcaacataggttatgtgatgctagaaaatgttatgctgttggaaaagcaagggctttgccagaaaatgcattgcctggtggagatggtgaaattgatggagttgaggacaaggaagagcaaaatggtgtggcttatgtggattcagttcttgatttggcttcacattttattactcgattgcgccgttatgctagtttctgtcgcacattggcaagtcatgctgtgactgcaggctctgggagcaaccgcaatatggttgctagtcctacccaaagttcagcaacacccgcaacaagtcaaggaggtcaaaatgggaccagcagttctatgggaagcgcccagttgcaaacctgggtgcaaggggctattgccaaaattagcaacacaactgatggcgggtccaatccaactcctaatcccatcagtggcccttcaacatttatgcctattagcattaatacaggaacatttcctggaacaccagcagttagacttattggggattgtcatttccttcacagactttgccaactattgctcttctgctttttctttcgacggacacaacttcctcgctatattaatagaacatctgatacaaatatacaaaagcctcaatctaatactcctgctcctggcaaggtggaggagattgcaaaaccagtttcagctgtggttaagtcagatgatggtcagacaggtcgaactggggcaaaaggagctgaagaagtaccctctggacgttcaagattgggtagtgggaatgctggccagggatatacgtttgaagaggtcaaggtgctttttatgatgcttatggatctatgtcgccgaacagctgggctgcaacaccctttgccagtttctcaagtggggagcaacaacattcaggttcggctgcattatattgatgggaactatagtgtacagccagaggttgtggaagcatcccttggtccacatatgcagaatatgccccgtcccagaggtgcagatgctgctggtcttcttttacgcgaactagaactccaccctccagcagaagagtggcacaggcggaatatgtttggtgcaccttggtctgatccagaggatgtggattgtgctaatgatacacctaaacttgttaattctgacccacttgattttagctcattggagcattgtgatgtttactatggaactcatcgcttatggccaaggaagcgcaggatgtctgaaagagatgcagcttttgggttgaatacttctgtgggcttgggaggttatcttggtataatgggttctcgaagagatgttgttactgcaacgtggaaaactggccttgaaggggtctggtacaaggaagttgcaacgcttattataatcctagggaatggtctccaccaagtctatctagagtctataaataaggatgataatgatatgcagaagaatagatcgaataacatttgtgatttggcaactgatggaagtattgatgatgtcagcggcagacttcagcatttacttcaccagatgctactgcttctcctagtcagaatgaccgggaaatgtggtggatcagccgctgggtacatagctgcccaatgtgtggtggaacatgggctcgg

SEQ ID NO: 65230 - DNA, 348 bp, Glycine max
  Peptide Sequence Number=SeqID_182008
atggacagattgtcatcttgctggagcccttggactgttaagaatcctaatttacaagctgtcatatatccctctttattgcaacttgaaaaaggtgtcactgataccgaggataagaagcaaaaggttgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcttgaaatgttacagagaatggtgtgcttgcagcatcggcaccatgcatatgaaggctggagtttgtaaggcttaa

SEQ ID NO: 65231 - DNA, 636 bp, Glycine max
  Peptide Sequence Number=SeqID_182009
atggaattttcacttgaaacgttacaaccaacttatagaatcctctggggatgtactggtgattcaaatgcattaagcatagcaggatctattggctttgatagaaatataattgatcgtgcacaaaaatgggtagagaagtttcaatcagaacaacagcaagagcggagaggaatgctctatcggtcattacaggaggaaagaaatcggttaaaggctcaggttgaaaaggctgcatccattcatgcagaaattatgagcgttcacaatgagatccaaggggaggcagaagaccttgatcaacgtgagatggaacttatggcaaaggaaacacaacaggttcaacacgagctagagcatgcaaaatctcagatggaaactgtgatacagaaatttgagaagcgactcagaatttctgctcatactcctgctgatagttttccatcaatgaagctgatcgtgcttcgtatactccacaaattggagagcaagtccataatcgcgcctggcgacgatggaacaatcatggtacagtatggtaaagtactagtgaaagtccgtgtaaagaaaagtaacatcattgctattccatctagtagaaagaatgctgtaactagttcttcttccacacattag

SEQ ID NO: 65232 - DNA, 1920 bp, Glycine max
  Peptide Sequence Number=SeqID_182010
atgagcctgccaaacgcctatgaccgcttctctaactcccttaaagtagtgactcatctcttctcttctcatctcatctcttgtcttcaccacccctccccaacttcacgtgatcctttcaagtccaaaacggtgcgtattatcaccgccgcgagagacccttttcgtactacaatcacggaaacgttcgagctcttcctaaagacccctttaatcagaatccgaattaaagataaagaaaaaggtggtggtggtggtgtcggaatcacaatgccagaggttagaatcattgccaagaatttcatggacatggtggcttccatgcccgccatgaagctcgataagctctatgaaaacggattcatctgtgaagctattctcagttcagagttaagtaacccaaagggttggtgcaatggtataaggctccattgcgtttacatgagtgagaaggatccttttagcgggagaacccgtgtccgattcccatcacgtgtaaaattcccatggccagcggcagccatacacagtgggtgggggattagtcttgacctaggaccaaaaaaaagttcagagataagtggggtagagaaatggtctcttctgcctcttgcgaagaaatacgtcatacagatgctgcatattgatgtgtcagtggcagctaaattgttggaggaatgggtgcttccgggtggagtttcaaagcacagagtggccattgataggttggttcaattgagagttttccttgaagctgttgacaggaagaatgaaaagacttacaaagttaatccaacatttcagagaagtctccaaaaacttttagtacaaggtggaactttgccaagggaatcaatgccttctaatattactgtgaggctcccaaccttagagaatcttgaggcttatgctctagaacaatgggagtgtttcttattgcaacttataagcccaagtcaggttgaaaagcccttgaatattagctcttccctgatgaaggttttccagcggcgtatcctgagttacagagacaaagaagctccaaaattaactgaaagtggtttccagtttttgctgatggatacaaatgcacagctttggtacatcatcagagaatatatatctaattctgagtgctcttcatcatccaatttgatgcaggatagaggtgttgatgcagctgaccttatctcattcatgctggaacttagttttcatgacattggggaggcatatagtgttgacacattgactagttttcagaggaccataattaatgacctagcagaccttggtttggtaaaaattcagcagggcaggaaaggaagttggtttatacctacaaaattggcaaccaatctttcaatgagcttggctgattcatcatctagaaaacagggatttgtggttgtggaaacaaattttagagtttatgcttactcaacttctaaattacattgtgagatattgcggctattctcaagggtagagtatcaacttccaaatcttattgttggggctattacaaaagaaagcttgtatagtgcttttgaaaatggcattacagcagagcagatagatggtaatgatttatttcttgctatgcttttgctaggaataaggggcctaataatcactttccttcagcaaaatgctcatcctcgtgttgcggagaggataccatctgtgcctgaaaatgtcacagaacagattaggctgtgggaagcagatctaaacagagttgagatgacagatgcatactattacgatgagttcccttccagagatgtgtttgaaggagcctgtgactgtgctagagaatggaatggtttgttgtgggaagattcaaagaagatgcacatggtggttaagactgaggtacatcagtatgtacgagattatttgcgccgtcaaaagtag

SEQ ID NO: 65233 - DNA, 483 bp, Glycine max
  Peptide Sequence Number=SeqID_182011
atggtgcaagttaccacccttaaattcctcatgcgtggcgccgccaccgccgccgcttgcaccaaggagcgctccggcgtccgggccgtcgaggaagccgccaagagtgccatcggccccgtctacgacaagttccacctcgttcccgacgagctcgtccgcatcgccgaccgaaactccgatagctccgtcgagcaccggcctaccccgcatcccagctgtacagccgtctcgggcatcgccggagccgtttacgctaagtgcgagacggtggcgaaggagctgtacgagaggtacgaggccaaggcggagcagtgcactgtggcagtgcggcggagactgttccctcaggtgtcaaatgcgtcacattggacggagaagtacaacgagaaagttgcggcggcggtggagaagggtcgtagggtttcggcattggttgctacggagaggatatctaagatgtttagtgagaaacgatcatga

SEQ ID NO: 65234 - DNA, 1731 bp, Glycine max
  Peptide Sequence Number=SeqID_182012
atgactgcgaggcttcatagatttgaagaatgtgacaagtttggaagttaccaaaaggggctccttttgggtcctaatgctccttcttttaacccaaagacggttaaggagttgattgcgaaggggatagaagttgagcgtttggggaagctgcgtgatgaggctgtttcgtctggggtttctgatttgagtttgaccgagattgagtcgaggattgtgaaggtgaaaaaggaaattgatgatctctttggtggggagggaaaggagaacaaagaattatgtggagggtgttgttgcaaagcaaatgagtgtggtgggattaaggctttcataagggacttgaggactgaattcaaaggtttggatgatgtctatgtgtggcatgccctttgtggctcgtggggtggtgtgaggccaggagccacacacttgaattccaaaataacaccttgcaaactctcccctggccttgatgggaccatgcaagatcttgctgtggttaaaatagtggaaggttccataggacttgttcatcctgatcaagctaatgacttgtacgattccatgcactcttatcttgcccaatctggtgttaccggagtcaaaattgacgtctttcatagtcttgaatatgtgtgcgaggaatatggaggcagagtcgagcttgcaaaggcttattacgatgggttgacaaactctattgtcaagaattttaatggaagtggaatcatcgctagcatgcagcagtgcaacgactttttcttccttggaaccaagcaaattcccatgggaagagttggggatgacttttggttccaagaccccaatggggacccaatgggagtgttctggttacaaggggtgcacatgattcactgtgcctacaacagtttgtggatggggcagatgattcagcccgattgggacatgttccaatcggatcatgtgtgtgccaaatttcatgcgggttcgagggctatttgtggcggtcctgtctatgtaagtgacagtgtgggctctcatgactttgatctcattaagatgcttgtgttccctgatggtaccgtgcccaaatgcatacattttgcacttccaacaagagattgccttttcaagaaccctctctttgaccaaaaaaccgttctcaaaatttggaacttcaacaagtatggaggagttattggtgctttcaactgtcaaggggctggttgggaccctaagatgaagaagatcaagggtttctctgaatgctacaggccaatttcttgtactgtgcatgtaactgaggttgaatgggaccaaaagaaagaagcagttcacatgggtaaggcagaggagtatgtcgtgtatctcaatcaggctgaggaactgcatttcatgaccccaaagtctgaaccactccaatttactattcaaccttccacttttgagatctacaactttgtcccagttgaaaagctaggtggcagcatcaaatttgcaccaattgggctcacaaacatgttcaacagtggagggacaattcaagaattggagtgtgttgagaagggtgcaaaggttaaggttaagggtgatgggagattccttgcttactcaagtgaatctccaaagaagttccaactgaatggttctgatgttgcttttgagtggctccctgatggaaaactcactctcaaccttgcttggattgaagagaatggcggggtttctgatttggcaattttcttctag

SEQ ID NO: 65235 - DNA, 1695 bp, Glycine max
  Peptide Sequence Number=SeqID_182013
atggaagtaattcttgagattctgggagggaactcgttctttattgatgtcggtccctcgttctttattgaagttggtcccttagacacagtcctcgatgtcaaagagaaggtgcaaacccttcacaacatacccatttcctaccaaaccttcctcttcaatggcgaagtcctccaagacgatctccaagtttcgacatctggaatcgatcgcggctcccgcattggcctcctagtcgccccacctgatgacgcaaaccttgcgccgccacaaccgacgctgagaccgccatggcacacacgtccgttcgggatgccggagtttccaccgtcgttgcatctcaatataataccacacgtttacgatccgtttggatatggaatgccaaatataccggagttttcatcgttaacggagttgaggccgatgccacagatgccgcaacagcttccgtcatcatcaacggaggatatgctggtgccgtcaaatagcaatgagtttgaagaaccgctgcctgacatgatggaggcgtcaccgccgtcagagacggcggggagagtgacgttgaacgtgaaagtgcatgagatccaagatcgcatccctatagaaatggagtttgaagacaccgttctgaaggtgaaagagaagatagttgcccgcgaagacatgcgaggtgtgccattggggaggatcgcgttgcagtcgtattcagcgggtgtggaattgcttgaccatcaggttctgcaggattgttgtgcgattttagagaataacgagatcgacgtgttcttgaaaccgactctcgaggtggccggtggcagtagtagaaatgagtttgaagaaccgctgcctgaaatgacggcggcgtcactgccgtcagagacggctgtgagagtgacgctgtacgtaaaaatgcctgatatccaaggtcgcatccctgtagaaatggagtttgaagacaccattctgaaggtgaaagagaagatagttgcgcgcgaagacatgcgaggtgtgccagtggataggatcgcgttgcactcgcattcagagggtgtggaattgcttgaccatcaggttctgcaggattgttgtgcggttttagagaataacgagatcgacgcattctctaaaacgtgtcctgagaagcggatggtgaacgtgaaactgcctatgtcgcaaaatcgtatccgtatagaagtggaggtgaacgacacctttcagaagctgaaagagaagattgttgcgcttgaagagatgcaaggtgtgccggtggaaaggatcctgttgtatccatgttcaccgattcctgaaagcgtgttgaatcctattttctacgtgtacttgaaatcgtctgttccggtggctggtcgtgccggtggtggcagtagtagtgcgtcgtctgggaagatgacggtgtatctgaagccgaacggtcgcccaaagtgttatccattacaggtgaatgccgtggataatgtgtcggcgttagggcaacagctggggcggttgctacggaatagcccgcaccgtcttccccacgatgaggctttttttatggttcacaggggtgagtggatgaatgaacaagaatcatttgagtggcacggtgttaggaacggtaccaagattgcaacttttgttggacgtcttaatgattcagtaacacctatacttcgtcccaagtcacctagctag

SEQ ID NO: 65236 - DNA, 216 bp, Glycine max
  Peptide Sequence Number=SeqID_182014
atggttgtcatcgtgttgtcatttcaaaacaacgtcgttgtgaagggacaacacggagaacctaaaaagggacaacagaaacacgaggttcattggtttgacattagggagaaatgtactaattttggagcttgtgtccgaaatgagcaaagagagttgtattgtccatgtgagcgtggaggagaccttatcttgaagtttaaaaccttctattga

SEQ ID NO: 65237 - DNA, 855 bp, Glycine max
  Peptide Sequence Number=SeqID_182015
atggctcctccaaacaatccagtgaattccaccttgggatttaagtcactggaaaaggtttttgatttatgtgacgggaaattcaccgtgagaggtgtgccattactctctcaggtacccaataacgtcactttcagttccttctcctcaatctgtgaaccccgtgacgccccaccttccatccttcaacgtgtcattgccgtgtcacacaaaggtggcttcttcggattctcccaggtttctccctccgacagattaacaaactccttaggtagtttcagtggcagaaacttccttagcatcttcaggttcaaaacatggtggtctacccagtgggtaggaaattccggttcagaccttcaaatggaaacccagtgggtcctcatagaaatccccgaaataaaatcctatgttgtaatcattcccatcattgaaaaatctttcaggtccgcacttcaccctggctctgatggccatgtcatgatttgtgctgagagtggttcaactcaagtgaaagcatcgagtttcggtgcaattgcttatgtccacgtttctgagaacccttacaacgtgatgaaagaagcctatagtgttctcagggttcacctcgattcgttcaggttgttggaggagaaaacggtgccaaaaattgctgacaagttcggttggtgcacttgggatgcgttctacttaaccgtgaaccctgttggggtttggcatgggcttaaggattttgccgagggtggggtggctccgaggtttgttatcattgatgatggctggcaaagtgtgaattttgatggtgatgaccccaacgtggatgctaagaatcttgtggttggccgggatcgataa

SEQ ID NO: 65238 - DNA, 294 bp, Glycine max
  Peptide Sequence Number=SeqID_182016
atgagtccgacacagtcaagggatcctcctagaattctgttggttcagcaatatgacacatttgttgaaccagatgtgtatcaacaactgatggcgacagcggcacctgataaggcagacattgatgtgcatcatcttcgacatgcagtggatggtcatgtagcaattgctaataagttggagaggcaactgaacctgaggatcatgaccgaaggaacagaagcgtatactattgttgaagaatgtttgagcatcgcaagaagctacattagccaatcaattgtaggtcactga

SEQ ID NO: 65239 - DNA, 249 bp, Glycine max
  Peptide Sequence Number=SeqID_182017
atgtcgtggaaggaaattatttgtggttctaacatcttatatattactattattattcacaacaagaacataagccttttacccacaataaagtttgttcagaagtatcatattaaagcaatgaagttatcttttacccaaggtcgatggaactatgaaagatggggtggatttgattcaatatcatgcaacaatgcaaagcctccaggagttgaattgtgggcagtttttgatgtccctctacattag

SEQ ID NO: 65240 - DNA, 512 bp, Glycine max
  Peptide Sequence Number=SeqID_182018
gtggaggaggaggtggaagtggaagtactggggttggtggagatgtaggaggtagcataggtggtggtggaagtgttggtggaggtgtaggaggaggtgctagtgttggtggaggtgtaggaggagctggaggtgcaggaattggtacaggtagaggtgttggtgcaggaggaggtgctggaattggtggaggtgcaggtggaagtgtaggtgtaggaggaggtggaggtggaggtactagaattggtggatgtggaggtggtggtggtggaggtgcaggagttggtgtcggtggtggtggaaatgtaagtgcagggggaagtggaggtgttggtgcagaaggaggtggtggaattggtggatgtggaggagcaagtggtggtggaggtgtaagtgttggaggaggtgttggtggagttggaggtgctagaattggtggaagtggaggtacagggattggttcaagtgcgggaggagtgggtgcaagaggaagtgttggtgttggtggatga

SEQ ID NO: 65241 - DNA, 348 bp, Glycine max
  Peptide Sequence Number=SeqID_182019
atggctgataattataatgtgttagagctcaacattggtttaggcaacaacaacaacagcaaagttggtggtcatgcagggcaatcaccaaggcaaaggtgccctgcaccgtttctgttgaaaacgtacgaattgttggaagaattaagtgagaatgaaaaagatagcaccaaaattgtgtcgtggaatgcagaaggaactggctttgttgtgtggtccccagctgagttctctgagctcaccttgcccagatatttcaagcacaacaacttctctagcttcattcgccaattgaatacatatttttttttttatctccagattcccctgtacattcttcaaaactag

SEQ ID NO: 65242 - DNA, 1230 bp, Glycine max
  Peptide Sequence Number=SeqID_182020
atgaggggaaaagaggcaaatgtggtagtggtaactcatgcttatggaaatcgctctggggttagatatatgactggtagtttgaaagtttactatgttccatggagaccattctgtaatcagagtacatttccaactttatatggaatactaccaattataagaacaattctcattagagaaagaattactgtagtgcatggacaccaaaccttttcaacactttgccatgatgcacttttgcatgctaggatcatgggatacaaggttgttttcactgatcattcactgcatggttttggagatgttggaagcatccacatgaacaaggtgatgcagtttaccttggcagatgtgagccaagctatctgtgtttcccacacaagcaaggaaaacacggtgttgaggtcaggtttggcaccagagaaggtttttgttattcctaatgctgttgacactgccatgttcaagccagcattggagcgccctggcggattggagattgttgtagttgttatcagtcgattggtttaccggaaaggagcagacttgcttgttgaagttattccggaagtatgccggttacatcctaatgttcgattcattattggtggtgatggacctaagcgggtgcggttggaagagatgagagaaaaacactctctttttgatcgagttgaattattgggagctgtaccacatgcacaagttcgatctgttctaatatctgggcatatcttcttaacctgttccttgacagaagctttttgcatggccatattagaggctgctagttgtggattgttaacagttagcacacgagttggaggtgttcctgaggttttaccggatgacatgattgtgttagcagaacctgatccaggtgatatagtgcaagcaatccaaaaggcaatatatatgcttcccgaaattgatcctcaagtcatgcacaatcgaatgagggaactctacaactggcgtgatgttgccaaacggactgaaattgtatatgatcgtgcttcgaagtgccccaatcaaagtctattagaatctctatcacgatacttgtcttgtggagcatgggcaggcaagctcttttccttggttatgatcttgggttttttgttttggcatcttctggaactatggcagcctgcagatgatattgaggaggtgccagatgttattttttcacacaactgtgatgaagagatgttgcagaaatcctaa

SEQ ID NO: 65243 - DNA, 2325 bp, Glycine max
  Peptide Sequence Number=SeqID_182021
atgtataaatcggtggtgtaccagggggaggtggtggtgggtgaggtagatgtatacccagaagagaacaacaacaacaacaacaagaactacaacaagaacttccatgtgaaggaaatcagaataagccacttctcgcaacctagtgagagatgtcccccacttgctgtgcttcacactgttacctcatgtggtgtttgcttcaaaatggagtcaaagactcagcagcaggacggcctctttcaattgcactccttgtgtatcagagagaacaagactgctgtaatgccactgggtggggaagaaatacatttggttgcaatgcattctcggaatgatgatagaccatgcttttggggatttattgttaccttgggactttacgattcatgtctcgtgatgctaaatcttagatgtttgggtatagtgtttgatctggatgaaacactcattgtagcaaacacaatgcgatcatttgaggatagaattgatgcactccagagaaaaataaactctgaggtagatccacagcgaatttctggtatgcaggcggaggtcaagcgctacctagatgacaagaatatattgaagcaatatgctgaaaatgatcaggttgttgataatgggagagtgataaaagttcaatctgagattgttccggcattatcagacagtcatcagcctatagttcggccactgatccggttacaggataagaacattattctgacacgcatcaatccacagattcgtgatacgagtgttcttgtgaggttgagacctgcatgggaagatcttcggagctaccttactgcaagaggacgcaagcgttttgaggtttatgtctgcacaatggctgaaagggactatgcactagaaatgtggagacttcttgatccagattcaaatttgataaattctaaagaactattaggtcgcattgtatgcgttaagtctggtttgaagaagtcattgttcaatgtcttccaagatggttcatgtgatccaaagatggcattggtaattgatgatcgcttgaaagtgtgggatgagagggatcaacctcgggtgcatgttgttcctgcatttgctccatactatgctcctcaagctgaagcaagcaatactatccctgttctgtgtgttgcaagaaatgttgcttgcaatgttaggggtggcttctttaaggattttgatgatggtcttttacaaaagattcctcaaattgcatatgaagatgatatcaaagatgtaccttctcctcctgatgtgagcaattatctagtttcagaggatgatggttctatttccaatggaaacagagatccgttcttgtttgatggcatggcagatgctgaggtagaaagaaaattgaaggatgcactagcggcagcttcaactttccctgtgacaactgctaatctagatcccaggctcacttctcttcagtacacaatggtgccttctggttcagttcctcctccaacagcacaagcatctatgatgccatttccccatgtacagttccctcaacctgctacactagtaaagccaatgggtcaagctgccccttccgatcctagcttgcatagctctcctgctagagaagaaggtgaagtacctgaatcagaattagatccagatacaaggcgtaggcttctcatattgcaacatggacaagataccagggatcatgcatccgctgagcctccatttcctgttagacatcctgtgcaagcctctgctcctcgtgttccatcatcacggggggtttggtttcctgtagaagaggagattggttcacagccactaaaccgggtagtacctaaagaatttcctgtggattctggtccattgggtattgaaaagccccggcttcatcatccatcctttttcaataaggttgaaagttctatttcatctgatagaattctccatgacagccaccaaagattaccaaaggagatgtatcacagagatgatcgccccagactaaatcatatgctctctagttatcgttctttttctggtgatgatatcccctttagtaggtcatcttccagccacagggatcttgactctgaatctggccattctgtattgcatgcagatactccagttgcagtattgcacgaaattgcactgaagtgtggaactaaggtggactttatgtcatctttggttgcaagcactgaactgaagttctccttggaggcatggttttctggaaaaaaaattggtcatggatttggcaggactaggaaggaagctcaaaataaggctgctaaggattctatcgaacatttggcaggcaggatattctaa

SEQ ID NO: 65244 - DNA, 291 bp, Glycine max
  Peptide Sequence Number=SeqID_182022
atggcagtcttcagatgggcaaatggtgacagaattagtgcaataaaaaactataagccggttgggatacagacaaccgatactgcattgctagggaggaccaagatgcgagtatgttacaacatttttgaccagtacggaaaccccacttcaatgaggaactcatattggtacaaaaagtgggaattggtggagcattcctgggatatcgagctgatgagggcatccgctgcattgttcgagggtattcttgctttaaacgcttatttgaaaatccctgatggggcctga

SEQ ID NO: 65245 - DNA, 1059 bp, Glycine max
  Peptide Sequence Number=SeqID_182023
atggagttcaacattgagtccctcgaattaattctcccaggaatcaaggaactatatgaacagaaaaagacccaccatctagttcttaaaatactgaagtgcttgtgcgaaagaatttcggattacaaggaatcacagctccaagaggcttcagcgtatgatgcgatgttgcaggcagcaacgcttggaattaccgagtacatagatgcaatgaggaaggctaatcctgacctcttatgggccatcgacaagaacaagagaggcatattttcgcatgcaattctcaatcgtagaaaagatgtcttccgactcataaaccgtgtcaatggacggaaggagatcatcaaatgtcgtgcagacgcgtttggcaacaacctcttgcacttggcagcatatttagggccttcatccgatctcgatcgtagatccggtgctgctcttcaattgcaaagggaacttcaatggttcaaggctgttgagaatatagtgcatcccaagtgtaaggaagagaagaattcagatggtaagaagccccgtgaaatattcagtgaaagccacgaggagatggtgaaagctggtgagaaatgggcaaaagacacagctagttctttcactcttgtgggtactctcatcactactatcatgtttgcggcggcttttaccgttcccggtggaaacaatcaagatactggagtacccgtcttcttgcacgaccagatattcactttgtttatcataacagatacattatctctctttacttcttccacttcagtcctgatcttcattgggatcctcacgtcgcgttatgctgagaaggatttcctcaagacattgccgttgaagttactttgcggccttgtgacacttttcttgtctgtggtggcaatgatgatagcattttgcgcttcacttgctatgatgctgaagggaagtcagcgactcataatagcagccatgtcacttgggagtattccagttattgtattagtaccgtcacaacttcgcctcttccttgagattttcaattctacaatatatgcgagatatatcaagtga

SEQ ID NO: 65246 - DNA, 1227 bp, Glycine max
  Peptide Sequence Number=SeqID_182024
atgggagagattattcccactgcaagcagaagaaaagcgctatatacagtgccctgcaaggtaaatggttacttcctccccgttcagattgtggaagcagtagaaatggcagctacaaaccttgcagcccgtggaatagttctggaatcgcttacaagagacaattacgacaactggagtgctcttgtgaagaactatctaatgggtgaagaaattagtgcgaaacctaaaactgattgtgagaattggaagagggaaaatgccaaggctttgcatatcattcagctagcatgtggttcagagattcttaatcagattagacatgttgaaacagcaaaagaagcttggaacagattgggcgcgttatacagttcacaattaaaaggcgatccagatattgagcaaggtttcgtggacgatactctccatgaatataaacagctgcacagatatgtggagagtggtgattggaaaaatgcaaaatcaatcatctatacggacgacacggccatattttccacgtcctccacgggtagaaccgttcttcatattgcagtaattgctgggtacgaaaacattgtgagggagttagtgaagaaagggaaagagaaattagtaaaaatgcaagacaactgtgattacactgctcttgctctcgctgctgaattaactggaaatcataagattgcaaagtgcatggtggatcccaagaagggagggaaggatctgctaaccatgaagaccaaagacgctgaaattcccgttcttctttctgctgccaagggacacaaagatatgactcgctatctttattctcaaacttctttagaccagttccgaaacaaaaattcccacaacggccttttgcttcttacacgatgcatcaccgctgaaatatttgatgtggctttgaatttaatccatcgtattccacaactgcctctaatccatgaatccgatgacctacggcccttatacgcattggcacgcatgccttctgcattccctagtggctgtggatttggacgtctccaacaactcatttataatattttaatattagaaaaacaagagcagcaaaaattgtgccgaattgtgccagatattgctcaagtagaatgccatgctcaagcagaagcctcatatgttgatctagaggaactagagaaaggccaacataattcgaatgcctccttcgcaggatattttgagatcctgcaaagttga

SEQ ID NO: 65247 - DNA, 561 bp, Glycine max
  Peptide Sequence Number=SeqID_182025
atggaatgtaaatggatcatagaagaagggacaatttggcagattggaaatgagcaaacagcaaaaatctggcagcataaatgggtttctaatgtaagggataattgcatccatggcgatatcctgaatgaggttgaccccaatgctttgcaaaaatctttgcagagtaggaggcacaatgggaccatcaaaagctccaagaaattttccaatattagattcacaaggcctggaatcagaatgatccagatctccagcgtctctgcgaacgccgccattatctctggcacgaccaccctctacacaatcccacccagatccgccaccaatacccagtgtgcgccaccacctcttccttctccgttcacgaactctccggcacagatcaagcctatctcactcgttcgtgaaccgcaccacctcgtaccagctggcatttggcggcctcgttctggcgccgccgtcgaacgcgacccgatggcgtttttggaaaccggcaacatcaaacccttaacacttggagaccggaggatgccacgtgtacaccaacttaacgcgtaa

SEQ ID NO: 65248 - DNA, 301 bp, Glycine max
  Peptide Sequence Number=SeqID_182026
atgcctcaccgtaacaaccctgcacctctccccctcgtcgtgaccctaaactgcgtcgaggactgttccctcgaattcgaatccctagccggcgtcgccaccgcggtggaggaagttgtggatcccaagtgtaaggaagccagaaatgatgacgataagaagcctcatgagctattcactgaaaggcacaaggagctggtgaaagctggagagaaatgggcaaaagaaaccgctaattcttttacacttgtgggtactctcatcactactatcatgttcgctgcggtcttcactgtcccag

SEQ ID NO: 65249 - DNA, 1686 bp, Glycine max
  Peptide Sequence Number=SeqID_182027
atggcagaagcagaatccgaagcgctgcgcctcaaggccatggcggagtccaagttcaaagcctccaacaacgccaaatccgctctcaagtacgccaaccgcgcccaccgcctctgcccgcacctcgccggcgtgccggagaccgtcgctgccctctccgtcctcgccgcgccggactggtaccgcgccctcggcgccgagcccttcgcgagcagcagcgtcatccggaggcagtacaagaagctcgcgctgctcctccaccccgacaagaacccccacgtggcctccgaggaggccttcaagctcctcggcgaggccttccgctttctctccgacagaaaccgccgccgcgagtacgacgccgagcttcgacgtaaaatcgaggcggcggagagtgagagcgagacattctggactgcctgctccacttgcaggctcctgcaccagtttgagaggaggtacttggggcaggaattggtgtgtccgagttgtgagaagggttttagggctgtggaagcggttcagagtgatgatgatggggatgttagggttaggagtaggaggttaaagttgaaagagatggagaagagggaaattggggtggaagggaaagtggggaatgcgaaggaagggagattggggaagagaatgtgttcggttggggaggttttggagagggctaaacctagtaatagtaagagggttaaaaaaaatggggaggaaatgatgacattggctgaattccagagtcaagtgaagagaaaattgcagggggaaaagttgaaggcaaaaggaaatgaaaaggaaaaggagaaggaggatggaattgagaagaggagaaaccgggcggagaggcggcagggattgagaaataatggaggtttagaggttggggaggtgaggggtttgaagaagagtgtgaagcctgcgattgaggagaagaggaaggggttgagaattgagaagcatagggggggttctagtggaggggatttggaggatatggcagtgctggattcggatttttatgattttgacaaagatagagtggagaaaagctttaagaaaggccaagtatgggcggtgtatgaagatgaggatggaatgccgaggaattatgccttgattgatgaaactgtctcggtgaatccctttggagtgaggataagttggttggatgtacagaacagtggggatgggaggatagttagtagggagaaaattgggtttcatataccttgtgggagatttaaggctaccaggaaggcttctgtaaattcggtgaatatcttttctcatgttgtggattgtgacagggcagcgcgcgagctttacaaaatttaccccaagaagggatcggtatgggcgctttatggggagggaagtattgatgtggatgagggcaagggatgctatgacattgtcgtgtttttgacgagttacaatgaggtgaatggtctgagtatggcgcatcttgagaaggttgatggttacaagacagtattcaagagacaggagaaggggagtggtgctattagatttcttgggaaggatgacatgtggttagtttcacatcagattcctgcacggaagcttctttgtgatgaaactcctgaactgttgaaagattgttgggaacttgatcctgcttcacttccttcagatttacttactattggtggatag

SEQ ID NO: 65250 - DNA, 1176 bp, Glycine max
  Peptide Sequence Number=SeqID_182028
atggggatttcacaaactgtgcaaaatgggaaggaaaatctcactggacagcgacaccgtacgacgattcatggatcaggttttgtttttgcttctgctccagctttggaggatccacagtttctctctgagtggtttggagataacatagggcaacatcaaaagttggattttgggatgattgggagggaacaaggtgcaatgtattggttggttcctgttgggtggtttaatgtatattttgaagatactgatataagtatgggcagcagtgagatggataaaactccaaaagagaaggagtcaaagacgccgccaccaccacctacgtcacaggagcagtcttcgaccaccagcactggaacaattaatcctgagtggcctggctttcaggcatattctcctatacctccacatggtttcttggcatcaaatccccaggctcacccttatatgtggggtgtccaggctagagatggtgcagtgaggcacacaatgacaaaagtgggtgggtggttgaacaaggctagaccagatctgaagacaggagatcacaggtcaagcaaccatggatcaagcaagaatggttttatggcagtgctgcaccagtggctagtcagctctcagctgcagaacattggagggcctgcagccattgataaccatgagtatgactgcacgagagaaaggttgttgcaattgcaaaaacacatgcccgaactgatggttgtggcatatcaattgtactctggtaatggcactggtgatgctgggctgcaatttatgcctccctatggtactccaccacatccctatgttgcaatgtatccccctggtggcatttatgctcatccatccatgcctccgggatcttatccttttagtccttttgccatgccttctccaaatggcattgctgaggcatcaggaaacactcctggcagcatggaagctgatggtaaacctcctgaggtgaaggaaaaattgccaatcaaaagatcaaaaggaagtttgggtagtttgaatatgatcacagggaaaaataatgaacatggtaaaacaccagggacatctgctaatggaattcattcgaagagagctttacacaatcctcctcctttactaaggcttgagactgactatgagacctttggcggagttggagagcggggatga

SEQ ID NO: 65251 - DNA, 414 bp, Glycine max
  Peptide Sequence Number=SeqID_182029
atggttttgtgctttgaagtggcttcatggaaggtagtgggggcagaatcttatatggttttggcttcgttgttggattcagggttgagtggagcatttgatcgaataggtggtagatgcaaaatcatgtttatgtggaaagggtattttctgaataacaaaagaaatccacctaggtgggtggtgagaatagaaagtgtggagggttacaatagcaactcccacctcgttaatagcatgtggaatgtaaccaacaatcttcatctcagtagaaaagaaaggtgtggagcaggacaacgtagagataactggaaaaggaacaaaagtcaagttctcacgctacacttaactgcagctataggaattcaacaactgcctcggctcttggaagtgggcaactatgaacttctctag

SEQ ID NO: 65252 - DNA, 162 bp, Glycine max
  Peptide Sequence Number=SeqID_182030
atggtggctgcaatgatgctttttcttctcatttctacgcaaatgaagagcgttgagccggatgctgcggattgcttggatggttgcagtactgcctgtgttcaaagcgactatttcaatcctaaactcatgatattcttttggcaatacaaactattttag

SEQ ID NO: 65253 - DNA, 3444 bp, Glycine max
  Peptide Sequence Number=SeqID_182031
atgcttgcagaagttgaagcagcgtttaaggttgccgggccggcattgattttgtttctgcagtgtggtgtggttcattgcattgccatggcttctaaattcaagagtgtgtcctccattcggaagatcacgcatctgagcggtgatatggatcaggaggatgcgaatgggggaagggctagtcttgataactactcagttcacattcctccaacgcctgataaccagcctatggagatttcgctggagaggtcgaattctcggagagtggaggaccaatacgcttctagttctttgttcaccggtggctttaatcagctcacacgcgctcatttgaaggacaaagtgactgagtcagaatccagccacccccagatggctggtgcaaaagggtcctcttgtgcagtgcctgggtgtgatggaagtctcatgactaatgagagagggttggatgtggttccttgtgagtgtaattacaagatttgtagggattgttatatggatgctttgagggctggtgaggggatttgccctggttgtaaggacccttacaaggagcctgaggttcaaggaggtgtggccaactcacaggcactgcctttgcctccgcctcctggtgctaataagatggacaagagtttgtcgttcttgaggagcaagaataatgaatttgatcatgctaagtggttgtttgaaaccaaggggagctatggatatgggaatgctatgtggcctaataaagaagaagaagttgatgccagttctggttctggctctgattggatggggggtgaccctaatgtgttcaaggaaaagcagtggaggcccttgacccggaaattgagtatttctgctgcaattctcagtccttatcggctcatgatattagttcggctagtggttctagttttcttcctaaagtggagggtcgaaaaccccaatgaggatgcaatctggctgtggggcatgtctgtggtttgtgaaatctggtttgccttctcctggctgcttgaccagcttcctaagctcttccccgtaaaccgtgttgccgatcttgatgttttgaaagaaaagtttgaaactcctaatcccaccaatcctactgggaaatctgatcttccaggaatagatatgtttgtctcaactgctgatccagaaaaagaaccaccacttgttactgcaaataccattctctctattctagctactgattatcctgttgagaaactctcatgttatgtctctgacgatggaggagcacttttaacttttgaggccatggccgaggctgcagcttttgccaatatgtgggttcctttttgtcgaaagcacaacattgaacccaggaacccagaatcttattttaacctgaagagagatccctacaagaacaaagtgcggtctgactttgtgagggaccgcaggcgagtaaagcgtgagtatgatgagttcaaggttcggattaatggccttcctgattcgattcggcgccgatctgatgcttataatgccagagaagaaatgaatgcaatgaagaagtggagagagaatggaaatgaagaaccaatggagagtttgaagattcctaaagccacatggatggctgataaagaacccagctgctggcctggtacctggacaactgctgcaccggaacattccaggggtgatcatgccagtatcatacaggtaatgttacaacccccaagtgatgaaccactgactggcaaaacatcagattcaaatgccttggatttcagtgaagttgatattcgtcttcctatgcttgtgtatgtttctcgtgaaaaaagacccggctatgatcacaacaaaaaggccggggccatgaatgcccttgttcgagcctcagccataatgtccaatggccctttcatacttaatcttgactgtgaccactacatatataactctcaagcactgagagaaggaatgtgcttcatgatggaccgcggtggggacaggctctgctatgttcaatttccgcaaaggtttgaaggaatcgaccccaatgatcgctatgcgaaccataatactgtcttttttgatgtcaatatgcgtgctctagatggaattcaaggtcctgtatatgttggcacaggatgcctatttcgaagaactgctctctatggctttgatccaccccggattaaagaagagtctggttggtttggtcggaagaataagaaatcctcaacggtggcctctgtctctgaagccagtgctgaggaacagtcattgaggaatggacgcatagaggatgaagaaatgaccagtgctcttgttccaaagaaatttggaaactcaagtcttcttgttgattcagtcagggtggctgagttccaaggccttccccttgctgatcattcatctatcaaatatggccgtccacccggtgctctaactctccctcgggatcctcttgatgctgctactgttgctgaggccatcaatgtcatctcatgttggtatgaagacaagactgaatggggccttagagttggatggatttatgggtcagttactgaggatgttgtgacaggttatagaatgcacaatagaggatggaagtctatatattgtgtgaccaaaagggatgccttccgcggcactgctccaatcaatctcactgataggcttcaccaggttcttcggtgggcaaccggttcagttgaaatcttcttttcgcgcaacaatgctcttttggccagctctagattgaaatttctgcagaggattgcttacctcaatgttggaatctatccattcacttccatcttccttattgtgtattgcttcgttcctgctctttcacttttcactggccagttcattgttcaaacccttgaagtcaccttcctagtttacctcttgggcataaccttgacccttgtcatcctcgctgctttggaaatcaagtggtctggcattgagcttgaagagtggtggaggaacgagcaattctggttgattggaggcacaagtgctcatcttgctgctgtgcttcagggtctactaaaggtgatggctggcattgagatttcattcactttgacatcaaaatctggcggcgacgacgaaaacgatgaatttgctgatctctatgtcatcaagtggacatctcttatgataccaccaatcacaatcatgatggttaatctgatagccattgctgttgctgttagcagaactatatacagcgaagatcgtgaatggagcagcttgcttggaggtgtgtttttcagcttttgggtcttatctcatttgtatccctttgcaaaagggctaatgggtagaaggggtaggacacccactattgtgtttgtttggtcagggctaatttcaattactatctcacttctttgggttgctattgaccctccctctggtagtagcctaattggagggtcattccaattcccttga

SEQ ID NO: 65254 - DNA, 1113 bp, Glycine max
  Peptide Sequence Number=SeqID_182032
ggactactcgtcctcgcctttagaggactacacgtccttacctttagaggactacacttcctcgccatcagagcgctgcacgccctcacatttagaggactgcacgtcctcaccttcagagggctgctcgccctcaccttcagaggactacacgtcctcgccatcaaagggctgcacgccctcacttttagaggactacacgtcctcgccttcagagggctacatgccctcgcctttagagggctccacgccctcaccttcagaggactaaacgtcctcgccatcaaagggctacatactctcacctttagagaactacacgtcctcaccttcagaggactacgcgtcctcgccatcagagggctacaagtcctcatcttcagaggactacacgtcctcgccttcagaggactgcacgctctcaccttcagaggactacacctcctcgccttcagaggactacatgtcctcgcctttataggactgcacgtcctcaccttcagaggactaaacatcctcattttcagaggactacacgtcctcatcttcagaggactacatgtcctcacctttagagggctgcacgccctcaccttcagaggactaaacgtcctcgccatcagagggctacatactctcacctttagagaactacacgtcctcaccttaagaggactacgcgtcctcgccatcagagggttacaagctctcaccttcagaggactacacgtcctcgccttcagaggactgcatgtcctcaccttcagaggactacacctcctcaccttcagaggactacatgccctcgccttcagaggacttcacgtccttagcttcaaaggactaaacatccttatcttcagaggactacacgtcctcatcttcagaggactacacgtcctcaccttcagagggctacacgccctcacattcagaagactacacgtcctcgcctttagaggacaacacgtcctcgccttcaaagggctgcacgccctcaccttcagaagactacacatcctcgccatcagagggctgcacgtcctcgcctttagaggacaacacatcctcgccttcagagggatgcacgccctcaccttcagaggacaacac

SEQ ID NO: 65255 - DNA, 210 bp, Glycine max
  Peptide Sequence Number=SeqID_182033
atggctctagtgactggtcccttcctagggaggattgcattagaagctaagcgccagtcatggcagctaagcgagattccttgcggcaatattttcaggaagaatgatagatctcatccagcacaagaagttgcagcccagatacgcacactgctatataaacatggaggctgcacgggtttgagtaccaagtccgggattgaagagtga

SEQ ID NO: 65256 - DNA, 252 bp, Glycine max
  Peptide Sequence Number=SeqID_182034
atgaagttgaagaaagagaaggcggaaaagtacagaaagtttattattctgtattggtcaaagctgtggacaatcttgaccaacatttttaccagagggggagctcttcaggctatcgacatgaaccaggataattatttggaagaagctttgaaaatgagtaaccttctggaagaatttaatgaggatcatggaatgcgctcacccaccatattaggtgttggtgagcatattttcactggaaggatatga

SEQ ID NO: 65257 - DNA, 312 bp, Glycine max
  Peptide Sequence Number=SeqID_182035
atgttgccagaggaatggaatatcttcttggagagacttgagtgtaagaaagatagtgatatatgggagaaagaggagaatatattacagctacatcactgggcctcattaagaggacaaacactttgtaggacagagatattcgatggctataaagcgattgctgttccatctgaggaagaaaaaaagagtcatagatccttatatgcccgtttagaggctatggctgacttgaaattcacatacgttgcaaccggcagcaatatgggaatcagaagcgctctggagacagtcgtgcaacagatatcctga

SEQ ID NO: 65258 - DNA, 951 bp, Glycine max
  Peptide Sequence Number=SeqID_182036
atgtcctctactgataatcattgtccttcttcacaaatttcctcctttgtccactctatatattgtctcaggctggaactagttcattctttggaagagaatcaaggatccattacccaggattcggagcttgaaccattccaaaaacaggttactgatcgattcgaggacctgtccagggttagtgatgatgaattgctgtcaattgattggatgcggaagctcatggatgcatttatctgctgtcatgaggaattcagggccattctgttgaacaataaagagcaggtcctgaattcccctatggttcaatcaatctctgatttcttcgagaggttgagagcattgagtgaaggccaagtccagagggctagaaaggcactgatggatttagcactggcaatgcttaatgagaacggttgtaagtcagtttttactcagcgtaacagatcttttgggaggcataacactagcaaggatcaccgtcaccacttgatagcgcatactggatcaaattcatggactgtattccgatcctggtctgcagccaagcaactgcattccattgcaagcaacttggttccccctcgtgggaacgaaattgtttcaacaagtgggcttgcaattcctgtttatactatgaattctgttctcttgtttgttttgtggactcttgttgcagctattccttctcaggatagaggtctcaacatcgagttgtctgagattaatcaagttgaaagttgtgtccggaatatgactgacttggtagattcgattcagtttccattgacggatgagcagaaaatggaagctgatcagaggctgaaggagctaagtcttgtttgtggagccttaagacatggattggatccattggagctccaagtgagggaggtgttccggaagattatgacatgccgagctgaggggcttgattacctaggctag

SEQ ID NO: 65259 - DNA, 1092 bp, Glycine max
  misc_feature (49)..(49): n is a, c, g, or t
  Peptide Sequence Number=SeqID_182037
atggtgtactccaaggttgatatgcctcaccagtacatgagtaatgganttgaggggacatcattgtaccgtagcttacgtgggagatcatcaagtacaaggagatctaacgatgatcctgttcaaactgcaacaatgcgagctgaacttcatagacgtggtatagcacaaatgaggatcaacaatcggtcacttcaagacatgtatatatttggagatcctttgcgtgttcctattattattgttgaacgcttggaaaacatgtaccgttctgccagtgtgaagtcatatttccttcctttggaggacaaagctagacatatcctggaaaatggatctagagccataatacagttgcctaggaatagcccacaacaaaatgagcatggacatcatttagatttacggcttattaggaaccagtggcttttaatagaccccaaaatacaggttcttatgtcagagacaaatgaagacaaaacatctggagatttcagagaaatgggatcacggcttgctcaggaagttatctctttcctgaaaaagaagatggataaagcttcaagagttggaaacttaaaagatatgaagcttagctttgttggccattctattgggaatctcatcatcagagctgctttggcaggattgtggctcttgaagaagatcaagggcacacaatgcatccatcaactaactttcacagatgatcatgatcttgaaaataccttcatctacaatctctcaaagaagaagacactggcaaacttcaagaatgtgattcttttatcctctcctcaggatggttatgttccatatcattctgccagaatagaactgtgtccagcagcaacaatggacttttctaaacaagggaaagtgttcctggagatgttaaacaattgcttggaccaagtgagaactcactctgaacatcgtgtcgtcatgcgctgcgacattaacttcgaaacctcctcctacggcaggaggagcttcaacacacttattggacgtgctgctcacattgaattcttggagtgtgacatttttgtcaagttcataatgtggtctttcccagagctctttagttag

SEQ ID NO: 65260 - DNA, 300 bp, Glycine max
  Peptide Sequence Number=SeqID_182038
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaatgaacatgggagtttcataaaggcaaagactctttggcaaccaggtggtgtacctgatctcatggggtctacttcaaggctactttggatccaacagcttcactatcataatatggtgatcgattga

SEQ ID NO: 65261 - DNA, 1503 bp, Glycine max
  Peptide Sequence Number=SeqID_182039
atgactgttgcaaagtatgaggcctcaccaaaaaaacatgaagaaattttagccaattgtttgttatttgcaggaaatgtatatagatcgggaaaggatatatccgttcaaagagggggaatttctatttctggtgtatctgttgctaaggatccctttccaagatggcagcataagatgtatttgccattggaagagagagtttcaaaacaaatgcaaacatccaacaacaaaggggagcatcgttctcttgtatcccagcagtccagtcagtgcaactttaaactaaaggctagtggaagaagtcgttgttccttcctttgctcagctccttatggcaccaacaatgttggacatggggaagtatatcgacttggtttgagcaaaagaaagcatgcacaaactgaagttggtaaaacaaataagttccgcgtttgttacaagtctgaggagtatgacatttcagaaacaaagatggatccactgcaatcaactgaagggactggagaagccattcttttggaaggacgagcatcaccttggtggcagcagtttcctaagcgctgggttattgtactgctgtgttttacagcatttcttctgtgtaacatggatcgtatcattggtggcatatgggcagacaaacttggtgggaagctagtactaggttttggagttgtctggtggtcaattgcaacagttttaacacctattgctgcaaaacttgggttgccatgtcttcttattatgcgtgccttcatgggaattggggagggtgttgcgatgcctgcaatgaataatatactttccaaatggattccagtgtcagagagaagcagatcactagcgctagtgtatagtggcatgtaccttggttctgtcactggcttggcattctcgcctatcctaatccagaaatttgggtggccatcggcatacagctcaccaaaagaagacccggatcttggggcagaagagaagaagctcatacttggaggcaatgtatcaaaagaacctgttggtgggggatacccatcaaactgtccacataatgctggtctggttctgaagttcaatctcactgaatctgggctattttgtgtcctgccatggttaaccatggctatttttgcaaatataggaggctggattgctgatacacttgtgagcaaaggcctttccataacctctgttcgaaagctaagccatgtgaaaacacctgccatggcagtactttgtatggcttgcagtcagggatctgatgcattctcacaatctggtctatattccaatcaccaagacattggaccacgctatgctggagtattgctgggactatcaaatactgcaggagtgcttgctggtgtctttggtacagctgcaactggatacatactccaacgaggttcttgggatgatgtttttaaggttgctgttgcactgtacataataggcacattggtctggaatatcttttcaaccggagagaaaattcttgactga

SEQ ID NO: 65262 - DNA, 1599 bp, Glycine max
  Peptide Sequence Number=SeqID_182040
atggaaacttgcacggctctgttgtttttaacggccatcacagcatacttgatatggttcacgttcatctcacggtcgctgaagggtccacgtgtctgggccttattgggcagtctcccgggcctcattgacaactgtgaccgcatgcatgactggatctgcgacaacctacgcgcgtgtggcggcacgtaccagacatgcatctgtgcaatccccttcctcgccaagaagcagggtctcgtgactgtcacgtgcgacccgaggaacttagagcacatactcaagacacgcttcgacaattaccctaaagggcccacgtggcatgctgtctttcatgatctgttgggtgatgggatctttaacaccgacggtgacacgtggctgttccagcgcaagacagctgcgctggaattcactacccgaacgctgcgccaagccatggctcggtgggtgagccgagctatcaaccggctctgcttgattcttaagaaagctaaagatcaagcagagccggttgatcttcaagatttgatgcttcggctcacttttgataacatttgtggtctcgcttttgggcgagacccacaaacttgtgtgttgggtctgtcagataaccgatttgccacggcttttgaccgagccaccgaagccacgttacaacggttcattttgcctgaggtgttgtggaaggttaagaaatggcttcggcttggactggaagtgagcttgagccgaagccttgtccatgtggaggaccatttgtcaaatgttattgagaaacgcaaggtggagttgttgagtcaacaaaaagatggtactcttcatgatgacttgttgactaggtttatgaagaaaaaggaatcctacacggacaagtttctccaacatgtggcgttgaattttatcctagctggacgtgacacttcatcggtggcattgagttggtttttttggttggtgattcagaatcctaaggtggaagagaaaattctacgtgaaatttgtacaatcctaatggagacacgtggtgatgatatggcaaagtggttggatgaaccattggactttgaggaagttgaccgtttggtttatctcaaggctgcattgtcggagacactaaggttgtacccttcagtgccggaggattcaaagcatgtggtggccgacgacgtgctgccggacggaacattcgtgccggcgggttcatcggtgacatattcgatatattcggcggggaggttgaagtccacgtggggtgaggattgcatggagtttcgccctgagaggtggttgtcattggatggaacaaagttcatcatgcatgattctttcaagtttgtggcattcaatgctggtccaaggatatgtttggggaaggatttggcttacctgcagatgaagtcaattgctgctgcggtgctgctccggcaccgccttgtgctggtgcccggccaccaggtagagcaaaagatgtcactcactctgttcatgaaaaatgggctcaaggtcaatgtgcatgagagggatttgagaggggttatcacaagtattaaaaaggaaagggaggaagatgttgatttgagaagtaacgaaagttag

SEQ ID NO: 65263 - DNA, 1182 bp, Glycine max
  Peptide Sequence Number=SeqID_182041
atgtttcggagattaggatggttcgtgggtctgaatcaaaccaatttgtcaaccaaaaggttgctcaatgcagaccaaactgcctctgctaggccaaatcaccaacttcctatgctcgatgctgttcatgaagttgctgtttacattcataggtttcacaatcttgacctttttgaacaaggatggtacagaatcaagattactttgagatgggaggacggtgatgactcccatcccggggttcctgcacgggttgttcagtatgaagctcctgaagtgggtgctgacaatttatgtggagtttggatgattgatgataaagacaacagtttttcaacgccgtcattccggattagatatgcaaggcaggatgggaaatcgtctgctgttatcttgaagtttgagctctttcacactccaacacctgaaatgcggttagttaatgatgctctttctcctcttctgttcattaagcccgagttacaaagttcggtaaatggatgtgcagcttcatttcatgagtataggatccctcctaaagctcttttgggattgcattcgtattgtcctgtacattttgatgctttccatgctgtccttgttgatactagtgttcatatcagtctactaaaatctggttatctcacaccacaactgaaggtaccaagtgattctttggcttctaaaggaacatatggtgaagaatgtgttaggtcaagcaaggctgcactcatcaaagcattgatggctgcccgtgatatcctgcttgatgacctgagaagaataagcaaaggaactaaccaagctattgatttgactggaattacttttgaaccttatgatactaagtcactcaattctacttcaacagcacatgaaaaaagtactgatgatgaggtatcgcttcaactgtctgatgggacacaaatcagtgctgaggttcttaattctggcaatgcaaatgcttcattatctgttatgccttttttatgttttagatttatttctcacacaacaatttcttcttaccttcaacagaaagttactcaatatatcaatcatgttactgaggaattgtctcaacctttttcttgggatgacatgttaaactccttccagtttattgggaatcagctcttatatctctggaatacatttctgaaattccacaggtatacttaa

SEQ ID NO: 65264 - DNA, 198 bp, Glycine max
  Peptide Sequence Number=SeqID_182042
atggcatgcgaaaagaagaagaagaggaagggttcttatatgttcagcgcaacggagattgaggcggcgaggcagctcgtagaacttagcaatggcagtatcagagaagtagaggatatattagcagaaatagaagaagatgaacgctttaggagaagaaacagcagaggttatctattgtatttgaatcttatgtaa

SEQ ID NO: 65265 - DNA, 354 bp, Glycine max
  Peptide Sequence Number=SeqID_182043
atggcagtaaaatcaggatttgtgtacataaagatggagtatcaacaagtcttaatttcagatatagatgccctcataatactcacaagtgcagtgccacagacaaaacttgggtttgatccaaccaaaggactaagaccagagttctattttgacgagcatgtggcccatttagctgaagttgcagtgcaatgtgaacgcatggggttgtgggctcaatatgtaggctgtgtactggatgaattgtctagcacaaagaatcaacttctacagggtttttcccccgatgatgcatatccatcaggacctccattatttatggagacatcaagaccatgctctcctcttgcttag

SEQ ID NO: 65266 - DNA, 882 bp, Glycine max
  Peptide Sequence Number=SeqID_182044
atgacgtgtagtttggttccagtgtggatgatggtggcgttgcttatggtggccaacggcgttggagtgagaagcataccgaacagagagtttgattcgatgctgaacaccgtacgagcaagaggctacgacctcttctgcaacgcgatcgtgacctctgatctcaaaatcgatattctctccgacgcaaactcatcacgcgacgccttcaccttcttcgctcccaccgacgcctcactattcgccctcgacatgactctaacggcctcgtcttacaccgacactctccgtttccacgtcgtccctctccgcctctccctcgcccagctccgcctcctccccgacggctacactctccccacgctcctccctcaccgccgcctccacctcgcccaccgcacttcctcctcccccgcctctatctccgtcgccggcgtcgacgttgctttccctggcatcttttacggccgtaacgtcgtcgttcacggcctcgccggtattctcagccttcgatccaacaactctccttctccttcgccgattccttccgaagatcgctggttcttctctccaagaagtagccctaactcgccggcgaaccatccgattcttgctccgttccacgtcacgaatcggtcaggttctcccgctccgtttgaggctccggcaccggctgcttcgccggttgatgctccagaaggtgaacctgattggacggtttatcctccggtcgctgagtctccgagatatcctgattcggcaatatcactgccgccggaggaatattccgactcggcggctccggcgcctgaaggcatccgaaagtgtctgaatccagatgaaggattggaagagtcagtcatgcagtgctatgcagcatag

SEQ ID NO: 65267 - DNA, 858 bp, Glycine max
  Peptide Sequence Number=SeqID_182045
atgacaaaagtcaaaactgcaattaaacgccataaccataaaccccaaggtcaaatccgtaattctacaatacagaagcaacatttaaaacccaacgtttccccactctctcttctcgcgctctctgcaactgcaactacaacaacattcattcattcacagctgtcacgccgtgaacggaaaatggcaacggcgagacgcagtttcccgcctatcaccgaatgcaacggaacgacgccgtgcgagtctgtggccgccgacctcgacggtacgctcctcatctcccgtagctcgttcccgtacttcatgctcgtcgccgtcgaagccggcagcctcctccgcggcctcatcctcctcctctcccttccgttcgtcatcatcgcctacctcttcatctccgaatctctcggcatccagatcctcatcttcatctccttctccggcctcaagatccgcgacatcgaactcgtctcacgcgccgtcctccctaggttttatgctgcggatgtgaggaaggagagcttcgaggtgttcgaccggtgcaagaggaaggtcgtggtgacggcgaatccgacgctgatggtggagccgttcgtgaaggactttctcggcggagacaaggttctaggcacggagatcgaggtgaatccgaagacgaagaaggccaccggtttcgtgaagaagcctggcgtgctcgtcggaaagtggaagcgtctcgcggttttgaaagagttcggcgatgaatcgccggatgttggactcggagaccgcaaaacagaccatgacttcatgtctatttgcaaggtgaagaatttgtttctggtaaaaatatgtgttagtaggaaaaggtttggatag

SEQ ID NO: 65268 - DNA, 387 bp, Glycine max
  Peptide Sequence Number=SeqID_182046
atggatttctcttcggtgagggctgcgttggattcgaagtcgtacgacaaggttgcggatgtgtgcgacaacttgatgcttcaggcacctatttctacctataatctatttgattgtgttgggctttattttttcattttccttaggctgagggcattgcttatcaggacgattggccctacacaattcacctcctctctcacatttatgttcacgacatcaatagtgcgcgctttctttggaagtcaataccttcctcaatcaaagagagccagcctgaagtcaccgcggtttggaaaattggtcagaagctctggttacgtgactatgccggagtgcacgaggcaatccgtggctttgattggactcaggaactccaaaccctag

SEQ ID NO: 65269 - DNA, 606 bp, Glycine max
  Peptide Sequence Number=SeqID_182047
ggaaaggctggtttgagacccaccatcaaagaattggcttcggcattggaaagtcacgaccttttcatatattttgggcatggaagtggagggcagtacattcccaggcatgagattcagaaactagacaaatgtgctgctacgcttctaatggggtgtagtagtggttcattgaccttacctggtcaatatgcgccgcaaggtattcccctgtcatatctgctggctggttctccagccattgtcggcaatctgtgggaagtgacagacaaggatatagatcgatttggtaaggcaatgcttgatgcatggttgaaagaaagatcagatatgccaacagaatgcttgcaatgcaatttattgtctgaagaatttgaggccatgaacttgaagggctgcaagggtagagcaaagaggaaggctccacggaagaaattattagagttggctgagagtgagtcacccaagaactgtggtcacagacgcaaaattggagctttcatgggtcaggcacgggaggtttgcactcttcctttcttgacaggagcatctccagcagttggaatcacgacagttccacgcaagggagacaacccctgtcattag

SEQ ID NO: 65270 - DNA, 765 bp, Glycine max
  Peptide Sequence Number=SeqID_182048
atgaccaccccaagaggaaaccaccacccacagcctaacggtgagcgaagaagacaatggccaccgccacagccaccagcagcggcaccggaagcggcagcggcaccgacagcagtagccgcaaattacaatggataccgacagtaccacccgacaacgccagctcgttcgtcgtcgtcggcgtcgttcaaaggatgctgttgctgtctgttccttctattctcgttcctggcgctgttggtgctagcggtggtgctggtaataatcctagcggtgaagccgaagaagccgcagttcgatctggagcaagtcggggtgcagtacatgggcatcacacccaattccccctccaccgcttccctgtctctcaccattcgcctcctcttcgccgccaccaaccccaacaaggtcgggatcaggtacggccagtccagcttcaccgtcatgtaccgcggcatccccctcggaaaagccaccgtccccggcttcttccagcaacctcacagcacccgacaggtgatcgccaccatcgccgtcgatcgcgtcaatttgcttcaggcggacgccgccgatttgatccgagacgcctccctcaacgaccgagtcgacctgagagtcttgggagacgttgctgccaagatccgcgtcatcaacttcgattctcctgctgttcagatggagatattagatactgagacttctatagttctatttcttccacccttgacattgacattgacattcacaggcttattaatgatttga

SEQ ID NO: 65271 - DNA, 1386 bp, Glycine max
  Peptide Sequence Number=SeqID_182049
atggcagtggagaagacggagcaagaactccgcaacgagatcgatgagcttcttcgccaacagcgcgagatttcggaaaggcttcgagatcctcgaggtcttcgcagaggtgccttgccgggtcctcctgctctccgcactaacggtgttcgccaacgaccctttattcgccctggagacaggaacgattctgaagatcaacctccttccaagcgtcgactttcatctgccgtcgttaaggtggatgatggggacttgcctgaagatgctgatgcaggacaagaagatggaaagacaaaggatttgactaatgaagctgtcaatgggacagctgcactggtccagaatgatagcaaccctttcaattctcaccaaagtggatggtctaagagagatatcagcaatcaaaaaacttcaaaggcttctgacgttcctaatacagatcatgttccaagggtattgcctaagaatgaggatccaagtttggttaataggaacaaaagaatgttgggccagcttttgggaactctcgagaaattccgaaaggaagacatgcaactctcaggaacagaggcatatatgcgaagatctaattccttgcaaagagctgagcaaagggctcgtgaagaaagtgaaaggcttaggaaagaagagcgtgaacagattgctgaaaaacgaaggagagacttgactctcagggctcgtgtggctgctaagacagaagaaaagaaattggagctgctgtttcttcagtggagtgagcatcgtaaaagactaagcaattttataaggactaaagcagagcctccaatctactatttgcctaacaagcccttggatgaagatcctacattacttgagaagcgcaaagaagaggttgtcaaacttggaaatttgatttcttttggtcttcatcttatagcatcattttgttcaccatggacagccatcccagatttgcccgttaaatctcctccaatattgatggctttccttgaatggaagaatgctagaagagaggaagtgtctgagtatcagaaacagattggggagcagtatcttgccaatgttgagaaggaattggagagatggcagaatgcaagaaatgcaaggaaagtaaacaatgaccaaaatttgcaggagacaatggacaaagagttggatactcataggctggagcatggccccaagaaaagaaagatcccagacggaaacaataatgaagatgatgatgatgtggaagatataaatgtgggagaggatgacatgatggatgatgaattagatgatgattctggtaggaggattgatgatacaactaagacggaagcaggtaatgccagcacagatcctgtggctgatggcgagaatgcggaagggaagtga

SEQ ID NO: 65272 - DNA, 2220 bp, Glycine max
  Peptide Sequence Number=SeqID_182050
atggcatatcttcagggtttcatggaactgttcaatgatgcatctcgattggtgattaaaatgtttaaaaggaagaatgtcccaattgagaagtggttgcccctaatgtgggaaagtagaagtctaagtcatgccctttgtgtttcgcctggaaatcaatcatcattgatagggtttcagcagaatttttctttcttgtttgctagctctcataagaattcttgcagtcacgggagctcttttcaaacggacatcacaattgctgaagttcaaaaagcagcacttgatctgatttcaaatgttcctgtcccaagtcattctacatttcttgctgggtgtcttttttatgatttgtgcccaagacttgttgcaaatggacagttaatagaggctctttcatctgcaaaagaagctcatagattacatgccaaactcttccaaaggaagtttacacatagtgttcagcagcagaatgaagagcaaaatgtaatagctgattcctcaaagaatctaatggatggtattgaaaatattggattgaacttatcagttgccagggaagttttgctatttgattctatatcatgggacttggaagacaattatcttagtgcatggaaagttatgcaatgctatcttgagagcactcttcaggtaggaatcatccatgaaatggttggagatggagctgaggctgaaacctatttcaagtggggcaaagccatatcctgttcactaaacctccctttctttttaattgttttttcttcctctttaggaaaactttatgttaagaaaagactttgggatttagcagaaaaggaactacggagtgctgaacagattttaaaggaaagcaacacactgttttgttgctcaaagtgtaaattgaagctcgaagtcactctgtatgagtatcttggagatttgtgtcaaagtaaatttgacacttgtgatggggttatgtctgaggagactgcaaaaaattggtatacatcagctctggataaactaaatctttctgagtggaaaaatcctcttagctgtccagaagttggcagtgatggaactgcaacagacataaaatgtcctgctggtaagacttgtacttgctttataatgaatgaagcagcaaaggttttaccaaaggaaccaaacttagtggttgagaacacatcaaggttaactcgttctagatatcgatctttgcagaaccaagatacaagcattcacaggaagttagaagtccatgaaagtctggaggggaatcatgtttctgattcatctgatatgcttagtcagaatgggtcagtttttagcaacataggttgcccttttccttcaaggcttgtgcctgataccactgtagatcttgcagagtatgtgaagaggtttttggctggtcttccatcaacgactataatcagtataagtttgcttggacgtgattatactagtttactacaggaattgttgtcttatcctacatgtgttcaagcatggatgctggtgtcaagactgagctttaagaatgaacctgttgtaatgttactgccacttgattctattttacaagcttcaggtgagggtgatctgagtactggttcggacacttttcctaagtgtgaggaacatagtgaaaaatggcgttgcccatggggttttacagttgttgatgatgtggccccagcattcaaaacaattttagaagaaaactacttgtcaacaatatcccctcttgaagatacaacacaaaataggatgttatggtggaagcgaagaaagaaccttgatcactgtcttgataaattactgaggaatctcgaagagtcatgttttggttcatggaaatgcttgcttcttggagaatggttgaactgcaaaaattttgacttggtgcttaagaatcttgtgaatgatttaagatctaaatgcaaattggatgtaaacgagggccttcttaaaattattctcggaggctccaaatatgtttgtgatgggaaaacattggtttcacaactatgctcaaagaaagattgctacattgctaaagtaggctattgtaatgaagcgagaagggggatattaaattccgccgatggaattggagtgtcatctgaggttgcttttgaactgttaagtgaggcattaaatgtgctggaagtggatgactccatgtatagagagcctataattcttgtgttggattatgaggtgcag

SEQ ID NO: 65273 - DNA, 438 bp, Glycine max
  Peptide Sequence Number=SeqID_182051
atgcagaatggagtaacagcaactgtcagatatgagacagctccaaagaaggatccttctgaacagcactcgatagctgttaagagaattctcaggtacttgaatggcactcttaaccttggtctcaaacttcagccttccagctcctcaaatttctctgtccaagcatactgtgatgcttactgggctttggatccggatgataggagatcaacttcaggggcagctatttttctaggacctaatcttgtctcctggtggtctaagaagaagaaagttgtggctcaatctagcacagaagcagagtatagaagcttggctcttgctactgctgaagttacctggattcagactttgctttctgaattacagacatcctcaccaaatctcttaccccctctaattttactctgtttagggacaagctcagagtggtaa

SEQ ID NO: 65274 - DNA, 1626 bp, Glycine max
  Peptide Sequence Number=SeqID_182052
atgtcagaaactgacttggcagttattaaacctgagatgatgaagccgtatgtatggcttcagacttcagatgattcaatccaacaagtggaacaagaaattgcaatgttttccccactgatatgtcaagaaataatacaaaaaggcatgggatcttccaagaattgtgcaatatgtcttcctcaacaagtcagtcctgccatgttgagcttaattctcgactattgtcgttttcatcaagtaccaggccgctcaaacaaggaacgtaaatcttatgatgagaaatttgttaggatagacacggagaggctttgtgagttgacatctgctgcagacagccttcagttaaaacctttggttgatcttaccagtcgtgcacttgctcgaataattgaagggaaaacaccagaggagatacgtgatatatttcatttgcctgatgatcttacagaggtgtctggtgcttgtgagaactctgaagaaaagttggagcccttgagaaatataactgccgacccaaggatcagacttttgaaccgtttgtatgccaaaaagagaaaagaactaaaagagcgcggaaggttaaagatcagtgttgtcagtggtctattgcatatttgcattaacttccatagttttatggaagattgcatagtgtcaccattttggaagcagcgtaacaatgttggagaaaataatgttgaagttgaagaagagcatgtggatgaacgttctgttgatgaccttttgtcttttattaatggaaatgatggagagaggaattgtctgagagctatagtccttttatatttttcttcagttccgcttttgaatttcttactggaggcgaagaattttgtcgcagatccaaagggagttaaaacatcaaagaataaaaagaagaaccggaggaaaaaagagcaacagaagaactcttctctgaaggaggcatctgaaatgaacaaaaaggaggtaaatggccatgatatcagacatcaaagttctgaagctgagagaattagcgagacctcatatttaccctatgcagaagatgacacattttctcctaaggttgagtttgatgatggtgatatagatgatgagattgatcctgctttaaaggaaaaaattgacaggagtggaacctatgatttctgcacacttgagttaagcctagtggcaatgttcatgactctatttaccttccatgtttttttaccttttcattttagggaagtggaagattttgcccgcagattaaattctgactggccagaaagaatgcaagaacttttatcttcagggcaagaacggaagacaatgctttttactacagatggttttctaaggcgacaagcttggaactacttatcattctccttactatgttattcacaactcactaaatctctttttccatcttcaggactggacttagaatggaattatggaaatgaatccttaccagaggcttcaacaattttgagagatgctggcaagagcaagaaaagttttgcatggacaaatatgagtcccttcgaattccctttggccgaacatgcccttggatatgtttttcttgatttagtcagaacttccctgtacatggccctcactttgaactag

SEQ ID NO: 65275 - DNA, 837 bp, Glycine max
  Peptide Sequence Number=SeqID_182053
atgaatttggcgggaaatgacagcttgattaagatgagattctgcttcactcggcgccggcaccgtcattgccgcctgtcggtgtgcctgcactggaggtggtcctgcaaaggctcctccgcgtctttctcatttggagttttcgacgtggattttgagtttgcgagggaatttggatttttttttttgcgcaaagaaaactgtgtttctctgcagaggaaggagaaaaaggacttgtgcaccatccttgcagattggactatgtgtttctttgcaaagaataaactcatttttttgatattgcaaccattgcatggaatggtcaagagaggttgggagaatgttgatgtccctaagtttgagtgtgagatatgtgatgcccaattagattttgctttaccttcagcttcttcttgtgaggctattatggaaatggtaattgttaaaaaagagtatactgtgttcctaacactccccttatgtaaacttgtgacggttatttatggggtgttcctagcacttccaaaccattggcatgtttttggtggtggcaagggaaaatggggacagatgattgaaatctgtggattagaaacattaaatattgttcttatacttacaccatttttggttatatgtgtgcagccattagcgcgcagattgaatcaagctaagtcacaaaccctaattttcgaggatgactggcatgtggttctgcctcttgaagtcggtaaaatgcttccacagaatcggcttctcaaagaacagccgcaggaaatccaggcacatcaaagcatggtttctcgagttgaaaatctgaaagtggaagagcattaa

SEQ ID NO: 65276 - DNA, 2533 bp, Glycine max
  Peptide Sequence Number=SeqID_182054
catggctatggtgagttctatgcctgcaactccaccacaggtcaatcctgtgaactcacttcgtgatattggagttcctggaatcatgaccagcaggagaaaaattgtaaataagcctagtccaagtatggttaatgacacaatctatgttgctgtgggaaagaatgtgaaaagtagcaaatcaaatctcatatgggcaatacagaactctggaggaaggagaatttgcattcttcatgttcacgtgccagcacctatgatccccttgatgggtgccaaatttcctgctagtgcgctgagagaggaggaagttcaagattaccacgaaacagaaaggctaaaaatgtacaagactctggatgcctatctttctatctgtcaagggatgggggtgcgtgcagggaaactacaaattgaaatggattgcatagaaaaaggaattgttgaactcatctcccagtatggcatacagaagcttgtgatgggagcagcatcagataagtaccattcaagtttggatatagggaatgtagaggttgcatttcctatggcgcagcaaatggcaaactctgaagttggaggttctcctaaattgagatcccaatcaattgtgcaagggcaaaatcatgggataaaactaactaatccagctcaagagttatttcgtagagtaaggtctgtcaatgatggacataggaggagccttgcatctgtttctgatgagtcatatgggcagtcagggaggagtccttcagttttctcaatgtgctctcacagtatttcagttgaaccaggattgaccccaaatttgataagtgatggcagtgagaatgaattagacttgactttgaatggcccttttctgattaacaagaatcttcatcattcagcatctcctagtgtactggaaatggatggaggaatggatgatgctctctatgatcaacttgaacaggcaatggctgaggctgtgaattctaagcgggatgcatatcaagaaactgttaggcgtgggaatgctgaaaaaaatgccattgatgctattcgcagggctaaaaccactgaaaacttgtataaagaagagctgaaactaaggaaagaacaagaagaagcggtagagaaagcaaatgaaaaacttaataatatgaagagccagacagacaaagttaatgaggaactccgacttgccttatttcagaactcatcactagagaatcaaattgcatcaactgaacttatgataaaggagttggagcaaaagattatatctgccgagaacctgttacaaaactacaaggatgaactagatgatttgcaaatacagcgtgatattgcagtgggagaggctgaggagtttaggagaaaacaatgggaagcctcatcaagcgcacacaagcttcaatgcttctcagaattttcctttcaagagattaaagaagcaacaagtaacttcaatccatcccagaagatcggagaaggcggatatggaagtatatttaaaggtatcttgcgtcacgctgaggtggctataaaaatgttgaatcgtgacagcacgcaaggacctgaggagtttcaacaggaggttgaagtattgagcaagttaaggcatcccaatattatcacacttataggagcctgcccagaatcttggactcttgtctatgagtatttacccaatggaagccttgaagatcgtctcaactgcaaggataactcacctccattatcatggcaaactcgaattcgcattgctacggaactttgttctgctctcatttttcttcactccaataaacctcacagcatagcgcatggtgacctaaaacccgccaatattctccttgatgcaaaccttgttagcaagctcagtgactttggaatctgccgtatattattatcctgtcaagacagttccagtaacagtactacacagttttggaggactgatccaaagggaacttttgtgtatttggatcctgaattccttgcttctggtgaacttacaccaaagtcggatgtttattcatttggaatcattctgttgagattgatgactgggaaaccagccctgggaataataaaagaagtgcaatatgcattagatgctggaaagttgaaatcaatcttggatccttttgctggagactggccatttatgctggctgaagagttggttcgcttggctttgaggtgttgtgagatgaatcggaagagccggccagacctttatccagatgtttggaggatactggaaccaatgagggcttcttctggagtcacaaacacctttcaactgggttctcaagggctatgccaacctcctccatattttatttgtccaatctttctggaagtcatgcaagatccacatgtagccgctgatggttttacttatgaagctgaggctatacgtgaatggctagaaagtggtcatgacacttcaccaaggacaaattccaagcttgctcatcgccatcttgttcccaaccatactcttcgccacgcaattcagaactggcttcaaagtcactga

SEQ ID NO: 65277 - DNA, 288 bp, Glycine max
  Peptide Sequence Number=SeqID_182055
atgatgaggacaaggaaaaatatgagaaatagatttaatgggagcaaggggaacaggtggttggtgcaatgtgacatcgatctagttagtgtgaggtctggatgtccatctttgtctgccatggcaatgccacagagaaagaggtgcaagagaacacaaacatcatggagggaaaccactagcatccttgtcattggtggcaatgatgccaatgccatccccaccatgtgcaccattgagggaaaccaaccaaaggaaagaggggaagaggaagggatgagggtgtag

SEQ ID NO: 65278 - DNA, 276 bp, Glycine max
  Peptide Sequence Number=SeqID_182056
atggtgtatcacaaaaaacaaacttctaattttgtgctctggaaccgcgagtgcatagaacttataggtaaatctgcacaagaattaaacgacatgatgtttgttggtggtgataaaagtgttaatgtgttcctagatccactcgacaatcttttgggttgtactcttgcatttaaaatcaaggtccaacccaaatacaggaattcatctgtgaaaaatatatctgatgatcctgaactcatgcaagcaattatggatttactaccagatgtggag

SEQ ID NO: 65279 - DNA, 360 bp, Glycine max
  Peptide Sequence Number=SeqID_182057
atgactctccacgattattcttccaatagtgccaatagtaacacaatttgttacctattcagccaaaaaagaaagaggggaacgagcaacaatttgaaggttgtacattcaggaactaaagaattcaaaatagctattgaaaggaaagatattgacctgatagacgaggaagaagcacagattggtggtgatcgttctagtgcaacctcgaataaagctgagatttataacgaggaggcacggaagaaaacacagaagcataaaccaaagagggtggggagtgtcaatgctgatgcagaagcctttggtgatcactcgaaaattctgattgctttatgcattctgaagctaaagcactag

SEQ ID NO: 65280 - DNA, 600 bp, Glycine max
  Peptide Sequence Number=SeqID_182058
atgttacagggttgttactgcttaactgttggaacagttgacgaaatcattattgatgctccatggagttatgacagttgtcctaactgtaaaacgacatttgatccatcaaaaggtggctccgcttgtcgttcttgccataccagtgtggtcgatacagtaccacggttagccatgatcattttttgtactgattatttatttacacgctttgctgttttagcaaatttccctgaaatttctatggatgtcaaggatgcaacatgtatcaagctgtttggtaaaactgttggagaatgtcgagatgagttgatagcggctggggaagatattaaggtatttccaacgtgtgttgatgaaatcctgttgaaaacttgggctgtcagatttaagtttcgttcacaattacgccaatcatctgtgttggatgtgagtgaagaactccatcatattcaatcattgatagccacccttgggttgaagccatcgttgtcacagtcttctgattacgatcctggatactctacttgtttaactccaaccaaaaggattagttgtcagcaaaccagttctgatttcgattttgatgagcatgcatag

SEQ ID NO: 65281 - DNA, 1980 bp, Glycine max
  Peptide Sequence Number=SeqID_182059
atgtacaacagtaaggccaaatttgacatacctgaaggtttaactgcgaagaagaaggttatgtccaccgctgggaccagatggaggcaatttaagtcctccctgacgaccagatatgtatatgctgagaatgacgatgaacaaaacaaggatccatctgctaagtatggtattgatcgaaatacatgggaagaatttgcaaagactcgacagacccctacttggaagggaatacgcaaaaaagcacaggaaattcaaaaattcaatgaatctccccatgtactctctcgtggaggctacaatgtgcttgaaaaaaaattaatggccgagaaaaccaagtcaagactgaatgaaggtgacaatagtcaaaatgcagatatggtcgtcgaccctccatcccctattgcgagacatgagaagtggaaaaaggctaggacaaacaaatttggacaaatgacatctgcagcagctcaagaaatcgcagacaaaattgatgaattacaagaacaagctaaacagggagcttttgtcccacatggtcgtcaagacatcctaaacactgccattggtcgtccagagcatcctggacatgtttgtgtcggtggacatggtgtgaccataaccagctactttggacatgcttcctgtgggtcccacagttcttcgcctgcgatcaccgccgaaagattggttgaaatcatacaaactataaagcaagaggtgaagaaagaggtagaagacgagaacaaagatcgtatggacaagatgaaaatggagttggatgcgatcaaaagtgaattatcccaaattcatacgcaacagtcagctcccccaagaccgtctaaccttgacgtatttgttgcatgtgttagcacgaaagagagttgtgctgaagctgctaataatgttgttggtaacgagcggtctacatttaatacatgtagtatgggcttctacattgtttgtggtgacagtacacagctggtggcagggggaaaggtctttggagtaggtggcatgatacacactgttgcttatggagatgatgtagtaagggtgtgtgttgacactgtatacgatggtgaagccattgtcccgttacccacttcagagattcagtatgtcagggatgtcgtgaactcattcattggatggcccagacatctagtgaaacctttatcttatgattctgaccttaatgtgtggaagccagttgaacatagtagtgatgcaaagcttgcaggtgaatccgatccattgggagagttgatgaagatattgttttatgtgtaccagaatccagtggaagtgccatgggaggcgaaccaatttggacttcctgagattggggcaaaattttacatcacacatgcagatctagcggaaataatatcaggtgacaagtgtttaaacatagcgatactacaattgtggaccatatttatgaatgagtgcggtagaagcaaagctgatcagtcactatatggtttgttggagcctcaatctatacaaaatgctaaggaaagacggcaacaatgccaacaatacattgaaacatgggtcaaggaatcacaaaggcagttgtatttaggagcttacttgaatcaggcacattggcaactatttgttctccacccaagggaaaacacggtcgtttggttttgttctctgaggaagaagcctgatattaacatcaaaggcacaattaacagtgcaatgaagacaataaccagttcttttgaaggcatgtctaatcaaggtgcacctcagtgggttgaacccaagactaatgtgcaaagcggagggtttgagtgcggatattatgtcatgcactggatgtggtgcatcgtgactgccggtttgaagaatgactggcacaagtggttctctgatggctcatcgttaaacgtggaggccatcacatcagttcgacagaaatgggcaacttactttttatcttttaggaaaagcagttgctaa

SEQ ID NO: 65282 - DNA, 723 bp, Glycine max
  Peptide Sequence Number=SeqID_182060
atgcagcaaagaagcatgatttgcactgataacactgaacaagcagttcagaagatcaacttttcaattttttctcttccaaagactttccatgatcttaaagtttatgtggaagcttatacgtgtccttgtgtgaggtgccacccatttgattcaatttttgttgcccaatcaaatgggaattatgatgcaatctttactaccaccccaccttacagactcaacaaatataagcgatatgagggacatgtggtctctgggtttccaatcaaatgcaatttcagcttggatgggaaaaaacttgcttctggctcttcagatggttctatctacctttatgattatcagtcatccaaagtcgtgaagaaaatcaaggcccatgaccaggcatgcatagatgttgccttccaccctgttatacctaatgttattgcttcatgctcatgggatggaagtattttgccttacaagaaacattgtgatatgccctccatggaagattttgacaagcctgccgtgaaactggaaattacacttatttgcatgtccttcacactcttaatgctgggcagggcttactttattctcatgtgcatttgtgaaataaaaactaaaacaaaaacgtggcatgaggcagtggtgcagctcacgagttacaagaaatgtctagatgcttgtaaccattacctaccatcatggaaggaaaccctaaatgtgacttaa

SEQ ID NO: 65283 - DNA, 542 bp, Glycine max
  Peptide Sequence Number=SeqID_182061
atactccactttggcctaatggaccagctgataaaccggtgttgtgtaacgcttgtggatcaagatacaagacaagaggacaccttgacaattatcttcccaagaatgtccatcctcagccacaccacaagaaatttaaaaatgtaaatagcggaggaagtaatctcaatgttgagcctgagcttgagtccggcaaccaacttttaaaccatgtttcgcctagatctacaactaatggtgacagcgacaagttaaccttagatgtccatcatatatcaccacaagattcctttggcaattgcatccgtggctttattggagatattggggttgcagataacacaaaggctgagtttttagctttgttgttcggtttgcatatggcatggagattaattgcagaaattaatgtttgtgctgatttccgggcaaaaatgggtctgaattctggtagtgcgttattagaattggagtgccctcctaacgagttgaaacatcaccttctgtctgatgctaggagagtgcagtttcttaggctgtaa

SEQ ID NO: 65284 - DNA, 261 bp, Glycine max
  Peptide Sequence Number=SeqID_182062
atggcgaattttgggaagaagatcccatcaaagaaacggtcaccgatggtgtacaagcgtatgataccaatggagaagtttcaaaagcagcttgttaagttgtataaaagtgaaagacaaccagaagagagtgttttggtggataacatgatgaacttcatacccgaaaatgagataggacttggaaccattcttcttaagacaaatgatgatgatgcttcttctacagataaatgtggatcatccacatctgcaccctga

SEQ ID NO: 65285 - DNA, 321 bp, Glycine max
  Peptide Sequence Number=SeqID_182063
atgaagcaatgtaaagagtttaaagacgaatcgaacactgtcgcagctggaatcgcgagagagagagagagagagagagggagggagaggttaccgaatgtaggaacggccatcgtcgtggatggaattggcttgggaagcgacgatgccttcgctgccgccggcgaggagaagaggagtgaagctaagaagaacatggatcttgttctcgttctcgcaaatgctgaatccatgccgacacacactcactcagattggatcggcgaaaagaatgcgcagagtgaaagtaagagagagaagaagacatgtcagtcggtgtga

SEQ ID NO: 65286 - DNA, 856 bp, Glycine max
  Peptide Sequence Number=SeqID_182064
atggccataagggaaaaattcagagcattcatgcatatcactgagaaaacaaattacggttctaaagagggggaatatgcggaggttaaagccaaacatgcattgctagaactgaggccaatgcttgtcatttcaaaacccagaaagaaaccagatccaaatgatgctcctacgttaatcaaaataaaaaaatgcagagcagagaaattgtatgagccaggaagagataaagcaagcactattcagaaatgcagtggtaaggagaaagaacaactcaccagtgacgacgacgttggggtgatactccggcgaaaggcggcgacggagctgaggctacggttccacggcggcggcgggggagcacatctcactctcgcccttcactcctatcgtgacctccgcacatctcactctcgtccttcaccctgccgtgacctccgcaagcttgtcgtggacattccccaacctgtgcttcgtcccgtcggcggcgttgctctcgcacaccatgcacagcaccttcaccagtggcaagaaaattcccccgccctcttcgacaccgagggaatcgtcagcgcaagaagcgcctcgctgaagaccaagctgccggttttgataaaacctttggcgaagaagaaagcgagggcgatgagccaggggatgggatcgctgaagccggagaatgaggcggcgaaggtcagatatttgaagtttaaggagtcaagaaaattggactttgcaagttttcatggtgagaaggcgatggagtatatatggagtggtgaattggtagtgctagagctagatgtgacattagcaagcacgatctctattatcatgtggctgttgcagtgtgcga

SEQ ID NO: 65287 - DNA, 363 bp, Glycine max
  Peptide Sequence Number=SeqID_182065
atggcattttatgacacagagactatgacgctgcaatgtgaaccttttaaaggttcaaagaacctcccccgccgccgccgtggaaccgtagcctcagctccgtcgccgcctttcgccggagtatcaccccaacgtcgtcgtcactgttgtccatggttgcagaaggagaaacagctgatggagattttcgtagaactaagctttagtaagttcaaaaccagaagcactggacctgctttatatttcagaacattatcaagcaccggtttggctggtcagctttctggagatattggatcactatctgaattagagactttggatacagaaaacaaggatcaggaatcctcagaatccatgtaa

SEQ ID NO: 65288 - DNA, 276 bp, Glycine max
  Peptide Sequence Number=SeqID_182066
atgagttctgatgacattcaaattgatgaacctgtagtcttctcatctcctcagaaaatcgatattgacaagagagataaagggaaaggaacagacagacagaaatttcttgaagaagcaagcacagacttgaaaccaaaagctagaacagctgaggaaattaaggctaaatacagaaagacgggcacaggggatgcctcggcagcagctgcacttgcaagggataaacttgtagagcggcaagaaaagctccagtggtattgtccattgaattag

SEQ ID NO: 65289 - DNA, 369 bp, Glycine max
  Peptide Sequence Number=SeqID_182067
atgttgcatggtgatcatcaggaagaaggggtaaatattactgctaattctcttcatccaggagccattgccaccaatattcatcgttacaacagaatattgactggaattccaggtgtagttaagaggttgttgaatcttgtaattaaaaatgtccagcagggagcggcaacgacatgttatgtagcattgcacccagaagtgagaggaattagtggtgagtattttgcagataataaaattgccaaagcaaactcactaggaagggacattgatttggctaagaaactatgggatttcagcatgaatctgatcaaagtagaatacttggtgccaattgtcgatgctgatggcatacttagagaatga

SEQ ID NO: 65290 - DNA, 741 bp, Glycine max
  Peptide Sequence Number=SeqID_182068
atgtctccgtatcatggacattcttctcaacgattcttcattttcctactcatcctcgctttcagaggggtgagagttacagccacaacattcacattcgtgaacaagtgcgaccacacagtgtggccaggcgttctaggaaaaccggacatcggaacaaccggtttcgagctcaagagaggaagcacgcgtagcttcgacgcgccgccgggttggtcggggaggttctggggccgaaccggctgcgaattcgacgactccggccacgccacgtgcgccaccggcgactgcggatccggccaggttaactgcaacggcgccggagccacgccgccggccaccctcgccgagttcacgctcggcgagggtgccccggactactacgacgtgagtctcgtcgacggctacaacctcccgatgatggtggacgccagcggcggctccggctcctgcgccgccactgggtgcggcgccgacctgaaccggcggtgcccggaggagctgagggtggacggcggcgacgcgtgccagagcgcgtgccgcgcgttcgggaagccggagttttgctgcagcgacgcgtttaattcaccggcggcgtgcgcgccgtcgatgtactcgcagattttcaaggctgcgtgcccaaaatcttatagctatgcgtatgatgatgctacgagcacttttacgtgcaccgctgctgattacactgtcacattttgtccctcttcttctccaaggtaa

SEQ ID NO: 65291 - DNA, 103 bp, Glycine max
  Peptide Sequence Number=SeqID_182069
gggaggtgtggttcgtgttggaaggtggtcacttttgggttactgtggagaggatgacgagaaattccttgtggtgagagtgcagctactcaagcttccatag

SEQ ID NO: 65292 - DNA, 471 bp, Glycine max
  Peptide Sequence Number=SeqID_182070
atggtgaagcctaaaagtggaaatgagaagaaaaaacctcgttcggagccacaccgggaggttacttttggccatttcaataccatcgcaaggggttttgctgaagggttcaccacatcctcgacaacgaagagatatgcaagtgttcataaggttcaatgggagcagattgagggccaactaaagacaataactgtcaaatacttggtggtgaatgctcgatcggcttacaacttgctactaggaggacctacattgaaccgtataggggtggtcatctccacatcccatttgaaggtaaaatatcccttggatgatggggtgttgatcggaaccattactgctaaccaggaattggcacacaagtgtcataaagaaagtttgaagaatcaaagaaaatggtatggggatcaaactggtcatcaagttaatgtcttgaatctaaatccaaggaaggactttgaggaatga

SEQ ID NO: 65293 - DNA, 243 bp, Glycine max
  Peptide Sequence Number=SeqID_182071
atgcacttcatcagaaacaccattggtgcctgttactatatggaacaagaaggtaccatggagcccttagaaatggctaaaagatttcaaatgaagaataaaaagaacaagaatgatgctagaaatcaaagtatcgccagatctttgaccccatatcacactacatcaacaggtgccaattctggagatttggatggtcgaaaaaaatatagaattggcaacatttctgttgtgaacgtctaa

SEQ ID NO: 65294 - DNA, 123 bp, Glycine max
  Peptide Sequence Number=SeqID_182072
atgacgctgatggaccattcaaataaaaatgatctgatggaccattcaaatgccactgcaaggcataccatgaaaaatttgttgcaagggtggagaagatcatcccaagagttgtctatctga

SEQ ID NO: 65295 - DNA, 548 bp, Glycine max
  Peptide Sequence Number=SeqID_182073
gggcatccagtggtattggtgctgagactacccgtgttcttgccatgcgtggtgttcatgtaattatgggtgtgagaaatgtggtagctgcaaaagttgttatggaagcaatacttaaagagattcccaacgctaaagttgatgctatggagttagaccttagttcaatgatatctgttagaaaatttgcattagagttcatttcatctggtcttccattaaacattctcataaacaatgcaggaatatttggaacccctttcaagctttctgaggacaatattgaactgcaatttgccacaaatcacatgggtcattttcttttaacaaatctgttgttggatactataaagagaacaacgcatgaaagtaagaaagaaggaagaattgttaatatctcctctagtggtcatcaatggctcaactatcgtggaggaatcctttttgataaaattaacgatgaatccagtgggatttatccagagactgcaaaatctaccaaggcttattcttctaggaatttgtcaatgaaagaacaattattatag

SEQ ID NO: 65296 - DNA, 205 bp, Glycine max
  Peptide Sequence Number=SeqID_182074
atggcgaggaagaataaaggggtggcggtgaaagatgccataagggccattgggttgggttacgatctcaccaacgatttgaagctcaaatccggcaagaaccactccatattgatcgctatcgatgatgacaaccttcaaactatcaaactccctacttggatttccatccctaatgtccccaaatccatcaaatgtgataaag

SEQ ID NO: 65297 - DNA, 363 bp, Glycine max
  Peptide Sequence Number=SeqID_182075
atggataaggaagaggggagagtggctagagggagagggttcccctatgagagattgctcaaactttggatgtattcattagagagctctgagtctcagtatctttctcctttgcttgccactccttttataagcctaagcgggcattctgggcttagcgagtatagcggtgatcaagtgcttaacgcaagattcgcgctaagcacgcctttgggcttcttcgtgcgccttctttgcactaagcttgagctggccgctaagcgaggagacacgttaggtctgtcttgtgtgctaagcgagctgtctcaatcttcaactttctcttcaagtttttgcatcaattttcctcaaaagcacttgtaa

SEQ ID NO: 65298 - DNA, 207 bp, Glycine max
  Peptide Sequence Number=SeqID_182076
atgtcttctgcaggtaattggccatcagaagatgttcttgctctctattgcttgtcacatgaagatatattcaggtctaaaaaagttattgagcttggttctggctacggcttggctggatttgttattgcagctgctacggaggcaacggaggttgtaatctcagatggaaattcacaagtagtagattgtatccttttggtatag

SEQ ID NO: 65299 - DNA, 474 bp, Glycine max
  Peptide Sequence Number=SeqID_182077
atgggttctattggaattgagagctcgggacccgaggttgtcacagttgatgtacatgcaaccaaggatctgatccagaccagtcatgtttatctggatgtcaggacggtggaagagttccagaaaggacatgtggatgcagagaagatcattaacattccgtacatgtttaatacaccggaaggcagagtgaagaatccagaatttcttaaggaggtttcatctgcttgtaagaaagaagatcacatcatcgtgggttgtcaaagtggagtgagatctctatatgcaactgcggatcttctgaccgaaggatttaaggatgtgagcaacatgggaggaggatatatggactgggttaaaaaagaatttccagtgaaagcacctttggagttggttaaaaacgaagtgccagtgaaaacacctttggagttggttaaaaatgaatttccagtgaacccacctatagttggttaa

SEQ ID NO: 65300 - DNA, 372 bp, Glycine max
  Peptide Sequence Number=SeqID_182078
atggctcagggaagaggtatcctactattattgtgtatgttggtgctttactctgtctctgagatggctcatgcaaaaacctatatggttggtggtgaatttggctggaactatacagttaacatgactacctggcctaatggaaagagtttcaggactggtgatatactcgtattctactatatcacgtatgacaatgtggtgatagtggacgaggctggatataattcatgcagagctccaaaaggatcaataacgtatcggtcaggaaatgatcacatcgcactagcccgaggaccaaactacttcatctgcactaatcaagatcactgcagcttgaatgggatgaaaattgcagttaatgctatatga

SEQ ID NO: 65301 - DNA, 948 bp, Glycine max
  Peptide Sequence Number=SeqID_182079
atggattcttgtggttgtggtttctcattcaccaatcaccgcaatcctcttacatttggcagtcatggtggtttgcttaactgtttggcaagcttgagtactcacttggctgaaaaacatgttcaatattgcccagtttcatcacccccagttctatgtgccgatcagaataatgatactgaaggtttgaacaatcaatttggttctaattatgaaaactggactgctattgtgaggggagaatatatatttctaatgggtcttctaatatcagggaaagcagagtcatcttttttcttgcagaaaaagaaagttacaagagatcttagacaagaatgctatgctttaattgaaaggatatttggagatggcccaggcttggacgattttcttgatggtttaggaagggtggagccttgcagaaagtttttgtgtccgttgcattgtagctgctccttatgttgttccatacagttttgtaagagcatcaatgatcttgaacttctcctaacatttagagctcagattattgaggttgccataataataaaacatgtgaagaaaactgaattgcaatgttcaaatgaaaaactttttgcacctgcaacatttgaaagccaattccaaatagagcttcctcttttgtataaatacctcattgatgctccttctggtaaggtctgctggaaggatgttattcattggatgtggccccttttcacagaaaattggggatcatggagaaatgatgtcttgcatcttagtccatgtccttttactgatccagtaacaggtattcctacttggcatgatagaccacaatctccacttgtgatgtatggttttagtaaagaagtagttgaatgtcctggtactatcctcctaaaccacaaaattgggataatgtcatacagtagttgcggtaacatactgaggggtgacgagtag

SEQ ID NO: 65302 - DNA, 1335 bp, Glycine max
  Peptide Sequence Number=SeqID_182080
gcctccgtcaacccaaacaccgcaatgaaatgcttacaaaaatttgcatcagacatctgtgtaatatttggagacgagtacatgaggagaccgaataaccaagacactgaaagactactacaaacgggagcgacacttgattttccaaggtcaaggatgggtcccagtatcttttcctcccatgctcattctcaccgtctcccctatgcagcaaatcttaaccctaattcctctcttctccgtcgacgcgcacaattcatcagcttcgcctccaattcttctccacctcagcctcggcctcagggagggttcaaagacgacgaggccaccgccaagaaatcgtttgcggtgtcgaccggcgagctgtttctagggctggcggcgcggctgattaagagccgaaacaggggaagcagcctcgcagaagaagattcgcgttcagtggccatgtttgaggagagaatcgaggcggcggcggtggtggtggaggacgagattgatcccgacgtggtttgggagcaaagagtgaaagatgtcgaggcggagcgcaataggtaccgccgcgtcgtcaccacccctggcttcagcttctctgccgctggacttctcttcccttaccatctcggtgtcgcacaatttctcattcaaaatggttacattaaggaaacaacaccgttagccggttcctcagctggagctatagtttgtgctgtgattgcttccggagctagtatggaagaagccttgaatgctactaaaatattggctgaagattgccgcaatcaggggactgcatttcggcttggggctgttctacgtgatattcttgacaagtttttgcctgatgatgttcatataagatctaatggaagagttcgagttgctgtgacacagcttctttggagacccaggggtttgttggtagatcagtttgattccaaggaagatctcatcaatgcagtttttacctcttcctttattccaggatatcttgcaccaaggccagcaacaatgtttcgtaatcgactatgcattgatggtggtttgacattgtttatgccaccgacatctgctgcacaaacggttcgtgtttgtgcttttccagcaagtcgattgggattgcaagggataggaattagtccagactgcaatcctgaaaacgtgtgtagcccacgacagtttttcaactgggcacttgaaccagcagaagatgcaattcttgaccgactctttgagcttggatatctagatgccgctgtctgggcaaaggaaaacccagttgaagtaatcgttcaagatgatagtcctgcgtttggaaatggcaatgcaaaatag

SEQ ID NO: 65303 - DNA, 231 bp, Glycine max
  Peptide Sequence Number=SeqID_182081
atgcattggcttggtgtttcacctgaaccactcagtagaaatcatttgctgcctgataaaaatgataacacgagtatccacgaagctgcgcgtgtactatcactggcaatccatgatgcattatcatcaacagttaaagcaagggcagcagaaattgctgaaagaatattgcttgaggacggtgtatcagaggcaattaagtacctcaaggaagagctgggcttaaattga

SEQ ID NO: 65304 - DNA, 489 bp, Glycine max
  Peptide Sequence Number=SeqID_182082
atgaagaaaacaacacaagaaagcaagaagcaaggaagaattgttaatatctcttcaatacttcatcagttaacatttcgtggaggaatcccttttgataaaattaatgacccatcaagctaccacaattggcttgcatatggacaatcaaagcttgctaacattttacatgccaatgaacttgccagacgtcttaagcaagatggggtagatattacggctaattctcttcatccgggagctattgtcaccaatatttttcgtcacactagtgtactggctggtataattaatacgctgggtagatttgtgtttaaaaatgtccaacagggagctgcaacaacatgctatgtagcattgcatccacaagtgagggaaatcagtggcaaatatttttcagattgtaatattgccccaacaatctcaaagggaagggacattgatttggccaagaagctttgggattttagcttgaatttgattgagtaa

SEQ ID NO: 65305 - DNA, 254 bp, Glycine max
  Peptide Sequence Number=SeqID_182083
atgggggatgcagtgaccttgttggatatccctggctatttccttggggatggtaccacattgcatctgagagttgagatcaatgacaatttcaaacctcaagtcgaagatatgcggaagatcttgggggtggaagcgacaatgagtaaggaacatgacgaagccatcttcatcttcaagatcatccttgtcaccatcgtcaacgtcaagatgtctctagcacaaatgacgttcttgtacatgatgaagaggag

SEQ ID NO: 65306 - DNA, 516 bp, Glycine max
  Peptide Sequence Number=SeqID_182084
atgaagaaaactgcaagtgaaagcaagaaagaaggaagaattattaatgtttcctctgatggtcaccaatatacatatcctgaaggaatcctttttgataaaattaatgacgaatcaagttaccagaagtggcgtgcatatgggcaatcaaagcttgctaacattttacatgccaacgaacttgcaagacttcttaaagaagatgggatagatattactgcaaattctcttcatccaggagctattatcaccaatatttataaaccagagcttagtggcccagtgccaactgatctaatgaatatgcttggagattatctgcttaaaagtatcccgcagggagcagcaacaacatgctatgtagcattgcacccacaagtgaaggggattagtggcgagtatttttcagatagtaatctggctaaagcaagctcactggcaacagacactgatttggctaagaaactttgggatttcagcatgaaaataattgactacaatgcccatgattcatga

SEQ ID NO: 65307 - DNA, 168 bp, Glycine max
  Peptide Sequence Number=SeqID_182085
atggctccattacaagacagaaagcgtacagcacgtacggaacaaaacaacagcatgtggtggcctttctggagaaaagggggttctgcattttcatcttcttccactgctgatgaagttacagaaggaatcgatggcactggcctcactgctattgttactggttag

SEQ ID NO: 65308 - DNA, 770 bp, Glycine max
  Peptide Sequence Number=SeqID_182086
attttggtgaagaagatgagggtaagacagagaagttggaggcactcctttcagctgttaacaataatgataccagccacattgttcatgttccatctggtccaaacgccctttctgatgtactaataagtactcctatttttactggtgacggggaaggtggaagtggttttgctgcaggcagtgtatctggatttgagtttggtgttgatccaaacttggaccctgaactggctcttgctctaagagtttcaatggaagaagagagagccagacaggaagcagctgccaaaaaggcagcagaggatgctgctaaacaggagaaagatggtgagcagcaagctagcccacaggatacaacaatgactaagggtgttagtgcagcagcttctgaagctgagactaaaagaactgatttgacggtcaacgagaatgctcttctacagcaggcccttgcaatgtctatggatgatcccacaattaaccacgacatgagagatacagatatgtctgaagcagctgctgaagatcctgagttggctctagctctccaattgtctgtagaagacagctcaaaggactcggcaagccagtctgacgtgagtaagctgttggcagatcagtcctttgtatcttctatccttgcatcgcttcctggggttgacccaaatgatccatctgtcaaagatttgctggcttccttgcaaaatcagtctgagcctcagcagaagaatgaagacaagccaccaaatgaagaggagaaaaaataa

SEQ ID NO: 65309 - DNA, 123 bp, Glycine max
  Peptide Sequence Number=SeqID_182087
atgggttcttctgggttttcatcatcttccactgcagaggaagttactcaaggaatcgatgggagtggcctcactgcaattgtcacagatataggtgcatacatcccaagtgagaagagatag

SEQ ID NO: 65310 - DNA, 762 bp, Glycine max
  Peptide Sequence Number=SeqID_182088
atggccataatgatggaggctgtgatgagcatgaagaagatgatggaggtcaatgcgactgtagttgccgttaccagtgccgttgctgaggtggacccgactcggccggctggcctcaaccaaataagtcatccaacctcggatatggtgggtcagggaggcaaagagttgggaagtacgagtggcccccattttgtgcaagttcagaacaaccatgccttcccgccatatggcttgcctcccaactacacaccacccaatatggtgcacactcttaatgagaatgtcaataactcgaatcccatactcattgagagccaacaacctcaatctgatcatgcacatgtctctcaacccatgagggaggcacatgaaataccccaccacaatctagccgactttgagacttgccttggatatgccattgagggacaagcagttggtggtgtacccctgccaaacactttggagggccctcagtttcacccacaaccacaacccttgcatttggcggcggggagagtccctcctgctatggcggaaaagggaaagttggatcagatagaggaaaggctaagggccgttgaaagaggtggagataatgcctttgctgacatggaagatttttgcctagtacctgacatggtcattcctctgaagttcaaggaaagtcttactggggcagtcgtcacctggtacactaatctggaaccttcccgagtccattcttggaaggacctaatggttgccttcgttaggtag

SEQ ID NO: 65311 - DNA, 213 bp, Glycine max
  Peptide Sequence Number=SeqID_182089
atggagttcattagtgggaaccttcggacatttagctactttgacttccggacattgaggagagccaccaagaatttccatcctcgaaatcttcttggaagtggtggatttgggcctgtctatcagggaaagttggcagatggaagacttaagtcaagacattgtctcctgacaagtctcaacaaggagaaaaagaatttctggcagaagtga

SEQ ID NO: 65312 - DNA, 318 bp, Glycine max
  Peptide Sequence Number=SeqID_182090
atgacaaatatcaaggaaggtcaatcaagcttaatcgtcatgaccactgtttctctctttataattattgctaatagttattactttggctctctgtgtggctattactttcattcctgcaacaaaaatcacccaaacacactcccccaaatttgggacaaatttgtcttaaaccgtacaatgctctcctataacctaagcataattaaatggggtcctgtcattagtcttcctgagttggagcgggctcgtcctgaggtgcagttgggtcatcctgagctgaagtgggtcatggatcccaagtcgcctgcatcgtag

SEQ ID NO: 65313 - DNA, 288 bp, Glycine max
  Peptide Sequence Number=SeqID_182091
atgaagattggtcaggataacgtggttcagtctcacaatacatgcttgagaaaatatattccaaataatacatttgatgattgtgaaaatcaaggcattcgaaataggatgtataaaaggtcttgtgacccactgactgtagagaaatctcctagtccttcacgccataaccctggagtgttcttcttccttggagggattgtagtgctcatcatattgcggattcttgtgtttatattttggaggcgtattaaacggccagcaaaggtgatgagaacacagctctga

SEQ ID NO: 65314 - DNA, 197 bp, Glycine max
  Peptide Sequence Number=SeqID_182092
acgtctcttcaccctgccgaagcttggatccatgggacacctcggcttcacgagacggatcagaagcttcctcactggtgtggctagcagaatttgaggtaggggcagcagcaggcaccatagaaggtgcaggtgagggtacttcacaatcgaaacaaggaggttgttcagcagctgctggtgatattggagtgtaa

SEQ ID NO: 65315 - DNA, 372 bp, Glycine max
  Peptide Sequence Number=SeqID_182093
atggtgcctgcgcatcctccagatccctgtctatatagtggcttccttcatcatccaatcccttcgccaaaatcttattctaaaccatcctttccccctgattattcacctgctgctgcccctacctcaaattctgctagccacaccagtgaggaagcttctgatccgtctcgtgaagccgaggtgtcccatggatccaagcttcggcagggtgaagagacgtctaataaactggtgtctcatctacttgctccatcctctttatcttcagcgagtggtgatttccgtggggaaatgttgctaatgggattttgtatgatgttgcctgctgaaggatcctggagacatgcgaggactactacaacagcctaa

SEQ ID NO: 65316 - DNA, 717 bp, Glycine max
  Peptide Sequence Number=SeqID_182094
atgggcagaaggaggttgttaatcgctgcttggaaacatttctttggtgctttgtttcagaacaacccaccaaatggtattcatggttgtcatgggccgaattctggtggtgtatgggcgcccaccccgtctgtgccgcgtttccttcctggcgaaactcaagtggattctgttgcttccatcttggtggatcgagatgaagctcttcgtcaattaaagttccacttgcatcctcataggcaacaatccatggctcaccgcatctgtcctaaattgtcgtcttgctattttggaccttcccaattcctttctcatgtgggagaagtggcctacaagcttaaattgccagatacaagccgtattcacccagtctttcatgtctcccagctcaaacgttctttgaaggatgggtccacagtcaattcccttcctttgggactggaaatgactgattctgattttcctgtaccagaagccgtgctagctactcgcgagaataagcgccagggtgttccaatacttgagtggctcattctatggaaatcacagccattagaagaggccacttgggaatctgctgtttcaattcaggagaaatttccttctttctgccttgaggacaaggcagcttctaacaagggtggtattgatgggaaaactaagtgggataaaccttacaaagtgtattatggtaggcccaagactaaaggggcttag

SEQ ID NO: 65317 - DNA, 882 bp, Glycine max
  Peptide Sequence Number=SeqID_182095
atggtttcccacaataagccttacactgtagccaccctcttctttctcgcattgttccttatctccatcttcttcttcttctccaccagaacaactcttcaccccgctccctccatccactcagatctctacatccacctccagccactttctccgcctccgcccctccaacctctttctccgcctcctcctccttttccgtccccacactcctcctccgccaccactgaaacccaacctgagcctgttggtgacattgaggatgtcgcggacaatgccaccgacgccgaatctgatgcccagcctgtaacggagaatatcgccgaggacgtagcgttgagtttgaaggtgtgcgatttgttcacgggaacgtgggtgaaggatgaaagttacccgatttaccaaccgggttcttgcccttacgtggacgaggcttacgattgcaaagttaacggaagaaccgacactctctactccaattggcgctggaaacctgatgcctgtgatcttcccaggtttaatgccacagacttcttggtgagactgaaaggtaaaagactaatgctggttggagattcgatgaaccggaaccaatttgagtccatcctgtgcctactacgtgaaggcctgcacaataagagcagaatgtatgaggactataattgcacagtgctatttgtgagatctcatttccttgtgagggaaggagttcgtcttaatggacaagggagatcaaatcctacattgtcaatagatcggattgacaagacatccggtcgttggaagaaggctgatattcttgtcttcaatactggacactggtggactcatggaaaaactgctcgagggattcgtgctagcattgctgcacaagaatgctga

SEQ ID NO: 65318 - DNA, 282 bp, Glycine max
  Peptide Sequence Number=SeqID_182096
atggggaggggcggcaaccggtatggtctcccgacccaactccccaaacatatcctcctattcatattcgatgagattcggggtcgggacagatatagtaatcttttaccctatccgacttttgattatcggaaaaaacctgaatccatacccgatcaacttaaatattacccgtcaaaatcgaaacggattgaaagagataatcacgggtatgaatttttcttgtcatgtatggttacaacacccatgaggccaatcttcgataaggcgcgtaatggatga

SEQ ID NO: 65319 - DNA, 812 bp, Glycine max
  Peptide Sequence Number=SeqID_182097
tattccctgactccgttgtcccctttgctgaacagaaactcgctcctttaactcacatttttagattgaacgataagtggtgtcaaagatgctttcaactcaatgggttgaactatcttcaactgtcaaccggtgatttgacttcctcatggtcaactagtttctctttctttaatgggggaggagatggaggccgccgctatggaaaggctgggatgtccaactccaagatgtctggaaaagatccatttaatggaaggaaatggacagaaattctccttgctgccaatgttttattttatattgcacaacttgcaacccaaggcaagctattattgtggggagcaaaggtaaattgttattccttgaactcagttggtcctactgtggagagcttcagtggccctcggagatttcttgcagtttactttatctctgcaattgcaagttctgctacgagttattggttctgcagaatgcctgctgtaggtgcatcaggagcaatttttggactagttggatcagttgccgtatttgtattaaggcacaaagaccttgtgggaggtggtaaaaaagatttacaacacatagcccaagtaattgccctcaatatggttattgggctattatccactgggattgacaactggggacatttaggagggttggttggtggagttgctgcatcatggtttattggaccggcatggaaacatgaatccacatcaagtgatggaagaagacttttcattgacactgcaccaatgtataaactcttcaagattaaaagagtacctaagcaatggaaatag

SEQ ID NO: 65320 - DNA, 219 bp, Glycine max
  Peptide Sequence Number=SeqID_182098
atgcccatgtcctctgaggccctccccactcttccacccccgataatgatgatgggagccatcgtggtagcaagggcaatgatggtggtagccatggtggaggctttgaatctaaaggttgggattgtgaaattaatctacagtcccctccaccaagctctccctgaatgcagagccccacctggtttcacttgtcgtctttgtggcgtccctaaataa

SEQ ID NO: 65321 - DNA, 888 bp, Glycine max
  Peptide Sequence Number=SeqID_182099
atggtacaatggccacctctaaccttggccaaggaacttcgagcttttcttggcctcactagtttctaccacaagttcattaagaactatacggccatcacaacacctctcacttcactactgtgcaaggacgcattcgagtggacttcgacctctcaaaccgtcttcgatcagctcaagattgcgatgaccagtgctccggtcttagctctaccaaatttctcagaatcgttcatagttgaaatagatactaccggcacagccatggggacggtaattcagacgccgaagcagctctactacctatccaagctactaggattcgactacaccatccagtataagtcaagcgcttccaacgccatggcagacgccctctcgctgccgcaattcgattttcttgatgatcttcgacgcacgttgcatgctaacccggaatttcaagctctcctatctaaggttcgcgccaacccatcaaaccatcccgactatcgcatccataatgagttactcctgttccaagggcacatatggttagacaacactaacccttatattcccaccctcttgctcgagttccatgccacgtcgttggggggtcatctaggcgtcgcaaagactacccacagactccaatccaatttctactggcctaacctccgacaggacgttaagcgcttcgttcgagagtgcaaggtttgtcagcagaccaagatgagtactcgtcgtctggaaggtcttctgcaacctttgctgattccgattggggtatgggaggatctctccatggatttcatcacccatcttcgcagtcccacgggttcacaaccattcttgttgtcgtcgacaggtattcaagggtgttcacttcggtgcacttccctctag

SEQ ID NO: 65322 - DNA, 537 bp, Glycine max
  Peptide Sequence Number=SeqID_182100
atggcggagagttgggactctgcgttatcgaagaagggtctcaatggcggagagttgggactctgcgttatcgaggggttgggatgtcattctgttgaggcatacagaaaggctataaagacctggggaaaatggatcgatgataatatcaatccacgaaaacagattgtctactatcgtggatattctaatgcccatttcagaggtggggactgggactcaggtgggtcatgctacggtgaaactgaaccagcttttaatggctctatcctgaataactatcctttgaaaatgaaggtagtagaggaagtgatccggggaatgaaggttcccgtaaagttattaaatgtcacaaagctgaccaatttccgcaaggatgggcacccatctgtctttggcaagaatacaatgggtggaaggaaagtctctacaaggaagcaggattgcagccattggtgtcttcctggggtccctgatgcatggaatgagctaatttatgccactcttgtttttcaacaaacaaattcaaggaattga

SEQ ID NO: 65323 - DNA, 202 bp, Glycine max
  Peptide Sequence Number=SeqID_182101
atggtgcattgcataaggcgaatggaatcactcggtattcgtagtgcccttgatgcgtgtgaaacatggttttctcaatgtcagagatttgcttttctatctcgttcttctgaaagtgtggatagcggtatggccggacgttcatcggaggggctgaggggaggagggatatatggtggtctatggctcgctgcggtggaag

SEQ ID NO: 65324 - DNA, 354 bp, Glycine max
  Peptide Sequence Number=SeqID_182102
atggcacaggtaccccctctctctgaggaacaatacatgggatttttctcaggtggtttgcgcgaagacattagaatggaggttttaaccttcgaaccacctaatcgccactgtctgatctttgtggcacgtctgatcgagcgcaagttagatcgtactccctttgtctatggtgcacgcaaattgcaacccaatcgtcgaccatttccttctggtgctcaaatcggaaccccattccttagagagggagaagacctgacgaaagacccaccaacgtcgtcggaagattcgcctgagcccgatcctcaagaattggtttgccaagctcttgatcttcacgcgttggatccttga

SEQ ID NO: 65325 - DNA, 393 bp, Glycine max
  Peptide Sequence Number=SeqID_182103
atgggctccgacgggtgcagagaaacgcgagggactggaaccagagaagcgacatgcaaaccgaggcaggattttaacattcaaaaggaaaaagaaagaggaagcctttttaaaataaaaagccacgttctctctctcttcacccactcagaaaaatttagaagctctcgtcaccttctcacgttgcttttcttcttcccttctcatccaccgtcgttgcccattaaagctccaaactttgctcaccatttctactccaaatcacaaaaagaagtcattttcggagtcgtgaagcgcacctctacattgtgggacttcaaatttcaggtttgggtagacttcttctcacatgattttcgttggtattgggtttttgggagatatgatgggtag

SEQ ID NO: 65326 - DNA, 210 bp, Glycine max
  Peptide Sequence Number=SeqID_182104
atgggtttcgcagatggtgaagaaaaagaagggtggtggaagaaagcggttgtaggaggaggaagaagacatgatgaaagaaagagggcgtcaactttgctcgcaataaggaggaacgatgtgacatccacggctccacaccttagtgacaccttaatgatgaggagcttcgatgcgatgacatcgatgcttaacgaggcggaatattaa

SEQ ID NO: 65327 - DNA, 240 bp, Glycine max
  Peptide Sequence Number=SeqID_182105
atggctgcttcacttgccaaactactaacatataaggcatttcatgcctacagtttgggtgagttgggtcttgggactcaccagggccagggccaggacagacttcaagtctcaaagagcacttacaaaggtgcttatagattacccaccaacaagttccttacatccacagcggcaatcgaacccacctccttttggaatatgagtgtgttctttaccaactggaccaacctttgttga

SEQ ID NO: 65328 - DNA, 3312 bp, Glycine max
  Peptide Sequence Number=SeqID_182106
atgagttgttattttctgaaactattttatgcacttttgctgcttttattgcatgctgcaggatccattcttggattcaacagccttcccaatagcgcagaaattaagtgcattgagagtgagagacaagcactcctcaacttcacacatggcctcatagacgactctggcatgctctctacatggagggacgatgacactaacagagactgttgcaaatggaaaggcattcaatgcaacaatcaaactggtcatgttgagacgcttcatctccgtggtcaggatacacaatatttgataggtgaaatcaatatctcttcattgatttcccttgaaaatattgaacacttggatctcagctataatagttttcaagggagtcatatcccagaactcatgggctcgttcaccaatttaagatatctcaatctctctgattctttatttggtgggagtattccttctgatcttggaaagcttacacatttactgtctctggatctaggtaacaattatttactccaaggacaaattccttatcaacttggaaatcttacacatttacaatatcttgatctaagtggtaattatctggatggggaactcccatatcaacttggaaatctctcacagttgaggtatcttgatcttggttggaattcattttcgggagcactccctttccaagttgggaatcttcctttgttgcacactcttggacttggtggcaattttgatgtgaaatctaaggatgcagagtggttgactaatctgtcttccttgacaaaacttaagctaagtttactacacaacctttcctcttctcatcactggcaacaaatgatcagcaagcttattccaaacttaagagagttgaggctatttgattgttctctttcagatacaaatattcaatctctgttttattcaccttccaacttttccactgctcttaccatcctggatctttcttcaaataagctcacatcctcaacatttcaactgttgtcaaactttagccttaatcttcaggagctttatcttggtgataataacattgttttgtcatctcctctctgcccaaactttccttctcttgtgatccttgatctttcctataataatatgacatcatcagtctttcaaggtggtttcaacttcagctcaaaacttcaaaatctttatttgggaaattgtagtcttactgatcgaagttttcttatgtcatcttctttcaatatgagttcttcatcttctcttgtttcccttgatctctcctcaaatctgttgaaatcgtcaactatattttactggctctttaactccactaccaatcttcataacctcgtcctttataataacatgttagaaggtcccattccagatggatttgggaaagtaatgaactctcttgaagttcttgacctctccggtaacaaactgcaaggcgagattccatctttctttggtaacatgtgcgcattgcagagtttagacctctcaaataacaagttgaaaggggaaatttctagcttcttccaaaattcttcatggtgcaacagatacatatttaaggggttggatttatcttataaccggttgactggcatgttacctaaaagcattggattgctatcagagttggaggatcttaacttggctgggaattctttggagggtgacgtcactgaatcccatctttctaatttttccaaattagaaatgttgtccctatcagagaactcgttgtctctgaaattggtcccgagttgggttcctccattccaattaaaatacttgggaatcagatcttgcaagttaggccccacctttcctagttggctcaagactcaaagttctttgtataggcttgatatttctgataacgggattaatgactctgtaccagactggttttggaataacttgcaatatatgagagatttaaatatgtctttcaattatctcattggttcaattcctaatatatcattgaagcttcgtaacagaccgtctgtacttctgaatacaaatccgtttgagggtaaaattccgtcatttttactacaagcttccctgctgattctctctgaaaataatttttcagatttgttttcattcttatgtaaccaaagcacagctgcaaattttgaaactttagatgtatcacacaatcaaataaaggggcaactcccagattgttggaaatcagtaaagcaattagtgtttcttgatttaagcagcaataaattgtcagggaagattcctatgtccatgggcgcccttgttaatatggaagccttggttttacgaaacaatggtttaatgggtgagttgccttcttctttgaagaattgcagcagtttaattatgctggacctgagtgaaaatatgttgtcgggtccaataccatcatggattggagaaagtatgcatcaattgataatcttgaacatgcgaggaaatcacgtctcaggaaatctacccattcatctctgttatttgaaccgtattcaattgttagatctttcaaggaatagcttgtcaagtggaattccatcatgcttaaagaatttgactgcaatgtctgaacagaccatcaactcaagtgacactatgtctgatatatatcggaatggtaagacttacgttgtattaaatggttacatattcggaggttatacgcttgacataacatggatgtggaaaggtgtggaacgggggttcaaggatccagagttggagctcaaaagcattgatctttcttgtaacaatttaatgggtgaaataccaaaagaggtcagatatttgcttgggttagtttctttgaatctatcaagaaataatttgagtggagaaattccttctcagattgggaatttaggttcactagaatcacttgacttgtcaagaaatcacatctctgggagaattccatcttctctttctgaaattgatgatttgggaagattagacttgtcacacaactctctttctggaagaatcccatcaggaagacattttgaaacctttgaagcctccagttttgaaggaaatattgatctttgtggcgaacaacttaacaaaacttgtcctggggatggagatcaaacaacagaagagggtcaagaaccaccagtcaaagttgatgattctgttttctatgagggattatacatgagcttggggattggatacttcactggattttggggcttattagggccattactactgtggcgtccttggagaattgcttacatcaggtttctgaacagattaacagactatgtatatgtatgcttatggtga

SEQ ID NO: 65329 - DNA, 174 bp, Glycine max
  Peptide Sequence Number=SeqID_182107
atggttgcgcaacttgtcttcttgaagcgtggaatttttcaatcacaagtatttggcagtgattggagaacaaagtttatcatgattcatattctccaagaaaaggtcctaaggcttattctaagtccaactcttgagaaggtactccaatgtgcaaaggtatctaaggtttag

SEQ ID NO: 65330 - DNA, 531 bp, Glycine max
  Peptide Sequence Number=SeqID_182108
atgaaaagagcactgattctgataacagcaactacgacaacagatgcagaaagtaactgcggctttccaaggagcaatcatccatgcttgagaacagcttcaaacagcatagcactcttaatccgatatatatttcatagggctaatactaatgctataactatttttgttatgtcgttttgttttacaccacgaggtaagaggattttatatatgcgttggttttggttccacatgcaggtccagaaacaagcactagctgatcaattgaatttaaagactagacaagttgaagtttggtttcagaacagaagagcaaggaccaaactgaagcagacagaagtggaccacgagttgttgaaaaaacactgtcaaaatctaagtgatgagaacaaaagattgaagaaggaattgcaggaactacgtgcacttaaggttggaccgtcgccactatgcattcaactatccaaaacggcgactctgacaactatgtgttcttcctgcgatcgagaattaaaactagtaaattaa

SEQ ID NO: 65331 - DNA, 1557 bp, Glycine max
  Peptide Sequence Number=SeqID_182109
atgcttccggcactgtctcaattcaaggttaaccatgtgggtgtggggttcaattcgtcccctaaccccattcccatgcttcccgcgctccgtcgcagccgctgtgttgtcctctttcgcctgcgatcctattcctccacagacttcaaaatcaccgcccacgtcgaaactgactccaccgttcacttggagcgttgctttaacgcgcccgtcgcttcccacctcccttccatttccatgaagggcggccagtatggtgccttcggtgccgttaccttggagaaatccaaactcgatatgtcgcaaaagcaaacaaggtctagccccgagctagacattgggggaggtgggggagatatcggaaagaaaatcaatcatggtggtggtgatggaggtgatgatgatggggacgatgacgattactttgatgacttcgatgatggtgatgagggagatgaggggggcttgtttaggagacggatactttttgaagagctatttgaccgaaaatttgtggatgctgtgttaaatgagtggcaaaagactatgatggatttgcctgctgggcttcggcaagcttatgaaatggctgttaagcatagggtactgactgaattttttgcttttaggggttggccaaccaccagtaggtttatttcccgaactctgcctcaagcactatcaaggtctttcattggcaggttgcttgcagatcctgcattcttatataggtttctattggaggaggctgcaacagtaggttgctcattgtggtgggagataaaaactcggaaagacaggataaagcaggagtgggatcttgcactcatgaacgtgatgacagcagcagcatgcaatgcactagtcgtgtggtcccttgctccttgtcgatcatatgggaacacttttcggtttgacttacaaaatacattgcagaagcttccaaacaatatatttgaaaagagctatccacttcgggaatttgacttgcaaaagagaattcaatgctttttgttcaaggctgctgagttgtgcatggttggtttgagtgctggtgcagtacagggtgcgttgtcaaactctttggctagtaaaaaggaggggagattatctgtgacagtcccaagtgtgagcagtaatgctcttggttatggtgcttttcttggaatttatgctaacctgagatatcaactgttatgtgggtttgatagagcaatgatgacccattttgacgtcattggagttgccttgttcttcagcacagcattcagggtcttgaacgttcaattaggagagacctctaagcgtgcctggcttggagttgaggcagatccactggctcagtcggatgacctcttgaaagtttataacaggacttctgagaatgtagaaaagtcatcctcaaaatggtttatatcaaagaatgcggttgtttctgggcttggactcctaggcatcaaacaaaggaatgcagacgggtctggttcagaatcttcagctcctaaatctcgccggaaaaggattgttcggaagaaggttgcagcgggttctgcttag

SEQ ID NO: 65332 - DNA, 871 bp, Glycine max
  Peptide Sequence Number=SeqID_182110
atgtctctgacaggccgtcctcgtgttgttgctaacgggagaaccgtcagaataccctttacaaacaatgatgatggttttacttctacgtgcccctattgcttccaccaactgcgttatgagcttgatatctcaaggccaaggcttctcatgaacgtgccgaataacttagagccttcacctgctactcaactattgcataacttggctctcattcttgatccacctcttaggaggcaaaacaaccatttgatcaacacaatcccacattgggaaacagaaaattatgaagatggttcaaattcatcaaatcctcatcaggcttggattacactccgatttccaaggccaactcgtgtacctaggcctatttccaatgacactgatgatcatgatgacaccctttttgagaacaatgcactattagatgacttcattgatggggtgattcagaacaataataatagaccagggccacctccagcagcatcttcagccattgcagcattgccaatggtcaagctgacacaaacacatttggcaagtgaccccaattgcccaatttgcaaagatgaatttttgcttgacatggaagctagagagttgccatgcaagcatttctaccattctgactgcatcatcccttggctgcgcatgcacaacacttgccctgtgtgtcgctatgagctacaaggtgttactagtgctaataatgctaattactaccgtttacaaaatgatgatgaaaatgctgcaagcagcttggtctggatttggaaccaactggcttcgttctggcctatccgttctgttctagattgggcactgtcctactttaatttccaagaaaatcatgttcgtggtcgtagag

SEQ ID NO: 65333 - DNA, 432 bp, Glycine max
  Peptide Sequence Number=SeqID_182111
atgaccactatcagctccaccgcaataggctaccatcagcatgcctctacagtagcacaattcctctattatgaattagattcaactataatcctttcttcatataatttttcatgtcaccttaagatccagacacacgtacgagggaaaaagagaaaggaagagcaacgtaagggggagactctccccctttgccgtgtccggtgtccgacacgcgtccgttgtcgtgtccggtgtctgtgtcggtgtcggtgcttcatagggggagagagaccaggcctggtaaaggagagacagagagaacgagggaagaggcaacaagcgagcgacaataaccaatatgagagggatccggagagcaacatgaggggtagagagatcgtacaagtagccaccactctatgggtaggtggtggtggtggtggtgggtga

SEQ ID NO: 65334 - DNA, 441 bp, Glycine max
  Peptide Sequence Number=SeqID_182112
atggagaaagatgaattagagagggataaaaacgatgggagcccccaagtgccaactccgaaaaacaaagatagtcatgtggcaactaagaatctaagatgtggctcaactaggatggtccaaattgattacatgatgagttcttcaatcttccttctatgttgtcttctcatattctctttatattccctctcccaacacacgggctactctctagatgctactccaacacggaagttgagcatgccagcccctgtccacgatcacaaaacccagcataaaatgcagggagcagaaaaggcaatggaaagtaccccagcaaacgaagattccatgacaccagattataccagcaacagttacagtccccatgatcttgtctttcatatagattaccatggagtaacaactcatccaactcctaaacatcccaaaccatag

SEQ ID NO: 65335 - DNA, 1152 bp, Glycine max
  Peptide Sequence Number=SeqID_182113
atggaacctctccctgatgccattcttcaatacatcttgtcccatatcaataatgcccgcgatgtggcggcttgcaattgtgtttctaagcgatggaaggactcaatggcttacatcagaatgctctacttccctcgcaactcatttgataacccttctcttggtgaaagtacggacgacattgtgaaaagaatggtatcagcagttgtgcgattggaagaactagttgtatacagccccttctccacatccggccttgcttcatggctatcacttgttggtatgtctctttctcagctcgagcttcgaatggactaccttgctgaaagtcaagactcccatgaaagcccttcaaaattggattgcattggtgcagcaaggaatttggaatctctaaaactctggggtgtcttaatgatgcattccccaaaatgggatgtcttccaaaatcttagaacccttgaaataattggtgcaagattggaagaacctgtattgactgtggtgcttcagtcatgtccatatctgagaaggttgctactgcttggatgtgaaggggtagcatcgatctcaattgaccttccctatttagagcagtgtaagctggatttttatggtccagggaactgttcacttacgctatcctccccaaaaattgaatcccttgaggtacaaggctgtagttggattagggttcctgaaacccagcatttgaggaatctttcaatatccaatagtgcagggagagtgtatatggttgattttggaaaacttccagctctggtgttcctgtctatgagggggatccagtggtgctggaatgcaatatgcaaaatgctgaaattggccagtgaggtgaagcatatttatatgaaggtggaattcactggggactatgaggctcttcaatcctttccagagatcgattttgttgattttttcaacaaccatcccaagctgcgcaagtttgacatccatggagccatgtttgcagcactttgccagaggaacagcctgaaacatgtggatccgggatttttaattccatgtttggaggaggttgtgatcacagtgaggtcaccactaaatgctgaacaaaaaatgagtactcttgaatccttgttgaagtatggcaaaaagctaaggactatg

SEQ ID NO: 65336 - DNA, 1395 bp, Glycine max
  Peptide Sequence Number=SeqID_182114
atgcagaaaatttttgaagcacttgtgcctgaatctgtatataatgatgcccgtaatttggttgaatattgctgctttagatttttgtcaagggatggttctgatattcatccttccctccaggaccctgcattccagaggctgatattcataaccatgcttgcctgggaaaatccttacactaatgacctttccagcaattcagagaaggcttctttacagaataaacttgtcactgaggaggcttttgttcgtcttgctcctgcaatctctggtgttgttgaccgtcccacagtgcacaatctttttaaggcacttgctggtgatcaagagggcatttctgtgagctcgtggctgaattacattaatgaatttgtcaaagtgcgtcaaaaactgatatcatatcagattccagagtttcctcaactttctgaggagagaattttatgcattggttccaacagtaagcggcctgttctgaaatgggagaataatatggcctggcctggcaagcttactcttactgataaagcaatctattttgaggcagttggcatactggcagagaagagagccatgagattggatcttacgcatgatggattacaggtagagaaggcaaaggttgggcctttagggtctgcactttttgactctgctgtttctgtttcttccggctcagagttgaatcggtgggtgctggaattcatcgacttaggaggcgagatgaggagggatgtttggcatgcatttataaatgaagtcatcgctttacataggttcatacgcgagtatggacctgatgattctgatgagtcattgtttaatgtatatggagctcgcaaaggaaaggatagagcaacaaccactgcaataaatggtattgctagactccaagtccttcaatatttgcggaagttgcttgatgatcccaccaagcttgttcagttctcatatttacagaatgcaccacatggtgacattgtcctccaaactttagctgttaattattggggaggtccactagttacaggatttgtaaatacccggaatcagccagaaactcgaccttctgatgaaatagctgatagccgcaaccatgtatttgatatagatggaagtgtctacttgcagaagtggatgaaatctccatcttgggggtctagtatttccactagtttttggaagaacatttcagtaaaaggtttaatattaagtaagaatcttgttgtggctgatttatcactcatagaaagagcagcaaaaacaagcaaacataagtaccacattgtggagaagactcaagccaccattgatgctgcaactctacaaggcatacccagcaacattgatcttttcaaggttggatgcttaacttgctcttgtcttctttga

SEQ ID NO: 65337 - DNA, 1467 bp, Glycine max
  Peptide Sequence Number=SeqID_182115
atggatggtggcttgaagaggattgtctacaacttggtgtatgagaaggaaaagatatgggccaacattctaaacaagagtgttcttcataaagcaggtggtctgttcgacatatgcaatgcaaccctcatcaacaagctcttgtgggatcaagaactataccatgtgttcaacaagatgggcgaggattctgagcacaccatgttcaatgtcgacgtgggcgccatcaacaagaggaaacagaaaaggctagccaaggtcatcgctgatgaagaccaaggtctgaacaactttggtatttcaagaaagattcagaagatcatggctgaacaacagaaaagaaaaaaagaccagaaaatagagcacaagactagaagacatgaacctactgcgtctactcctgaacgtccaccggtagtgaactcagtcgcacaaaggttgaaagacctaagtgagactgatgaagatgatgaaggtttggtgcgagtggccaagcaaaagaggaaagtagctgctccatatgcccttacaccaaagaaggcaaagaaaactcaactagtctctgaacctcgggcatttgtcatcctttctattattctaagacatattaagacaagggcgactaaggctaacctaaagattggtgataaagaatgggcaatttgcattactagaaacaaggaagatccaacctcttcctcatcagataataagtccaccaatgatactcttatctcacccctccacaagcatgcatcgtccactcaattgcatccacctccatcccctctacatctagacaaattcagaagggttgctcccagggaaccattaaccgatgctcagaggtttcctctagcattcattaatgataatcctacacctacaacccccttctctgaagtgctattctttgaacctgtagttagggaaaaaatatcagtccaagcacccgtgtggatgcaacatgactatgtgcacactccttttgaggcatttaaggtgtggggtactccaaaggaaaaaggatttgagctttattgcaaagaagacatgcctacaaggaaaatgaaggtggagattgtgaacttccctccctccacttctggctatgatggaggtgacattgttgtgcatcgcgatgttattcaagtgttacgtcctattaggaagtatcactttgatgacacttgcgtttgctttaccaaggatgttgatagatactcattcatacaacatcttctcaagcttccaacaattcagtacgaaggcacctacaacttgaaaaagatatcaaaagaaataatgatggctcatgtgactaagctccatgaagctcaacaaaaaaagaaggttgacaaagatgatgttgttgttgagaaagaaattgttgttgtattgtttgaattagccatgtgcgatttgcttgatgtggatgttgagttatgtggagttttattgacctag

SEQ ID NO: 65338 - DNA, 1653 bp, Glycine max
  Peptide Sequence Number=SeqID_182116
atgagaggtgttagtaggatgcttaagatacagagtgagaaatgccctgtccctccattcgatgttgttcacatgatcgttaagaagggcttcctcaccaccgtggcgcaaaaatgcaacaccctaacccaactcaagcagctccacgcccacatcctccgatgccgcatcaacgacacgccttacgccctcgccccgcttctctccgtcctagccacctccaacgacgcgtcgttcttctcctacgctcgctccatcttccgccacctcactaaccgcaacaccttcatgcacaacaccatgatccgcggctacctccaatgccggtcacccctccacgccgtgtcctgctacttgtccatgctccaaaacggcgttgccgttaacaactacacgttcccacctttaatcaaagcctgcattgcgcttcttccttcttctccttcgaacattgttggtcgtttggtgcacggtcatgtcgttaagttcggtctccgcaacgacccttacgtggtgagcgcgtttattgagttttactccgtttctcgcgaggtggacaccgcgagagtgttgtttgatgaaacgtcatataaagatgtggttttgggaactgcgatggttgacggttatggcaaaatggggaatgtgaagagtgcaagagaggtgtttgataaaatgcctgagagaaacgctgtgtcgtggagtgccatgatggcggcatattctcgtgtcagtgacttcaaggaagtgctggctttgtttacagagatgcagaacgagggaactgagccaaacgagtctatactcgttacggtacttactgcgtgtgcgcaccttggcgcactcacgcagggactgtgggtgcattcctatgcaagacgattccatcttgagtcgaatccgattctggccacggctttggtggacatgtattcgaaatgtggatgtgtggaatctgctttatctgtttttgattgcattgtcgacaaggacgctggcgcgtggaatgctatgatttcaggcgaggcattgaatggcgatgcagggaaatcgttgcagttgtttcgccaaatggctgcttccaggaccaagccgaacgagactacgtttgtggctgtcctcactgcttgtactcatgcaaagatggttcagcagggcctttggttgtttgaagaaatgagtagcgtgtatggagttgtgccacgaatggagcattatgcatgtgttattgaccttttgtcgagagctgggatggtggaggaggctgagaaatttatggaggagaagatgggtggactcacagctggtgatgctaacgtgtggggtgctcttctgaatgcgtgtagaatacataagaatattcatgttgggaatagggtgtggaaaaagctggttgatatgggggtcactgactgtggtactcatgttcttacttacaatatatatagagaagctgggtgggatgtggaggcaaacaaagttaggagtaggattgaagaagtagggatgaaaaagaagcccggatgcagcataatagaggtggataatgaagttgaagagtttcttgcaggcgatcattctcatccacaagcacaggaaatgtgcaaattgctcgattccattctcaagatggggactttagagcacttctga

SEQ ID NO: 65339 - DNA, 555 bp, Glycine max
  Peptide Sequence Number=SeqID_182117
atgtttccattgctggttggcaatctgactacagcctttggttctgcctggatgatgctctctcgcccatttattgaatactgtatatgggggtgggacaacttacctagaatagtcttgatgtattatgccaactttctgtcttccccggaagggtattttcacacagtcatctgcaatgctgacgagtttcgaaacactaccgttaatcacgacctccacttcatatcatgggacaaccctccaaaacaacacccgcattttcttacagttgatgactaccagaaaatggtggacagcaatgctccttttgctaggaaatttggcaggaacgaaccagtcttggataagattgatactgaactcttgggacaaaatgcagttggttatgttcctggcaggtggttcagtcaagcaaattcaagcatcactaataagtattctggcataagaaatatcactgacctaaggcctggccctggagctgaaaggcttggacgccttatcaatggtttattatcagcagaaaattttcacgcaaatcagtgttcttga

SEQ ID NO: 65340 - DNA, 1215 bp, Glycine max
  Peptide Sequence Number=SeqID_182118
atggaagtgacgaataaatacatagtaataaagcatcacgttgaagatgcacctaaacagtccaattttgagctcaaaactaaggcttttgctctgtcagttgagtcaggatctgatgatatcattgtgaagaatctctacatttctattgatccctatcagattaaccgcatgaagagttatagctcttcccagggcactataaactttgcagtgcccataaccccaggcgaggctattgatggtgctgttattggaaaagttgtggcttctgggaatgctaagtttcaaaaagatgatttggtgatgggagtattcacttgggcagagtacagattcaatggactgtcagcttatgcggggttttttgaattgtgtaaacccctaaagggtgaaaaggtctttgtctcaacagcttctggagcagttggaaacttggtagggcaatatgcaaagcttttaggttgttatgttgttggttgtgcagggagccagaaaaaggttgcattgcttaaagaaaagctaggatttgatgatgcattcaactacaaggaagaaacagatctaaactccactcttaaaagcggaaaaagtcaaaaccacaacatcatcccggaggcacctcacaatagaaacgcgaaaagccaaaaacacccaatagaaacacagaaaaaggacgaaaacggaaaccgcgtcgaaaagggaacctcacctgaacgaaaaagatgcagagaatgtgacctcgttggagaaagcgcgaactgtggtgacctcgccggaaaacacgagaacagggagaggttgcgtgaacggaaagggtttttgggcgcgagggagtattttcctgatggaattgatgtatattttgacaatgttgggggtgagatgctggaagcagcggttgctaacatgaaagcatttggaagagtggctatttgtggggtaatatctgagtatactagtgctggaaagagagcttcaccaaacatgttggatgttgtgtacaagagaatcaacatcagaggatttttagctgctgattttctgaatgtttttgaagatttttccacaaaaacttcggattacatacgtacagggaagttgaaggtgattgaagacttgtcattgggggtggagagcatcccttctgcttttgttggactcttcaaaggggataacattggaaagaaaattataagtttaacagaagagtga

SEQ ID NO: 65341 - DNA, 273 bp, Glycine max
  Peptide Sequence Number=SeqID_182119
atggcgaaggagatgcagcaacagttgatctttgtgtttgtgctaataataactttgatgagtttcatgatgttttctgcagaggccagaaacctacatgatgcttttcagcagcagcatgcaatggcacctagtgctggtggtttgcaattgaatttgcaaatgcaaagtttaattcaatcaacattaatcggctttgggatgttgccaaggggagcaattcccccatctgggccttctacaccaactcactcctgctactactactgctag

SEQ ID NO: 65342 - DNA, 216 bp, Glycine max
  Peptide Sequence Number=SeqID_182120
atggcgaaggagatgcagcttttgatctttgtgtttgtgctaataataactttgagtttcatgatgctttgtgcagaggcgagaaacctacatgcttttcagcaacaggcaatggaatatggtgctgctggggactggttcccccatctgggcgttctacaccaattcaactctgctagggcatgcatatattgcaactacgaagttcaaagctaa

SEQ ID NO: 65343 - DNA, 858 bp, Glycine max
  Peptide Sequence Number=SeqID_182121
atggcgagttcaaagctcatggaaaaaggatatgtaacagaaagcttgagttcttatgtagttctagttcttcttgttcctaagaaggatggatcatggaggatgtgcaatgattatagagctatgaacaatatcacgatgaaagagcctaatgagtacaataggaagatcagaagtgaagtgtccaaccaaatgaaagatatgaacaaggatgttcacaagaccaaagaaaaaacaagtgaaactcggggtcctcgggggaactcctcgacaaggaagaagcacttatgcaatgtgtgctttgtggacatggtggccatgggaaataggatggaaatgctcgacataaccttcacaagtgcaaactttaagagattagattctgaagaagatgatcccatgaccatcactactaagatggcaaatttctttgtaaggaaaaccctaatagacaaatggagtttagcgaatatcttattctgtaaaacatttaagcagatggacattcttgagttcatgctccagctccatgacgacccactctttggatttttcagggaaaaagtccttataagagggtttattgaacttatgacaagcgcctactctggatataaccggatccgcatgcaccctagagatgaagagaagatggctttcataactgaattgacaaactgttgctaccaagtcatgtcatttggtcaaaaaattgtgggagctatgtaccaatgcctcatggataagatcttcaaagataaaattcgtagaaatatagagtccgaagactttcaaagagatacaaagactcacaggacgcatagcctctttgataagatttctaccttggatagctga

SEQ ID NO: 65344 - DNA, 1059 bp, Glycine max
  Peptide Sequence Number=SeqID_182122
atgggtaagaaggatgatagaaaaggtcctcctagagatagaaataggagagatgaaagattggtaatagacctctatcaaaaactacaaagtcttaggcaagggtttaggagtgtggaggagtattatcaagaaatagaggtagctatgataagggctgatgtgaatgaaggtagggaggccacaatggcaatgttcttgaatgggttgaataaagaaatagctcacatagtggagttgcaacattatgtggagttagaagatatggtgcatatggcagtgaggaattggaacaaggaagaaaaggttgctccaaaaaaggctttaaaagcaaagaagaatattccatttacaaagtttttgggagcaagtcatattgcctcacaatgccctaacaagaaagtcatgatcatgtgtgacaacgaggtgatgattgaaggagaaaatgatggtgaatctatgctctcacttaaagatgcaactgataatgagattaagtatgtagttgaaggagaagcacttgtttctagacatgttttgaattcccaagttaaggaggataatgtagagaaacaaagagaaaacatattccatactcgttgccttataaataataaggtatgtagcatgatagatgggggaagttttgcaaatgtagcaagtactacattagttgagaagttgaacttgtctaccattaaacaccctagaccttataaattgcaatggttgaatgattgtggggaggttaaggttaaacaccaagttctggtttctatctcaattggtagatacaatgatgaagtactttatgatgttgttcctatgcatgttaggcagatgcttttgggaagaccatgggagtttgatcgtagggaaaataaagatgggcacaccaacatatattcatttgtgatgaataataggttcattactctcgcatcactttctcctaagcaagtgtatggggatcaaatcaaaatgaataaagatagagagaaaaaagaaattgcgttgaaaaataaggatcataagaaaaagagtgagataggagagtga

SEQ ID NO: 65345 - DNA, 414 bp, Glycine max
  Peptide Sequence Number=SeqID_182123
atgattttgttggttaaaattgcttatataacttaccaagtctcaattgtgtccaacaaaagaattggaagagaaaataatgtgagagaggatggggaagggtgtgggtgtcatgaggtagaaatgaaagaggaagggagaatggttgggggtattgggagatgcctcgagacttgtcgcgatcccgatcacctccctataggcggaggcattcaccatctcctgtgggacacaggtatagcaggaggagcagaagagacagaagcagatctccttattcatcctactcttacaacagaaatgaacatgacatttccaggattacagagctatggtattttaatgaccaaagcacgtaggttgaagttgaatcacatggttgataatgctagttatttatggattgttatttaa

SEQ ID NO: 65346 - DNA, 489 bp, Glycine max
  Peptide Sequence Number=SeqID_182124
atgttgttgtctggcgatgaagatacctttattgatgatggactacttggtttcctcatccattccctcaaagacgtgaaagacatgatattccctaaggagtttgttgacaagggtagcatagtagatgtcatccactccttccaaattcttcatgttcctcataatgttgatgtagattgtgtgtggaaggtcgaaggggacctcatccatcatatggaagagcacaaatttatgttgaaggttgtattgagccttctttttcccatctgtctccttgagattctttccctagagaaattatggaatatgcttgacgcaccctgtgacttgtgcaatggcatccatggacaacaccacctaatttccaagaaccttggacataatctttcaatccttgagttgagtgttcctccagaacattctaatgagttttgggtatatcagttgtggattgttgaagtaaccacagatgccacagagctttag

SEQ ID NO: 65347 - DNA, 333 bp, Glycine max
  Peptide Sequence Number=SeqID_182125
atgggggtgagcttagctattatagagggaatcttcttaaagaagcttctcaaggaggtgagcttagttatgagagggactcatcttctccttgaagtggtgtctcctctctctctccctttctccattccgctgccattcatcttccaagaagcaaaggaatccattgatgaagaagatcctaggcctacaagctccaatggagcttgcatcatgtggtatcagagctccattgattgcttgcacaatagtcttggcttgactcttgttgatactcttggttcatatgcatgttgggagatgattaggcattttgttcttataagcatttag

SEQ ID NO: 65348 - DNA, 672 bp, Glycine max
  Peptide Sequence Number=SeqID_182126
ggctacacgccctcgccaatcagaggacgcaatgtcctcaccttcagagggctacacgccctcgccatcagaggactgcatgtcctcaccttcgtagggctacacgccctcacctttagaggaccacacgtcctcaccttcagagggctacacgccctcgccatcagaggaccacacgtcctcaccttcgtagggctacacgccctcacctttagaggaccacacatcctcaccttcagagggctacacgccctcgccatcagaggaccacacgtcctcaccttcagagggctacacgcccttgccatcagaggactgcatgtcctcaccttcagagggctacatgccctcgccatcaaaggactgcatgtcctcaccttcgtagggctacacgccctcacctttagaggattacacgtcctcgccaacagagggctgcacgccctcacctttagaggactacacgtcctcgccaacagagggctgcacgccctcaccttgagaggactacacatcctcgccattagagggctgcacgccctcacctccagaggactacacgtcctcgccaacagagggctgcacgccctcacctttagagggctacgtgtcctcattttcagtgtgctccacatccacaccttaagagaatttaaggtcctctgtccttaa

SEQ ID NO: 65349 - DNA, 639 bp, Glycine max
  Peptide Sequence Number=SeqID_182127
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagagaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatgg

SEQ ID NO: 65350 - DNA, 513 bp, Glycine max
  Peptide Sequence Number=SeqID_182128
atgctcacatataagaggtcaaatcaccttgaagtgattggctactcagatccaaactatgttgggtgcatgaactcaaggaagtctacatttgggtacatctttcttttggctggcggagtggtatcatggaaaagtgcaaaacaatccatgattgccacttctaccatgaaggctgagtttgtggcatgctttaaggccacaattcaagcattgtggttgcagaactttactttagggtttggaattgttgacaatatagccaaaacgctgaggatttattgtgataactccacaactatcttcttctctaagaatgacaaatacttgaaaggagcaaaacacgtgggtttgaaatatttgtcaattaaagaaaagcagaaacataaagtgtcaattgagcatattggtacaaacttaatgatagcggatccattaactaaggtttaccaccaaagatattcattggccatgctgaaaggatggatattatggataagtccttgtttatga

SEQ ID NO: 65351 - DNA, 900 bp, Glycine max
  Peptide Sequence Number=SeqID_182129
tcgaaaagtcgttctagttcaccaagaggtcacagaagtccttctactactccaagacgtcgtagaagccgaactccatctgctaaacgatacagaagacatagaagtaggagttcctcgttgtctcctactcgtaaatcttccagtccaagtcttgggtcagtagagcacaaaagtgccactgaaaaactaaagaaagaagaagagaagaaaagtggcgtgtttggttcacttctgattccattggatgtcctaatgctttatgctttcttttttcaaccaatgaatatctcctttgagccttgcagggaagtaggagcttacatggttatggacttagtttttatagcacacccactcagaaaagattggcctgatcctctgaatcacctccaagggggtctagtcatcaggcgtcaactagaagcagagttgaaattaatagaagaagagactgcaaagagagttgaagaagcaatccgtaagagagttgaagaaagcttgaaatctgaggaggttcaggtggagattgaaaggcggttggaagagggacggaagagacttaatgatgaagttgcagctcaacttgaaaaagaaaaggaagctgctattattgaggctaaacagaaggaggagcaagcccgtaaagagaaagaagatcttgaaaggatgcttgaggagaaccggaggaaggttgaagaagctcagagaagggaagctttagagcagcaaagaagggaggaagaaagatataaagagctagaagagatgcaaagacagaaggaagaagccatgcgaaggaagaaacacgaggaggagcaagaacgtctaaaccaaataaagttgttgggtaaaaacaaatcccgaccaaaattgtcatttgctcttggatccaaatga

SEQ ID NO: 65352 - DNA, 1389 bp, Glycine max
  Peptide Sequence Number=SeqID_182130
atggaggatagcactggaaggtttgatgagaagtccttttcaaatggggatgtctacataggtatgatcaagggcatactgccccatgacaagggaaagtacacatggtcagatggaacggtattcgagggcaattgggaaggcgagaaaatgacgggaaagggactgattgtgtggtcatcaggagcacagtatgagggtgaaatctctggaggttacctagatggttatggcacacttacaacatctgctggatgtatttatcgaggggggtggaggatgaatgctcagcatgggattggacggaagcagtattccaattctgatgtttatgagggtttatggaaagaaggagttcatgaagggagtggcaggtatacttggaataatggaaatatgtatgttgggaattggaaaaatgggaaaatagatggtagaggggttatgaagtgggttaatggtgatacttttgatggtttatggttaaatgggcttatgcatggatcaggagtttatagatttggagatgggggtctttatattggggcatggaataaaggcttaaaggatggaaaaggagtattctatcctgcaggtagtaaacatccatccttaaagaagttgcatagccctcatgatagtgatcataacggtttcttgttgaatgtagaaaaacaagaggctccaaaagccagagttaagcgtagcctttctgaaaacatgccggtcattagtagatttaaaagtttccgtcaaatatctcacaggacctcgtcattgaaaataaatttgatccgtaatgattctgctcaagattgtgtatgtcatgattcttctcttccattatccaatgccgtggatgatgaccaatctgaggcatcgagtgaaagtactttggtttatgaaagggaatatgtacaaggagttctaattatggagagaattagtgagtgctctgagtcatcacgtagaaagaaacagcaaaacaagtttagtgtgaagcaagtaaagaagagttcatgtttggacatttttgaaggacggcaaagctattatcttaagcttaatttgcagcttggcatcaggtataccgttggcaaaattacaccagtgcctgcacgcgaagttcgatcatctgattttggggatcgagctagaataaggatgtacttcccaagggctggttcaaagcttactcctccgcattgttcaataaacttctactggaaagattattgccctatggtcttcaggaatttgagagagatgttcaggttagatgctgcagagtacatgatgtccatttgtggagatagtggactaagggacttgtcttctcctggaaaaagtggtagcatcttctatctttctaaagatgatagattgtga

SEQ ID NO: 65353 - DNA, 1096 bp, Glycine max
  Peptide Sequence Number=SeqID_182131
atgaagttcatcactgaagggaagtttgtggaattgcaaggggagcgcgagcaagtaggtgaacccgtatccccttcacaactacgtcgtctcctacatacgaattcctccagcactttttttcacattaaagtagaagctaatacacaaacagctaccatacctcccaactcacctgagatttcagcattactcacaaaatactcatgccttttccaacctctaacaaaccttccaccatcaagaaccacagatcacaccataaacttactacccaatgcaacaccagtgaatgttaagccctacaaatacccgtattatcaaaaacaagaaatagaagagcaagtctcagccatgcttgctaagggcttcattcagccaagctctagtccgttctcctccccagttttattgggatatcatcaaatcctgatgaacaaggaggacgtgggaaagacgacatttcgaactcatcaaggacactatgagtttcgagtgatgccttttggattatgcaatgcaccatcctcattccaagccacaatgaaccagctgttccaaccttatttacgcaaacacataatcatcttcttcgacgacatattagtatacagcaagaccattgttgatcatcttctccacctggaaaatgcctttcgtaccctagtagcatgtcagttctcacttaaaatctctaaatgtacgtttgctcagcaacaattggagtacttggcgcatattgtgacggcgttgggagttaaaccggtgccggaaaaggtacaagctattcaaacatggcccaatccacgctctcctcgggccttacgtgggttcttaggtctcgcggggttttatcgtcgatttatcaagggatacgcgattctggcatcaccattaactaagcttttgagtcaaggccagtttcagtggttgccggaagtcactgaagcattccaaaagctgaaggatgccattaccgaagctctagtgctagcgttaccagacttcaaagcacccttcgtcgtggagacggatacatcaaacacgggtatgggcgcggttctatctcaagggggtcaccccattgcttttttca

SEQ ID NO: 65354 - DNA, 229 bp, Glycine max
  Peptide Sequence Number=SeqID_182132
atgaaattttatcgtgaacgtatgctcgtgtacctgtatgttcacatcctgacacctttcctggcacctaatttcatctctgtttcccactgttaccttcagtggtgctacctccttagtgacgaggcccagtgttgctacaactctgtgatggaggaaattatgagtacttcctccatctatgagtatgcttacatggaatccattgatggttcctttcaagcgcaag

SEQ ID NO: 65355 - DNA, 261 bp, Glycine max
  Peptide Sequence Number=SeqID_182133
atggcgccaatacctcctgggccaccacttacagaccatagaagtcttaaggaactcatggcacaagcaatccaaactccagagcagcagacataccttgtgcgcttaataggttatgactatacgattcaatatcgtgctggaagagttatgataatccctatcgtagaagacagagttaccatgaatatgtttgttatccagcataaaggtccagagtttatcaggctcattaacaagcgaccagacatgcttgcctag

SEQ ID NO: 65356 - DNA, 480 bp, Glycine max
  Peptide Sequence Number=SeqID_182134
atgacccacatgaagaaaactggtcaaatgacgtttgagcctgccaaggaaattacagacaagattgattacttggaggagcaggccacacagggaagctttgtctcccatggacatcagaatgtactgactgctaccattaggcaaccagagcaccctggtcgtgtctgtgctattggagccaatgtcacaatcaaacactactttggactggcttcaaagggctcccgcacctcttcatccatggctgctgaagacctagagcagctgacacgaaagatcagagaccagctgaaggaactcgcactaccttttgtggctgaggttggtccttctgctggtcatgtcagcacaaaggaaagttgtatcgattcctcgagagtttatgaggggtcaatgactatccacaacgttcatttaggcaatggtcaagtaaaggtcggcgttgaggaagtccgagatgttgatactcccgttcat

SEQ ID NO: 65357 - DNA, 1962 bp, Glycine max
  Peptide Sequence Number=SeqID_182135
atggaggtatcatcatcatcttcatcatctgcacttattgcattcggaatggcgtttcgtcattcaccaatcccttcttctctcgcaatttcggcttctgtgtcaacaacggagccacacactcaaccttacagaaattccgtcaaacttggaagctccaaaaccttctcctccgcaagaaaagcagccacactcgaagttcggaacgcttctgatttggcctcagctctcgcaagggtaggagacgcgttgacggtcaaagacctcaatgccgctttgtatcactttaaaaagtcaaacaaattcaaccatatctctcagctattttcgtggatgcaagagaacaacaagcttgatgccttgtcttattcccattacataaggttcatggcaagtcataatcttgacgctgctaagatgctacaactctaccacagcattcaaaatcagtcagccaagataaatgtccttgtatgtaattctgttctcagttgtttaatcaagaaagccaagttcaattccgccttaaatctctttcagcagatgaaactagacggtctacttcctgatcttgttacctataccacgcttcttgcaggttgcattaaaatagaaaatggatatgctaaggcattagagttaattcaggaattgcaacacaataaactgcagatggatggagtgatttatggaacaattatggcagtgtgtgcttccaatactaaatgggaagaagccgaatactattttaaccagatgaaggatgaaggtcacacgccaaacgtttatcactatagctctttgatcaatgcttattcagcatgtggaaactacaaaaaagcggatatgttgatacaagatatgaaatctgaagggttagtaccaaacaaggtcattttgacaaccttactgaaggtatatgttaaaggaggcttgtttgaaaagtcaagagaattattagctgaactgaaatctttgggctatgctgaagatgagatgccatattgtatattcatggatggcctagctaaggcaggacaaatacatgaagccaaactaatttttgatgaaatgatgaaaaaccatatttattccccacatgcagatggctatgcccatagtatcatgatatcagcattttgccgagccaagctttttcgggaggcaaagcagttagccaaggattttgaaactacttccaacaaatatgacctagttatactgaattcaatgctctgtgctttctgtagagtaggtgaaatggaaagagtgatggaaactctaaaaaagatggatgaattggcaatcaatcctggctacaataccttccatattctaatcaaatatttctgtagagaaaaaatgtatctattagcttatcgaaccatgaaggacatgcatagtaaaggccatcaacctgtggaggaactctgctcctctttaatatcccaccttggtcaggtaaatgcttattcagaggcattctctgtttacaatatgttgaaatatagcaagagaacaatgtgcaagtcacttcatgagaagattctgcacattctcttagcaggacagcttttgaaggatgcttcatctgatgaatcttatcctgttcaggataatgcaaaatttatttctcgtccagccaccaaaaaatttgctagtgcatttatgaagtcaggtaacctcaactatataaatgatgttctaaagaccctccatgattgtggctacaagcttgatcaggatttatttgcgatggccgtgtcacgctatttagatcagcctgaaaagaaggatttgcttctacacttactacaatggatggcaggacaaggttacgcggttgattcatcaacaaggaatttaatcctcaagaattctcacttatttggccgtcagctcattgctgaggttttgtccaagcaacaagtgaagttaaaacacaaaaatctcactagttaa

SEQ ID NO: 65358 - DNA, 528 bp, Glycine max
  Peptide Sequence Number=SeqID_182136
atgggttgcagcgccagattgctgccaataagcctggccaaagatctgccgagagttcacaaaatttcactggctttagttcttagcatggaagctgtagccccaaatggctacagaggtaataccaagtccaagcttattgccaatgtattgtttaggatggggggagcagccattttactatctaacagaaaacaacacaagccagtgcccaggtacaagcttgagcatcttgtgagaactcacatcggatcaaacgacaaagcatatcagtctgtttatgaggaacctgatgaagacgggaatatcttggcaagggtgaacaaggaaatgtatgtgccgaatttcaggaaggcttttgagcatttctgcatagatgccggtggtaagtcagttgtcgacgccatagaggaaagtctcaggctgcagaagaaagacggcctccaggatggcactatacagatttggcaatacttcatcttcttctgtggtatgagccgtgctatttggaggcaaaaggaagagtaa

SEQ ID NO: 65359 - DNA, 1272 bp, Glycine max
  Peptide Sequence Number=SeqID_182137
atggagctgctcagctctttgaggaaggaggacatactggagctcttctctcatggcttctgttcccactgcgaggatattctgcatactcgaattacaaaccttcgtaaaagaaagttggatgaaacttcatctccggatgaagaaggctttgaatcttctggggatcatgtagtagacaagccagtgaatattggtaatgtttcaaattcagaatctttgactaaaaaccatgaaaaacaatgggatagtcctaggaactcctcacaaaggcgtgattctactacaccaatgaaggatgatatcaaaaacattttttattcttcacctaagtgtttagtaggctgcaaacaatctgatttcaagttgttgttaaatgatggaatttgtggagattcttcatttgaaaatggtgggttatcagaggaagaaaaggagcagatcaggtattctcaggttcactgtaaaaaggactttaccttcgttgaaagggtaaataggagatacgtaaatgtactccgggggcttgaacttcacactggagttttcaatgctgtggagcagaggaaaattgttgagtggatttacagattgcaatggaggggacaacaagggaaactgaaagatcgaacatattcagaaccaagaaagtggatgcgtggtaagggccgcgtgacaatacaatttggttgctgttacaattatgcagtggacaaaaatggtagccctcctggcataatgagagatgaagaggttgatccattaccacctgtgttcaagcaaatgataaagaggatggttaggtggaacataattccttccacatgcattcctgatagttgcattgtgaacatatacgaagaaggagactgcattcctcctcatattgaccatcacgattttgtgaggccattttacactgtgtcattcttgaacgagtgtaaaatattatttggttcaaatttgcaagttgtttgtcctggagaatttgccggtcccgtttctattcctttgcctgttggatcagtgtttgttttgaatggcaatggagctgacattgctaagcattgtattccatccgtgtcgtcaaaaagaatttctattacttttagaaagatggacgagagcaagttaccatataagttttcacctgatcctgacttagtgggaatcaagccacttataatttcacctctaaacaaaggacaagatgaagttgggaacctagataataaggctgacagtgttgaatctgaatctgatacaggataa

SEQ ID NO: 65360 - DNA, 489 bp, Glycine max
  Peptide Sequence Number=SeqID_182138
atggtgagtctttcggattatggagttgagtggtttgacccatcgaatcttggtacatcaagcttcattcgaggagggttactgatggttgtgcttggtgtaggtgtggctgaggacgaagatggggctagtttggccattgcttcctctaggtgctccaagtttgatttagaacgcgtggattcagccatgagggtcaatgaaagcaccgacgttggtgatgaaacaatcctccattggttgagagattgcataaaaactgttgttgtttggaatgctctcaggtgtttggcaacgggtggtcatggaattatcttctctccattgcgtgctggttcatctggaagtgcacgttcttgtgacacaactaagccagctctccaattagtgctgcaaggcaatggggtcgctgatatccttgcaaaacatggtgcaatggactctacctccttggtcacttatccctcacctcccctggagatgctatag

SEQ ID NO: 65361 - DNA, 201 bp, Glycine max
  Peptide Sequence Number=SeqID_182139
atgcctaacttcagagttcataatgccacactatcttcagagttcataatgcctaatgaagaatgcctaacttcaagtgccaaacgaagaatgcctaacttcaaagttcataatgcccaaagaagaatgcctaaccataatgtcattctacacttgttcaagctaacttcagagttcataatgtcattctacatcacttag

SEQ ID NO: 65362 - DNA, 555 bp, Glycine max
  Peptide Sequence Number=SeqID_182140
atgaagagccctaccattttcattctctttctactttctgccttctacacctcactcctaccttcagccaccgctcaagtcgtgcttgacacggaagtagtgtcatcatatggtggaataagagtagccgcaactggaaaagaaagacgccctctcactgttgtacaatctcccaatccgtttgataagggcattggaacaattatttcatccccatatcgatcctattttatcggcgaaagctttcctgtgaacatgacgttcggtaattttgcagttatactgccttgtgtcccccttcgttctgagtggactgtcgttaatggccaaccagaaggacccgcagttaaaattggtgcgcccccaaatggagaaaatggttggtttggaattgagaaacctgagcgtagcacatgtcagcatattgggattcatgtcgatgatgaaaatcacgcgcgtttggtgttgacaaatgatgatccactagaggttaagtttgagaaagataatcacttctggccccagaataatctagtgcttcctagaagtgagtga

SEQ ID NO: 65363 - DNA, 711 bp, Glycine max
  Peptide Sequence Number=SeqID_182141
atgcccttccttatctttgagcttggggtggatctcgagacgggatttttgctttatggacctcctgggtgtggtaaaacactgattgccaaagctgttgccaatgaggcaggggctacttttattcatattaagggacctgaacttttaaataaatatgttggagaaagtgagcttgcagttcgtacaatgtttagccgtgcaaggacatgtgcgccttgcatacttttttttgatgagattgatgctttgacaaccaaacgtggtaaagaaggtggttgggttgttgaacgactattgaaccagttgcttgttgagttagatggcgctgaacaacgaaaaggtgtttttgtgattggtgctacaaataggcctgaggtgatggatcgtgctgtcctacggcccggaaggtttggtaaacttctttatgttccacttccaagcccagatgaacgagttttgatattgaaagctcttgcaaggaagaaggctgttgatgcctctgtggatttgagtgccatagcaaaaatggaagcttgtgaaaacctaagtggcgcagatcttgctgcattggtttgtgtctgccctttattaatgagtaccaggggtactacaaataacagaggagatatatctcctgatatagaacataagacaaaaaaccccacaaaggaaacaacaccaccccaaccatacacaataacaacttaa

SEQ ID NO: 65364 - DNA, 303 bp, Glycine max
  Peptide Sequence Number=SeqID_182142
atgattttcatctgtggtgaagtagcatcgtacctcgtgctgccacaagatcaccgcaatacaaacatattatattggaagatcaagtatgtaagccggcttcagtacctttgggatgatataaagaaaggagagattgagataccagattttgttaaaagtcatgatgatattctggagaatagaccactcacagattatggcattgaacctgacccctttcacttgactggaattccttcaactacctactcatttggaaagtacgaggagagatgggcgggaaggaattatgtgtcttag

SEQ ID NO: 65365 - DNA, 720 bp, Glycine max
  Peptide Sequence Number=SeqID_182143
atgagaaaacgcaccgtttacgcatggcttgtagcacttctttgcttcctagttctcatgatcgtcaccccatccatcccccagtcccaagaataccatgatttcgccgaccaccgcaccttcctcggtattcctaatgcacttaacgtcatatccaatttcccttttctggttattggcctcgttggacttgtgctctgttatcatggaaattactttaggctcagcttgcaaggtgaactatggggatggacatgcttctatgttggtgtggctgcagttgcagttggatcttcattctatcatctcaagccagatgatgctcgccttgtgtgggatcgcttgcccatgactgtcgcttttacatcaatcatggcaatattcatcattgagcggattgatgagaggaagggaacagtttcaattatacctctagttttggcggggtcttatcttctagctaaggtgctagaggctactgatgatgtgatctacgaatggacgcgacatattgtcagtggtcacacacttaagcatctggttgcagcaatggttcctgtcttcttaacattcatgcttgctaagaggagtgttgaacctgagaggcaaagtttgcttaaaacgtggagggtttcctggacgaagttcagagagggcaactccaacactgaaagctactcttactcttacacaaatgtgcaggctgtggagccccagtga

SEQ ID NO: 65366 - DNA, 870 bp, Glycine max
  Peptide Sequence Number=SeqID_182144
atggagatttctgatgtcagtggagataaattgacatttttggcttccaagctttgggggaactggatcggttcaggtgctaggagaggaaaattggtattgaagttttggaaaactcagactgagtttcttgaacatcaagctgaaacctctacaagtaatcaaaacaccaggtctgtgggtgaggattctgtcatcaaaattgataaagaggacccaccaaaaagttttactttatcagccaaagagacattaaaagcagcaattatacattttggtaaaaagtggtataggcgtatctcattcatttggagacacacaatgcagatcatcggaagttttcagaagctgtggaatattgctggtgtacacctaaatcttgatatccccaaatggatgcatatccttcgtttggacaggcttaacactaatgcagtgcaatggcttaacaagaaaggcaagttatttgaacccacatatctttatactatggaaaaggggtatttcttgttacctgaaagtgctaagtctcatcataatatacatactgtgaatgttagcatatcagcctggtactcctgctttggaaacaagtggcagcaactactaataaacagatttgttggatatgatacgattttaatcaatagtttattgagttctcatggtcaaggttatctttataactatcaaacaaaggaattctataaccttagttatgcacaagaagttccagaagggccagctagactaccttgtaacaaagtgtggtgtgctgatgatgtccttgtttgtattttttactaccacaatgtcagtatcatttacattaagagaaacacagactcgcatgctgaagttcacgggtag

SEQ ID NO: 65367 - DNA, 147 bp, Glycine max
  Peptide Sequence Number=SeqID_182145
atgtcgtgctcgacacatgatggtgatgttcttcaaaatgtgcgtgcaactggaaacgaaagatgctctctcactgttgcgcaaactcccaatgagctcgataaggggattggaactcgtaataaggaatattcaaaagtaagataa

SEQ ID NO: 65368 - DNA, 3147 bp, Glycine max
  Peptide Sequence Number=SeqID_182146
atggcgcagtctctcgagctgttgctgattcagttcctcatgcccgacaacgacgcccgccgtcaagccgaggaccaaattaagcgtctggccaaggacccccaggtggttcccgccctcgttcagcacatgcgcaccgccaaaacccccaacgtccgccagctcgccgccgtcctcctccgcaagaagatcaccggccactgggccaagctctctccccaactcaaacaactcgtcatgcagtccctcatcgaaaccattaccatggagcacagtccccctgttaggaaagccagtgccaacgttgtcagtatcgttgccaagtacgccgttccctccggcgagtggcccgatttgttgccctttctcttcgaacgtagtcagagtgcgcaggaagaccatcgagaagtggcattaattctcttcagctctttaaccgaaacaattgggaatactttccggccgtattttactcgtctgcaagatcttctgctcaagtgcttgcaggacgagactagcaaccgggttagagttgctgccctcaaggcagtgggatcttttctggaattcactcatgacgagattgaagtgattaagtttcgtgagttcattccaagcatcttgaatgtatcacgacagtgccttgcctcaggagaagaagatgttgccatacttgcttttgaaatttttgatgagctgatagaatctcctgcacctcttctcggagattcagtgaaatctatagtgcagttctcccttgaggtttgctcaagtcaaaatttagagtctaacacacgtcatcaggcaattcaaatcatttcatggctggcaaagtacaagtccagtactttgaaaaagcataagctgatcacacctattctacaagttttatgccctttgcttgctgaatcaactaatgaaactgaagatgatgatcttgcaccggatcgggctgctgccgaagttattgataccatggctttaaacatcccgaagcatgttttccaaccagtttttgaatttgcttctgtaagctgtcaaaatgcaaacccgaagtttcgggaagcttctgttactgctttgggtgtcatttcagaaggttgtttggaactcatgaaaactaagctggaacctgttctccatattgtcctgggagctctaagggacccagaacaaatggtccgaggggcagcttcctttgctttgggtcaatttgctgagcacttacagcctgaaattgtatcccattatgagagtgttcttccctgcattttaaatgctcttgaggatgcctctgatgaagtaaaggagaagtcatattatgcgttggctgctttttgcgagaacatgggtgaagacatccttcctttcttagatcctttgatgaaaagactgttgacagctctccaaaatagttcccgagttttgcaggaaacatgcatgtctgccattggttctatagcttctgctgcagagcaagcattcattccttatgccgaaagggttttagagttgatgaaaattttcatggtgttaactaatgacgaggatcttcgttcccgtgcaagagcaactgaactagttggaattgttgcaatgtctgtagggagagtgagaatggaaccaatattacctccttacatagaagctgcaatttctggatttgggctggagtttagtgagcttcgggagtacacccatggattcttcagcaatgttgctgagattttggatgacagttttgcacattatcttcctcatgttgtgcctcttgcattttcttcctgcaatcttgatgatggctctgcggttgacattgatgagtgtgacgatgaaatcactaatggatttggaggagtttcatcagatgatgaagctcacgatgaaccaagagttcgaaatataagtattagaactggtgtgttggatgaaaaggcagctgcaacccaggcccttggcctgtttgcacagcacacaaagacttcttatgcaccctacttggaggagacactaagaatcttggttaaacactccagttatttccatgaagacgttagacttcaggctatcatttctttaaaacatattttaactgcggcccatggaatcttccaaagtcaaaatgaaggggctgctaaagcaaaagaacttcttgatactgtgatgaatatttacatcaagactatggttgaagatgatgacaaggaagtggttgctcaagcatgcactagtgtggctgacatcattagagattttggttatgcaactcttgagccgtacttgtcccagcttgttgatgcaacttcattgttgcttcaggagaaatcttcttgtcagcagatagagtcagacagtgaaattgatgatgttgatagtgcacacgatgaagtgcttatggatgcagtttcagatcttctccctgcatttgcaaagtccattggtgctcaatttgctcccatttttgcacagctatttgaacctctaatgaaatttgcaaaatcttctcgtcctcctcaagataggactatggtagttgcctgccttgctgaagttgctcagaacatgggttttcctattgcaagctatgttgatagggtgatgcccttggtacttaaagaactagcatcatccgaggcaactaatagaaggaatgctgcattttgtgttggagaattgtgcaaaaatggtcatgaaccagctttgaaatactatgacaatattttacgtggactttatcccttgtttggtgagtctgagcctgatgatgcagtgagagataatgctgctggtgccgtggcaaggatgatcatggtacaccctgaatctatcccattaaatcaggttcttcctgttttcttgcgagttcttccattaaaagaagaccgcgaggagtctatggctgtctatagctgtgtctccactcttgtattctcatccaatccccagatcctgtccctagtccctgaattagttaatctttttgctctagtggtggtatcacctgtggagacgcctgaagttaaagctgtagtaggcagagctttttctcatctaatttcattatatgggcaacaaattcaacctcttctgagcaatctcccacctgcacatgcaaatgcattatctgcatttgctcaacggagttga

SEQ ID NO: 65369 - DNA, 1647 bp, Glycine max
  Peptide Sequence Number=SeqID_182147
atgggaagaagaaacggtggtaggtcccttcaagaaaccctccgtcgccgacttgagtcatgcaaatccaaatactccaccgccgaagaattcgccaaccatctccgttcaacttatcccgattaccaccgaaccaagcaccaaaccctaattcgatttgttcaggaagctcttcattccaccgccaagcttaatcacactcccacacccaagcactgcgacggcgacgacgatgacgacgaagaaggagaggctcaaagcgcgtctcgaaagcggcggaagaaaatcgatgggagtgaagagagattgcagaggatggaagcgttacacgtccgaagcaaggtgcagagatcttcctcatcgtcctctgcttcggagagcgacgatgaagatgaagaagaaaccgtgtcgacttcggaggacgcaatttacggggagaaggtggagcctgagtttgatttgatgaagacaatgctgcgaaagtcgtatacgccgaagaaggttgccgcggaggaaaaaaacgttgaattggaggtggggaatagcagtaaggacactcttgtgaacgaggaaaggaaggaagtgaagggctcaagttcgggttcggtttcgaacaggaaggacggaccgaggtttaaggatttgggtgggatgaaggaggttttggaggaactgaagatggaagtgatcgtgcctttgttccacccccaattgccaagacagttgggagtgagaccaatggctggcattttgttgcatggaccacctggctgtgggaagactaaacttgctcatgccatagctcatgagactggtcttcctttctatcagatttcagctactgaggtggtttctggagtttcaggtgcatctgaagaaaatattagagagctttttgctaaagcgtacaggtctgcgcctgctattgtctttattgacgagattgatgcaattgcatctaaaagagagaatttgcagcgtgagatggagaaacgtattgtgacgcaattaatgacttgcatggatcaatcaaataggcttcttcaaccagcggatgatgtggagagttctggtgatgatcatcatcctggctatgttcttgtaattggagctactaataggcctgatgctgttgaccctgccctaagaaggcccggccggtttgatcgtgagattatcattggcaatcccgatgaatctgccagggaggagatcctttctgtgctcacttgcgatcttagacttgagggtttatttgatctacggaaaatagccagggctacatcaggattcgttggtgctgatttggcggctctggttgacaaggctggtaatcttgctatgaagagaataattgatgaaaggaaacgtgaattatctcaagatctcacgagtgagcatgctgaagactggtggagggaaccttggtcggttgaagaaataaacaagcttgccatcaaaatgtccgatttcgaggaagcagctaataaggtgcaaccttcattaagaagagaagggttctcttccattcctaatgtaaaatgggacgacgttggagggcttgatcttttaagaaaggagtttgaacgttacattgtaagacgtataaaatatcctgaagattatgaggtaatctttaaatactaa

SEQ ID NO: 65370 - DNA, 402 bp, Glycine max
  Peptide Sequence Number=SeqID_182148
atggagaatcatcgacgtcgtactcaagtgacaacaagcgatgatgaagacgaacaagaaaaagaagaggtattgaaacggtctcgtcctgtggaagacgctaagcctattggcgagcctcttaagtattctggaaaagggaaaagcaagaagtggcactatgactcctttgaattcaatggcatccaatatactattggggatcatgttcttttcaaacccgaggaaaagggccaaaagccatatgctggaattattaaggacattacacagggaaataatggcaatgtggtagtgacgggacaatggttttatcgtcccgaagaagctgagaaaaaaggtggtggaaattggaaatcgtgtgattcaagggagttgttttatagttttcactgtgatgat

SEQ ID NO: 65371 - DNA, 351 bp, Glycine max
  Peptide Sequence Number=SeqID_182149
atggccagagaagttataaggtattcaacaaatggaaaagaggtgcgagtggagaaaattacatgggtgaaaatgctcattccaaatccgagctatggttacaaatgcttgtacacttgccatgtggtcaaagtgaattggtggaatggtttctatattaagttgtttccgagggatattccatcggtaatggtaattatattttctgacggattagtaacgtatcagtgtatcacacaacacaattcactctatcactaccttggtcaaacaattcaatgggtggagatagtgctccgatatccagagaagaagaagagcagcgggagttttaatggtggaacattatga

SEQ ID NO: 65372 - DNA, 1155 bp, Glycine max
  Peptide Sequence Number=SeqID_182150
atgggagatcacccacgttctcaaccattggatttgcacaacctctttaagattccaaaaaacaaatccttgaaagatgttagcaaggcttacaaatcgcttgtatccaaacggaaccatcatgacaagaaaacccccgaggagccaacaacacccccaaggtttgaggagagtgataataaaagagtggatcaagacaattggagtcctaagttattttcaagggctgcaagcagaagatctaaaacgccaacgccaaaatcaaggcctatgtcaaggcacggaagcaggcgatgcacgacaccaacctctctatcgagaagttcttctagttctggtcgaaggagtgccacagaaattgctgcatcatctctcaaaaggattatgagcaaaagggtttctccgccttctttatcaagtaataagttggacatctctgaacctgagttaaccaaccatgtagcatctccaacaaaagatgcagatgctggcgcaaagacaaccacccgaaagactcaacatattcctgcagtctctctgtcaagcaatatgagttgtaggtcaacaacacctatcatattttcacagacgacaactagaaggaaacccccacaagttgagaggacgctctattgcacgcttgagaacttatgctttggatgcaaaaaaaatgttaaagttactagagatgccatcaaatttcccggggtaattatccaagaggaggagattttaaaaattgaggtgaagcctggatggagaaaaggaacaaagattacatttgaaggggtaggtgacgagaaacctggatacctccctgctgatatagtattcttgattgatgaaaagaaacaccctttgtttaggagagaaggcattgatttggaaataggtgttgagattccactagtagatgcacttacaggatgcttcatatcaatccctctattaggaggggaaaatatgggtttgtcatttgagaatgatgtcatatacccaggatatgagaaggttattaaaggtcaaggaatgccagaccccaaaaataacgggataagaggtgatcttcttgtcagattcctcattgaattccccagagaattaagcgaagaacgacggaaagaagctgctagtatcctgcaagactgttgctaa

SEQ ID NO: 65373 - DNA, 552 bp, Glycine max
  Peptide Sequence Number=SeqID_182151
atggattctggaaagactaatgaagcacccaatgcaaagctggttcgtgactttgacttgaacatttcatatgtggaggagtttgatgtgaatgctgaagacaaactttcatcgcccattctcatgaatactcagccggcttctcaaaattgcattgaaaacatgaacattcaggatgaaattgcaaataacggggacacaactattcaagcaaattctgctgctaagggagttacctctgtctcctttgcaccaggaagaatctcacaataccgtcgtcgtcgccgccgtcgcagtgtagaatgtaagccgagtactgatccagatagactctgcacaaatacttattgtaaaacaagaagaactcccttgtggcgcaagggacctctgggaccaaagactttgtgcaatgcttgtggcattcaatatcttaagatagtgaagggtacaggcagtggcctccctgctgcagttgcagatgatgaaggtgatgcttctcctggtcctgtcccagctgctgaaatcgtggaagaaggggattcaaatctctaa

SEQ ID NO: 65374 - DNA, 687 bp, Glycine max
  Peptide Sequence Number=SeqID_182152
atgaagttctttcctcgcttctttttgctgtatttcctggtcttccacatatatttcttctcttatgcttatggtttttcatatttggccctttctacaactgcagcttttatgcaacaccttatcctgtacttttggaatcggtttgagagacttgatgaggggataggaaaacgtgggctaggtgaggtaccggcactgcaaaggtacatgcaaaatcgacggtcacaacttcaacaacacccagacttccacattacctcttcgaccattcttgcatcaacgttacacatcacaagattgaacacaagaaaccagggattaaataacaccgacttgccaactggagcagggttgagacctggttttgatcaatcaatgccccaaaatggaccaggagttgccgaccctcaaggtcggtcagaaaacaaccgagacagggttgcgaaccctgcccagattcctgggcaagctgacattcgacaagcagaaaggggtctgaaccctggatccatgaattcattcagttctttattattatggatcttaggaggtgcttcgtctgagggcctaaactcgtttttttccatgttcagagacgtgagagagcaaggacaagtttttaatgaaacacctggggctgcgaatgaaaaccctgagaatcaggataatatcgacaacagatag

SEQ ID NO: 65375 - DNA, 402 bp, Glycine max
  Peptide Sequence Number=SeqID_182153
atggagtcaattggattgccatatgagcatatattggctgcaatacttcatttacacttttctgaagtaccaaagtctttgatgctggataggtggtcaaaacatgcaaaagaaggaattgttagatgttatgctcatggctcaaactattggaatttggattcgatggctaaatatgtgactttagtgcaaatatctagacagaccgaaaggatcgatgtgggtcaagcaagaagactcgatctggaagatctcgtaaggtgtagacatgtagcaggtgtggtggaaatggacataacgagatcatgcggtagcagtaatcaacattatactggtgatggcaatccggatggggttattcccctagtcaggagagcaatgttgttcatgaatttgacctga

SEQ ID NO: 65376 - DNA, 339 bp, Glycine max
  Peptide Sequence Number=SeqID_182154
atggtgccacctgatgcagcaaagggttctattgggtccgcacccatgcttcaaagaaaagggaaaattcatgatccacgccctcacccattcaagaaccagattcatgtggagaaaatgattcttgggtcaatgctcccacccatcgacgttttcttcattgccacccccacaccctgtggtttaattggaatcttcgtcaggaaaaggactattcctgccatagatgtagtagtgggtgaacaatcaagcttctatttacttgatttggatgccagattggacgaaggagatggacatcgaggctgcgatgctttggtgcttgctaaagcactctag

SEQ ID NO: 65377 - DNA, 402 bp, Glycine max
  Peptide Sequence Number=SeqID_182155
atgaatgcgcacaccttaatggggaggtgggcgtttggtcggcgacattgtcagtgttttgggcatcgggacgctgaaggagaagaaaaagaagaagttgaagatgcagatgatattcaaattgacgttgaagatggagatgttagaggttctacagaaaatgctggggatgatggcatagttattgatgatgttacagacatcttgaagtttgacatggaaaatttgagcatggacgatcttaggagagttggttttaagcaaaagaacggtttgaatccaaactgtagaaagcacagatcgaagaacggaacaaggtgtggttgtgatgcaatgtgtccgttgctagctgctcatggaaaaatgagtgcaactgatatattgcaaattgataatttttga

SEQ ID NO: 65378 - DNA, 585 bp, Glycine max
  Peptide Sequence Number=SeqID_182156
atgggttctccaaacaaaaccggaatcatatcccaaactccttcctccctctgggtcttgaggtacaaaaccctaatcaccgcttcgagctctgtcattgtctcaagttccaggtttcagcgatttcgatctcgcatagcattctacaatggccgtgagtaccttcttcttgcactacccgaacttaattatcttccattttatttcattcacttaatcatcttggcagcaacgtataagcctgtttactatgctgatattagtgttgccacgtattttttatgtggggggggggggggggggttcatttactggaattatgtgactattccagttaaccccaagcctttcttgaacaatttgactgggaagcccgtaattgtgaaactcaagtggggaatggagtacaagggctatctcgtttccgttgattcctacatgaacttgcagctggccaacactgaagagtacattgagggacagtttactggaaatttgggagagattttaatcagatgtaacaatgttctctaccttcgaggagtaccggaggatgaggaaatcgaagatgttgcagaagactag

SEQ ID NO: 65379 - DNA, 219 bp, Glycine max
  Peptide Sequence Number=SeqID_182157
atggtgggaaccaacgagaaggagaagaagaaacataacttgaagagatgtaggctgtggcggtgccaaggtaggggcgatggcctttgtcggtgcttagatgatgtgcaacaacaccaaggaaaatacaacaatgtcaagatgtgcagagaagataaaagaaaaggggagactcgtgatggtttgggacaaagtaagggaagggttcgaggtagttga

SEQ ID NO: 65380 - DNA, 1983 bp, Glycine max
  Peptide Sequence Number=SeqID_182158
tgcatcaaagacttccaatcaaagctctcttccctctctctccccaacaacctcgttgacacatgcttcgaccctcttcagtttgtgatctccccaaacatctgtgctggaattcaaaccatccctgattggacaaaaaaagttggtcagtccacaccactcaacactgcttgcagatcagatctcactgacatctctctctgtgatgtgtgtttacaagctggattgcaggtcaagcagaagcttatttccattgatggtaatgcctcacattccattgattgtttttactttgccattctctatgctgctgggattgtcaatgagtttggacctgaaagcaatggtgctgtaagttgcatttttagcatatcagtttactcacaagggggctctgggggaaagcgtcaccaggctcttgtgtttggtttgacaggtgccggggttgctttgttggtcatgtcttcttttttggggatgtattcgtggtatgacaggaagcataggaggaaaaagcttgagacttttaatcagtttgattttgaccctgaggaacaaggtggctctaggcctagattgagacccaatacagggtccatttggttcaaaattgaggaacttgagaaggctaccgataatttttcatccaagaacttcattggccgaggtgggtttgggatggtgttcaagggaaccctgtctgatggaaccgtggtggcggttaaaaggatcttggaatctgattttcaagggaatgctgagttttgtaatgaggtggagatcattagcaacctcaagcaccggaatctggtgccccttagggggtgttgtgtggctgaggaggatgagaattgtgatgaaaggggaagcagccaaaggtatcttgtgtatgattacatgccaaatgggaacctggaagaccatatctttttatcatcaacggaggactctcagaaatcaaaagggttgtcattgacttggcctcagaggaaaagcataatcttggatgtggcaaaggggttggcctatttgcactatggagttaaaccagcaattttccacagggatatcaaggccaccaatatactacttgattcagatatgagggcaagagttgctgactttggacttgcaaaacaaagcagggagggtcagtctcatctcactactagagttgctggaactcatggatatctggcaccagaatatgcactctatggtcaactcactgagaagagtgatgtgtatagctttggtgtggttgttttggagataatgtgtgggaggaaggctcttgacttgtcttcatcagggtcaccaagggcattcttgatcacagattgggcttggtcattggtgaaggctgggaagatagaagaagctcttgatggttccttggtgaaggataaggatgagagctttcctagttcaaatccaaagagcataatggagaggtttcttctggtgggaattctgtgctctcatgtcatggttgctttgaggccaacaattgctgatgctttgaagatgttggaaggagacattgaggttccacaaatccctgatcgccccatgccacttggccatccttcttccttttacaataatgatcatggcagtacttttagcatatctcctgcattaagcggccccaaattgcaaactggagacatgctcagaaagcaaaaagaagtggaagctgttttcattctaaagtctgacaagggtccagtcaaatcatgtttggtaacaccaccacttcatttgagtattttcaactacaaaccaaatttgccctgtgtcacgttacaaataaatttcctcccaccaactgctctcaagatctcaagatcgaagcttgcagtgactgactgtaggacagatcttgtttgcgtcaacaaagtatatgcagtgttgtgttgtaatccaaaccatgaagaaaattaccagggcatgactataaccagctaccaaggaagctag

SEQ ID NO: 65381 - DNA, 237 bp, Glycine max
  Peptide Sequence Number=SeqID_182159
atgacagacaaccttccacagccgtcgaaggtggcgaccttcctcaaattgaaaatcatcgtcgacggcatttgtggactattggcagggattcgagcatttgacacaatccaaattctattttatctagagaggtttctagtatcaagcattgatattaaggagcatgacctggttatgcccgtaattctagtgtgtttggatcggtgtccaacttctaaaaacgtgataatctga

SEQ ID NO: 65382 - DNA, 2287 bp, Glycine max
  Peptide Sequence Number=SeqID_182160
atggaggggatgaacttcagttcatacaatcctcaactagcctctagcttgaagaagagttacagcaagcaagagcatgatcattcagtagagcgtaatcatctcaatgaagaagatcatatgtctccctctttcaatctgcggaatatttcaaagctcattctccccccacttggtgtttcaagccagaatccagttaactcaaaaggatggatcatatcaccaatggattccagatacaggtgttgggagagttttatggttcttctggtagcttattctgcatgggtgtatccctttgaagttgctttcatgcacaagtcttccaataaggaaatctatattgtggacactgttgttgatcttttcttcggtattgatattgttttgacattcttcgtggcttacattgatcgaaccactcatctactagttcgagacaagaagaagattgtagtaagaaagtgggcctcccatacttcctcttgggcctgctcagattttggagaatcagacgggtcaagcaatacttcacaagttcattgtgctgggtgtctgtattacatgctagctgatcgttacccccaccaaggaaagacatggattggagctgtgaatccaaacttccgagagacaagccttcggatcagatacatttcagccatgtactggtccatcactaccatgaccactgtaggttatggtgacctccacgctgtcaacaccatagaaatgatcttcattattttctacatgctctttaaccttggcctaactgcttacttgattggtaacatgacaaatcttgttgttgaaggaactcgccgtaccatggagtttgaattatatgcaattgtgactaatgtctcatgtagtttcatggtattatctgtgcagagaaatagcattgaagcagcatcaaattttgtgtgccgaaatcggttgcctccaaggttaaaagagcagatcttggcttacatgtgcttaagatttaaggcagagagcttgaaccagcatcagcttattgaacagcttccgaagtcgatttgcaaaagcatctgccagcatttgttttttgcaactgtagagaaagtctatcttttcaaaggcgtctcaaaagaaattattttgtccctggttgcaaaaatgaaggcagaatacataccacccagagaggatgttatcatgcaaaatgaagcaccagatgatgtttacataatagtctctggcgaagtggagatcctcgatactgaaacggagaaagaaagaattttagggactctacatactggggaaatgtttggagagtttggtgcactttgttgtagacctcagagccttacctacagaaccaagactctcacacagctcctgagactcaagaccaatactcttctagaagcaatgcagattaaaagagaagataacatacaaatactcaaaaattttcttcagcatttcaagcaggttaaggatctgagtatcaaagatttgatggtggagaacgtagaagaagaggaccctaacatggctgtgaacttgctaactgtggcaagcactggcaatgctgcttttcttgaggagcttctaagagcaggtttggatcctgacattggagactccaaagggaaaactccattgcacatagcagcatcaaatgggcatgaagggtgtgttaaagtcttactcaagcatgcatgcaacatgcatataaaagacatgaatggtaacactgcactatgggatgctatagcatcaaaacattactcaatattccggatcctcttccagctttctgctctctctgatccaaacatagcaggcgatctcatgtgtacagcagcaaaaagaaatgaactaacagtgatgaccgatcttctaaggcaaggactaaacgttgactccaaagatcaccgtgatacaactgcaatccaaattgccatggccgaaaatcatgttgacatggttcagttgcttgtcatgaatggtgctgatgtctctgatgtgcataaccatgaattttgttcatccaccttaaatgaaatgctgcagaagcgtgaaattgggcatctaattaatgtaactgaggtcatgctcagtgaagttgtattaaaagggagacatcaagagcaggagcacaatggaggaagatctaatagtggactaaagtttccaagggtaagcatatatagaggtcaccctgtagttagaagagaaaaatgttccatggaagctgggaagctaataaggttgcctgattcaatagaggaactaaaaactattgcag

SEQ ID NO: 65383 - DNA, 657 bp, Glycine max
  Peptide Sequence Number=SeqID_182161
atggcatttgcaattacatttgcctatttggatggtgaagatataaacaatgttgtttgggctcttgaacggtttagaggtgtttttatgagacatgatgcaatccctcaagttattgtgactaacaaagattcaacattgatgaatgcaatgaaaattgtgttccttgaggcaactaacttgttgtgtcgggttgagtctgcacattgggccttaaagaaactactgcataataaccttggagatccatgtagtgtttgggaagccatgaacaacatgatcactctgcaacacactgaaataaaggcatcttttgagacaagcacacatgtggtcgaacatgtttttaaagctaccttatacaagagactaattggcatgatatcaagatatgtgttaaaccagattgctgctgagtttgagcgagtaaattatgttggcattgacagttctcgttgtggctgtattacatggtctcccatgtgcatgctaagttttttagaccaagatttatctacgctcgaagtctgcataaccgaagagatgaaatccatatcaaagtggtttgaagatcttgatatatgtgacaaagtgactctaaagagtaaacttcagaaaattgcataccctgatcttaattcgatgtgttcctcttga

SEQ ID NO: 65384 - DNA, 1515 bp, Glycine max
  Peptide Sequence Number=SeqID_182162
atggatactttgctcaaaacacctaacaagcttgagtttttgcacccccttcacggttactctgaaaaatttagcaattcatgttcctctagggtacaaaatcaggattttaggtttggttccaagaaaccaattgtgaggtggggtaaatgtggtaatttgagggctagtagcagtgcccttttggagcttgttcctgaattcaagaaggagaatctggattttgaacttcctttgtatgattcttcaaagggtgctgtagtggaccttgctgttgtgggaggaggtcctgcagggcttgctgttgcacagcaggtttctgaggcagggctttcagtttgtgccattgatccaaaccccaggctgatttggcccaataattatggggtttgggtggatgagtttgaggccatggatttgcttgattgccttgacactacttggtccggcgcggtcgtcttcattgacgacaaaacaaagaaggatctagacaggccttatggtagggtcaacaggaagctgctgaagtccaagatgctgcagaaatgcatatcaaatggcgtcaagtttcaccaagcaaaagttatcaaggttattcacgaggagaccaaatctttgctgatttgtaatgatggtgtcactattcaggccactgtggttcttgatgcaactggcttttcaagatgccttgttcagtatgataaactgtataatccggggtaccaggttgcttatgggattttggccgaggttgatgaacacccgtttgatgtagataaaatgcttttcatggattggagagattctcatctgaacaatgacatggagctgaagcagagaaattgtaggatacccacctttttgtatgccatgcccttttcatccaccaagatatttcttgaagaaacttctcttgtggcacgccctgggttacgaatggatgatatacaagaaagaatggttgcaaggttgaaacacttgggtattagagtgaaaagcatcgaagaagatgagcagtgtgtcattcccatgggtggccccctcccagtacttccccaaagagttgtaggcattggcggtaccgcaggaatggtgcatccttcgacagggtatatggtagcaaggaccctggctgcagctcctattgttgctaattctattgttcagtgccttggttctgatagaggtttttcaggaggcgaaacatctgcacaagtgtggaaagatttgtggcctatccaaaggaggcgacaaagggagttcttctgttttggtatggacatcttactcaagctggacttaccaggtacaaggagattttttgatgcattttttgatctggaacctcattactggcatggattcttatcatcaagactgtttcttcccgagctcatattttttggactctctctattttcttatgcttctaatacatctaggatagagattatggcaaagggaactcttcctttggtaaacatgatcaacaacttggtaaaagatacagaataa

SEQ ID NO: 65385 - DNA, 378 bp, Glycine max
  Peptide Sequence Number=SeqID_182163
atgtatattgtgtatccaatgatatacttgcttgtgaagttagctttgattttacctatggaaattgcaattgaaaaatgtgtctctgcaatgaattttgtgaagaatggaatgtggaattgcatgggagatgaatggttgaatgtacatgtacccacacctatccccattcaaaatttgcataagtcaaccaagggaaaaagggaagaaggaagcacatacctccgcgatgggggcaaggttgcgatggtggttgaaatcctcttgaacaaatcgggggatgatgaggcgctcgataccatggatgacgtcatcgacatgaagtatatcgacaaagtcgacggttctctagccaaagggcttagaggccaaatgtag

SEQ ID NO: 65386 - DNA, 642 bp, Glycine max
  Peptide Sequence Number=SeqID_182164
atggatcaggcgagccgaggagtagtctcagattccttgactttcgagttgctcagcctggctattaatttggcctacatcaagaaaaattgttggaacttggatgacccatcggtcactttcccagggacccgcaaggctagggccagaggatctgagggaccgtcttcatcagctccccctgcgtctactgcaccagctccctcacctccatcatacgctcagagcccagacatcattgtggcgatgttgcagagccttcaccatggtttatacctggtgatgcagagcatccatgctttggctcagcatcgacccatcataagcatggaggagtttgcttctcaggagcctcagccggagccagaggctgctcaggaagctgatacagatgttgatccagaggctgacttagagattccagagccagagatcctagagactgacccagctactcaggaggacgttgtggaggctactcccgacacgactccacaaccatcaccagtgaccacacctgtgctggagttgacttccccacaggcatcaccagtaggcacgcctgtgctggagctctctgaggatgaggatgatgtcacaaccatggatttttccccttctgcaccacaggacccaccatag

SEQ ID NO: 65387 - DNA, 636 bp, Glycine max
  Peptide Sequence Number=SeqID_182165
atggacgccaagttcggaagcctcttcgaaaccatcggaaacttcttcaccggcggtgagcagatcccgtggtgcgaccgtgacgtcatcgctggctgtgagagagaagttgcagaggctgctaatggtgactctgaggagcggaagaatgagagtataatgaggttgtcatgggctcttgttcattcaaggcaaaaggaagatattcagcgtgggatagccatgcttgaaattactgatagccttgagatgcttatgctactgagttctggcaattggcactatgaccacagcctcttcccttctttctattgctttccttcttccttgggcaatgataaaagtcctttgcatcaaagagagaagctttatcttctggctgtaggttactatagaagtaatgactatggaaggagccggcagcttgtggagcaatgtttggagattgcacctgattggaggcaggcactatccctcaagaaaatagttgaagatcgaattgctaaagcattaactaaggaattgcaaatgttcgttgtatcaatgccagatggtgtaataggaattggcatcactgcaacagctgtgggacttatagtcggtggcatagctacggcactggccaggaggagttga

SEQ ID NO: 65388 - DNA, 567 bp, Glycine max
  Peptide Sequence Number=SeqID_182166
atgttagttttttataacaaccgcagcggaagagcagcactcacagcagagaatgggttgttggagtgggtgagagtgggaggggaagaagaagaagaagaagaagaagcaaaagggtgtttgagcaagttcgtggatgatggcatcgtggagagccacagatactacttgtctcgcacaaccactctcgaaatgctaaaaaacagaggctattccattccctctcacgaaatcgacctttctctctctgatttccacgacatgcatggtcaatccccggaccctgatcgccttcgcctctccctcactcatgccaccaactcttccaaaaggattttagtcatattctgtgagccaggtgttgtgaaagttactgccattcagaacattgcggggcagattattaatagagacactttgactggcctcatgttgatagtggagaatcatattactagccaggccttgaaagcagtcaatcttttctccttcaaggttgaaattttccaggtatttgtgtcagatatttcatggtgtttgagtaatattcagttcggttatgcttag

SEQ ID NO: 65389 - DNA, 1878 bp, Glycine max
  Peptide Sequence Number=SeqID_182167
atggacctctctcaccctcaatccaacctgtccctcggattctcttcctcccacgcctctccgcctcgccgctccgacccgccggtgccgctgcagctcatggaaccgcagacggagaacggcaacaacctagatgtcgaatcggacgacgacgacgacgacaaagaagtcgaggagtttcgcattctaggccactcaatgtgcctcaagaggcgaagagattgcgactcctcctcctcctccgccgccgccgccaagagggtttccgtcgaacccgatctcgacgcgcgtaaggccgccgtgcgcgcgtggggctgccaacccctctccatcgctgatcccgacatccacgagataatggaaaaagagaagaagcgtcaattttgcgggatcgaactcatagcctccgagaatttcgtgtgcagggccgtgatggaagcgttggggagccacttgacgaacaagtactccgagggaatgcccggctcgcgctactacggcgggaatcagtacatagacgaaatcgaaactctctgttgcgaacgcgctttgaacgcgttcggcctcgaccccaagtgttggggggtgaacgtgcagccatattcgtgtacctctgctaatttttctgtttacaccggcttgttgctgcctggtgatcgtatcatggggctggatactccttctggagggaacactagtcacggttactatactcccaatgggaagaaagtttctggtgcttccattttctttgagagcttgccctacaaggtgaaccctcaaactggttacattgattacgataagctcgaggaaagggcgcttgattttcgccccaagatacttatttgtggtggcagctcctaccctcgagagtgggattatgccaggtttaggcacattgcggataagtgtggagctgtgttgttgtgtgacatggcgcagattagtggcataattgcagccaaggaatgtgtgaatccttttgattattgtgacattgttacttcaacaactcacaagagtcttcgaggtccaaggggaggcataattttttatcggaaaggtacaaagccaaggaacagagggattcttctaagtcagggacatgaaagtgatcaatatgactttgaagaaaagataaattttgctgtttttccatcgatgcaaggggggccacacaataaccacattgctgcgcttgctatagctttaaaacaagtggctactcctgagtataaggcatacatgcagcaggtgaagaagaatgcccaagctttagcatgtgctttactgagaagaaaatgccgtctagtaactgggggtacagacaaccatttaatactttgggatttaaggcccctgggattgacagatgggcatatggatttttatagaaagaataggggcttcctaggctttcccccaaaacgtcctaggtgtgaccctgtagcagggcatgtgctttatagagacaagacttttgctttgagtttatgcttgaatcctattgttcaagctggacaatcaatgaatttttttttggtatatggtaagttttatgagaaggtatgtgaaacatgtcatattactttgaataaaattgctatttttggcgacaatggaactataattcctggaggtgtaagagtaggtacccctgccatgacgtcaagaggatgtctggaagctgattttgagacaatggctgaatttctcattagagctgcacaaattgcaagcatactgcagagggagcatgggaaattgcagaagacaacattgaagggacttgagagccatagggacattgttgagctccgggcacgggttgaagcttttgcaactcagtttgccatgccgggttttgacatttga

SEQ ID NO: 65390 - DNA, 318 bp, Glycine max
  Peptide Sequence Number=SeqID_182168
atgtcgatgtcagtgctttataggtggagattgcagtgttcgctcatcttaccacaatgtaatagaaaaacatgctggaaattgatcatctcaagactaatgagcgaagctgatgttcagtcttggtctccaccagtgaatggtacattaaaatgcaattgtgaagcaaccatattcaaggaacatcaatcttttggtgttagtatgtgccttcgtgattcaaatgattgcaagacacttcacgataaccttcaatcaggcaccaagggttcatctgatttttacagaatcttggctgaaagtaaatgttatttttag

SEQ ID NO: 65391 - DNA, 1290 bp, Glycine max
  Peptide Sequence Number=SeqID_182169
atgatgattgtggcaggcggtggaggtgctgaatcgggcattgggaatgggatcgtgcatctcggaggttggagctggtggaagtcccctcctcttcttcctttttcgcctgaatcgaacatggatggtgggaagaggagaaggttaaggggttcctcttcctttgatttcaaagtgcctgggaggatgttcttgaatgggtcaagcgaggttgcatccatgtattgcaagcaaggaagaaaagggatcaaccaagatgctatgcttgtttgggagaacttttgttcaaaggaagacaccattttttgtggtgtttttgatggtcatggaccttatggccacagggttgcaaagaaagttagggattcttttcctttaaagcttaatgcccaatgggatttgcatcataagaatagagatggactcagtgatcatagcagcgccacaggaagttataaatctgaagggaatggatttagactggtggatgagaaaactagtcccactgatcatgaacttgatgaaacagatacgattttgacattacgagaatcgtttttgaaggcttgtaagattatggataaagaactgaaacatcatcctgatattgactgcttttgtagtgggactacagcagttactttggtcaagcaggggctgaaccttgttattggaaatgttggtgactcgagagctgtattgggtacccgagatcatgaggattcccttattgctgttcagttgaccgttgaccttaagccaaatcttccaagggaagaagagaggatcaagcttcgtagaggaagggttttttcccttcagaatgaacctgatgtggctcgagtttggctgcctaactctgatttccctggtcttgctatggctcgggcatttggagatttttgccttaaggactttggattgattgctgttccagatatctcatatcaccgccttaccgagaaggatgaatttgttgtgttagcaacagatgggatttgggatgttctgtcaaatgaagaagttgtggacattgtggcatctgcttcacagtctactgctgctagagcactggttgagtcagctgttcgggcatggaagacaaaatttcctttttgtaaggttgatgattgtgccgcagtttgcctcttctttgattctgatttagatttcaagtcaacagatacaaaagacaagttaataccggaggcatctattgaccaatctgagcagttagctttacttggtgaaaagggagttggaaatgaagctgaaaaaaagcagcaatag

SEQ ID NO: 65392 - DNA, 486 bp, Glycine max
  Peptide Sequence Number=SeqID_182170
atggagaaaggcaaagagcccattgtaagccatgaggatttgttggcattggttgttgaggactcagacactgaacaagattctcaatgttatgaagatttgcttggaatgattgtggaagactcgctagagtctgaacatgtgaactcgaatatgctattgccgaaaatgattgaaagttcaaatgcggcattgtcttcaagtgcagcaaaaatggtcgaagtttcaagtgtggcgtcgtcttcaagtgtggcaaaaatgattgaaggttcaagtgtggcgtcgtcttcaagtgtggcgaaaatgattgaaggttcaagtgtagcgtcatcttcaagtgcatcatcgtcagttagtaacgaagtgctattgttcaatcttaacaagttcccagaggatgagtgtaaggatgatactgaggaggagaaagaaaaaaaacttgttgagcgagcactactaaaaatatattttcctgattattactaa

SEQ ID NO: 65393 - DNA, 1212 bp, Glycine max
  Peptide Sequence Number=SeqID_182171
atggctggattgttatgtcccctcccggtaccgtcacggtcgtgggaggacctttctctcgattttatcacgggcttgccggtgtaccaaggtcacacagtcatcctcgtcgttgtgaataggttctcgaaaggggttcatctgggtatgctacccacagctcacacagcgttagcagtagcttcgttatttgtcaacatcgtcgtcaagcttcacggcattccccggagtttggtgtctgatcgggaccccctcttcattagtagattctggcaagaacttttccggcgcagtggcactcaactccggatgagcaccgcctatcacccccaaagtgatggccaaacggaggtgctcaataggactattgagcaatacctgagaagcttcgttcaccggcgaccaagctcatggggaaagtaccttccttgggcagagtggtcacacaatacgtcctggaattccgccaccaggaccactccttacgagctcactttcggcaagaagccgttcaatttccctgagtacatcgcagggtcctctactgtggatgtcgtggataatttgctgcaggaccgagatgagaccttccaaatggttcgtagaaagctcttgaaagcccaaagtcgcatgaaggaacaggcagaccgtcgccgaagcgacgtaaactacaattctggtgattggacctcggccaaaggctctcagagttcttctggtaaactagcaaggaggtactatggacccttccgggttatcgaagccatcggcaaagtagctcatcacctgcaacttccaccagatacgaaaattcatgaggtcttccattattctcttctcaaaccattccgtggtcaactggagaccacctctcccgcgcctttaccagaccaatttcacaatgatcaacctattatcactccggcagcaattgtggattatcgcagaaccccttcggacgcttgggaagtcttggttcaatggcatggcttatccccagatgatacatcttgggaggattggtccactctttgccatgactatcaccttgaggacaaggtgatttcccaagggccgcgagatgatagggaaaccacagaccacagagcaggggtacaaatagaatattcagcagaggtgcaagcagatcataccaaggtgcagattgaggaaaagcccaaaagaagaatcatgaggccaacttacctttga

SEQ ID NO: 65394 - DNA, 192 bp, Glycine max
  Peptide Sequence Number=SeqID_182172
atggaaatcgccttgagccgccaacatataccgctcagctggggttatgacgaaaacaatgggaagaatcagatgtactatgtacaacactgtcctttcaaggaaatgaggaacctcagagaaatacaaccagagacaaaaggagatgacccgctatgtcaaaactcaggacaaaagagacacgacaactaa

SEQ ID NO: 65395 - DNA, 249 bp, Glycine max
  Peptide Sequence Number=SeqID_182173
atggggacgatgctgaagttggagatgaaagggtttttgagggagataatggacttacatgttgagatgtttataagacttcagagattggagagcctagaatgtatacggggattaaaaggaagcaacctgcaagtagagaaggcacataatctcgaagagcttttaaaagaggcaacagagggacttcttcaactaggaaagaaaaattggttcaagttaaagaagctgaggattggaagatattag

SEQ ID NO: 65396 - DNA, 1401 bp, Glycine max
  Peptide Sequence Number=SeqID_182174
atgtgttctctactttggagttccattgcattgtgtgtagcactcctactccttcagcttggcattgtgcacccttcaccctctcaccataggatcactcgcttaccgggtcaaccccatgttcagtttcatcagttttcaggttatgtaaccgttgatgacaaaaaccagcgtgcactcttcttctactttgctgaagctgaaaaagatgcactttccaaaccccttgttctttggctcaatggaggtgctcctcagtcacttcttgtttcttttcacacctggcccggttgttcttctcttggagttggtgcattttcagagaatggaccatttagacccaaaggagagggcttggttagaaaccaattcagctggaacaaagaagcgaatatgctgtatttggaaacgccaattggagttggattctcttactcaactgatacttcctcttacgaggccggggataacttggtgttcttgcaaaactggtttatgaagttcccagaatacagaaaccgaagtttgttcattgtaggagaaagctatgcaggccattatgttcctcagctggctgagcttatgctccgattcaacagaaaggagaagttgttcaatttaaaaggcattgctcttggtaatccagttctagaatttgcaacagatttcaattcgagagctgagttcttctggtcacatggattaatttcagatacaacgtacaagatgttcacttctgtttgtaactattcaacatatgtgagggaatactataatggtgctgtttctcctatctgttcaagtgttatgagccaagttagtacggaaacaagtagatttgtcgacaaatatgatgtgacccttgatgtttgtttgtcttcagtgttctcacaaaccaaagtcctcaatccccagcaagtcacagaaaccatagatgtatgtgtggaagatgaaacagtgaattatctgaacaggaaagatgtgcagtcagctttgcatgctcatcttgttggagtccaaagatggtctgcatgcagcaatgtcctggattatgagctgcgtgacttggagataccaacaatcacggttgtggggaagctagtcaaggagggaataccagtattggtttacagtggtgatcaggactcagttatcccactgactggaagtagaacattagtacataaattggcaaaagaactaggattgaacaccactgtgccatacagggtgtggtttgagaagcagcaggtgggtgggtggactcaagtttatggtaacatcctttcatttgccaccatcaggggagcatcccatgaagctccattttcacagcccgagagatcacttgtgctgttcaagtccttcttagaaggaggacctctaccacaagagatttga

SEQ ID NO: 65397 - DNA, 336 bp, Glycine max
  Peptide Sequence Number=SeqID_182175
atggcattgcatatatgggtatgcaggtacactgacaaaagtgacatctttagttttggcatgatactaggtgttttgttaactggtaaggatcctacagatccattctttggagaagcagccagtgggggaagtttgggatgttggctgagacacttgcagcaagcgggcgaggcgcacgaagctctagataagagcatgttaggggaagaaggtgaggaagatgagatgctaatggcggttaggattgctgctgcatgcctctctgatatgcctgcagataggccttctagtgatgagcttgttcacatgctaacgcaactgcacagtttttga

SEQ ID NO: 65398 - DNA, 789 bp, Glycine max
  Peptide Sequence Number=SeqID_182176
atggaagaagagcaaacacacataatgaaagactccgatgacatggaatcccaagaagaagaagaagaagaacgagaggaggcactctcgctctgcgaccttccacttaaccgcaattccagaactccaagcttggacgacatgtcgtttaagaaaattctccgaccgtcctcgttacccgatcacgccggcgagattttcaacggcttcagcagcagcagcagctccgacatgtgccccgccgacgacatcattttctgcggcaaactcgttcctttcaaggccgaacagccgctgaaaaacctcatcgccgctgaagaggagaaatctcccgcgcgccgccggagatcggagtctctctcctccgtgacgcgatcgaacagtgtgagcacgttcaccggttctcgccacctcatgatgaggaacagcaagagcttggattatagcaggttgcgagagtctgcggcgccggaggttgatcggaattcttccagcagaagcgtcgtgccgccggaggcagcggtgaagaaggcgacgaagccgcgctggtactctctgatgttcgggacgatgaagattccgccggagatggagctcagcgacatgaagaaccggcaggttcgccgaaatccgtccagcacgatgtttctcacggcggattccggcggaaagatggccgtgaatcgcagccacgggaaggtgtcgtggagaatactgaaggcactgagttgcaaggatcacagcagcgtcgccgtaacgacgtcgtttccgttaccgcaagcgtcgtag

SEQ ID NO: 65399 - DNA, 1110 bp, Glycine max
  Peptide Sequence Number=SeqID_182177
atggttccttctcaaaacgggaaacaacaacaaaacattaataggagtgctatgaaccaggttattgaagttgaaggaggctacaattgcttgttaggatccgattttgtggcgaggaggcacatcatggctgaggctgaagaatcatcgagacacaataacaacactaacgaggaagctgaagttggagcttgcggttcaatctcaaaggaggaggaagaagaagaagatgaagaagaagcaaacaacaacagcaacaacaacaacaacagtaactggcttcaattaagcataggtttgacaagcacaaaacaagagcgtgatactcgaaccgttgttccaacaacaacaacaaccagttcagggcttgttgagttagacttgcttcctttacggcggagctcggagcagcagcagcagcagccgccgccaccggcggtttttccagtgatggcttcagggagaggaggaggttcttcttcttctttgctttttgagcagcatcatcgaacgacgtcgtattcatcttcttcttccatgtcgacgatgatgtctatggccagtggtccaattacatcaacctttggtcaccaagagatgatgaactgggcatttggtccactacttcctcaatattcaatgcctattatgccctcttcttcatctttcactcctcttcctattccttcttcttcttcctcttctcaaacttgttactcttctttgaggcctcatcccttaggatcttactttcccacagtaccctttcatcatcacttcccttcttcttcctcttctgggtttgatcaatatgacgtggcagctgggccaggaccaagctccgataataatgtcaccgttcgagttgttgatcctcctagaagacctcattctggaatatggtttatgttacaagcctctccaaaccaagcgagagaaccattcttgccacaaatacctaagaactaccttagaattaaagacggaaggatgacagttcggttgctattgaagtatctggttagcaaactcagactggaaagcgaatcggagtacatagctagggatatgattttccatcgctgctctcttggtcatgcaccttgctaa

SEQ ID NO: 65400 - DNA, 3714 bp, Glycine max
  Peptide Sequence Number=SeqID_182178
atggggaaggaggtagaggatgttgaagagggtgagatttcggatactgcttcggtggaagagatttcagcggaggatttcaataagcaagatgttaaggtgttaaataataacaataagcccaatggaagtgatgctagggtttgggctgttcatgatctttactcaaagtaccctaccatatgtcgtggctatgcatcgggtttgtataaccttgcttgggcacaggccgtgcagaacaagcctttgaatgatatttttgtgatggaagtggactctgatgccaatgctaacagtaacagcaacaactccaatcgactggcctctgttgctgtgaatcctaaggatgtggtggtggtggatgtggacaaagaggaaggggagttagaggagggtgagattgatgccgacgcggaacctgaaggagaagcagagagtgttgtggctgttcctgttgtttctgattcagagaagcttgatgatgtgaagagggatgtttctaattctgagcagcttggtgtgaggggtgttctggagggtgttaccgttgctaatgtggcggagtcgtttgctcaaacttgcagtaagctgcaaaatgctcttcctgaagtgctctctagacctgctgattctgagagggatgatctcgttcgcctgtcatttaacgctactgaagtggtgttttgctccatggactctttaaaaaaggaacagaacaaggatagcatattaagattactttcttttgtgaaggatcaacaacaggctcaattattttctccagagcatataaaagagatccagggcatgatgactgcaattgattattttggtgctttagttaatagtgaggctattggcaaggagaaagaattgcagaccactgtgcagacccatgagataaagactcaggaaaatcaagctgtagaagctgctgaattgatttcttataataagcctttgcatagtgacataattggggcatcacatgctttaaaatttggacaaaatagtattaaaggtagaggggttctgctccctctgttagaccttcacaaggatcatgatgctgacagtttaccatcaccaacccgagaagcaccctcatgcttccctgtgaataaattactttccgttggagagcctatggttagttctgggtcagcagctgctaagccggagtctggaaagatggaacttgatagtgaaggttctaaatttcatctctatgaaactgatgctttgaaagctgtttccacatatcaacagaagtttggtcgaagttccctttttacaaatgataaatttccaagtccaactccttcaggtgactgtgaggatgagattgttgatacaaacgaggaggtctctagtgcttctactggtgattttttaacaagcactaagccaactcttttggatctgccacctgtttctgctacttccacagataggtccagcttgcatggattcattagttctagagttgatgcagcaggtcctgggtctttgccagtgaaaagctctgcaaagaatagagatcctaggcttcgtttcgttaattctgatgcaagtgccgtggataacccatctacattgatacataatatgcctaaagtggaatatgctggaacaacaatctcaaggaaacaaaaggctgctgaagaaccttctttggatgttactgtatcaaaaagacaaaaaagtccattggaaaatactgagcataatatgagcgaagtaagaactggaattggtggttggttggaagagcatactgggcctggagctcagtttatagagaggaatcatttaatggacaaatttggacctgaaccccaaaagactttgaatacagtcagtagttcttgtactggttctgataatttcaatgcaacaagcattagaaatgagcaggcaccaattacaagtagtaatgtgctagcttccttacctgctctattgaaaggtgcagctgtaaatccaaccatgctggttaacttacttagaatagcagaagcccagaagaaatctgctgattctgctacaaatatgctgttgcatccaacaagctcaaattcggctatgggaacagactcaactgcgagtattggttcatcaatggccactggtcttcttcaaagttctgttggaatgcttccagtttcatcacaatcaacttccatgacacaaacccttcaagatgattcaggaaagattcgcatgaaaccccgtgatccccggcgcattctccacactaataatactatccagaagagtgggaacttggggaatgagcaattcaaagccattgtatcccccgtgtctaacaaccagggaactggggacaatgtcaatgcccagaagcttgagggtagggtggatagtaaattagtgcctactcaaccaagtgcacaacctgatattgctcgacaattcgcccggaatctgaaaaacattgctgatattatgtctgtttcccaagaatcatcaactcacactcctgttgctcaaattttttcttcagcatctgttccccttacttcagatagaggggaacagaaatctgttgtgtcaaactctcagaacctggaggctggcatggtatcagctcatgaaacagctgcatcaggtacctgtcgatcccagaatacatggggagatgttgagcatctttttgaaggttatgatgagcagcagaaggctgctatacagagagagagagcaaggagaattgaagaacagaataaaatgtttgctgctcgaaaattgtgccttgtattggatctagatcacacactacttaattctgctaagtttgtggaagttgatcctgtgcatgatgagatattgagaaagaaagaagagcaggaccgtgagaaaccacacagacatctttttcgctttcctcatatgggaatgtggactaaactcagaccaggaatctggaacttcttggagaaggccagtaagctctatgagctgcatctttacactatgggaaacaagctatatgcaacagaaatggcaaaggtgcttgatccaaagggacttttgtttgctggaagagttatctctagaggtgatgatactgattcagttgatggtgaggagagggctcccaaaagcaaagatttggaaggcgttttgggtatggaatcatctgttgtaattatagatgattctgtgagggtctggcctcataacaaactgaacctgatagtggtggaaaggtatacatacttcccctgtagtagacgtcagtttggactgcctggcccttcccttctcgagattgatcatgatgagagacctgaagctggaactctggcatcctctctggcagttattgagaaaatacatcaaatcttttttgcttctcgatccttagaagaagtggatgtcagaaatatactagcatcagagcagagaaaaatcttagctggttgtcgcatagtatttagtagggtatttcctgttggtgaagcaaatcctcaccttcacccattatggcagacagctgaacagtttggtgctttttgcaccaatcagattgacgaacaggttactcacgttgttgcaaattcccctgggactgataaggtgaattgggctctaaacaacggaagatttgttgtccatcctggctgggtggaagcatcagcattgctttataggagggcgaatgagcaagattttgccattaaaccataa

SEQ ID NO: 65401 - DNA, 927 bp, Glycine max
  Peptide Sequence Number=SeqID_182179
atgggggttttgagcatgaaaaggcacaccctttcttctcttgcaagggaattgttggcatttcagccactttttcttctcttcttgttcagcttgcaccacaacactatgcagtgtcaaggaaggttgagtaaacatgtttcttctgagcctccctcaccttctaggtcaacaccatcaccaccatcttcatcaggatacaaggatgaccctaggaagataattttgagcatggttttaggagcagtcactggactagtttcttctgctctctttgcacttgtggttcgttgtgttgttcagtatctgaaccgcacaccaatcctcaagggacctgtcatattctcccccaaaattgcccccatgacactccaatcagctttggcaaaggaaaaccacttgctcggttcgagtcctaatgggaagtactacaaaactgtgcttgacaatggactcactattgcagtcaaaaggctaacaccctttgagagtaattccccggaggctaagagaaaatcagtgaagaggcagatacaaactgagcttgagcttcttgcaagccttaggcataggaacttgatgagtttaagggcctatgttcgtgagcctgatgggttctcattggtttatgattatgtttccactgggagtcttgctgatgtgttgagtaaagtgagggagaatgagttgccctttggttgggaagttaggctcaggattgctgttggtgtggtgaagggtcttcagtatcttcatttcacttgtgtgcctcagattctgcactacaacttgaagcccacaaatgtgatgttggatgctgagtttgaacctagattggcagattatgggttggctaaacttctacccaatttggatggaggaagttctctctacactcctcctgaatgtttccataattgcaggtaa

SEQ ID NO: 65402 - DNA, 189 bp, Glycine max
  Peptide Sequence Number=SeqID_182180
atgacggaaataggaggtatgtttggttcggatgattttagagaaacgatttcatcgccgtcgcgctggtacggagagattgtttgctgcgtcgtggtgtcgttgaaggatggcggctggagtggagttgccggaggggagaagcggcggtggcggcggaattgtgatggaatttccggccggagatga

SEQ ID NO: 65403 - DNA, 1890 bp, Glycine max
  Peptide Sequence Number=SeqID_182181
atggcgactcagctgctttgtatgtgttgcggtgctcagcctcagcctcagcctcaggcagcaccgtttatgaggttcccattttggaattcagttcatccaaagaatccaacaagtgtagtaagggtgcaagcagaagcagcagatatgaatatgaattcaatcccacacgtgctgagtgttgctgggtctgattctgggggtggtgctggaatccaagctgatcttaagacttgtgcggctcgccgtgtctactgttccactgtcattactgctgttactgctcagaacactgctggggttcaaggactcaacattctacctgaggattttgtggcagaccagttgcactctgtgctctctgatatgcatgttcatgtcgtcaaaacaggcatgctgccctctcttaatatagtcaaggtcctttgtcagacccttaggaaatttcccatcaaagtgacttctatgctttcttcgtcttggctgaaggcagctcttgtggttgatcctgtcatgatatctaccagtggggatgtacttgttggtccttccgttcttgctggatttctggaggagctgcttcccatgactgacattgtaaccccaaatataaaagaggcatcagttttacttggtggtgtgccgctgaaatcagtttctgacatgcgcactgctgccaaattgatacatgatttgggtcctaggaatgtacttgtcaagggtggtgacctccctaattcgttagatgctattgatgtattctttgatggcatggcaatggggcccgaacccgtggggcccgccccgattttgacgggagaaacccgagttgaccggggtcggattttccccgacagccaaagtcggcatgtcgggggcgggggcgggagcgggacgaggaaaatccgaccccgtcaggggcggggggaatggggagtcgagggcaggggtggggtaagcaaaatctggtcccgacccgtcccgttgccatgcctatgtgaggagttctacgagctgtgttcaccgcgtgtaaatactcgcaatagtcatggtactggttgtaccttggcatcatgcatagcagcagagctggcaaagggttcatcaatgctttctgcagttaagacagctaaacattttattgaggctgccttggattatagtagagatatgacaattggaaatggagctcaaggcccttttgaccattttttggcacttaatatcaatcagagttcttgtaggctgaataggttcaatccaaatgacttgctgttatatgctgtaacggattcggctatgaataggaagtggggccgttctattgctgaagctgttaaggctgctgtagaaggaggtgctaccattgttcaattaagggagaaggatgctgagacacgagattttcttgaagctgccaaagtgtgcctcgaaatatgccattcctatggagtacctttacttataaatgatcgtatagatgtggcccttgcttgtgatgctgatggtgttcatgttggtcagtctgacatgcctgcacgtcttgctagaactctccttggtcctgaaaagataattggtgtatcgtgcaagacgcctgagcaagcccaccaagcatggattgatggtgccgattacattggttgtggtggtgtttatccaactaatacaaaggcaaataatcgtactataggcttagaaggcttgaaggaagtatgcctggcctctacacttcctgtggttgcaattggtggcattggtctgtcaaatgcacgtgaagtcatgaaacttggtgcaccaaatctcaatggggttgctgttgtttctgctctatttgacagggaatgcattttgactgagacaagaaacttgcacgcattagtaagttag

SEQ ID NO: 65404 - DNA, 426 bp, Glycine max
  Peptide Sequence Number=SeqID_182182
atgtccatgctcttcagattctctctcctcctccctctcttcctctctacggcctttgcttccgagtcagatcataggtatcaacaagatgacccagttatcctttgggtgaacaaagttggtccttataacaatccacaagaaacgtacaattattacagcctaccattttgccgttcacctggtaatcctgcacacaaatggggtggtcttggtgaggtcctgggtggcaatgaactcattgatagccaacttgagataaagttcctaggaaatgtggagaagaccaccttttgccgtatagaacttgatgaggcaaaggatattgcccttaactctggcttagctgcccaatcaactgctgtaacttgttggatacagcccaaaaccagtttcattcagggatatgcccccggaagtggctaa

SEQ ID NO: 65405 - DNA, 621 bp, Glycine max
  Peptide Sequence Number=SeqID_182183
atggaatacaatcttttgaggttccaacaatctagtttgaatcatcattacaaatgtattgaaggagggtctgcatatcaagaatggaacaaaaaatatgtcgtgaaagcaacctctaaaccatcttttgattctggacttccaacttctaattccaaaaacatgttggactctgtaaaaaatttcttggcagctttttatttgttttgctacccttacgtaatgattggccgagccttggtaccttacacgtttttggatgtttatattaatggactgaatcagttgtctgacattgaaatagacaagataaataaaccatatcttccattggcatctggacaattatcctttagaactggtgttattattgctggatcatctttaattttggtgccatataaaaccatccattttacgacaatatttttcaagatgaacttcattgacaaaagtttttggcttggctggattataggttcttggccactgatttggagtcttgtaatgtgtttttcactatggaccgcttattcaatcaacgttatggagggaagccatggtgcaatagttggatttgctatcatgggacctaggagttattggttcaattggtcatga

SEQ ID NO: 65406 - DNA, 2458 bp, Glycine max
  Peptide Sequence Number=SeqID_182184
tgaaggacttggggaggcctatgatggagatattgcatttgcaagtgccttggaaacttttggtggtgggcataatgacccaatcagtgtggcttttggaggtatgctccccttttacatcaatcttatgatggttgatgaaaggttctctgttcctcctggccctgttatgaccaaattcaccatagccttaagagaaattgggacatataaggaagtccttcgatcacaggttgagcacatgttaaatgacagattgcttcagtttgtcaatattgatttacaagaggtcaaggaagcacggaaacgctttgacaaggctagccttatttatgaccagactcgtgaaaggtttctgtcactaagaaaaggcacaaaaactggtgtagctactgccctagaagaggtaggcccttgtgtgtcttatgtgtttgttcagcttagattcactctggagcttcatagtgcaagatctacatttgagcaagctcggtttaatctggttactgccttgtcaaatgttgaagcaaagaagagatttgaatttttggaagcagtcagtgggaccatggatgcacatcttcgttacttcaaacaggggtatgaattgttgcaccaaatggagccatatattaaccaggtcttgacttatgctcaacaatcaagagaaaggtccaattatgagcaggcagccctaaatgaaagaatgcaagagtacaaacgacagattgatcgggagagtaggtgggcttctaatggttctaatgggtctcctaatggagatggtatacaagccattggtagaagttcacataagatgatagaggcagttatgcaatctgctgccaagggaaaggttcaaactattcgacaaggttatctctcaaagcgttcctcaaacttaaggggggactggaaaaggagattttttgttcttgatagtcggggaatgctgtattactaccgtaaacagtgcagcaaatcatctgggtctagtagtcaacattctggccagaggaatagttctgagcttggttctggacttttaagtcgatggctgtcttctcatcatcacggtggagtacatgatgagaaatctgttgctcatcacactgtgaacttgcttacatcaacaattaaagtagatgctgaccaatcagatttgaggttttgcttccggatcatttcacctacaaagaactacactttgcaggcagagagtgcgctggaccaaatggattggattgaaaaaatcactggtgttattgcttcattactgagttctcagattcctgataggatgttgcctgcaagcccaatgggaagtggtcatcataggtctaccagtgagagtagttcttttgaaagttcagattttgatcactctgctgttgaagaatgtgcagcagatagaagttttacttctgcgtatctggagcgcccctcaagaagtttgcaacagcagcgatcctgcactaaaagtgagaagccaatagatgtactgcgaagagtttgtgggaatgataaatgtgccgattgtggagctcctgaacctgattgggcatcgctaaatcttggtgttcttgtttgcattgagtgttctggtgtacatcgtaaccttggtgtccacatatcaaaggtcaggtctcttacattggatgttaaagtgtgggaaccttctgtcataagtttatttcagtctcttgggaatacttttgccaactcagtctgggaggaattattacaatcaagaagtgcctttcaggttgatcttgtccctacaggcttaagcaagtctgataaaccaatgatgttcttcatcaccaaaccttgtcaatctgattctctatctgtgaaggaaaagttcatccatgcaaagtatgctgagaagctttttgttcgcaagccaaaggacaatcaataccgtctcttagtagcacaacaaatctgggaggctgttcatgctaacgataaaaaagctgtataccgttacattgttaattctgatgttgatgttaatgctgtttatgagccaacatgcagcagctccttaacccttgccaaagtaatgctattacaagagcagactagccatgatcacagctctactttagcagggaacacattggactggtcctccactaaagaaggccaggtcatggacaatctagatgggtgcaccctacttcatctcgcatgtgaaactgcagatattggcatggtggagctcctcctacagtatggtgcaaatgttaatgcaactgattcgagaggtcaaacacctctacatcgctgtattctcaaaggaagatctacatttgcaagattattgctttctaggggagccgatcctcgagctgtggatgagcagggaagaacccctattgagcttgctgctgagtcaaatgctggcggtgacagagaagtccatgctccatcgactgattctaatggatga

SEQ ID NO: 65407 - DNA, 2217 bp, Glycine max
  Peptide Sequence Number=SeqID_182185
atgacatggattcatgtatgctggtttgaaaaattttatgcgagtctcttatcacatgcaaaattttaccccaacaggacttggctagtatttaatgcgagtctctttaagtcttaccacaaggaaaatttacctaaatccggacgtgttgaaaagtgtcagttagagaaagataaagaggttgaagaggatcaaggaaacgacatcgttttgaatgtgaggctgcgagtgatgatggattgtggagtgaagagacgtgagagtgtgagagaggaagatgatgaagtgatgatagtaacaccattgggggctggaaacgaagtgggtcgttcatgcgtgtacatgtcctataagggtaaatccatattgttcgattgtggaatacacctaggtttttcaggcatgtccgccttgccctatttcgacgagattgacccttccaccctcgatgttcttctcatcactcactttcacttggatcatgctgcgtccttgccctacttcctcgagaaaaccaccttcagaggccgctcagcaaggtctccgtcgaagatatgctttttgatgaacaggacatcaatcgctccatggataaaattgagatgcaacacttattttgggacggagggacctctaaattccagccatgtccttggtgctgctatgttcatggttgacatagctggtgttcgagtgctatacaccggagactattcacgtgaagaagaccgccatctccgtgctgctgagatcccacagttttccccagacgtatgcatcatagaatccacctatggtgtacagcatcatcagcctcgccacacacgagaaaaacgcttcaccgatgttatccactcaaccatttctcaagggggtcgtgtgttgattccagcatatgcccttggccgtgcacaggagctcctcctcatccttgatgaatattgggcaaatcatcctgaactccacaatatacccatctattatgcttctccacttgcaaaaaagtgtttgactgtttatgaaacatacaccctttccatgaatgacagggtccagaatgcaaagtcaaatcccttttccttcaagcacatatcagctttaagtagcattgaagttttcaaagatgtaggaccatctgtggtgatggcaagccctggtgggcttcagagtggcttgtcgcgacaattgttcgataagtggtgctctgataagaaaaatacttgtgttttaccaggatttgttgttgaagggacattggcaaaaaccatcatgactgaaccaaaggaagtgactctcatgaatggactctctgcacctcttaacatgcaggtgcactacatttccttttctgctcatgctgactctgctcaaacaagtgcgttcttagaagagctcaatcctcctaacataattctcgttcatggggaagctaatcagatgggcaggctcaaacagaagctcacaagtcaatttgctgatcgcaacaccaaaatccttactcctaaaaactgtcaatctgtagaaatgcatttcaattcacagaaaatggcaaaaaccatagggaggctggctgaaaaaacaccagaagttggtgaaactgtcagtggtttgctagtaaaaaaaggcttcacatatcagataatggcacctgatgatcttcatgtcttttcacagctatcaacaacaaacataactcagagaattaccgttccttactctggtgcctttagtttcatacagcatagactcaaacggatatatgagagtgtagagcagtcagtggatgaagaatctggagttccagaattgcaagttcatgagtgtgttactgtgaagcatgaagctgaaaagcatatctccttgcattggacatcagaccccattagtgacatggtatcagattcaattgttgctctgattttaaatatcaaccgtgatgtccccaaaataatggctgaatctgatgtgattaaaattgaggaagagaataagaagaaggctgagaaagttatgcacgccctccttgtttcactctttggagatgtgaaggcaggtgaaaacgggaaattgataattaacattgatgggaatgtagcagtgctcaacaaagaaagtggggaagttgagagtgaaaacgaaggtctcaaggaaagagtaagagcagctttccagcgcattcaaagttctgtaaagccaattcctctatctgcaccgtaa

SEQ ID NO: 65408 - DNA, 1485 bp, Glycine max
  Peptide Sequence Number=SeqID_182186
atggcagaggtgctgcaacgaggtcgttctctggctgagacgccaacatattcagttgcctctgttgttactcttatggtctttgtttgcttcttggttgagcgttcaatctatcgctttggacagtggttgaagaacacaagaaggaaggcactttttgcttcactggagaaaattaaggaagaactgatgctgcttggccttatctctttgctattggcacaaagtgcaaggtggatctctgaaatttgtgtcaattcctcactttttagcagtcgcttttatatttgttctgagcaagacctcggcatcaatgagaatatcatgcatcaaagctcctcctcctcctcctcctcctccttccctcaagaaattaatagtggagcattcaaccaatgtggagagggccatgaaccatttgtttcatatgagggtcttgagcagctgcatcggttcttatttgttcttgggatcactcatgttctgtatagttgtctggctgttggtttagcaatgagcaagatctatagttggcgcagatgggaaaatcaggctgcgatggcaaccggtggaaacttgcaaggaaagaaaatcaaggtgatgaggcggcagacaacatttgttttccatcacacttctcatccatggagcaggagtccaatcctaaactggatgctctgttttgtgcggcaatttagaagctctatacaaaaatcagattaccttgcactccgcttaggtttcataactgaacacaaattgccgttgtcttataatttccatcaatatatggttcgaagcatggaagatgaatttcatggcattctaggaataagctggcctctttggatttatgccatagtctgcatcttcgtgaacatccatggaacaaaacttcagcatgttgtatccactttagcacttgaaattatggagcagacaggtccatctgctcggacacaagtaaagccacgtgatgaacttttttggttcaaaaaaccggatatactgttatgggtgatacaatttgtcatatttcagaatgcctttgaaatggcaacgtttatttggacattgatgggttctcgatgtaagaaggccttagtaacggagagtgttagagagtccctgcatagttggtgtaaaagagtaaaacacaagtctaagcatgattcgttgcattcacacaccgcaagatcagtgtgttccctcgaatcaacaattgatgagagggacgaaataacagtagtatccggcactctaactcgaagctcgtccttagagtctttgaatcagataacagtgacttcagtagaccagctgaactttgagacttcttctaataacaacccagaaaaaaattcaaccaaggtggctgagtatttgtcgtcagaatctgtatatactaatcccccacaaccatcccacaacagaggagaggaagcaaaagctatcactcttcttgatttgtttcagaaaacatga

SEQ ID NO: 65409 - DNA, 1596 bp, Glycine max
  Peptide Sequence Number=SeqID_182187
atgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacattgagaaatgactatgcaaagtatgcccgggaagatgatgatttggaaactctggaaagagatgttagtgaagaatctggctggaaacttgtgcatggtgatgtttttcggcctcctcgcagtttggttattctttcagctgttgttggtacaggtgctcagcttgcattgctggttcttcttgtcatcttgttggctattattgggatgctgtatgttggacgaggagccatagtcacaaccttcattgtttgctatgctctcacatctttcatttctggttatgtgagtgggggaatgtactcacgtaatgggggtaaaaattggattaaatccatgatccttacagcatcactgttcccattcatgtgctttggaattggttttattttaaacacaattgctatattctatggatctctagctgcaatcccctttggtactatggttgttgtctttgttatatgggcttttatctctttccctctagcacttcttggcacagttgttggaagaaactggagtggtgctccaaataatccatgccgtgtgaagaccattcctcgtcccattcctgagaagaaatggtacctcacaccatctgtagtttcgctgatgggaggactgcttccctttggcagcatattcatcgagatgtattttgtattcacttccttctggaattacaaggtgtactatgtctatggcttcatgctactggtttttctgattcttaccattgttactgtttgtgtgacaattgtggggacatactttttgttaaatgctgagaactaccactggcaatggacttctttcttttcagctgcctcaacagctgtttacgtgtatttgtactcagtatactactactatgtgaagacgaagatgtcaggcttcttccaaaccagcttctattttggatacactttgatgttttgtcttgggctgggaattctgtgtggagctgtgggttatcttggttcgaatttgtttgtgaggaggatctacagaaacatcaagtgccctattgacggactgatgtctgattcccctacacggtttagctatttcttcgatggtcaagtgttaagcaatatagttacattggaatttgggaggacgtggaggcgtgtgactgccatggcaagttacaaggtgaagctgataaccccagagggagagcaagaatttgaatgcccagatgatgtatgcattcttgaccaggcagaggagaaaggccttgagcttccctactcatgcagggctggttcttgttctgtctgtgctggcaaagtggaacagtcagatggtaacttccttgatgatgatcaaattgttgcaggatttgttctcacccgtgttgcttaccctacctcagacgttgtcgttgagactcactgggaggaggagctcactgcttaa

SEQ ID NO: 65410 - DNA, 528 bp, Glycine max
  Peptide Sequence Number=SeqID_182188
atggacaggaagagaagggtgtggctaggtacatttgagacagcagaggctgcagcaagggcatatgaccaagcagcaattttgatgagtggtcaaaatgccaagaccaatttccctacacaaatgaatcagcctcaaggtgctactactactactccgtgtgtagaccctttctcatctccaaatgttctttctgagcatctgagtaggaagctcaagagatgctgcaaagacccttctccatccctcacatgtctaaggctagatgctgacaattcccacattggagtgtggcaaaagggtgcaggaccacattcagactctaactggattgtaagggttgagattggaaagaaattacatgcagagggtgagtcatcaagtgtatcatcatcagcagcaggagggtcaccaccaaaacctagtgttggtcatggtgatggttatggtgacgaagaggatagaattgccatgcagatgattgatgagcttcttaattggaatcatccctgtggttcgagtaattaa

SEQ ID NO: 65411 - DNA, 282 bp, Glycine max
  Peptide Sequence Number=SeqID_182189
atgaggatccaccagcgaaaaagggagcctacaaaagtaaaaggaatgcaattgtcttctgatgattctggaatgataaagaagggtgaggaagaaagattacatgctttgaagtcaaacaaaggtaaatatgaattatcatcattggttaaatcaattaagatgaaatcaaagcaagttcagttaccctctgatgataagacaaggaaagatggaaaatcacacattaaagaaacccagcagggggaaaaggatccacgcagaattctgaaagaagtgtag

SEQ ID NO: 65412 - DNA, 324 bp, Glycine max
  Peptide Sequence Number=SeqID_182190
atgcagatgaaaaagcatctaatgagtctgaaaaggcgactaagagggattggttttctaaaatttaaaactgtagaagcaactaatactgtaatttcaactgccagtgctacttctgggatggatattttattgaatggtagaccattaaaagttttcaaggctttggataacaaatcagcagatgacaaggaactgcagaaagcaaaaaatgaggttgatgaccaccgcaatctttacatgccaaaggagggacttatcattgagggaactataggtgcagaaggggtttcagccagcgatatgttaaaatgccaagagtga

SEQ ID NO: 65413 - DNA, 1086 bp, Glycine max
  Peptide Sequence Number=SeqID_182191
gagaaagtctatcagctgaaaaaggccttgtatggcttaaagcaggccccaaggtcttggaatggcagaattgatgcacatttgataagcttaggctttgaaaaatgtctaagtgagtttaccttgtatgtcaagaagacggatgtaggaatagtcattgtttccttgtatgttgatgacttacttatgacaggaagttcaaaagagttgattgaagagtttaaaggaggaatgaaagaagcctttgaaatgaatgatcttggaaaaatgccatttttccttggtatgcaggtgcaacaagatagaggtgcagtctttgtaagtcaagaaaaatatgcaaaggaaattcttagaaagttcaagatggaggaatacaagccaattccaatgtcaatgaatcaaaaggagaaattcaacaatgaagatggagctgaaaaggttgatgaaaaactgtacagaagcttaatagaatgtctgatgtatttgactgcaaccaggccagacattacctatgcagtaagcttgctgtcacgatatatgcactgtgctagtgagattcattttaaggcagctaaaagaatcctgagatatatcaagggtactattggttatggagtgaagtttcagccagtaaaagatttcagtctttatggatattcagatagtgattgggctgggagtaatgatgacatgaaaaacacttcaggctactgtttcacatttggttctggagttttttcatggcgttcaaagaagcaagatgtcatagcacaatctaccgctgaagcagaatacgtagcagctgttgcagctgcaaatcaagcaatttggcttagaaaacctatggctgatctacacatggagcaaaaggagagtacacaagttcttgttgataatcaagctgcaatttcaatttctaagaaccctgtgtttcatgggaaaacaaaacattttaagataaagttgtatttcctaagggaggtgcaaaagcaaggtgacctgcagctgctatattgcaaaactggaaatcaacttgctgattttttaacaaaatcacttcctcaagcaagatttgagtatctttga

SEQ ID NO: 65414 - DNA, 174 bp, Glycine max
  Peptide Sequence Number=SeqID_182192
atgaatatcaatggacttgcaagacaatcgcttgtcaatgcagctagcattattgagcaatcgtttctgcccgggcaattccctgtggagatgtcttcagcagtttacaagggttggaggaatggcagtggaggatccatcctctccctatgggcttcgccttgtgatagatga

SEQ ID NO: 65415 - DNA, 501 bp, Glycine max
  Peptide Sequence Number=SeqID_182193
atggagaagatacgtatgctatcaaaggaaactcctgagaatagggttttggttgttgaacatgaaggaataccaccactagtgcagctcttgtgctatacaaattcaaaaatacaagaacataaagtgaaaacacttttgaatttatcaattgatgagggtaacaagagtcttatatccacaaaaggtgccattccagctatcatagaagttttggagaatggtagttgtgtggctaaggagaactcagccgtaactttattgagcttgtcaatgcttaatgagattaaagagattgttggtcaatcaaatgagttcccaccttgggtggatttgttaaggaatggaacaattacagggaagaaagatgttgtgatagctatttttaacttatctatcaatcatgcaactaaagtactggatattaaagctgacattgtcacacccttgcttgaattgctaaaggaaccaaacttgggaatgattgatgagggagcatga

SEQ ID NO: 65416 - DNA, 2110 bp, Glycine max
  Peptide Sequence Number=SeqID_182194
atgacgatgaaaatggcacacaaaatctggaattttgtgaaggaagagtatgaaggcagtgagaaaatcaaaggaatgcaagctttgaatctgattcgagaacttgagatgcagaggatgaaagattcggagacaagcaaagattatgtggacaagcttctcggcattgcaaacaaaatacgtcttcttggcactgaaattcctaactctcgaattgttcaaaaaatacttgtaacaattccagaaaaatatgaagccacattgacttccttggagaactcaaaagatctttctactatcaccttggtagagcttttgaccgcacttcaggctccagaacaaagaagactcatgagacaagaagaggtggatgaagaagaactttttgttgtttcttgctttgctaccgcaagatcaacagaaagttggctaattgacagtgggtgcacgaaccatatgacttatgatcaagaattattcaaagatcttgatgcaacctacaacacaaatgtcagaattggaaacggagaaaaaatagcagtgaagggcaaaggaaccatcgtgatcgagggttgcacaggtctgaaattaattcctgatgttctatacgttcctgaaattaaccaaaacttgttgagtgtcggccaacttctagagaaaggctataaagttctatttgaagataaaagttgcatgattaaagattcagataataaagaattattcagagttcaaatgaaaggcaaaagttttgccttgaatttgattgatgaagagcagcttgttgtgcacaaggttgaagacaacacgctggtttggcataaaaggatgggtcattttcatcatggcgctttgctctatttgaggaagaatgatcttgtacaagggctgcctgaattggaagacaaatcacccgtatgtgctgcttgtcaatatggaaaacaaacgaggttgtcttttccaaaaggcaaatcttggagagcaacaagcaagctacagttagtacatacggatgtcgaaggacctcagaaaaccccatctctgaatggcagtaattactatattgcttttattgatgatttttcaagaatgtgttggatttatttcatgaaaaacaaaactgaggttgccagcatattttacaagtttaaagcatgggttgaaaataaaagtgaaagaaaaatgcagatattaagatctgataatggtacaaaatatacttctgataagttcaacaagctttgtgaagatgcagggatagaacatcaattgacaacaccatataccccacaacaaaatggggttgtggagcgcaaaaacagaacgatcttggaaatggcaagatgtttacttcatgacaaagatcttccaaaaaaattatgggcagaggctgcaagcacttctgattttttgctgaacagattgccaacaaaagctctttcaaaatcgaccccatttgaagcttggtatggtttcaaaccaaaattgatgaacttgaaagtctttggcttcttgtgtttctcttatattccacaagttaagagagacaaacttgataaaaaggcggaagcgggaatctttgtaggctatagctcaacatcaaaagcctatagaatattcttgccacaaagtaataaagttattgttagcagagatgtgctattatttgaagaagaaaaatggagcaaggaaagtgagaagcttcaagttcaggaggagagcgaagaagatgtagatgaccagctagtcagaggaactagacctctctctgatatttatcaaagatgtaatgttgctgtaatggagcctgtagactacaatgaagctgcaactgattcgaagtgggtaagtgcaatgaaggaggagcttgatatgattgaaaaacatcaaacatgggagctcacagagaaacctaaagataaaaatgtcattggagtgaaatgggtttatagaaccaagcttaatgctgatggttctgtaaacaaacataaggcgaggcttgttgtgaagggatatgcgcagatgttcggggtagacttctcagaaactttttctccggttgccaggttggataccataaggctgttgttagctcttgctgcacaaaaag

SEQ ID NO: 65417 - DNA, 213 bp, Glycine max
  Peptide Sequence Number=SeqID_182195
atgaagaatggctccaaactcatcggtggaggatgcatgaacgaaaacgcaattcatggggctccgaataaaaggcgaggatggaggattgcactagagggtcctcacaagtcaatcatgaagcatggctccaaactctttggtggaggatgcatgaacgaaaatgcaattcatggggctccgaaaaaacgcgaggatggaggattgcaatag

SEQ ID NO: 65418 - DNA, 777 bp, Glycine max
  Peptide Sequence Number=SeqID_182196
atgcgtttacaaggaaatgcccaattaattgatgatcaagaaactactaaatttgcaaagtggattctagatattggagatggagttattgggaatcaaaatgatggatatgctaccattgaaattcctgagtacctactgattactgaatataatgaccccattgatgctatagtcaaatcaacatttccagatttatatcaacatcacagtaatcctaaattcttcaaatctagagcaatattagcttccaccaatgaaacagttgaagaggtcaatgattatatactttccttgattctaggtgaacaaatggaatacttaagctctgattatatagagaagttagaaaccattgatagttggcatttccaatcaatcacaactaaatttctcaattcactaaacacatctagtctgccaaatcctcgtatcaagctaaaaatcggtagtcctataatgttgctaagaaacttagaccaaacgcaaggactctgtaatggtactagattaatagttactagactagccaaacatgtcattgcagttgaaatcatttttggcaaaaatgttggcaaaaatgtttacatcccaagaatgtcaatgtcacctacacaatcaccatggcctttcaagcttttaagaagacaatttccaatcatgctatcttatgcaatgacgattaacaagtctcagggccaatcactttctatggttgggctttatttgccaaaaccagtctttagccatgggcaattatacgttgcattatcaagg

SEQ ID NO: 65419 - DNA, 675 bp, Glycine max
  Peptide Sequence Number=SeqID_182197
atggcaaatgtaagagcaatcaaggtgatgttgaggagctttgagttggtatcgggattaaagataaactttgccaacatctgtttttgggcaattgggatgactgagcaatggatgaacagtgctgtgaggctgcagcggtggttcttgtggggaggacactcggataagaaaaagattacatgggtgaattggggttcaatttgtctacaaaaggaaaaaggtggcttaggcattaaggatttggtgaaattcaactatgcactgcttggaaaatggtgttggaatttgtttcaacaccaaggagaattgtggccacaagtgctgttctgggaagacgggtggaaggatgatgggatttcgttaattgaaaagtacccaaaattgtaccacatttctcaacagcaacatcaatatatccaccagctagaggcgacatcaggtgcaggttgggaatggcagttccaggggaggagattctttttggagtgtgaaatggacatgactgcaaaatttatggaggatatagaaggtctgatcgtacaactgcagcgacaagacacctggaattgggagggagattcaagcgggggatatacagtggggaatgtttacatgctgcttgatagggattcgacaaatgaaaatcaggatggagtgtttactgcactatga

SEQ ID NO: 65420 - DNA, 579 bp, Glycine max
  Peptide Sequence Number=SeqID_182198
atgagacgaacaaaccggagggatgcatctgatgtccattccttctacttcacaaaatttcttgaagagatgagagaaaaagacttgtggtatgagtttaagaaatggggggacgtgcaagaggttttcattgcaagaaacaaaaacaggagtggcaggaggtatggtttcgttaaattcgaggtgggcgatgtgaggaggcttgaaagacaactagacgacttgatagtaggggggctgaaactacacgtcaacataacgaagcatggaagggagagagaagccaattcaaacaacaatggtggtgacaagcaacagaaagacgggacgaagaaggaatctaacgcgcgtgagtccaacaagaacaatttctcactcgtcagtgcagctaaacatacctgtgtagaaagtacatggctcaataacacctgggtaggaagactaaagaacctggcgatgtttgatagagtggaagacgaattcatgtggaataggggagaagataatgttaggaagttccatatcgcctgtctcagttcttgggtgcagcttatatatctgttggacaacttcacttag

SEQ ID NO: 65421 - DNA, 528 bp, Glycine max
  Peptide Sequence Number=SeqID_182199
atgggcttgtttctggagataaagatagcggtgaataatgtagaaataggtgaatttgaggataatgactttggtactctgcgaatatttgagattatgaaaaataaaagagataaaggggagagaaagaccaagaacaagggaatttgggtcgccagaaaaatgtgggtctctggaaaatacagatcatcacaggctatcaaaagcattcctgaatgtgtacatccattggtttctagaattttgccgtatattggaccaattttgaataaaccccaagagcaggctgatggtttggtagctggatcattagatctgaatgcccctgctgatgtagtgaaagcaatatatggtgtctcttttaatgctgttatcaacataatccttcaaagtgatgaccacagtgaaattcagaatgctacagaatgtttatctgcttttatatctgggggaagacaagaaattcttgcatggggatctgattctggatcaactatgagaagtttacttgatattgcttcaaggtag

SEQ ID NO: 65422 - DNA, 618 bp, Glycine max
  Peptide Sequence Number=SeqID_182200
atgtccaaccaaacgcttattattaggagactatgggtagtagtggaattttttgatattatagtggctttattggcagatgcattaactgagatacaagaacaagttttggccgctgatgatgaggatagtgactgggaagaagttcaagcagatggcattgaaaatgataaagaatttctttattcagtatctacatcttcgggaaaagccacaaatgaacaacttgaagcaatggcgaaagtatttaatgaggatcaagatgatcactatgaagatgaccttttaagtattgctgatcctctcaatcagataaacctggcaaattaccttcttgatttctttgttagcttttctcagtctgacagacagctcttagatcacatttgcaagcttgtctcagtctcaacgaaatgccattcaaatggtactgaagagatgagaatttcgtgtcctgtcatcgagtgctgtctcaaggatgggttgataataccagagagagtgaaacaaagaaatggttggaaaccaatatcttacattgttcaggttggggaatctgtctgcagttctgaaaggtattttctttctgctgcagtgttcccccttgtatgtctctga

SEQ ID NO: 65423 - DNA, 2199 bp, Glycine max
  Peptide Sequence Number=SeqID_182201
atggaggcatgtgattatccagaagaagaggaagcaaacaactcactttcaggtcccattaaaaacaattctgttgaaagacaaggaggggaacataagctattaggccctaaagtaaatgggcctgaccctatatggaaggagattgagtgggagaggcctagactagctggggtcagatttcagtccattggccagcaagataatgttctcctggtggcgcgttttgaagagaaagaagtgaaggctgtagtgtgggattgtggcagtgcgaaaagctctggactggatggactaaatttcaagtttatcaaggaattccgggacgtccatgatccccagagcctcaatgaatacagacctatttcattaataggatgcatgtataaaattgtggctaaactgttatctagaaggctgaagaaggtgctgccaaccattatagatgaacgccaaactgccttcatagagggtagaaatatgctgtacaacgtggttatagccaatgaagtggtcgaagaagcaaaaagatgtaataaaagctgcctagtgttcaaagttgattacgaaaaggtgtatgacttagtatgttgggactttctgttgtatatgatgaggcggatgggtttttgtaccaaatggattagatggattcaaggttgcctaaaatcaacttctattttcatattggttaatgggagcccaagagcagagttcactcctcaaagaggactcaggcaagatgacccactagtcccattctcgtttaatattgtagcggagggcttaactggtctgatgagagaagcccgagagaagaatttgtttgaaggttttacagtaggaagaaacgtggaaatcggtgtattacagtatgcagacgatactgttttctttgggacaacaatgatgacaaatgtaagagcaatcaagcaatggatgaacaatgctgtcagctatttaaattgcaaaatgttgttcagtaccctttccttatttgggtgtccctattggggcactcccaagactggttcttgtggggaggcactcggatcagaaaaagattgcatgggtgaattggggttcagtctgtctatcaaaggaaaaaggtggcttggacatcaaggatttggtgaaattcaactatgcactgcttggaaaatggtgctggaatttgtttcatcaccaaggagcattgtggccacaagttttggaatccaactatggagggtggaggaatttggatgtgacaagaaggaccaacagagagtccctctgggtgaaatagacatgactgcaaaatttatgaaggatatagaaggtctgatcgtacaactgcagcgactagacacctggaattgggagggagattcaagcgggggatatacagtggggaatgcttatatgctgcttgatagggattcgacaaatgaaaatcaggatggagtgtttactgcactatggaagtttaaaatcccaagtaaagcctcattctttgcttggagattaaccctggaaggactgccaacaaagagtaacttaagaagcaggaatgtggaaatcaacaacataagagaagctactctttttgccttatcgtctctttcagaagaactgttggagacagaggaaaccggatttgatacaagtagcttgaagcacctggttgagcagattttcactgaagactctctaataggtcctcttgaatatccctttttatatgctcgcatctttacgtcagttgctaaattgtcttctttggcatcagatgaaaccttgctcatggtacttgatacattgcttgctgcagtaaaagcagattattgcctacataaaatgcagattgttcttgttggtaatcccatttcatgcaagagtaaaaagcagaatgttgttgcaaggtttattgcagagttagagtatcgggcaataggtcatgagtcatcaacattagttgaacacatgatttctcctgtaatccttaatgtgtgggcatcacatgtttcggatccttttatcagtattgatgcactggaagttcttgagcgtccccagaactgggttcaatggaagcccgtggatgagtctttgaaaacacggactgatgtgaggctcttgaagtcggagaatgaaccaccatggatgatgaatctgatgactgaaggaatagagaaccctgccaaacagaagatctag

SEQ ID NO: 65424 - DNA, 1083 bp, Glycine max
  Peptide Sequence Number=SeqID_182202
atgttgaccattgtgggtaatccaagactgggaaaggtggttgtggctaatatcagagaattggtgtactatactattgcttttcttcaaatgactgagcagcaggttcatacatggtctgtggatgctaaccagttcattgctgatgaagaagatgccacttatagttgccgcgtctctggtgtgcttttactggaagaggttgtgaattcttttgctggtgaaggaattttggccataacagatggtgcaaaacaatggttcaccgagtctcaaattagaaaagcagctggggttgatgactttaggaaactcgagagacaattggataacttgattctcggcggactgaaactacatgcgaatcttccgaaacatggaagggagtggaagctgatagagaaaaccaacaagatcagcacaaggggctggcagcaaaactacggtgaagaggtggttactgagatatgtgcaagcaatgagaatgacatcccacttgtcaatttagttaactataccaatggaaaagaggacatggttcagcaatgcttgggtgaggacattaagtcaaagtaccttggtggcgacatggtgttactcatgtgcctcattgatactagagcagaagaaatatgtagggaagaattcgaaaacggactgcctatgttcctggtggatattgatgacaatgttgaaggccttcaatgcttggatagggcacgagtgctcatcaaaacatcatggtaccttacaatcaatcacaccgtaactgcgtccattaacggggacgattacgtgatcaacattgtagaggagacgtgctacaacccctgcaggtgtaaatgcaacagtgggagcctgatagggtcctcagaggaaatattttctgatgagagcgaagtggggctgaccttatcgttggaggacgcgtcgtcccatgacgagtctctggcgatagccatgctagcggatgcagatggagatgagcagaacagaagtgaagacaaagacctacctaggtgcgacaagctgttgataaggtcaggaaggacaaaggaggaagctatcaggcatggcttttga

SEQ ID NO: 65425 - DNA, 1509 bp, Glycine max
  Peptide Sequence Number=SeqID_182203
atgagtagagagagaaacactgagtgggagagagataggattagtggtaaggctgttgagagaaacagagtgaggttcagtgaggatccccgacggacatccgtcagaaactggaaaggaaaccaacaatactacattcgatcaaactggagggatcacaaggatgtatcatccttctacttcacacacttctctgatgacaccaccgagaaggagctgtggtacaattttaaaaagtggggtgacgtgagggagattttcatccctaagcgaaggaacaacaatggtagaaggtacaatttcgctagatttaagggggtgaacgacgtccagagacttgcaatgcaactggacagcatcgttatcggtggactgaaactaattcagggcaaagaaaggcacaaaaatagcgaaccgtacagccgcgcaagctccacatcatcagtacatctcgacattgcaccagacgacacgaaatggctcaatgaagcttgggtaggacaactcaaaaatccgaccatgttcaagagaattgaagatcacttactatgggacatcagagcgaacagcagaacaaatgctcaacaaagaaaaccacggaggaatctcaatgtttcactcactggagaagtggagtccgagcctgcgcgcggtttcaggctaacctgggtacaatgctggggcattccgatactggcttgggacacgaaacaaattcagaagatcgtggccgccatgggagacatggtggaggtggacgatgacatcgagaacggtcggaggatggacagagcaagggtactcattaaactccatggaagcctgctattcagcacacggttaatgtgtacatcgaaggggaggcctacaaagtacaggtggtggaggaatgtggctatggcacccaacattgccattgcagatgacggagtgtcatggggtcgtcggaggagatttagtccgttgaaaaaaaagaggtacaagacagggaggagccaaaaaccagagctgaaccgtgaaggaccaccctcggtcctaacgccgacaacgataactacgggacctcgacaatacccaccgatcaaaagcgaaaaagaacacccacaagataatcgaaaaacctcgcagataatagaaaccattcaaaaagagagcagagagggcaccaatatagtgaggaaggagcttttaataatgggctggatttttctatccacaccccttatgagcactcagcacaatatggctttagcccacaaattaaaaaagctgactccaagtgtacatggtaggtctactcacgaaacagaaggaacaacaccactgaaacggaggactcaactccagggaaatcagctaaaagaggcaatagatatatggaacatggctaaacaactgggggcaataagggggacagaccaaggggaaatcattggcaaaataagggcaatggaagaaagagacaagaaagaggcagagaggttggaaaatagaagctctaccccatga

SEQ ID NO: 65426 - DNA, 1603 bp, Glycine max
  Peptide Sequence Number=SeqID_182204
atgaagaaggtgatgccgctgataatagatgaaacccaatctgcattcatagggggtcggcagttcttacatagtgtgataatagcaaatgaggtgattgaggaagctaaaaggagccagaaatcatgccttgtgtttaaggtagactatgagaaggcatacgattcagtatcatgggacttcttgtcatacatcctgagaagaacaggctttagttccaaatggatcaaatggattgaggggtgtttaacatatgcatctatttcggttctagtgaatggaagcccctcaactgagttcactccacaaagaggacttaggcaaggggaccgattagcaccccttctctttaatgtggttgctgaaggtctaaatggtttgatgaggaaagcggtagagaaaaatctgttcagaggttttccagtgggctcagacaatcccgtgtgcctaccaaaagaaaaaggtggtttgggcctcaaggacattaggactttcaatcttgcattgcttgccaaatggaaatggattctttttcagcaccacggacaattatgggcaagggtattggagtcaaaatatggtggttggaggagcctggatacaacatctagagctaccaatgattcaatatggtggagggatttaaaaatggctttacttcactcgcaagagggtcagaatctccaaaatagaacattgtggagggtaggatgtggtgacaggatcaagttttgggaggacagatgggttagtggggaggaaacattatcagcaaaataccccagattatatctgatttcttgtcagcaaaatcagttcattaggcagatgggagatcacaagggcacagaatgggagtgggagttcacatggaggagacccctatttgacaatgaaatttctacggctgttagttttctaagagaggttgaaggcaagacaatacaacaacatcgaagtgatgagtgggtgtggaaggcagacccaagcgacatctattctgtacaaagtgcctacaacatgttaaggggggaaatagctgagggaaattactcagagataggttgccaacaagaacaaatttacaaagaaggcaggtgcaaactaacgacttgtcttgcccattctgcagatgttcggaggaggatgcagcccacttattcatccattgcaacaaaatccaacctatctggtttggataagggcataagggttaatagatggcaatgctggtggctgactttgacatggtctatatggcagcacaggaacagcatactgttctccaatgcagtgtttaatggcaacaaattgtttgaagatgcattgaagaaacttgctacaatcccgacagatgcaaatgtcgaacagggagaaagcaaacctgtgccggagattaacttaccgattgcagacggcaaagagcagttacgaagcggagaaaatgaagcagaccaaagcagacacagggaagacaaaagcgaacaaagtgaggcagatgggatagtagttggagtcaaacacagatttactcaacaaaggtttgggggtaattgcacgaaagaggcgacagagaaagaactatcaaaggaggcaggaacaa

SEQ ID NO: 65427 - DNA, 312 bp, Glycine max
  Peptide Sequence Number=SeqID_182205
atgaaagatgcattacaacctcttggaaatatcccatttgcatggaattcagctagaaaccggaggacatcaggtttgagtataaaaaacttcgtaccccattgcccagaggctcttcgctatgcgaagtctaaaaagagattccatccagcttgggtctatgctgatcagattcttgaaatctttggaaaaaaacaatctgacttcctctttcactcatgttggttcatcaatccaggttccatcaatcctgattcctttcagagaattatgtctgcgattagcattcgtcaacaagtgaaagtaatgtga

SEQ ID NO: 65428 - DNA, 596 bp, Glycine max
  Peptide Sequence Number=SeqID_182206
ccacactcagcgaggttgagaaaaatgatgcttgcatttttggcacaatcaaaggttgtgtcactagtggttgtagctttgtaggtgtcgtcgcaacttgttcaaagtacatcgagattgttttctcttctagtggcttcacttttacaagttgttggattgtcacagaagccatggatgagatccttggaagtatgcttgttattgaatgttgggtcaaggatggtagcgggaaaggctctgtaaaggttggcattggaagtcgaatgagaaccaggggtcttttggaggtggcaacggtgtctgatgaaactgggtccagcgaaggaggtgaaacaagtaatgcagcaacggcaaagactgatatagttgttgtggccactggaacaataggtaagggtcttgggaaggataatggaaatgttggtggttctggaaggggttggagaataaatatgcttgaggttagtggtagggatttgccatgggtgtttgcggttgttacaatggtggcattaagggctattgtcctagccattgttgaggaagaaaagggtttcagaagagtgacacatgaacgaggagcaccaggatag

SEQ ID NO: 65429 - DNA, 1086 bp, Glycine max
  Peptide Sequence Number=SeqID_182207
atgttggtagctaatagctttgatctatggcgaaaggacgcttttttctctgcggcggaagaggtgcaggaatcagctgatatgagggagcttggtcagttggtcatgtcttcaatgcactatagtgtaatggaatctgcatacagggcatggttgagagagaagagagaaaggtcaactcctgaggaattaaatgaactatgtagagagctgcaaactgctttaggtaccgcaaaatggcagttggaagaatttgataaagccgtcaggctaagctaccgacctcacagtgatgacaatacatccactaggcataggcagtttatttctgccattgaaagccaaattacccaggttgaagcagcactgagggaatcttacattgaggaaggtaagcaaccacttcggtgggtaaatcttgatgaagaagagcgagatgatctggctgcctttctatctggaacttgtcagaccacacaaagcactaacgatgaatacatggaggtgaaacaagccaagaaagaagataagattgtagatatatacactttccgcaaccgggatatatctgctagtgaaaagtcttctaaggatgtcatttctgttaacaaggatacagattatctgatagaaataaaagcagatgctgtttctagaagtaatgatgatttagtttctcaaacagatagaacaactagtacaaggaagacatggagtccgcctaattatggtgctttaaaaattgtaattgctgatgaaggtgagcagagagataaacccacacggactgttgatgccacccctaaagaaaaagggttcagaaatctattttggaaacaaaagtttgaagattatcctcaggccacgcgaatagttcgtatgttcaatcagcgttttgggggcattggtatatgccagagccagaggcagtttcaaagtcccttgcacttgcgatatggctgttctgttcaagttacacttgctctaatgttgaccatttttctcattgaaagaaacagaatgaggactgaggtaatcactattcagataggaagcatgccaatatctaaggaaagatcaatctag

SEQ ID NO: 65430 - DNA, 249 bp, Glycine max
  Peptide Sequence Number=SeqID_182208
atggcgcttacctcgacgatggacggtggctcaagtcctcacaggaagctcctcaatgcacgtcactgcaactccatgtcactacaactccgcaatgccccagaacttcggcagcgcaacgaacatcgcaaacaaagaagaacaacagcgtcgcagggaaaagaaaggaagtgttgggtgaagaagaagaagaatagcaaaagcgtgagaaagaataagaaagcagttgcttgcgtaattaactattga

SEQ ID NO: 65431 - DNA, 216 bp, Glycine max
  Peptide Sequence Number=SeqID_182209
atgaagaacgatgtagaagttgattacagtcgcaattcggtagtgcctcggcctcgtttttctcttctttcttcttcttctcttagatttctctcaatttctctcaatgttggacttttggaaccctttactcagcctccctcacgcctatttatagcaaaagatggcattaggggtcatggcaacttgcctagacgagctgttgcttcaacctga

SEQ ID NO: 65432 - DNA, 354 bp, Glycine max
  Peptide Sequence Number=SeqID_182210
atgtcatatatttgcccgagtagtgctgcttactcaatacgcatgcttacgtttgcacatttctgggaaagtactaccaatgggaaacgggcaaccccaaatccagaaatgggttctacatctcaaggggaacggaagaggaagcggttagcaaccgacggagaggaggaaactttgcaaagccaattaattgatgtcttagaaaagaatggcaaaatgctacatgatcaacttgaagctcagaacctgaatttccagttggatcgccaacagcagaaagacactgcaagtaacatagttgctgtacttgataagcttgcagatgctctagggagaattgctgataaattgtag

SEQ ID NO: 65433 - DNA, 1113 bp, Glycine max
  Peptide Sequence Number=SeqID_182211
atggccgctcatagtaccaatcatatcctttggtgctttgttttggttattattgttgtcgccctttacactccaaacattagtgctgcaaaacaatctaaaataaatggcttgaatgtgatcgatcaatgttggagactgaatcctaaatggaggaggcatcgacctcaactagcaacatgttctgtgggctacactggcaagatgacaaacaatattggtaaggaccttatccattataaagttattgaccccaatgatgatcctataaaccccaaacctggaaccttgaggtatggagcttctgtaattcaaggtaaagtgtggatcacattccaaagagacatgcacattaaacttgagagacctcttcttattagtagttttactaccattgatggtagaggtgttaatgtcaacattgctgataatgcatgcttaatgatctttaaggcaaccaacgtaatcatccatggcattcgggttcatcattgcaaacctcaagccccaggaattgtaatggggcctgaaggcaaggtgattcctttgggccatgtagatggtgatgcaattcgattagttacagcctcaaagatttggattgatcataacacactttataattgtcaagatggtctacttgatgtaacgcgaggttccactgatgtaactgtatccaataactggtttagaaaccaagacaaggttatgcttcttgggcatgatgatggatatgtgagagaccagaacatgaaggttactattgtgtacaaccactttggaccgaattgtaatcaacgcatgccaaggattcgccatggatatgcacatgtagccaacaacctttacttaggatgggtgcaatatgccattggtggaagcatgggacctagcctcaaaagtgaagctaacctctttatagcaccaacaatagggagtaaagaggtaacatggagaaagagtactcaaaaaaatggaaacacatgggaatttcattcagtgaaagatgcttttgaaaatggagcctccttcacaataacaaaaggaggacgtgtgccaaagccaattatagcaagaaacaatactttaaagttgttgatgtcaaatttgtga

SEQ ID NO: 65434 - DNA, 177 bp, Glycine max
  Peptide Sequence Number=SeqID_182212
gaggcttgccatgcgattgctgaaaggttggagtgtcatctcaaccttaggatagtcaaggcaggcacagagacacacgaggtcatggaagaatgcattaggattgccaggggtgtcacagaagactgcattgtgtatgcgaggtctcgacgtaggcggcgcacagatgaggcatag

SEQ ID NO: 65435 - DNA, 741 bp, Glycine max
  Peptide Sequence Number=SeqID_182213
atggctctggaccagccttcgaatcccaacgccgtcgatggcgctggtaacggcgcgacgccctgctccgccgcagacggcggcgatgacgggaggccggcggcgaggctgccgcggtggacgcgacaggagattctggtgctgattcagggaaagagcgacgccgagagccggttcaggccgggtcgggggagcggttcggcgtttggttcgggcgaaccgaaatgggcgttggtgtcatcgtactgcaagaagcacggcgtgaaccgggaaccggttcagtgccggaagcggtggagcaacctcgccggcgattacaaaaagatcaaggagtgggagtcgcaggtgagggacgaagcggagtcgttttggctcatgaggaacgatttgaggagggagaggaaattgcctgggtattttgacagggaggtttataatattctcgattcgccgtcgtccacggcagcggctgcggcggcggagactccggtggcggtggcggaggcggcgtcggcgggggatgaggaggtgcacctctatgatagtaatcggagggttgggagtgaggatgggttgttctcggattctgagaaggacgaggttttgcttttagccgctgccaaggatgttcctgcacctgttcctctctcagagaagcaatatcagccgcatctccatgggtgtgaaggggaaggcaaccctcaaggtaagggagttctctacccttttttttatcggtaa

SEQ ID NO: 65436 - DNA, 366 bp, Glycine max
  Peptide Sequence Number=SeqID_182214
atgatgcttaggtccaatctgacaaggtttcagttcacatggctgaattccatgactaggaagtttttgctgacgatggtttggaggctgaggaagccgccggggttgccaacggcggaggagtctggcaacatgaccaagttttcagcttgcacatctcctcaagttgtgaaacaactgtttcacgtgctttcttcaagcttccacaagaaacaacttgagggagaagatttcactggcattgatcatggcgaaggggtttcaaggcttagggagttggccatgcccatggcaatggcggtcttgctgactaggacaattgcacggttttccagacctgtcgttcgagacggcatacagctctaa

SEQ ID NO: 65437 - DNA, 486 bp, Glycine max
  Peptide Sequence Number=SeqID_182215
atgcaagttagtgacttggtaggcatcagagtggatctcaaaagcggtgactcgatgaacacttcgatcgagtacaacggaaatgacaaagggttgcatgtttgggtctcgtactcgaatgttcggccaaaagatcctattttgaaggtggatttcaatgtgggtatgtatgttaaggatttcatctatgtggggttttctaggtctacccaaggtaccatcgaggttcacaatgttgagtggttcatggctaaggaggcggcgatgttgacgacggttacgcggtggtcctatgattcgagcatggctgaagggaaggggaagcaagagaatatggtggtgtcgtggttagggtttgtgagtggaatgcaaaagataccaaaagggaggggcaaaagggtcatttcagggggtcttttgaaccctggctcacccaggctagcctctggctcgcttgggcccccaaatagcttaggggtgaagtaa

SEQ ID NO: 65438 - DNA, 216 bp, Glycine max
  Peptide Sequence Number=SeqID_182216
atggatgaggcgtgtagtagtagaagaaaaagggggggtcggcctaaaagtaaatactggagtgaagctgaaaaattagaaggtaaaaatatgtggaagtgcaaccattgtaaacatgaatttgccggaggtgctacaagaattgaagagcatatcactggcaaaggaaacaatattacaaaatgcccaaaatatggtgcccatgaagaattttaa

SEQ ID NO: 65439 - DNA, 1629 bp, Glycine max
  Peptide Sequence Number=SeqID_182217
atgaaagaagatgaaattaacttgggagaccagatagtggagcatgattctgctgcatttaaaaaggcgtatccaaagggggaccctgatgctgtttgtatcaaaaagagcgatattgagcttttacagcctgagaaatgccttaatgatactatcattgacttttatatcaattatttgaaaaataaacttccaagcgataaacaagacaggtttcactttttcaattgctttttctttgctaagcttgctggtttaagcagaaatgatacatcaattgcttgtgatggtaaagcagcatttcagcgtgtaagcacttggggaagaaaagtcaacctttttaaaacggattatatcttcattcccataaactatagtcttcactggagtttgattgtcatttgtcaccctgctgaagtcatgacatgctacagagatgaagaaactaagggatctcccaaagaagcttgcatcttgcacatggattcccgaaaaggaattcatgtacatctccagaatgttttccaaagttatctatgtgaagaatggaaagagaggcacaacaatgtgagggatgatgtttctcctaaatttttagatcttccattcgtgccacttgagctgcctcagcaacaaaatgcatacgattgtggcatctttttgctccactatgtggaacattttctggaacaagctccaatcaactttaaccgttcaaccaagttcagtgttcctccaccagatgcttctctgaaacgatctcatatacagaaactattaatagcggctgaaggagacagtaaaatgattgttggtggttcagttaaccctcaaaacaatacacaattctcagctgctttattaggaggtgatgtagaagatcatgctgtgaacggaggtagcaatggcgatgatgctttgactataaataatttgctatccgatctagcaagggaagaagactactttgataaagaattacagtggcgggagttccaggccattaagcgcaagagacaagatgacgattggtcggataaactaaaggacctgaaaaaaagagttattgatgtgaaaaactcactgcatcagtctgggtcgactaatgaattgcccaagccttctgaattgcatgctaagtttatttatttattgatagagaagctttgggagttgcgagatgaaaatgtgaagaagatgtgggatcttctggaggatgaggaagtcttcattattggcatagatggaatggggggagttggaaaaacattcatggcaactcatttcaagaatgagattaaaagaaaggggactttcaaggatgtcttctgggtcactgtttcccatgatttcaccattttcaaattgcaacatcacattgcagaaacaatgcaggttaagctttacggagatgagatgaccagagcaacaattttgacgtcagagttggagaaaagagaaaaaacactgcttattttggatgatgtttgggaatatattgatctgcaaaaggtggggattcctcttaaagtgaatggcattaaattgattatcacaactcgtttgaaacatgtgtggctacagatggattgcctaccaaataatacaataaccaatattcccctttga

SEQ ID NO: 65440 - DNA, 165 bp, Glycine max
  Peptide Sequence Number=SeqID_182218
atggatgaaaagggaactttgaatgacaaagtggtggaattatgtgaattacatgtaaagggtgtcacagttaagaaaggcccttcctggtcctcgaattccaataacaaccatagtttcaaggtgctcagaacataccaccatagtgaactgaaagataattga

SEQ ID NO: 65441 - DNA, 264 bp, Glycine max
  Peptide Sequence Number=SeqID_182219
atggggaatacaaggattgatttcccaatagaggctttggagagggtggcagtgaatgtgggaaaggaaacagagggaagttggaaggggtccaaagaaatgattagtagcaaggtcaactgtttgaagattagacaaagtagtgaaattaggaccaaggtggaaggcaagggtccaaaaaatgaattggcatgtgcttttaattcttcaagctgcaaaaggtgcccagacacatttgggaatttcccagaaaaagcaagctga

SEQ ID NO: 65442 - DNA, 501 bp, Glycine max
  Peptide Sequence Number=SeqID_182220
atgctccaaccatatgggatcagcataggcttaaaagagcactcaaacccgatgacccccaaggcctacactccaaagaatccgttagggcctctccctcctgattcagccagcaatagcagcatctctagcggttctctgagattcctccaatttttttcctctagctgctccgatagaattcctaaacgtcaaagagacagagaagggattgaagcctccacttgtactgtcaccatgcgatttatttttctccctccacaaatattatctcgcaaatcccaacgacataatatcgaaattcccaacggtaagaatgctcgtaattgggtttcaaacgcggcgctcaaatttcacgacgatccaacggtgaacgagtccgagatcgtcgtttttctgagacaggttaggtggtctgcgggaaaaagagagggttttgggagaagagagaaaaacaacattgtgaggcagaggaggctgaggagtcagtctgaaaactga

SEQ ID NO: 65443 - DNA, 423 bp, Glycine max
  Peptide Sequence Number=SeqID_182221
atgactgaagtaactctccaaaataaatttgggtttagcctaactcatcaccagaagttagctcaagaggtaaggattgcccccttgaaaggaaaatacatgaaagcttaccttggcgaacacttgcaaggcacgacaactaaagggcacgagcccgaggtgacggtggtcaaaaagtcaggcacgagctcaggggagttgtcagggcagctgaagaagaagaatgagagggtgggtttggaaccaaaaaacctactcccgaaacaaacctacacggaacataccttaggatgcacagggtacacgcacggagaagaggtaagcgcaatagagaacaacaagcttcaatggagaacaaccttaggatgtagagggtacacgcacggagaagaagaaagtgcaagcaaaataggtggcgtctaa

SEQ ID NO: 65444 - DNA, 291 bp, Glycine max
  Peptide Sequence Number=SeqID_182222
atggcaatgggaggagatgttgaagaagtgcttctcgacaaagaagaatgtgattgtgacaaagaagaatacgatcttgagaagggtgagtttagggaaatcgacattggtagaggtggagggtttcatggtttaattcgtgaacggaggatccgaattgaaacggcgacacagaggaagaagaaaacgatcttgttacggtggtgcttggttcgtcgtcggcagcatacgaggtacgcatttgtgctgggtgtgtgtgagtgggatggtgcacaaatgtcatacgaatga

SEQ ID NO: 65445 - DNA, 267 bp, Glycine max
  Peptide Sequence Number=SeqID_182223
atggagaatgtatttgttgttatgtattacgatggtgacatactttcatcatctgaaggggtattgtttgaatgtcttattgttcctaaattcattacaataaatgatgattgtgttgaatatgagtgtatggagcttaaatgcgacgatgatgtggatgaaatatttttcatcttttcggaatttagtagcaaaggtccaattgagttgaatgcgacatttgaccgatctccagatgaaatccttgtcctattgcacaaacaatga

SEQ ID NO: 65446 - DNA, 450 bp, Glycine max
  Peptide Sequence Number=SeqID_182224
atgtctatcgtccatatccaaattgcactgatgttggtgacaaccaagtggccgagaaccccgactataggcatttttcggaccaacaacaataatttgactcacaggattgcgagctatatgttgggcctcacacatgcgttatgcctatcatttcacaagatcacaataagatgcattccaaactcagacaaaaatatccttgcgatggttgaagaaaatgagcaactaatcgttcctacattcattgcattcgttagacaagagttcgaatacaccatcatatatcgaaaagcatggctagcaaaacaatgggcactcgagaagagttttttcatcattaccgattgttacaagaagacaacccacacgacattgcctggcttgatcaaataccaagggagaaatggacgttggcatgggatgatggaaagcggtggggatacatga

SEQ ID NO: 65447 - DNA, 1539 bp, Glycine max
  Peptide Sequence Number=SeqID_182225
atgttcttacagtctgcactgtttcctaatcatatttttaaagaggaatgggttatgatgcttgttgagagtgggttgttagatggaaagaggagtttggaggaaacatttgatgagggacgtgtcataatggataaactcattaaccattctttgttgttaggttgtttgatgttacgaatgaatggtctggtgaggaagatggcgtgccatatcttgaacgacaatcacacttacttgataaaatgtaatgaaaaattgagaaagatgcctcagatgcgggaatggacagctgatctggaggcagtttctttggcgggtaatgagatagaagaaatagcagagggcacatcacctaattgtccacgcttgtccaccttcatcttatctcgtaattccatcagtcatattcccaagtgttttttcagacgcatgaacgctctaacacaacttgatttatcatttaatcttagattaacatctttgccaaagtcgctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattgttacccggatgcgcactgcccggtttgagcaatatgcaatatctggatctccggggttcgtcagtaagctttctcgatcaggattactacaaccgttatgtgcaagaaattcaggacactggttatggacctcaaatctattttatctattttggaaaatttgatgattacacacttggatttcctgagaatcctatttatctttgtcttgaattcaagcgtcgaagggtatgttttggagattgcgatgaattaccctatttactgccaagagaccttacggaattacttgtaagtggcaatgatcaatgggaatgcttatgtgctcctctgtcatctaatggtcctctatctttaaaggacattaacattaaacactgtacaaaattgaagagtttattctgtgtatcttgttccttatgcactaatatccaaaacctcaaatctttgaaacttgataatttgggtagtttaagtgtcctctgcaaggaagatgttgctggtttaacacaatctttatctcggagtggggtgttttctcatctcaaggaattgagtatcgagaaatgccatcagatagagaagttgctgacgccagggttagtgccacaacttcaaaacctggcgtctatatcggtagaggactgcgaatcaataaaggagatatttgcgggagatagttccgacaacattgcacttcccaatttaaccaaattgcaactacgctatttaccagaattacagacagtgtgcaaaggaattttactctgtaactctgagtatatattctacatcaaggattgtcccaattatgaaacacccagaattggtggtcgtgtatga

SEQ ID NO: 65448 - DNA, 318 bp, Glycine max
  Peptide Sequence Number=SeqID_182226
atggaaggccatggtggaatatactatgatcgcgaagagccaggtacaacgcaccatgtgagtcgttcagttggacatgggtatatcctcaatagaatcaacattagaactagacatgacaatgggacggggcggggacaagtattgtctcctcaattcccgaccccgactctccaacatgtccccttacccgtacccgatacccgatgggttaaaatttattatcccatccccgtacctgttgggtatcggtggcggggtgggtccgggttcggggtcgaggcagatgtagtaatctcatcccgtacccgtacctga

SEQ ID NO: 65449 - DNA, 642 bp, Glycine max
  Peptide Sequence Number=SeqID_182227
atgtcccctcgcagtttgacagaggcaatgaagatcttgctaatgagtcatcttggcattctgactgagacaaaggttgcagtggtgacaaacgcagacaccatggaaaggttgacgtggctgacagacttgtattatcgctacattgagttaggctcctatgtttgggctgctatgacttatctcttgcacttgattgaaatcaaaggattatgtggtggaggacctgatagccaccagatgaaagccattgagaggtaccgagcgtgcccttctgatgtaaggcctttcgcacatcaaacccttttctctaacctcatcagatgtgtgactgacatgaggccttatcatctagagaggatgctgaggcaatttggccatgtacaaacgattccacgccagccacctacccgtcttacatatcaactttgtgataaggcatgggcagaatggcaacaacacatcattcctctgggtgatgttgtgctaactaatggtccttgggctgatacctttgactatctgccttggtttcacaattttgcttacctttatgtcatttcactaaatgagggacaaccatcacatggtcttgtacgtttaccgcccatccagtacaaccacaacctaggcaaccactag

SEQ ID NO: 65450 - DNA, 285 bp, Glycine max
  Peptide Sequence Number=SeqID_182228
atgaaaaaggaaaagggaatgaaatttaaagtatatgatagggttgatccagccacattaaaatctaattttaaagaacttggtaccatcaggatcaggccatcaacataccaatcaatacatccattggaatcgcttgcaaaaaacaaattggcttttaaaagtaagtggtgcatcttccacacaccaccagcagctaagccaagtgttattccaattatgatgtccttaaccacactcggacctttcaaggtagcatgggcaatcctaggaccagccatttaa

SEQ ID NO: 65451 - DNA, 162 bp, Glycine max
  Peptide Sequence Number=SeqID_182229
atgggatcaaattggaagaggaaccaaaacaaggcaaggaagtgtttagggttttgcttttggtatagatctgagaagatgatggttacaagagaaagcacccacgattttgatactcgttcggtcaatccaacctacatctcgtactcaggcaacaattaa

SEQ ID NO: 65452 - DNA, 192 bp, Glycine max
  Peptide Sequence Number=SeqID_182230
atgttgcggaacgcgaacacgaaaagcactttgaagagcaccgaagttcccttgtcgtgcgcaaaaaacaacgctcatcttgaaaggacggcccgtgtgcggaatgcttctcctggggcaaaaggggtcatttttcagatccaaagacgagatcttctacccatcatgatgaagctcgggtacctaaattag

SEQ ID NO: 65453 - DNA, 156 bp, Glycine max
  Peptide Sequence Number=SeqID_182231
atgaggggttttgggaaagctatcacagatgctaacccttttgatatccctttgcaaggacatcctttcatgtggtggagaagcaaaggcggtgcagaatgggttgttgaaaaggtacaaagaccttttctcttggggccaccgtatccactctag

SEQ ID NO: 65454 - DNA, 396 bp, Glycine max
  Peptide Sequence Number=SeqID_182232
atgcgccctcattctcttcgttggtttctctctttggtgcacaatgcttcgccgttcttcttcgtttccttgcgctcggttaggtttggtgaaggtgaagctactagtgttcagcgttacggtggtcgacgacggcatacgaggtacgcatttgcgttgggtgtgcgttctggtgtaccgcaggtcgtgcagatcaagttgatccgcaatctacgtacggatcaacttgatccgcaaataagacttacgaatcaagttgatccgcaaatggaccaagatcagtggatgtctaaagaagtgaatatggattatgaaaataaaaaagaatatagtgtgaatgaaccatatgtcgattgttcgaaagcgttcaatacttctcaggtgttcgacagttga

SEQ ID NO: 65455 - DNA, 315 bp, Glycine max
  Peptide Sequence Number=SeqID_182233
atggatggggcttgtggtagtaaaagaaagaggggaggtagaccgaaaagtaaatactggaatgaagctggaaagataggaaaagatatgtggaagtgcaaccactgtaaagagaagtttagtggaggtgctacaaggattgaagaacatatcactggcaaaggaaatagtatcagaaaatgctccaagtatcctggtcatgaaggaggtcacaacatcattgcttccggttcaaccagtccacgagaagcactacatacattgaatcaattacgagaggtatcacaaggactctcacagggaccttcaaactaa

SEQ ID NO: 65456 - DNA, 495 bp, Glycine max
  Peptide Sequence Number=SeqID_182234
atgtcttcattcttgtttgattacgccaccagcatgggcggtagtgattctgagggctcgattgagcaacccttgatggaccgggaagtcatttccattggtagttcctcctccttggatgctcgtcgtggtgccgtcgatagcaagtcctcctccttggagaaggtgaaggcttcatgccatactagtggaggaagttctcaccttcgcgggagggtgcgaccttccgttgcttctggggagcctttcctggttactatgatcctcccccctgttgcttttgggggagtgaggagaggtagtggcaatggagatgccagggcatttgcccacgttcgatgtagccatagtgctggctcaccatcgtccccacttgctattgttggctgtcgcaacctgcccttcagcgggggcgcgaaaaggcttctcggatgggccaagggtgcgtcttccaaggaaagaaaacgcatggagtcgccaccaatgtttatttga

SEQ ID NO: 65457 - DNA, 337 bp, Glycine max
  Peptide Sequence Number=SeqID_182235
atgaagccacttgttccaaagacaattggtgtggaagaatatggccagagatatggatttcgtctagcaattgatgagatgctacatggcaagcttccactatcttcacaagcatcagaggagaaagaggacacagtagaagagtttgatgcttataataattatgcatcttggtcttcagaaactgacatgtctgaaatggtttctgctcttgctcaagttatgggaactaccaatcggaacccatacatgccacaatcaacctcctttcctttctcaacttccgtggtcaaagatcaacctcaaccgtacccatctcaacctcctccagatcaag

SEQ ID NO: 65458 - DNA, 7751 bp, Glycine max
  Peptide Sequence Number=SeqID_182236
aagatgaaattaacttgggagaccagatagtggagcatgattctgctgcatttgaaaaggcgtttttttatccaaagggggaccctgatgctgtttgtatcagaaatagcgatattgagcttttacagcctgagaaatgccttaatgataatatcattgacttttatatcaattatttgaaaaataaactcccaactgataaacaggacaggtttcactttttcaattgctttttctttcctaagcttgttgatttaagcacagataatccatcaattgcttctgatggtaaagcagcatttcagcgtgtaagcaaattgacaagaaaagtgaacctttttgaaaaggattatatcttcatccccataaactatagtcttcactggagtttgattgtcatttgtcaccctgctgaagtcatgacatgctacagagatgaagaaactaagggatctcccaaagaagcttgcatcttgcacatggattcccgaaaaggaattcatcaagatctccacaatgttttccaaagttatctatgtgaagaatggaaagagaggcacaacaatgtgagggatgatgatgtttcttctatatttttacatcttccattcgtgccacttgagctgcctcagcaacaaaatgcatacgattgtggcatctttttgctccactatgtggaacgttttctggaacaagctccaatcaacttcaaccgttccatgataagcaagttcagttattggttccctccaccagatgctcctctgaaacgatctcatatacagaaactattaatagcggctgaaggagacaataaaatgattgttggtggttcagttaaccctcaaaacagtacaaaattgtcagctgctttattaggaggtgatgtagaagatcatactgtgaacggaggtagcaatggtgacgatgctttgactataaatcagttgttatccaaactaacaagggaagaagactggttacattggcgggagttccagggcaataagcgcaagagacaagatgacgattggttggataaactaaaggaccttaaaaaaagagctattgatgtgaaaaactcactgcatcagtctgggtcgactaatgaattggatgagccttctgaattggatattgagtttgatgtattattgatacagaagccttgggggttgcgagataaaaatgtgaagaagatgtgggatcttctggaggatgaggaagtcttcattattggcatagatggaatggggggagttggaaaaacattcatggcaactcatatcaagaatgagattaaaagaaaggggactttcaaggatgtcttctgggtcactgtttccgatgatttcaccactttcaaattgcaacatgacattgcagaaacaatacaggttaagctttacggagatgagatgactagagcaacaattttgacgtcagagttggagaaaagagaaaaaacactgcttattttggatgatgtttgggattatattgatctgcaaaaggtggggattcctcttaaagtgaatggcattaaattgattatcacaactcgtttgaaacatgtgtgtctacagatggattgcctaccaaataatataataacaataccccttaatataataacagaagaagaagaagaagaagcttgggaattatttttgctaaaacttgggcaccgtggaacacctgcaagactttcccctcatgtgctagagattgcaagatctgttgtaatgaaatgtgatggtttaccacttggaatcagtgtgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacggtctgcactgtttcctactattattaggaaagaggaatgggttacgatggttgttgagagtgggttgttaaatggaaagaggagtttggaggaaacatttgatgagggacgcgtcataatggataaactcattaaccattctttgttgttagatcgtgggagtttacgaatgcatggtctggtgaggaagatggcgtgccatatcttgaacgagaatcacacttacatgataaaatgtgatgaaaatttgagaaagatacctcagatgcgggaatggacagctgatctggaggcagtttctttggcgggtaatgagatagaagaaatagcagagggcacatcacctaattgtccaggcttgtccaccttgattttatctcataatttgatcagtcatattcccaagtgttttttcagacacatgaatgctctaacactacttgatttatcatataattatgagttaacatctttgccaaagtctctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattgttacccggatgcgcactgcccggtttgagcaatatgcaatatctggatctccggggttggtcaggtataaaagtagaagatgtaaaagggatgactatgcttgaatgttttgcagtaagctttctcgatcaggattgctacaaccgttatgtgcaagaaattcaggacactggttatggacctcaaacctattttatctattttggaaaatttgatgattacacacttggattttctgagaatcctatttatctttgtcttgaattcaagcgtcgaagggtatgttttggagattgcgatgaattaccctatttactgccaagagaccttgcggaattacttgtaagtggtaatcatcaatgggaatgcttatgtgctgctctgtcatctaatggttctctatctttcaaggacattgacattggatactgcacaaaattgaagagtttattctgtgtatcttgttccttatgcactaatatccaaaacctcaaatctttgaaacttaataatttggatcgtttaagtgtcatctgcaaggaagatgttgctggtttaacacaatctttatctcggaggggggtgttttctcatctcaaggaattgagtatcgatggatgccatcagatcgagaagttgctgacgccagggttagtgccacaacttcaaaacctggagtctatatcggtatcggactgcgaatcaataaaggagatatttgcaggagatagttccgacaacattgcacttcccaagttaaccaaattgctactacgctggttaccagaattaaagacgttccggcgagacctcccaaattccgttgaagttcacaaagaagaaaaagtgaaggtgttcaatgggaagaaatgggagaaattcaacagtgagaaagtggcatcactagcatatgctcgcatacaagggaaagcagctctcattgctcacttccaaaattcaagcttgatgaatgaggataagcactgcaagcctatatcctcttcaacgccgatggccctaatgccagtgatcagagatgaagctacaaaatgggtactaactttgctagcaacacaggttcctttcccagttggcattaacattcgcaacgaagttggaagagtgagaaacaatactcaggaggataacctgcaaggaaaagatgtggagcatgattctgctgcatttaaaagcaatgacatggaaaaggcaatttgttatccaaagggggaccctgatgctatttacatcaggaagagcgatattgagcttttacagcctgagaaatgccttaatgataatatcattgacttttatataaagtatttgataaataataaactcccaagtgataaacagaagaggtttcactttttcaattgctttttctttcctaagcttgttgatttaagcacagataatcgttcaattgcttgtgatggtaaagcagcatttcagcgtgtaagcaattggacaagaaaagtgaacctttttgaaaaggattatatcttcattcccataaactatagtcttcattggagtttgattgtcatttgtcaccctgctgaagtcatgacatgctacagagatgaagaaactaagggatctcccaaagaagcttgcatcttgcacatggattcccgaaaaggaattcatcaagatctccacaatgttttccaaagttatctatgtgaagaatggaaagagaggcacaacaatgtgagggatgatgcttcttctaaatttttagatcttccattcgtgccacttgagctgcctcagcaacaaaatgcatacgattgtggcatctttttgctccactatgtggaacgttttctggaaaaagctccaatcaactttaaccgttccctgataaccaacttcagttcttggttccctccactagatgcttctctgaaacgatctcatatacagaaactattaatagttgaaggaggcaacaaaatgattgatggtgattcagttaactctcaaaacaatacaaaattgtcagcttcagcaggaggtgatgtagaagatcatgctgtgaacggaggtagcaatggcgatgatgctttgactataaataagttgctatccgatctagcaaggcaagaagactactttgataaaagcttacagtggcgggagttccagggcaagaagcgcaagagacaagatgacaattggttggataaactaaaggacctgaaaaaaagagccattgatgtgaaaaactcactgcatcagtctgggtcgactaatgaattccccaagccttctgaattgggtgatgagtttttttatttatcgatagagaagcgttgggcgtcgcgagataaaaaagtggagaacatgtgggatcttctggaggatgaggaagtcttcattattggcatagatggaatggggggagttggaaaaacattcatggcaactcatatcaagaatgagattaaaagaaaggggactttcaaggatgtcttctgggtcactgtttcccatgatttcaccaatttcaaattgcaacatgacattgcagaaacaatacaggttaagctttacggagatgagatgactagagcaacaattttgacgtcagagttggagaaaagagaaaaagcactgcttattttggatgatgtttgggaatatattgatctgcaaaaggtggggattcctcttaaagtgaatggcattaaattgattatcacaactcgtttgaaacatgtgtgtctacagatggattgccaaccatataatataataacaatattcccctttgaagaagaagaagaagaagaagaagaagaagaagaagaagaaaaagaagaagaagaagaagcttgggagttatttttgctaaaacttggacaccgtggaacacctgcaagacttccccctcatgtactagagattgcaagatctgttgtaatgaaatgtgatggtttaccacttggaatcagtgtgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacagtctgcactgtttcctaatgctgatgaagggaaatgggctatgatgattgttgagagtgggttgttaaatggaaaggggagtttggaggaaatatttgatgaggcacgtgtcatagtggataaactcataaaccattctttgttgttaggttattggagtttacgaatgaatggtctgttgaggaagatggcgtgcaatatcttgaacgagaatcacacttacatgataaaatgtcatgaaaatttgagaaagatacctcagatgcgggaatggacagctgatctggaggcagtttctttggcgggtaatgagatagaagaaatagcagagggcacatcacctaattgtccacgcttgtccaccttcatcttatctcgtaattccatcagtcatattcccaagtgttttttcagacacatgaacgctctaacacaacttgatttatcatataatcgtagattaacatctttgccaaagtcgctgtctaagttgaggtctcttacttctttagtgctccgccaatgttcaaaattgaaagatatacctccactgggagatctacaagcattgtcaagattggacatttccggttgtaattcgctcctcagggtaccggaaggcttgcaaaatctaaaaaagttgcaatggcttagtctttcccgcaagctgaatttatcattagtaccgttatgcgtactgcccggtttgagcaatatgcaatatctggatctccgcggttggtctggtataaaagtagaagatgtaaaagggatgactatgcttgaatgttttgcagtaagctttctcgatcaggattactacaaccgttctgtgcaagaaattcaggacactggttatggacctcaaacctattttatctattttggaaaatttaaggattacacacttggattttctgagaatcttatttatggtgaattcaagcatcgaagggtatgttttggagattgcgatggattacactatttactgccaagagaccttgcagaattacttgtaagtggcaatgatcaatgggaatgcttatgtgctcctctgtcatctaatggttctctatctttaaagcacattaccattcgggactgcacaaaattgaagagtttattctgtgtatcttgtcccttatgcactaatatccaaaacctcaaatctttgacacttaataatttggatagtttaagtgtcatctgcaaggaagatgttgctggtttaacacaatctttatctcggaggggggtgttttctcatctcaaggaattgagtatcagtggatgccatcaaatagagaagttgctgacgccagggttagtgccacaacttcaaaacctgaagtctatatcggtatcgaactgccaatcaataaaggagatatttgcaggagatagttcccacaacattgcacttcccaatttaaccaacttgcaactatactggttaccagacttaaagacagtgtgcaaaggaattttactcattaactctgaggatatattgcacatcaacaattgtcccaattatgaaaaacccagaattagtcgtaacaatggcaatgtgggatatgcattcatcaacatgatcaatcctggcttgattatactattctatcaggtgttcaatgggaagaaatgggagaaattcaacagtgagaaagtggcatcactagcatatgctcgcatacaagggaaagcagctctcattgctcacttccaaaattcaagcttgatgaatgaggataagcactgcaagcctatatcctcttcaacgccgatggccctaatgccagtgatcagagatgaagctacaaaatgggtactaactttgctagcaacacaggttcctttcccagttggcattaacattcgcaacaaagttggaagagtgagaaacaatactcaggaggataacctgcaaggaaatctgccaaattttgcaaactgtaagctctcatctgatggagatagtcattcattggactcagactaa

SEQ ID NO: 65459 - DNA, 564 bp, Glycine max
  Peptide Sequence Number=SeqID_182237
atgcagaagaagacccatgagagcatcaacaacaggcttgctcttgtcatgaagagcggcaaatacacccttggttataagaccgttctcaaatctcttaggagctccaaagggaaattgattatcattgctaacaactgcccccctttgagaaagtcagagattgaatactatgccatgttggcaaaggttggagttcatcattacaatgggaacaatgtggatttgggcactgcctgcggcaaatattacagagtgtgctgccttagcattattgatcctggtgattcggatatcattaagacactgcctggggagggaggagaggaagaggtggcggcgggagcgaatagctggagtggacgacggcgaggaagcggttgtgcgggatatcgactgatcggagatgaaggtttcagcgatgccagcgtcggagacggcgacgatgatgcgcttgtggagggatccgaggaggaagtgctgctcggttgtttggctgatgagattaacattgtgcttgaagaatgtgaagtgactatggtggtaaaattagggttagcttag

SEQ ID NO: 65460 - DNA, 651 bp, Glycine max
  Peptide Sequence Number=SeqID_182238
atgccgaatgaaaaaccgataggatttgaattcaaataccatttaaactattcaaaccttcccactactaaggtggcaaagaagccacactacagaggagtgaggcagagaccatgggggaaatgggcagcagaaatccgtgacccaaaaaaagcagccagagtgtggctaggaacctttgaaacagcagaggatgcagcacttgcatatgacaaagcagcactcaagttcaaaggcacaaaagctaagctcaatttccctgaaagagttcatcaagatgttccctttatgcaacaacaccaacaacgttcatcaaacagaaacgtttttcccatccatgcaacttccaccactagtagtgctactgggtctgtttcttctgttgatgctgttgctcctccttcgttgtccactcatgatcaacatggccaccaagttttcccaaatctgtatcaatatgcacagattctttcaagtgatgatgcacagttaccttatttcacatcccatcttttcaatcaacaacaacaacagcaacagcaacaacctttcaattctcaattctctagcactttttcttcaacctcatcctacttctacaaccagcaacaacaatatgatcaacaaggacatgatcactcaaaccactag

SEQ ID NO: 65461 - DNA, 366 bp, Glycine max
  Peptide Sequence Number=SeqID_182239
atgaagcaacacagggtagtgcctcctgtttctggagacatggtgcagtgtggcacctccttggaggagacatataaggtgacaccacatgttctgacaggcaaccttaaaaggtggctgacattgaaaaggtctaagaaaatccgtaaacagtgtggagaagtgaatgaggtgaggttcaagtacaaaaagccaggccagaaggaaggcctttgtaagaagttgtttgccttgccagctgatgatgacacttgtctacgtagctcggagattaaggatgattataagtcatcaatctcaagaggctattatggaaactgttgtgatttctggggacaaaaaaagaaagacaaccaatgcgattga

SEQ ID NO: 65462 - DNA, 1074 bp, Glycine max
  Peptide Sequence Number=SeqID_182240
atggcctcaacagctgagccacttccttatagctcaagaagaagagatgagtcagagttcaatttgagagaatgggcagtgaaagctcgaatcagccgcgagggaaccaactccagaaggtactcaggatcttacatgagaagctttagagaagacacaagatcatttagatcaaacataaccatttctagcactgcttcttcacccggatacctcttaaaagatgaaatagacccttcaacatattctttcactactgctcttaaagcattgcaagcaaggtcaagctattacagttgggaatgcttatctccagatggttttgctttaaattcaaagtggaatgaagcagaaaggtatatatgcaaccctctctcaggggaggtaccattggagtgtttatctgcaaaaactcttagtggaagatcttttagaaactcaataaacagaattgccatgtctgctcctctagtttattcctcaaagcacattccaacaaagccagcaactttcacacaagaagaagtggctcttcaatttcccaatccagaaaagaagaaagagggaatgacaagagatgttggtactcaaagtacacctccttatattagttcaaccagtcccagccctgcttcaactccatccatcacagagagatcaaaacctctagtttctgactcgcctaactcaaatgcaaaaacaaaatccgaggaagagcatccgaattcctttgatcgttggtgtggagcgatggaacacggctcatacactgatcagagtaaatcaacatttagtctcgtagatgaggatcatacttttgcaaacgctgttagattcaccttaaatcaagacccaagagtgtcattttgtggctacagcattcctcatccttcagataatcgtgttaatatcagagtccagacaacaggcgatccatcacgcgaggtgttaaaagatgcatgtcaagatctgatgcttatgtgccagcatgttaggagcacttttgataaggcagtcagtgattttaaaatcagcaaggctaggaagaataatgaggatatggatgtcgagtaa

SEQ ID NO: 65463 - DNA, 120 bp, Glycine max
  Peptide Sequence Number=SeqID_182241
atgaaaactgttgctgacgatgtcggggtgggtagcactactgttaggacactgccagttgttttgatatacataatggacgcgtcttatgacaaattccacccatttagagtttcttaa

SEQ ID NO: 65464 - DNA, 420 bp, Glycine max
  Peptide Sequence Number=SeqID_182242
cgggaaaaggcagcgcggcgaagtgtgaagcagcgaaagcaacaaacgtcgccgttccatcatcgagctctagggttttccatttcgcgcatggggaacctcgtggatcaagatcagcaatggctgctcagttgcttgtccgccacactcgaccccaaccccgagtccttcttaagcagtttgttaaaaagcattggcaagagggtgaggactcttttgaacctcctgttgttgctagtgatgaaaaggaaatcatccgcagaatgcttctattggcattggatgaccctcataagaaaatttgcacggctattggtatggctgtggcatccattgcaatgcatgactggccagagttatggccggatttgttaccatttctcctgaatttgattaacaatcaaaccaacatgaatggag

SEQ ID NO: 65465 - DNA, 303 bp, Glycine max
  Peptide Sequence Number=SeqID_182243
atgaatgaggaatatgaagctgcaattgcagttgcgtttcagtcacagaaacccaaaagccttgatgttgtgattgaaatcggggttgggtgccactggctatatgccctgaaaaaaacgcttccaaaagctgatgccttcactgcaccctgctcttctattacgcgtgcctgcaatcctgaaaagcttactcccctagcgcatctcgccagtcaaactggcgagtcccctgcatggtcaaatcgccagtgcaactggcgagaccaatgccacgtgtcgacgccagcccaaactcaccaatga

SEQ ID NO: 65466 - DNA, 177 bp, Glycine max
  Peptide Sequence Number=SeqID_182244
atgattagtttcagtgatgacaatgatgataatactgatgttagcaacaacaacgacgatagaaatatcagtaatgatcacgatgtagtgacaatgatggcagtagtggcgatgattcaaatggtggtggtagtggttgtagcaatgagtcaattacgatggtggtggtggtggtga

SEQ ID NO: 65467 - DNA, 333 bp, Glycine max
  Peptide Sequence Number=SeqID_182245
ctctcagaggctccgatggtcagtcaggatggtgaagcggtggcccaagaggtattggcgccacttatgcacgacgatagtgatggcgtacagctcgcggacgtaggcggaggctcgatggacgcgtgggcagaatgtcttgctaaagaacgcgattgggtgtccttgctggaggaggacaactcccatggcggtgcacgacgcgtcggtcttaacagtgaagggcaggtcgaatcgcagaagggtcaggattggagccgtcgtcatggctgttttgagcaggtcgaaggtggtctgcgactccggcgtccagcggaaggcatctttacgtag

SEQ ID NO: 65468 - DNA, 298 bp, Glycine max
  Peptide Sequence Number=SeqID_182246
atggaacagttctttggctttgctgggttgggctgtgaccgcaaaatggcactgcgtgaggctggtttcacagaacagcgaacacctcccattcccaacagtggagggataacaggttgctgcaatcacagtccaccatggcctgcttgtgactcaagtgggggcaccaaggtgatggaacagttctttggctttgctggggcactgcgtgaggctggtttcacagaacagcgaacacctcccattcccaacagtggagggataacaggttgctgcaatcacagtccaccatggcctg

SEQ ID NO: 65469 - DNA, 273 bp, Glycine max
  Peptide Sequence Number=SeqID_182247
atgaattccttacgaagttcaatgattgctgttatctttgccatgacattgatcttttcatatgaagtgattatgtcccaagctagggctcactcttcttcatccttagtttcaaaaatgtcacaatcttctcaatctcattcacattcattttttcacaaagaagagcaaaaaccaactcaggagcctgcggttgccactagccttagaaggataccacctagcagaccaaatcctacacagaacaggttaaagcctaggataaggggctaa

SEQ ID NO: 65470 - DNA, 366 bp, Glycine max
  Peptide Sequence Number=SeqID_182248
atggggagagttaacttagagttaaatcttgatttcgaaaatctgcaaaattatgcagcaaagctgtcaaattgtgcagcaaattctgccaattatgcaggaaaaaaatggttgagtgctagtttctgctgtcacgggaaaggtagtttcatgacaaatggaattgaattgtttggatattgtgaaagcttggcggggttgatggggacccgggctgagaggaacgaggagaaggctacgtgcgtgcacttgtacctggagatatgtcacgggggtcaggagaccttggggacgtcaggtgggatgctattgcccaaaaccaagcttggccaatcccgacccaacccgggcatagtcagtcagtga

SEQ ID NO: 65471 - DNA, 381 bp, Glycine max
  Peptide Sequence Number=SeqID_182249
atgacatggaaatacgatttgttgattgatgttggaaatgcattggcatgtgcatgttgtgtatgttcgtggggggcactgtgcactgacctttcagggtctttggcactagcttttggccacgttcatacgttggatgttgtgtatgatcgtggggggcactgtgcactgaccttccagggtgctttaattggtccatggtctttggcacttacttttggccgtgatcataactcatacgacacaggaaatagagtaattgtggccaaggaacacctttgggctcccaggctgatcacctatgggaggggggctgttacgtgcacaaccgggtggtctcgacaaactcaacacagttccctaagtgagagtgtcgtgtag

SEQ ID NO: 65472 - DNA, 415 bp, Glycine max
  Peptide Sequence Number=SeqID_182250
atggaccgaggtgttatacgaccattcggccaaggtgaggtatgtgaaccaggtcgtgctcatttgcagggaggtgccactcaggcaaaacagctcgcgctagaaggagctgacaaatatggggtcgcgatcggagatgatgttgcgcgaaaacccgtgatgtttgcacataatgtcgaggaacaaggctgcgactttataagcagtgaaacgggctgtgataaaatccatcgaaatatcctcccagacaccggaaggaggaggaatggggtggagcaggccgacaggctttcgattgactggcttcatttgttggcaaacctggcactggcgcacgaagtccttaacatttgtgcccatatttggccacgtagaagctggcttgaaggcgatggagggtcttcctcattcccaa

SEQ ID NO: 65473 - DNA, 1260 bp, Glycine max
  Peptide Sequence Number=SeqID_182251
atgcatattccaacaacacatcacccccccccccataaccaaaacccctcaagcctcattagtgtaagtcttcaacatgtcaaccccaccagtgtcctttctattcctccttttgttctccctcgttgtaccatcactattagctcaggctccatcaccatctcccaacacattctcctcatcctccaccatctccaaaagatacacatcctcccttctacttctacaccaccctcttcaaaacactcacctcctcctccttcttcaccaccaccttctccaaaacatgctcctcctcctcttcctccttcctctccaccaccaccatctccaaaacatgctcctcctcctcctccttcttcttctccaccaccaccatctccaaaacatgctcctcctcctcctcctcctcctcctcctcctcctccttcttctccaccaccaccatctccaaaacatgctcctcctcctcctttttcaccaccaccatctcaaacacatgtccctccacctcctccttctccatcatctccaaaacatgcccctccacctcctactccatcaccaccatcttcaacacattcccctcctcctcctcctccttctccaacaccacctccagcacgtgccccttctccccctccgcctccaccaccttcatcaccctcttcagcatgcaagtccacactataccctaaactatgccgctccattctctcctccatccgttcctctccttccgacccctacaacctaggcaaattctccatcaaacaaagccttaaacaagccaagaaactagtcaaggtcttcaaaaacttcctcacaaaacacaagtcatcctcttccctcaacaccgcagaaatcgcagcgttggaggactgcagcgaactcaacaagctcagtattgattacttggagtcggtctcaatagagctaaagtcgatcgactccaataacactgagctggttgagaagattgagacgtatctcagcgctgtggccactaaccactacacttgctatgatgggttggtggtgatcaagagcaacattgccaatgctattgctgtgcctctcaagaatgtcacccaattatacagtgtgtcacttgggttgttcacgcaggctctgaagaaaaacctcaagaagcataagacacgcaaacatggtcttcccaccaaggactacaaggtcaggcagccattgagaaaactcatcaagcattgcacgtggcctcatagttgtgtcgaaagctga

SEQ ID NO: 65474 - DNA, 417 bp, Glycine max
  Peptide Sequence Number=SeqID_182252
atggatgtgggaattgatactgataatgcaggtgatcacagggaaatttggagagataaagagctaaaaacaagcctaaatgacaaagtgaagaatttgtcttttcatcacgaccatgatgtatatgatccaccaccctcatgcgaatttatgtgtattttcaaggttgaacttgatagaacaagggaagcagttgctcaagcattaacagattgtgctcatgttgaaaaaaaggctcccaagtggtttatgactgaggattatttttataagatcaatggatggaaacctcctcgtcctcctacccttccaagcaatcctattaatctctcatccgattctgatgactttggtgatgagtttctatggaagcttgatgaagaagttgtaaaagatgaagctaattgcatcatctaa

SEQ ID NO: 65475 - DNA, 1260 bp, Glycine max
  Peptide Sequence Number=SeqID_182253
atggcttccaggaagaggaaatccacagcctcccaacctcgggaactctatgataccacccggtttgttttcgaggttgcttgggagtgttattctcagaacattcactcctggaacatccttccagagaggaacattaacctcttcgtgactgagtacgatgagttcaggcgagagctcatccggcggaactggcataaggcgctgacacagcatatggatgggcacatcgatgtggccctagttaaagaattttacttgaacctgtatgatccagaagataaatcaccaaaacagattcgagtcagagggaagctaataaattttgaagctgcgttgttgaatgctttctgggaaacaccaccagtcattctgccaggggagcagtacccctcatattctattttctgtagggcgtggacacaccctcaggagcttgcctccaagctttgtattctaggacatggatttgttcttaatgttgaaggagcgccctggaggctcctgaggaaggacttgactaccttggccaagacatggagtgtgctctcatactccaacctcgcccccacctctcacacgtctgattttaatatggacagggcgaggttagtctatgggccggttatgaagatggacatggacgtgggcttcctcatttcacaccagatgtcacagatggccaagttcaactcctgcaggcttgggactcgcaaggcacaggctcgaggatctgaggttccatcttcagctgctcctcctgcttctgcttcctctgcacctgctccttctccggctttagccccttctacttcagcaccaccacttcctcctacttattctcattcaccagcttcgtttgctccatcatcatcatgccagtgccaatgctccaaggtcaccattcctatgttgcaaagcatccaccgtggcttatgcctggtgatgcagagtatgcatgactcgactcaacattggccttttatcagcatggatgagttcatggcacaggtggcttggccaagagtccagccttctcctttggggggaggtgaggcttccacaacccaggagcctcagccagagccagaggttgctcatgaggccactctacatgctacttcacctatcgtagaggtctctgagggtgaagaagcagcacatgagacaccacaaccagcccaggatactccttctttaccttatggcgagcctgcaccagctcaggacgagcctactgctgctccggatgattgttga

SEQ ID NO: 65476 - DNA, 1047 bp, Glycine max
  Peptide Sequence Number=SeqID_182254
cttcttcacacaaagtacagttgcacaggatcatccaactgtagtactagaagtgaaaggattcttcaagaaagcgagaacaaaggagttcttctaaaagagtttgcgattgttagccttgatggcacagaaaacttcacctctattggagatgctattgccgctgcacccgataatttgaggccagaagatggctattttcttatctatgccagagaaggaaactatgaggaatatgtcactgttcccattcaaaagaaaaatatcttgcttattggtgatggcatcaacaagacttgcatgacaggaaatcatagtgtcgtagatggttggaccactttcaattcttcaacctttgctgtctctggagaaagatttgtagcagtggatgtcacattcagaaacacagcaggtcctcagaagcaccaagcagtggccttgaggaacaatgcagacctctccacattctaccgttgcagctttgaaggataccaagacactctctatgtccactccctcaggcaattctatagagaatgtgacatttatggcactgtggatttcatttttggcaatgctgctgtggtgttccagagctgcaacatttatgccagaaaaccaatgccaaaccagaagaatgctgtcacagcacaagggagaactgaccccaatcaaaacactggaatttcaatacagaattgcaagattgatgctgcacctgacttagctgcagatttgaattcaactgaaaattacttaggcaggccgtggaaagtgtattcaaggactgtgttcatgcagtcatatattggagaactaattcaatctgctggatggttagagtggaatggcactgatgggttaagcaccctcttttatggtgagttccagaactttggacctggttctgataccagcaagagggtgcaatggagtggttacaatctgttgagtgctactcaagctaggaactttactgtgcataattttaccttggggtatacatggcttccggatacagatataccctattctgaaggactttag

SEQ ID NO: 65477 - DNA, 258 bp, Glycine max
  Peptide Sequence Number=SeqID_182255
atgaggaatacttacttggatatggagaagattaatgcacaggaagcaacaaaagcagaggaggatgaatgcacaatgcagagagtgcaagtttcggctgcctcgcttagcgcaggtcactcgctaagcgagcactcaatgacttttgagttttcagaattcaagctcacgcgcttagcaggtagactcgcttcgcccaattcgaaaatatggcattccagagaaaaagttaggcttagcgcgaagggtcgcgcttag

SEQ ID NO: 65478 - DNA, 1053 bp, Glycine max
  Peptide Sequence Number=SeqID_182256
atggtgcacttgaggttgtgtgacacaatcaaacaacccaacatcaacaaggagtacataaggatagctatttttcccttctctctaaatgggaaagcatgcttctttgtgataaatatcgataagcttcaagggaatttgtctgaagcatgggaaagattccaggagttgctcaaaagttgtccacaccatgggttcaaccagcagaggataatgcacatattttatggtggagtgccctcccacaataggacaagccttgatgctacatgtcaaggcaatatgatgatgaagccaccaattgatgccatcaagatcatagaggacatgcgctccaatccctacaacaactccaaggataagagaatcatgaagataacagttaaccaagaagatgctaaagctatcaagataagaagcaaaaaggttaaagaggacttcaagcaaaaagaggagtctacttcaaataccacagaagaggttctcactgaagagagcctggtgccagacaaaggagtagaggaaaagaaggaagcttcatctgaagctgaaagaccttgggagctgagggaacctaagcccactaatatcactgttcaccttgtggatcacttagtggaagatgaaaaagtccctatcatattaggatgcccttttctgaatacttgtgttctagtggttgaatctagggacattcttgatgatttggtagaggaaagactcccaagtgtttggatgattgatcctcttgagagagttcttaccaatgagaactttgaaaaggaaatgggccttggtgaaaaggaaggaaatggtccaaaggaaaaaccttccattgaggatcctcctaactttgaattgaagcccctcctgtccaacctcaaatatgttttccttaacataacttcttctcttccagttgtgatttctacaagtttgcatgaaagtgaaaagggaaaactactgagagttcttagagatatcagggaggcctttgggtggacaattcatgacataaagggtcttgactctaccatatgcaccacaagataa

SEQ ID NO: 65479 - DNA, 639 bp, Glycine max
  Peptide Sequence Number=SeqID_182257
atgccaccgctattcggtggcattttttcgaaaatccgccacggaaaaccgccatggcgccgccatttaacaacactgtttgtcggtgactacctacgaccaccgtcgcctatcttcggtgaccctgatactataaatgcgctgacgtccatgacgcgcgacatcttcttggctatgtacttcacgcatgcgcaacagaacgacaagtggagtagtgttaggaagtcccacattatttgcctcagttcttggggtgctgcttatatatctgttgggcaacttcacttagtgccgctacatccaccggtgattccacatactgatcccccagcatcatctcctgctccaaccggccctccaacgattcctcctgcacctgaatttaccattgccctaagcaaaggtgaagctatggctgatctgcgttggcggcaggcgatgttggatgaaatggctgctttacagactagtggcacatgggagttggttgccccagatggtattgatcggttcaaagcccatttggtgactaagggctatactcaaatctttggccttgactatgggaataccttttcccctgtagccaagattacttatgttcgtatgtttcttgctatggctgttattcgtcattag

SEQ ID NO: 65480 - DNA, 201 bp, Glycine max
  Peptide Sequence Number=SeqID_182258
atggatttcacagtcaaacaaatggcaggaagaaaaaaatctccattaaacacttctcgatctccctctcacttcgagcactgggacctctgtcttcagttgcattgcaaacacctccgtgacagttgccttattcctcgcatcacactcccacccgttgtcgtcagcctcgtcaatgatctcctctcctttgcgaaatga

SEQ ID NO: 65481 - DNA, 678 bp, Glycine max
  Peptide Sequence Number=SeqID_182259
atggagaagaaaccgctgttggcggagagcgattactactacagggtggagttcagagcgtgcaaggacgacgcgtggtacgcgacgcgcgtttcgctggagggagaaacactgaaagtgaagtacttcaacttccccgacgaatacgacaacgcgtttcgagcctccgagtttggggacttggaaaagcttcaggagtttggggaacgcttcagaaccctctccaaacaggctcaggacagcgattgtcgttcactcgctgagggtgtctgggtctgcgcgtgtcagtgtttcggcgatgatgatcttcgctactacgacgctgtcgtcgacggggtgcaacatggaaagcattattggaaagcaggaaaggaaacatgcttttgcaccttcatacttttctggttacaagggccaaatgcgggaaatttgactgctacaacaattcaggatatctgcatggttcagcttgaacggcagctagatcctgtagtggcttcatttctagagatggcaaggaggaaaatagaacgaccagcaaaggcaatgcttgacatgatatcttacatcactctacaggaaaaacaatgtgctaatcagtctgttgtcaaattttgttcacctgaaggcctaagacatagcagtcaaaatcacaggtcaacatttaggatcatatga

SEQ ID NO: 65482 - DNA, 351 bp, Glycine max
  Peptide Sequence Number=SeqID_182260
atggtgatcttcttatatattgcattgttgagagaagtgaagttggaatgcttgatacaggaaattaaaggaataatattgtttcaagttggaagggaaaagtttttaatccgatggcttcttgtggcgaatcagaaaaatgttgaagttcatcatgagattagtaaaaaattctgggattctcagcattggccaaagcatatactcgtccaatatacatggaaggaacattcagagatagatgtaacttcaagattttttgttctgtttggttcagccaaggaagaggaaaagaatgaaggaccaactgaagaatctgatgatgacatagctcatccccttgggaactag

SEQ ID NO: 65483 - DNA, 1497 bp, Glycine max
  Peptide Sequence Number=SeqID_182261
atggaagagaatgttaagcagccattgttggagaggaaatactacgaggactgcccaggttgtaaagtggatcaagccaaagagttgagtgagggacaaggtgtacctgttagaaatcttttcatcatatggatggtggtgttgtgtgctgacaaacacagttgctacaaggttgctaaactagcgttgcccatatcgtctctcttccccttcctttatttcatggtaagggattttaatattgcaaaaacagaagctgacattagttcttatgctggttatgttggttctgcattcatgtttggaagatgtttgacatctgtaatgtggggtattgtagctgatcgctatggccgaaagcctgttatagttatagggattattgtagttgtcattttcaacacactatttggccttagcacaagtttttggatggcagttataatgagatttcttctgggaagtttaaatggtttgcttggaccagtgaaggcctatgccactgaactttttcgagaagaacaccaggctctgggactctcaactgtcagtgcagcttggggagtaggtttaatcattggcccagcattgggaggctatttggctcagccagtagagaagtacccccatatattttcaaaggattccttctgggataagtttccttacttcttgcccaactttataatatcagcagttgcatttgtagtagtcattggttgtatctggattccggagacacttcacaaccacaattgtagaaatgaatccatagacaatgctgaagctttagaaaacggtggcagtgtggccagtaaagacaagataatccaaaagaaggaaaacctcctcctgaactggcccttaatgtcatcggtcattgtttattgtgttttcgcacttcatgatattgcatatcaagaggttttctcattatgggctgtgagtcctcaaaggttggggggtttgaactttacaactgatgatgttggtaatgttctttcaatatcaggtctagcacttatcatttaccaacttaccatatacccatccgtggaaaaagctagtggacctattgttattggtcgcatttctgggatgatatccataccacttttgcaaagttaccccttcatagcgttgttgtcaggcttagcaatatacatagtgttaagtattgcttcagttttgaagaatattctgtctgcgaccattaatactggtttgttccttctacaaaaccgagcagtggaacaacaccaaaggggggcagctaatggcatttccatgacaggcatgtctctattcaaagctattggccctgctacaggtggtgcaatattaacttggtcacaaaagcgaatggatgcttcatttctcccaggcacccatatggtcttctttgccttgaacatagttgaagcacttggattactaatgttgttcaaaccattccttgttgaaaagaacaaaacgcacttaaatcagttacattga

SEQ ID NO: 65484 - DNA, 246 bp, Glycine max
  Peptide Sequence Number=SeqID_182262
atgaaggaagcgcttgtaatgactgatggcgaaagcgttgacgccgacatagggggtcgacaatggagacgaccctttagcggaagctacgcacaaccatcggggaacataaagaaaaaccattggtgtttaaaagtttcgggaatcctttcgctgcacatgatcggaaacaacgagttgccatatcttgggagaggaattcagtcagattctcctaccagtgcaataagggaattttctctctaa

SEQ ID NO: 65485 - DNA, 324 bp, Glycine max
  Peptide Sequence Number=SeqID_182263
atgacagagaagaatggcaaacaaccattgttggagaggaagtactacgaggactgcccaggttgtaaagtggatcaagccaaagagttgagtaagggacaaggtgtatcctttacaaatctttttatcatatgggtggtggtgctgtgtgccgtgtgtcggtgtcaaaaacgacacagagacacttcaaacaagaaaggtctccgtgcttcattggttccagctctgcctttgtgctttgtggggtgtttgaaagtcccacacgctcctctctcaattcctgaggtgcaacttatatactgttctgcactcattggcatttga

SEQ ID NO: 65486 - DNA, 1743 bp, Glycine max
  Peptide Sequence Number=SeqID_182264
atgtcctccttcaaatcttacggaaaggttgatgaatccgagcaagcaaggctcgaagctcgccgcaaaacgggaaagcgagtcaccatcatagccctgtccaccatagtcctcatcggagttgtgtgtgctgctgtatttggaaccgttgctcacaacaactcagataataatgatggtgtaaatagtaatagtgcaccatttctttcgaattcagtgaagagtgtttgtgacctgacactttacaagggagcatgctacagcagcattggtcctcttgtgcactcgggtcaggttcgacctgagaagttgttcttgctgtctattgaagttgccctagctgaggcttcaagggctgttgagtatttctctgagaagggagtttttaatggcttgatcaatgttgataataaaacaatggaaggctttaagaattgcaaggatcttttgggtcttgcggttgatcatttgaatagctctttggcttctgggggcaagtcttcattgcttgatgtgttggaggatcttagaacttggttgagtgctgcaggtacttaccagcaaacctgcattgatggctttggagaggcaggagaagcactgaagaccagtgttgtaaacaatctaaaaaattctactgagttcaccagtaatagtcttgccattgttacttggctcaacaaggctgcaagcacagtgaacttgaggcgcttgttgagtaccactttgccacatcatcatcatatggtagaaccaaagtggcttcattctaaagaccggaagctgattcaaaaagatgataatttgaagagaaaagctgacattgttgtagcaaaagatggcagcgggaaatttaaaacaatcactgctgcactaaaacatgtccctgagaaaagtgacaagaggactgtgatctatgtgaagaagggggtttactatgagaatgtgagggtggagaagactaaatggaatgtcatgatcattggtgatggtatgaatgccacaattgtatctggaagccttaactttgtggatggcaccccaacattttcaactgcaacatttgctgtgtttgggaagaatttcattgctagggacatgggatttcgcaacacagctggtccacagaagcaccaggcagtggcactgatgacaagtgctgatcaagcggtttactacaggtgccaaattgatgcatttcaggactctctctatgcgcattccaaccgccaattctacagagaatgcaacatttatggcacagttgatttcatttttggtaactcagcagtggtcctccaaaactgcaacattttcccaagggtgcctatgcagggccagcagaataccataacagcacagggcaaaactgaccccaacatgaacactggaatttcaattcaaagttgcaacattgcaccctttggagacttaagttctgtgaaaacataccttggaagaccctggaagaattactcaactacagtgtttatgcaatccacattggggagtttcattcacccaaatggatggttaccttgggtaggagactcagcaccagataccatattttatgcagaatttcagaatgttggaccaggttcttcaacaaagaatagagtgaagtggaagggtttgaaaaccattacaaagaaacaagctagcatgtttactgtcaatgcttttctttcaggggagaaatggattacagcttctggtgccccctttaaatcttcaacgtga

SEQ ID NO: 65487 - DNA, 594 bp, Glycine max
  Peptide Sequence Number=SeqID_182265
ttgagattgcctgctatcagacaaccattgatattgcagtttaaagctaccttccattgtgacaaggacgccatagaaataccaggcttttatcagcgccaatggctaccaaattatcctgaaattgttgaatttaagtatgatggggaaacctacgaaattctagtcagacaacagaaagacaaactttactttgctgatggcctaacaagattcaggacagaattgcagatttatgaatctgtcacgataaatttcctggcctgcgaccaccctgcaaaatttgacctccacttcactccaccattagaccagcagaaatgcaaaaggcgccgtccaacaagaaaacacatctggacatatgaaatcacccaatcaatgctaggcgcaccatatccactgcaacttccaacctctgtcacacaatgcctaatccactgtggtgatcatatgacaattctcagaagattcggacctccactgcaatggaatgtagttgtgctcgacaaaggcatcggtgacaagcgtgctgagaagatctgggaggttgtcatcaggcgtgcaattgattgggatgatagtgatatagattag

SEQ ID NO: 65488 - DNA, 150 bp, Glycine max
  Peptide Sequence Number=SeqID_182266
atgccacaacaccatccgctatggtccaccatcgataacactggagaagtgaaataccagtcaccaagtctagttatttttgccgaagggaatatctttgtcaaagcagctggaacattcccagagaaggatggcagcactagaaaataa

SEQ ID NO: 65489 - DNA, 681 bp, Glycine max
  Peptide Sequence Number=SeqID_182267
atgtttcctgactggaatccatccacaaattctgtaactggcacatccaacaaccagaagatatacctgttgccacctggaaatagaaggtacttatttcaggaaacactatctgatatgccacaggcacatttgtggtacccctctgacgatgtaattaaggcattacaactattcctagctggtgggaagaatcttgctggaagtctcacatataggccatctgtggatagtagtaatcaggacaataatttaagagaaatagttggtaaagcactacttcaggcatcaaaggtataccacaaggcagttacttcttatcagaagaagaatattgaagctttgcaatttcacagcaataagtttcttcaactgataaaagatattgatgtactgcttgcttcggatgataactttcttcttggaacttggcttgagagtgctaagaaactggcagtgaatccaagtgagataaagcagcatattccatttggcagcttgaggagtgttagaattagcacgtttcatattggctcattgctgattgtatttttccttcgcggtgaacagtactgcactgtgccactgcccttgtttggcagccttcctgacacccttttgtcggcaatgttgttaatggcggatggcggttcatggcggaaagtcaaaaatccgccataa

SEQ ID NO: 65490 - DNA, 210 bp, Glycine max
  Peptide Sequence Number=SeqID_182268
atggagattactgggttaacgagtggacggtggaagagaggtgtgaatcacatgaattggacaatgcatgctgcatgcgtcagctttgcatcaactagtgtggagcacattttgaagaatgggcatgaaggaataaaacagtactttttgaggaagatggttatgtctagcgtgagtggcgttgtacagggaaaatcccacttgaattaa

SEQ ID NO: 65491 - DNA, 549 bp, Glycine max
  Peptide Sequence Number=SeqID_182269
atgttgaaaagatcaatttctacatcattattaatggatgtctgtggtggagacagttgttttctaataaacaatcacaacaagtcaagccagaatgagcctgagattatcattagaggaaccacggctgttgagattgcatctggcctccattggtatcttaagtattggtgtggtgctcatgtctcatgggataagacaggtggcattcagacaacttcaatccctgagccagggtcactacccagtttaaaagatgagggtctgaagattaaacgccctgttccatggaattattaccaaaatgttgttacctctagttattcatatgtttggtggaactgggaaaggtgggaaaaagagttagactggatggcacttcagggggtgaatcttcccttggcatttactgggcaggaagcaatttggcaaaaggtttttaaggtgaagtgctattcacatgcttgtgtatgtctggataaagcttggtttaagaaaaatgaattctctagtttgaggatattaatcgagccaaagatttgttcctag

SEQ ID NO: 65492 - DNA, 612 bp, Glycine max
  Peptide Sequence Number=SeqID_182270
atgttgctcaggctcagaatagtgttacttagagcagtgattcaacatattcctataatgggagtaatcgctttctcaacaatgatcgtggtggtggacgaaatttttctcgtggtggccgtggtggtggtcacggctatagaaatggtgatggccaaggagtaccccaatcagtaccctaaccagtctcaatatcagatgttaccccctcctagccattatcccaatcagtaccctaaccagtatcataaccagtaccctagccagcctcattacaatcaccctcaagcacctgctccacaagcccattcacaaacccacccacctgcttcccatcatgtcacaaatctccctcaaaatattcaccagactacaccctttgaaggactagaccaaatcaccattggtaatggtcagggattgagcatcaattcctcagctttgcttcaattaactaaacagcaacttcagtcttctttcactgtcaataccatgtcaagagcatcttcttccgactctgtttcaccttctgtaaacagaatcaataatgtctctgctgtaaatacagtttctatagtactgtttcttttgccacttggcattccagattag

SEQ ID NO: 65493 - DNA, 1617 bp, Glycine max
  Peptide Sequence Number=SeqID_182271
atggttccacggcagccaatgaaggcctgcagtgatgatggagaccatggtgttttgagtttgctgtgcacgtggacggcatggtgttcttcggcaaggtcactgaaaaagcttccgaaaattcaaaaacagatcttcaaagaaggagagaagggtccccggagcactggaacgtggaaacatcaatctaatctaagtaataatgaacaaatccctataccagcagctgctggtcctttaccatcttctcaaccagaggtctcttccactgcagcaccagctccctcatcctcccctgtgatatctgcttcagcacccactgcagaatcacttcccttgctggccagacctgacaatactcactccatgtgtacaagggcaaaagctggcattgcagaatatgatgctcttattcacaatggcacttggacacttgtagacataccttcctcaaggcttggttatgattacaatgagaccttttcacctgtaatcaaaccagtcactgtaaaaatctttctgacacttgctatcactcacaaatggaaacttcagtcgctagatgtcagtgatgcctttctcaatggcattgttcaggaggaagtctacaagactcaacccctagctttgaggactccaacaaacagcttgtttgcaagctcaacaaatgtgatccctccatttgtgtattcaggctctactactgtggtctacatgctggtctatgtggatgacattattgtcacaggaaataatcccactttcatcaatctctcgtatataaactcaattctgagtcctctcaaggatttaggagatcttgactatttctgggaattgagagacctattggaaaagactactatggatgaagccaattcattttcttatcctatggttggtggccgtaagtcaactagtacaggatatgaatccttttcagatccctctctctatagatctgttgtgggtgctctccaatatgctacagttacgaggccagagataagtttttcagtcaacaaagtgtgccagtttatgggtaaacctactgaacaacactggatggctgttaaaaggatacttaggtatctcaaagggactataaactttggtttgcatatgcagcctcggcctaacttctcagtttcccatttctctgttcatgcttattgtgatgctgactgggcatctgatccggatgacagaagatcttcttctggtgctgccatctttctaggacctaatttggtctcctggtggtccaaaaagcagacagtggtggccagatccatccctcatgctccacctgttatcttctgtgacaacttaagcacagtagccttggctcataatccagttttgtactcaagcacaaagcacatagagcttgacttgttctttgttcgtgaaaaggttattgggaaacatcttcaggttgttcatgttccagctgctgatcaaagagcagatattctcactgaggctctcaccctttctaacttcactacatacgggaccaagctcagagtggttgaaaagccttctgccaaccactctggagcttgcgggggggttataggagtacacttactcgttgtaatgttttctttttaa

SEQ ID NO: 65494 - DNA, 270 bp, Glycine max
  Peptide Sequence Number=SeqID_182272
atggcggcggcttcttgcacggatggaggtgcccttttggagtccaagcgctgcagcaaaggctctatggcttcatacttagacagtgccgccggcagtaaaggcgttagaatcaatattagaaacacaaatcccaacttcaacattgttctcttcttcccacaaagagaaatgaaaaatggtattttgtttcgacacctaattgctactgcgttgactgtggctaccggtattatcgacacgcatactcatgtacaaacaaaaagttaa

SEQ ID NO: 65495 - DNA, 1050 bp, Glycine max
  Peptide Sequence Number=SeqID_182273
atgggtgctttcttttccaatctggacgcaaccgtggaggagattgaaatcggaagagacgatgctttcttcaatggagtccacgatgacaatgtttctagcagaccgggtggagagggttctgccggagctaaagctgtaagtctaacttctcagtttcccatttctccgttgatgcttactgtgatgctgactaggtatctgatccggatgacagaacctaatttggtctcctggtggtcaaaaaagcagacagttgtggccagatccagtacagaagcagaatatcaaagtctagccttggccacagggcaaaagcacgtagagcttgacttgttctttgtttgtgaaaaggttattgggaaacatcttcaggtggttcatattccagttgctgatcaaagagcagatatttttaccaaggctctcacctcttctaatttcactacatacaggaccaagctcagagtggttgaaaagtctgccaaccactcctcagcttgcagagggtataggagtatacttactcattgtaatgttttctttttagctaaagctcaccttacaagccgattttgtgggattgagttaggccctaagctcaaattcaaagatggaaatattgaaagtaccattgttgagtttgcactgacacgagcatcaacaggccctgaagaaattgaatccagagtgccatacatttcaatattgccaccaaagttatgtagcatgcacctgaagcaaaatttagtaacaagagctaacaaagtgttaattaccagatataaggagtaccataaaactgaaaggaatttttccatattggttttacatcagcaaatagatcaagaacaatcatcttcccaaatggaacagaatcattggcaatttggcattaaaaagcattaccatgtagactgctacagggcagaatatggaaaacaaagatttataatgcagagtatgctacatgagtatctagaatgggatcctaatactaccaccacattggaattagaagtcaatgatcattttgccaaaatgctttag

SEQ ID NO: 65496 - DNA, 399 bp, Glycine max
  Peptide Sequence Number=SeqID_182274
atggctctaagtgggaaagtggagactcaagtagagattcaagcacctgcagccaagttctactacgtctttagaaagcaacttcatcatgttcctaatggcgctaaagtgcacgatgctgactgggaaaatgttggttctgtcaaacactgggactttaccatagatgtaattgaacatttaaatagtaagaggatcaaattgaacctaaaaagtaaattagaagagaaaaaagtgtgtgtgctcgataacataaagtgtatgaatgtgtgtcgagagagtatgagggaacctgatacttatagtgtggagaggaagttgcgggtccttgttggcaggagctgttacagtgacataatagcctttgcagataattaccagtttgtagataatagctag

SEQ ID NO: 65497 - DNA, 354 bp, Glycine max
  Peptide Sequence Number=SeqID_182275
atggctgttatcatgaggtttcttatgggaagtttaaatggtttgcttggaacagcgaaggcgtatgccactgaaatatttcgagaagaacaccaagctctaggactctcaactgtcagtgcagcttggggcataggtttaatcattggcccagcattgggaggctatttggctcagccagtggagaagtacccacatatatttccaaaagattccttttgggataagtttccatacttcttgcccaactttgtagtatcagcacttgcatttgtagtagctattggctgcatctggattccgattgtgagctatgcttattgcaaccttgctctcacagtacaacttaaataa

SEQ ID NO: 65498 - DNA, 186 bp, Glycine max
  Peptide Sequence Number=SeqID_182276
atgatgatcatgacccatcctagcggtgtcgtccacgctcttcggctctcaaaagccctcaagggtgaatccaccacgaccgtgatcggaagtggcactgaagccttaagttgttatggattgactacgaccctcttggttgaccacgaccctcatgaattgaccacgaccatggtgagaccttga

SEQ ID NO: 65499 - DNA, 270 bp, Glycine max
  Peptide Sequence Number=SeqID_182277
atgttggtgcagagagagagagagagagagaatgggagcatgaaatctgaattgggggaaaggaaggagcatagactcaaagatgagcaaagattccatgagaggttcaaagaagaaacttttatgcagaaggcttggaggaatcattctcaacaacaagcattgtttaacgttcttctttgcggctcatcatatcgtggatcagcacactctagagtcctcaaagccatagccaaggatcaaagttcaagcacgcagaaaaaaggataa

SEQ ID NO: 65500 - DNA, 672 bp, Glycine max
  Peptide Sequence Number=SeqID_182278
atggcagaatcgtcaaagaagagaaagggatcatcctccaccgccgttgctgctgcccatcaccgccacagaccatccgaagcacccacagcacctatccatccttccttgtcatctccaagatcatccactctgttttcttccgatgatcggcgtctacggtacctttctcaattttcttctaggatcattttagaccctatgtacctagacatagatttcttcaatgatgagacatttgattggtatcaagatggcattctttcttctgaggtgcatggtattaccatgatcattgatagtcaaggtgcaccttttgagggcaccattgttgatgattggaaatttgattattctagtcatgatgctcaccgtatggtttgcaatgaccaggctaaaataaccagtagattgctcgtcggatcattaacatttgataattgcatcatgcactacattattgttagaattttgcttccccggtcttcaaattttgctcaagcctctgaggaggacttgattttgatgtgggctttccttactggtcgtcagatcgattgggctcacttggttcggtaccgaatgcataaggcatatattacgggccaatgcacctctcccttaccctcaattggtcactctatttctctgtcattttcaaattccgcttga

SEQ ID NO: 65501 - DNA, 180 bp, Glycine max
  Peptide Sequence Number=SeqID_182279
atgcttggttttgtcgtccttgagcttgtgcgtgtaatttttactgttgatgacttccttgttagagcaattgtagtggataacataagtgttctcatcagaaaggttgatgttgacattgatttgctggagtgtgtcattggtgggggtgggggtcacaggcgaggaagtgtggcgtga

SEQ ID NO: 65502 - DNA, 1608 bp, Glycine max
  Peptide Sequence Number=SeqID_182280
atgagggaaataattgcaactgctatcatggttcatgaatatccttttagtgttgatgaagattctatttggatgtgggccttccaatatgcaaaccctgattttcataaggttactcataaaactgcaggaaatgattgtttggcactgtttgagatggagaagaaaacattgaagaaattgttagaaagtgtgagcaagatcggtttaactacatatatgtggaaatctagccatcaagtagttgagtatatggttattactggacatttcattgacgcgggatggaatcttcaaaaaagagttttaagttttgtgaaagtgcctgctccaaggcgtggtattgatgttgttgatgctatttttaagtgtttgaaaacttgggggattgaaaataaagttttttcaatatctgtcaataatgcttcttacaatgactcatgcataagatgtctcaaagagaatatatctctaagtttgcaagatgaccttagtacaattaaggatatcattttcaatattcgtgaaagtgtcaaatatattaaccacaacgatgcaagactaaaggcattttgtgatgttgttgagcaaaaacacttgaaagaaaggaaacttgttattgattgtccaacaagatggaattcaacctttaatatgttgtcaactgctttgaaatttaagactgcatttgcttcttacaaagaaagagagcctcactataattatgcacctttacttgaggagtggaatcaagttgagaaagtttgtaagctgctggaagtttttaatcttgctactcatgtcatctcaggtagtgagtatccgactgcaaatttgtatttcgcagaagtttggaaggttaaaaaaatacttgacaaggagattgaagatgaagatatcttcatgagagaaatgataggtccaatgaagaaaaagtttgacaaatattggggggaacgtaatatgttgatggctatcgcaagtgttttggatcctagcaaatttcatatggtgagtacatgttttcccttgatatattctaaagaagatgttgatgagaatataaagaaggtgaaaagttcatttgaagaattgtatgatgagtatgtaggtctatgtttacaagagtctacgtctagtgttgttaatttggatgataatatttcatcatcctcccaattgaatacttcagttgtcactggttttgacgatatgagcatgctacgtgaaaaggaagttgtttctcctataaaatcagaattgcaagattatcttgatgaaggtatttatgttcctaacactaattcctttagtgctttggactggtggaggaacaataacatgaaatataagatgttgtctaagatggctgctgatatactagctatttcaatttcaactgtggcatcggaatccacatttagtgctggaggtagagtaattgatgaatttcgctctaaattaaacgaagaatctgttgaagctctaatttgtgatggaaattggtttcgtcagaaatataatgtgaagaaaaaatcaaagatattttatgtaccagttctgttcaaatggaatggagatgtaggccaagattaccaactaaattaa

SEQ ID NO: 65503 - DNA, 815 bp, Glycine max
  Peptide Sequence Number=SeqID_182281
atggccacaattatggaagccatgatgagcataaagagaatgatggaggtcaatgtggctacagttgttgccctaagtaccgccacagaaatggacccaactcacctacttggcttcgatcaagtaaatcatccaacctcggatatggtagggcaggcaggcgaagcgttcgaaagtatgaacgaccctcattttgtgcaagttcaaaacaagcattccttcccaccatatggcttgcctcccaactatacgccacccgatgttgcacgcactcccaatgagaatgtcgacaacttcgcatgcattcccagtgagagccaacaaactcaatttgatcatgcacatgtctctcaacccatgggggagacgcatgaagcatctcgagaccacaatcttgttgactctaagcctcaccttgaatgtgccgctgaggggcaggcattttgcattgtacccctaccaaacagtttaaagggccctcagtttcgcccacaactacaacccttgcattttgcggtgggaagagtccctcctactgtggtggaaaggggaaaatttgatcatatagaggaaaggctgagggccattgaaggaggcagagattatgcttttgttgacatggcagagttatgcctagtgcctgatgtcatcatccctccgaagttcaaggtgccgaatttcgataagtacaaggggactacttgccccaagaatcacctgaagatgtacaacaggaaaatgggggcatactcgaaaaatgaaaaaatgttgatgcatttcttccaggaaagtcttactggggcagccgtcacctg

SEQ ID NO: 65504 - DNA, 1893 bp, Glycine max
  Peptide Sequence Number=SeqID_182282
atggatgcgcgtcgtgctccacgcgccgtcattgaccctaaggtccgtagggtcgggttcttcgctccacccgaacccgacccgatctcattcgaagtctctccctccgccaactccctctcgccggtaatgatccctccgccgcggcattcgtcggagaatctcggcctccacactcgtctcgccgcgacttccccttccgcccaagaatcctttgcagccgggagctattccagctcgtcggacttcttccccgctccgatgtcgccggctacgtcgccttactcgagcaggatcgtcggcggcgatggagacttcttcgccggcgggaaggcggcgtcttcgtttcctcgcggcgggtttgacttgacggcgacgatggcgagtagcgttccagcgagcgaattaaccacggtttcggtggtgaatgctgcttccctttcgattcgcggtgagtttggaacttcatttgtgaaagtaaaaatgaaattgcaacttaagagcgttggtggattgattgagtattttctctaccattttctccccccattagaaagaaagaaagctaacaaaggaggaggatcagcagtggaagtgaaagaccaagctctgaatactaaacagcagaagaaagagaagacttcaaaggctgaaagacgagctcttcaagaagctcaacgagctgctaaggctgctgcaaaaggaaacaaggcatctggaactctggcttcagtaaatgtaaaaccagctaaagctgcaaagcccccacagaaagttgataatgcttcggttgcagcctctgagaagaaagggggtgatcgtccaccagaaaaagatagaaagaaagatgttcctcaaccacgtctgcaatacgatgataagagcagagtggagaaagccaaacggcgtgctgtggtaaaacaaactgaagctaagaacagagttgaactgttcagacatttgccccagtatgaacatgggagtcaactcccagatcttgaggcaaagtttttccagctgggtcctgtgcatcctgctgtttataaggttggtttgcagtatctgtctggagatatatctggtggcaatgctcgttgtattgctatgcttcaagcatttcaagaggccattgaagactacagggttccatccgagaagactcttgtgagagacttaacagcaaaaataagtagttatgtttcttttctcatcgagtgtcgaccactttctatcagcatgggcaatgcaattagatttctcaaaagtcgaattgccaagctacctttgacgctgtctgagtcagaatcaaaaacctctcttcaatcagatattgagcgttttatatatgagaaaattatacttgccaacaaggtgatagtcaagcatgctgttacaaaaataagagatggtgatgttcttcttacttatgggtcttcatcggcggttgaaatgatactgttacatgcacacgggttagggaaacagtttcgagttgtagtggtagactctcgtccaaaacttagagggaaacttttgcttcgtaggctagtggagaaaggtcttagctgtacatacattcatataaatgctgtttcctacataatgaatgaagttactcgagtctttctgggtgcttcatcagtgttgtctaatggaacagtttattcaggagttggtactgcttgtgttgcaatggttgcccatgcattccatgtccctgttttagtatgttgtgaggcttataaatttcatgaaagggtacagcatgattccatatgctcaaatgaacttggtgatccagacgtcatttctacggttcagagtagagaggatgtcaaccacttggaagcttgggccaatactgaaaatctgcaacttctaaacctgatgtga

SEQ ID NO: 65505 - DNA, 216 bp, Glycine max
  Peptide Sequence Number=SeqID_182283
atgaccttgcagctccttgagatcgtcaagctagtggcaagaaacttctgggcactctgtgggatatgggttctttctaatgggatagatatctccttttatttggtggttacaatgccccaggctattagtttcaatatcaagaagttgtcttgtagctggaattgcaatgccttatatgcatcgccactcccaacagttcgtagtgtgctttga

SEQ ID NO: 65506 - DNA, 3381 bp, Glycine max
  Peptide Sequence Number=SeqID_182284
atggctgtaaaactttatgagtaccaattcaatatgggactgctcttgattgagaaaaaagagtggaattctaagtatactgaactaagtcaagatttagtagaagtgaaggatgctctagatcgagaaaaagctgctcatttaattgctctatccgaggcagagaagcgagaagagaatctgaggaaggccttgggtgttgagaaagagtgtgtgcttgatcttgagaaggctctgcgagaaatgcggtcagagcatgccaaaattaaatttacagcggactcaaagttggctgaagcaaatgctttagtagctagcatcgaagagaagtctttagaagtagaagccaaattacgttctgctgatgccaaatttgcagaaatcagcagaaagagttcagagtttgataggaaatcactagaccttgagtctcaagaatctgcacttcgaagggatcgattatccttcattgcagagcaagaagcacatgagagtacattgtctaagcagagagaggacttgcgggaatgggaaaagaaactacaggagggtgaagagaggctggccaagggtcaaagaattatcaacgaaagagagcaaagggctaatgagaatgacagactatgcagacagaaagaaaaggaccttgaagaggcacagaagaagattgatgcaactaatgtaacactgagaaataaagaagatgatgtgaacaataggtttgcgaatattactctaaaagagaaggaatatgattctctgagaataaacttggatatcaaagagaaggagttatctgcatgggaggaaaagctcaatgctagagaaaaagttgagatgcagaaacttcttgatgaacaaaatactattcttgatgtgaagaagcaggagtttgaggtggaattggatgagaaaagaaaatcctttgaagatggattgaagaataaattggtggaagtggaaaagaaggaggctgaaatcactcacgcggaggagaaagttgtgaaacgggaacaagccttgggaaagaaagcagagaagcttaaagagaaagaaatagagtatgaacaaaaagtcaaagctttgaaggaaaaggagaagttaattaaatctgaggaaaaaagtttggaaactgagaaaaggaaaatagaaagtgagagagaggaattgctcacacataaggctgaagttgagaaaataagagctaacaatgaagaagagttgttgaggataaatgaagagattgatcgacttaaagtgactgaggaggagaggtctgaatatctgcgcttgcagtctcaattgaagcatgaagttgatcagtacagacaccagaaagagctacttctgaaggaagctgaagacttaaggcaacagaaagagacttttgaaagagaatgggatgagctagatctgaagagaacagatgttgagaaagagctgaaaagtgtggttcaacagaaagaagaactattaaaactacaacaatatgaagaagaaaagttaaagaatgagaagcaggacacacaggcgtatgtgcaaagggagttagaaactcttaagttggctaaagagtcatttgctgcagaaatggagttggagaagtcaagcctagctgaaaaagctctaagtgagagaaaccaaatgcttctggattttgagctgcagaaaaaggaacttgaagctgatatgcataatcagttagagcagaaggaaaaagatttgatagagagaaagaagttatttgaggaaaaaagagagagtgaattaaacaatattaacttcttgagagaagtagctaatagagaaatggatgaaatgaagcttcaaagaagcaagtcagagaaggagaaacaagaagctgatgagaataaaaagcatcttgaaaggcaaaggatggaaatgcaagaggacatagatgtacttgttgacctcaacaggaagctgaaaaatcagcgggaagaatttattgtggaaagacgacgctttattgagtttgttgagaaacttcggagttgccagaactgtggggaaatgatctctgaatttgtgctttctgatttacaatcctctgttgacattgagaacttagaagtgccttctcatccaaaattagcagctgatattgtacagggagtttctaacgaaaatttagcttcttcaaggcaaaatactggagtgtctcctgcaactgatcctaagtcacctgtttctggtggcactgtctcttggctacgtaaatgcacctctaagatttttaaaatctccccaattaggaagattgaatctgaagattctggtactttaagagatgttgtgactttgtctgttgagaaaactaatgtggaagattcaccaggaagaattcctgatgctgaaaatgaagcagagttgtcatttgctgttgtaaatgattcttttgatgttcagagggtacaatctggcaatgatatcgtcgaggttgaagctgaccatgaaccttcagttgaaaacctgaacaatgttgacagtaaggcaccagaagatttgcaggctcctgattcaaaggttgggcagcagaaatcccgcaagggagggggaagacccagagtaaagcgtacgcacactgtgaaagctgtcatcaaagaggccaggggtatacttggggaatctgctgaagcattacctggggaatctgtggatgatcatgagaatgagtttccaaatggaaatgctgaggattctgccaatgtgaattctgaaagtcagaaaccatccaatagaagaataccagcgaatgtcaggaagcgaaaccgggttcaaacatcatctcaaatgactgtaagtgggcatggtggcgatgccagtgaaggacattctgatagtctaattccaggacagcgcaagagaaggcgacagaaggctgctgctccccccgcacaaactgctggtgaatcaagatataatttgagacgacccaaaattggagcaacaacttcatctgttagagctatgtctggtggtggcaaagaaagtcagggagaggttgatcgtgtaaaagatacaggagaggggattgttgactcaaaaacttctcattcacattcggtgggcattactaatgagaatggtggaagcatacatcttgagcagtctctgaaaggtgcggagacaagggacggttatggtggtgataccatcgggacctttgtcaacaatatggccttgagtgaggaggtgaacggaacagcagatgatgtggaggagaatgatgctgagtataggagtgaatcccatggggaagatgctgctggtggagttgagaatgaggatgacgaagattacctgcaacccggtgaagcttcaatagggaagaagctttggaatttttttacaacataa

SEQ ID NO: 65507 - DNA, 1104 bp, Glycine max
  Peptide Sequence Number=SeqID_182285
atgaatgctctaacactacttgatctatctgaaaattatgggttaacatctttgccaaagtcgctgtctaagttgaggtctcttacttctttagtgctccgtgaatgtcgtcaattggaatatatacctccactgggagatctacaagcattgtccagattggacatttcacgatgtgattcgatcctccgagtaccggaaggcttgcaaaatctaataaacttgaaatggcttgatctgttgcagaatgagaattcaacggtgaaattgatagcaggacgtgtactggccggtttgagcaatatgcaatatctggatctccgcagttggtcaggtataaaagtagaagatgtaaaagggatgactaagcttgaatgttttgcaggaagctttctcgatcaggataactacaaccgttatgtgcaagaaattcaggacactggttatggacctcaaacctatattatctattttggaaaatttaagactgccacgcctggtttttgtgaggattctatttatgttaaattcaagcttcgaagggtatggtttggagattgtgatgaattgccctatttactgccaacagaccttgcggaattatgtgtaggtcacaataatcaatgggaatgcttatgtgctgctctgtcatctaatggttctctttcattggaggatatttacattcataattgcacaaatttgaagagcttgttctgtttatgtttttccttatgcactaatatccaaagtctcaaatctttggaacttgatttcttggaaagtttaactgccatctgcaaggagcatattgttgatttaacacaatctttgtctttgagcggggtgttttctcaactccagaggttttctatccacgaatgccatgcaatagagatgttgctgacaacagagttagtgccacaacttcgaaacctggagtttatatccgtatggaactgccagtcaatgaaggagatatttgcagtgagttacagcggtggtgatgatgatagtttcaccattacacttcccaagttgaacactttggaattggggtttctaccacaatttgtgcaaaggaattttagtctgtgcatctga

SEQ ID NO: 65508 - DNA, 120 bp, Glycine max
  Peptide Sequence Number=SeqID_182286
atggtcgcattgattggaattggagctcaccacaaaaacaacaaatgcattgttagttgttacggctgggctacggtgcatgaaggcacagttgcccttgaattaggcactcagggttga

SEQ ID NO: 65509 - DNA, 1350 bp, Glycine max
  Peptide Sequence Number=SeqID_182287
atgggtaggcctaaggatgagcactactggaatttagttacaaaagaagaaaacggtacattgaagtgcaagcagtgtggactcatgtttaaaggaggtgtttcaagaattaaagcacatgtggatcgaataaaaggaaaaggtgttcgtatatgctcctccattgatcatgatcatgttcagaacaatatcatatacggttcaaatcattcgaagcgcaagaggcaagttgatatttggttaaataaagtacaagaactgaaaaggagagctattgtcattaatgacttacaagaactacagtttgggttgactgatctttatggattggaaataaggatgtggaaatttctaaagaatgaccaagtttttgttattggcatacatggaatgggcggagtggggaaaacattcctagcaacttacatggagaatgagattaatagaaagggaactttcaagcatgtcttctggatcaatgtttcccatgatttcagcattttcaagttgcaacatgacattgcggaaacaataggggttaaacttaacagagatgatgagagaactagagcaacaattttgtcattggctttggagacaagagaaaaaacagtaattattttggatgatgtttggaaatatattgatctgcaaaatgtggggattcctcttaaagtgaatggcattaaattgattatcacaactcgtttgagacatgtgtgtctacagatggattgtctaccaaataatataataaaaatattcccctttgaagaagaagaagaagcttgggagttatttttgctaaaacttggacaccgtggaacgcctgcaacacttccccctcatctacttgagattgcaagatctgttgtgatgaaatgcaatggtttaccacttggaatcagtgtgatggctcggaccatgaaaggggaaaatgacatccgtcggtggagacatgcattgaataatcttgagaaatcagaaatgggagaagagatgaaggaagaagtcctaaccgtactaaaacgtagctatgacaatttaattgaaaaggtcatgcaaaactgtttcttattctgtgcactgttacctagcattagacaagaggagttggttatgatgcttgtccagagtgggttgttaaatggaaagaggagtttggaggaaatatttgatgaggggcatgtcatagtggataaactcatggaccattctttattgttcgatgaaattgaggttttacgaatgcatggtctggaatggacagttgatttagaggtagtttctttggcaggtaacgagatagaagaaatcccagagggcacatcacctcattgtccaccttga

SEQ ID NO: 65510 - DNA, 147 bp, Glycine max
  Peptide Sequence Number=SeqID_182288
atggcggaacctttaagagcctgggcaattgcccagggtagccggaccttgaaaccgcctatgactacaagaacactttcaacgttaatgcctctagccttcagaaaaaaattacaaggaatagtaaatgccaagctcaaggagtag

SEQ ID NO: 65511 - DNA, 3479 bp, Glycine max
  Peptide Sequence Number=SeqID_182289
accagatactggagcatgatccggctgcatttgaaagcaatgacatagaaaaggcgtttttttatccaaagggggaccctgatgctgtttgtatcagaaagagcgatattgagcttttacagcctcagaaatgccttaatgataatatcattgacttttatataaagtatttgataaataaactcccaactgataaacaggacaggtttcactttttcaattgctttttctttcctaagcttgttgatttaagcacagataatccatcaattgcttctgatggtaaagcagcatttcagcgtgtaagcaaattgacaagaaaagtgaacctttttgaaaagaattatatcttcattcccataaattatagtcttcactggagtttgattgtcatttgtcaccctgctgaagtcatgacatgctacagagatgaagaaactaagggatctcccaaagaagcttgcatcttgcacatggattcccgaaaaggaattcatcaagatctccacaatgttttccaaagttatctatgtgaagaatggaaagagaggcacaacaatgtgagggatgatgtttcttctatatttttagatcttccattcgtgccacttgagctgcctcagcaacaaaatgcatacgattgtggcatctttttgctccactatgtggaacgttttctggaacaagctccaatcaactttaaccgttccctgataagcaagttcagttattggttccctccaccagatgcttctctgaaaagatctcatatacataaactattaatagcggctgaaggagacaacaaaatgattgttggtggttcagttaaccctcaaaacaatacacaattgtcagctttattaggaggtgatgtagaagatcatgctgtgaacggaggtagcaatggcgatgatgctttgactataaataggttgctatccgatctagcatgggaagaagactactttgataaacgcttacagtggcgggagttccagggcaataagcgcgagagacaacatgacgattggttggatgaactaaaggacctgaaaaaaagagccattgatgtgaaaaactcactgcatcagtctgggtcgactaatgaattccccaagccttctgaattggatgatgagtatgatgatttattggaagagaatccttgggtgtcgcgagatgaaaatgtgaaggagatgtgggatcttctggaggatgaggaagtcttcattattggcatagatggaatggggggagttggaaaaacattcatggcaactcatatcaagaatgagattaaaagaaaggggactttcaaggatgtcttctgggtcactgtttccgatgatttcaccactttcaaattgcaacatgacattgcagaaacaatacaggttaagctttacggagatgagatgactagagcaacaattttgacgtcagagttggagaaaagagaaaaaacactgcttattttggatgatgtttgggattatattgatctgcaaaaggtggggattcctcttaatggcattaaattgattatcacaactcgtttgaaacatgtgtgtctacagatggattgcctaccaaataatataataacaatattcccctttgaagaagaagaagcttgggagttatttttgctaaaacttggacaccgtggaacacctgcaagacttccccctcatgtactagagattgcaagatctgttgtaatgaaatgttatggtttaccacttggaatcagtgtgatggctcgaaccatgaaagggaaagatgagatccattggtggagacatgcattgaataaacttgacagattggaaatgggagaagaggtcttaagcgtactaaaacgtagctatgacaatttaattgaaaaggacatccaaaaatgtttcttacagtctgcactgtttcctaatgatattagccaagagcaatgggttatgatggtttttgagagtgggttgttaaatggaaaggggagtttggaggaaatatttgatgaggcacgtgtcatagtggataaactcattaaccattctttgttgttaggtggttggaggttacgaatgaatggtctggtgaggaagatggcgtgcaatatcttgaacgagaatcacacttacatgataaaatgtcatgaaaatttgacaaagatacctcagatgcgggaatggacagctgatctggaggccgtttctttggcgggtaatgagatagaagaaatagcagagggcacatcacctaattgtcctcgcttgtccaccttcatcttatctcgtaattccatcagtcatattcccaagtgttttttcagacacatgaatgctctaacactacttgatttatcatataattatgagttaacatctttgccaaagtctctgtctaagttgaggtctcttacttctttagtgctccgtgaatgtcgtcaattggaatatatacctccactgggagatctacatgcattgtcaagattggacatttcaggttgtgattcgctcctcagggtaccggaaggcttgcaaaatctaaaaaagttgcaatgccttaatctttcccgcgatttgtatttatcattgttactcggatgcgcactgcccggtttgagcaatatgcaatatctggatctccgcggttggtctggtataatagtagaagatgtaaaagggatgactaagcttgaatgttttgcaggaagctttctcgatcaggataactacaaccgttatgtgcaagaaattcaggacactggttatggacctcaaacctattttatctattttggaaaatttgatgatttcccacttggattcaggacactggttatggacctcaagcgtccaagggtatattttggagattgcgatgaattaccctatttactgccaagagaccttgcggaattacttgtaattggcaatgatcaatgggaatgcttatgtgctgctctgtcatctaatggttctctatctttaaaggacattaacattcgagactgcacaaaattgaagagtttattctgtgtatcttgtcccttatgcactaatatccaaaacctcaaatctttgaaacttgataatttggatagtttaagtgtcatctgcaaggaagatgttgctggtttaacacaatctttatctcggagtgaggtgttttctcatctcaaggaattgagtatcatccgatgcgatcaaatagagaagttgctgacggcagggttagtggcacaacttcaaaacctggagtctatatcggtatcgtactgcaaatcaataaaggagatatttgcaggagatagttccgacaacattgcacttcccaatttaaccaaattgcaactataccggttaccagaattaaagacagtgtgcaaaggaattttactctgtaactctttggatatattgggaatcgacgattgtcccaatcatgaaaaacccagaattggtcgtgtatga

SEQ ID NO: 65512 - DNA, 294 bp, Glycine max
  Peptide Sequence Number=SeqID_182290
atgttaaaattcagtggatcttccagtagtataagtcacccaaattctatagactggattctttcttctgctcatgttattaccccttcaccatggacaatctttggctaccaaaatggtttacgacaattcaaggaagcaaaagacaaggattctaatgggaagaaatgggataatcaccttgcaataatggttgttggtgtggttgatggaacttcgatcagaagccatcttccagactcttcagaagttgtggcttgtggcatgaaggagatgtctgaagatgataaatga

SEQ ID NO: 65513 - DNA, 839 bp, Glycine max
  Peptide Sequence Number=SeqID_182291
atggctaacgatttctccttttctacaaatggtttgaatggctctagttccgaaaaagatcctcctgacggtggaggggtggtggaaaagttgaacatgattgagtacaagaatgggaatcctttaaatccaatgattcacattgttgattgggtttatgaaggtctgtgtgccccatggcaagatgctttggtgatcaagcttttggggaggaatttagggtttcaaatcctacatgagagactgacacggttatggaagttatttgctggttttgaaatgcttgatatctataatggcaccgccacccgtctcctcctcctccaccacccctccgccctcctccactactgggagctcgaccccgccatcatccaggtcgcccgcgagtacttcaacctcgcctgcctcgagagggactaccaagaccgcctcttcatctacgttgacgacgccctcaacaccaccgtccccaacggcttctccgggggagggaggatcatggtgaacgttggagggagctgcgtggaggcagagaataggctcagagatgggaaggttgttatggaagagactctcggagcgatgaaggaggttttcggaaagaaggtttttgttctgagtcttgggaatcgtaaggatgatagctcacttactctcactggggatttgcctcaccttgaggaatggaagaaactccttcctggtcccttcaaatgttatgctaacatagtaaattcatttttggcaacaaaattttacgaggttagtggtgattgtgttggtggcactgataacagatgtgactgtggagtttatgctaaggtacacaagttccg

SEQ ID NO: 65514 - DNA, 387 bp, Glycine max
  Peptide Sequence Number=SeqID_182292
atgagttcaggttcagaggtcgacaacttcggggattttgaggggtcgagtttgtggttaaggtggacagagatatcgtccaacgaaagagtgagtgttgacgcacctttaaatgataatgtgacaatcattgttaagccgaaatgtcaagtgccagtaaaaaagaaagagtactcgccgattactctactatggtattcatgggttgatgagattccctttgattatttcaccatgatgtgcttcacattcccaatacggctccttcacaacttcatccgaatgggtaagtggcaattcaagccttctgcattttatatagattctttaggatggaaccaacgactgggctattccttcatcatttccaaactaggaaatggataa

SEQ ID NO: 65515 - DNA, 150 bp, Glycine max
  Peptide Sequence Number=SeqID_182293
atgactattgaggaaaagtcttacaagaaagaaggaattggtaaagaacaaacaaaggggtcatatatcaaaagacatgataagagcctaatgacgagggaaaagaagacacgcataatctgtcaaacaggaattagttccatattttga

SEQ ID NO: 65516 - DNA, 1242 bp, Glycine max
  Peptide Sequence Number=SeqID_182294
atgcatcattttcagatgtttgacatctgtattatggggaattgtagccgatcgctatggccgaaaacctgttatagttatggggattattgcagtcttctagtacgaaattatcaatggttgcttgatttcagtgtcattttcaacacattatttggccttagcacaaatttttggatggctgttatcatgagatttcttctgggaagtttaaatggtttgcttggaccagtgaaggcctatgcctctgaactttttcgagaagaacaccaagctataggactctcaactgtcagtgcagcttggggcataggtttgatcattggcccagcattggggggctatttggctcagcctgtagagaagtacccacatatatttacaaaggattctttttgggataagtttccatacttcttgcccaaccttataatttctgcattcgcatttgtagtagctattggctgtatctggattccggaaacacttcacaaccacaattgtagcaatgaatccacagacgatgccaaagctttagaaagtggaaacagtggagctggcaatgaaaagataatccaaaagaatgataacctcctcctgaattggcccttaatgtcatctatcattgtttattgtgttttctcacttcatgatattgcgtatcaagaggttttctcattatgggccgtcagtcctcaaaggctggggggtttgaactttacaaccgataatgttggtgatgttctttcaatatcaggtcttgcacttattatttaccaacttaccttatacccatttgtggaaaaagctagtggacctattgttattgcccgcttctcagggatgttaaccataccacttttgcaaagctaccccttcatagcattgttgtcaggcttggcactatacatagtgataagtattgcttcaattctgaagaatattatgtccatcaccattataactagtttgttccttctgcaaaaccgagcagtggaacaacaccaaaggggggcagctaatggcatttctatgacagccatgtctcttttcaaagctattggccctgctacaggtggtgcagtattaacttggtcacaaaagcggatggatgcttcattcctcccaggcacccatatggtgttctttgtactgaacatagttgaagcacttggaatactaatgatgttcaaaccattccttgttgaaaagaagaaaacacactcagatcagttacactga

SEQ ID NO: 65517 - DNA, 198 bp, Glycine max
  Peptide Sequence Number=SeqID_182295
atggtgcaaaaaagtcctttcgctaagcgtgagcttcgcgctaagcgcatctttgatcatgcgctaagccacgagtctcaagtgcttagcgcccaacccttgcatctgaggctgatttggtcagctaagctagccaaggataagctaagccaacttcaattcgatctgaatttggctaagcttcagcctggccgctaa

SEQ ID NO: 65518 - DNA, 408 bp, Glycine max
  Peptide Sequence Number=SeqID_182296
atggaggtggaacctttttcactatccgaagagtttgtgaagggatgtgctttgtctaaatatgagggttggagaggtttagtgagggaagattcaagagtgagggagtccttgtggtgggaaaaaaataaattttggttacatgaatgggtagatggggatgattatttccttgtgtcagaccctaatttcgtttgtggacaatcatttgctaacgttttcattcttgctagccgaattgagctgtttgacaccagttgtcgcacaattcgaaaggtttttcgatgtttcggaaaagaatacggaaaatacccaaaaaaggagggtgaaaaggtcatttgggagttttttctgacccctaattcacccaggctagcctctggctcgcttgggcccccaataacttag

SEQ ID NO: 65519 - DNA, 621 bp, Glycine max
  Peptide Sequence Number=SeqID_182297
atgatgttgttcctcttgccaacaaaaacaaaaaaaaggaaatgtactaaagaaggtgatgaggaggctcagcctcaaaaaaggttggaacaacaaacattgcatcaattaaacactcttccttctagctctctcaaagcactttccatggtgtttggcaaggagtttttcaactcaacctaccaccctcaaagtttgatgtcaaatagtgtggtgtcggaatttggtattctaggaaacaaggctagttttgacaaggctatccggcaagtgcgccacaagtttgagattccggacaccgtggagtttgacatccttaaggatgtgcatgagggtgtcttgatgtctatcaatgacattccaaagaaggctcctagttcaagtcgaccacctactccacctgttgacaccttattgaccaatgcaggttttggtgaagaggaagaaagatataagcaggattacttaggaggggaacctatgaatttaatgaaggtgcatccttggctgagtaggactactcgggagagaaaccttgtgaatttgaacttttataggattaaaggcacgttcttacccgaatatgagttttcaggagggaaatctcattttcaagattaa

SEQ ID NO: 65520 - DNA, 867 bp, Glycine max
  Peptide Sequence Number=SeqID_182298
atgttgtggtctgggttctctgctgaattgctatcaacaccattctctgttgaattgctatcaacattgctatcattacccactgctcgaaatacaaccttgtcctcaaggttggacaataaaaacaagcaaaaacagggcacaagcttgcaatgcctccatgaactccttggtctcgaaacgtgcaatggtaccctagttgttcaccaaatttgctttggtcattccaatgtcacggtcaataatggaaagagtcttgttggttttgtcgggcacaagacagatgaagaactatggttaagcatcaagcttgctcttgtcagaatgatcctccataatttttactgcaacaacggtataatctccctgtggcggtggcttcggaggtggtggttgatatggcggcgggcgtcgacgccggatcttgcggtaacagtcaagggaggcggagttgacgtgggtgctgttgttggtggtggttgtgcgtttattgggaatgagttgggaggatcatcttctttactgggcattggcatgtggggcttgctgttggcgagtaggtggacggtggaggaagggcttgtgttttggtgttccaacattgccgttgacactgcaaaatccatggaaggtggagtcggcatggtctgcacagtttgcagagctagggtaccacacaaggctaagaaggtaggtgctgagatggaagggatgactcctgcaagggtggttgcgggtggatggttgtgtgaagaggttgcaaccaaaagaggtggtctggaaggtggtgtgttatggcatggccggagtaaaggtagaggcaaccatgggaggcagccatggacgataggtcggaccaattgttag

SEQ ID NO: 65521 - DNA, 534 bp, Glycine max
  Peptide Sequence Number=SeqID_182299
atgtctagaagccaatctgaagcagccaacaaaatcatcttggttgagttgaagaagaaacttggtttggccaaaggaaaatgggccaaggagttactagaagttctatggggaatttattgcactccacaagccaccaccaaagaaacaccatttcagttaacttatgggactgatgctttgattccagtagaggtgggagaaccttcatttcgacaattgtactacaacaaagcagggaacattaatgctttaaagggtgaactcgacctcattgaaaaaaccaaagatcaagcaaggattacaattgaagcatgcaaacaaagaatggtcaagaggtttaattcaaaaccgaaaccaagagaattcttggaagaagccttggtatggagggtgcaaggtgatgcaagaaaggactccaggggaggacttagggaaaacctcataaatgaggcttccaaactagaagaactctttggcaagctcatattgtgcacttggaattccactcacctcaagttttattacaattag

SEQ ID NO: 65522 - DNA, 854 bp, Glycine max
  Peptide Sequence Number=SeqID_182300
atgttaccaaaaccgtcgcctcgaacacctctgatatcgtctcgaacgctctctcagacactgctgacaccatctcagaagtctccaacatcatctcctcatcaaacaagtcactctcaggtgctgctgcttcctcctcaaaccctctccaaattgcttctgatgttaccaaaacaatcacctcaaacacttctgatatcatctcagacacagtgtcaggaatttccaacactatcgaagacgtggccaacatcctcatcccaaacccacttcaaattgcttcaaagatcatcacttccaagatcactggtaacattcccaacaccatcatcccctcaaacacttccaacatccctggtaatattacctcatcatcaaaaactctcttaaatgcggccaataaatccaaaccaacctcctcaaaaaaactactccaaaacgcttcaagtaccatctcaaacccttctaatgccgttgatgttatgaacagcccagaaaaactttttaaaaatgccctagggaatgcactaaacgcaaccctactactttccctcttggactatgttttatctcttgcgacgtcgtttcttggaaagcttcgagattcccccaccccagcacagttacttggcctaatgatcacacctttgtggaacttgctacgtcgttttgtaacactaggcctcgtcatgctccttcttcttgcgggcataatcatcactgttttcatcctttcaatgcctctgttgatgatcgtgacaagccctatatggattccaactgtgtttcttggacatctcaatgtttctggagaggatccggaatcaatcaatcaatctgcaatccaagattaa

SEQ ID NO: 65523 - DNA, 867 bp, Glycine max
  Peptide Sequence Number=SeqID_182301
atgatttattgtttttctgtgaattcatcattatcaccattgttgttgctcctgagtttaaatccaagtaggttgctcagtgaaaatagaccagttctagattggcctaccagagtcaaggttgctgctggtgcagctcgtggaatagcttacttgcatgaagactgtcatccacgcattattcatcgagatattaagtcatcaaacatcctacttgatctcaactatgaagctcaagtttcggactttgggcttgcaaaattggcattagattcaaatacacatgtaactacacgtgtaatgggaacctttgggtacatggcaccagaatatgcgacaagtggaaaacttactgaaaagtctgatgtatattcttttggggttgtgcttttggagctaattacaggtcggaagcctgtagatgcatctcaaccaattggtgatgagagcctggttgaatgggctcgacctctgttgacggaagcacttgacaatgaggactttgaaattttggtggatccaagactggggaagaactacgatagaaatgaaatgtttcggatgatcgaggctgccgcagcctgtgtacgccactcatcggtgaagagaccacgcatgagtcaggtggtgagagctttagattccttggatgagtttacggatctcaataacggaatgaaaccgggacagagttcggtgtttgattcggcgcagcaatctgcacaaatcagaatgtttaggaggatggcttttgggagccaagatagttccggtttcttcaatgagtctcagagtagctggaggagtagagatcacgacccaacaactgtcttctcccaaaataaaactgggcatgggaacgtttga

SEQ ID NO: 65524 - DNA, 130 bp, Glycine max
  Peptide Sequence Number=SeqID_182302
atgatgagcacagtgaatggaagaagaataacaacactcttgagaatatttcctgacgccaacttcccatgcccattgggaagtcgtacggaggggagtttcatggttgagatgaaatctgcagcagaag

SEQ ID NO: 65525 - DNA, 1467 bp, Glycine max
  Peptide Sequence Number=SeqID_182303
atgaaacgatgcaacatcttctctggagagtggattccgtacagtaaaggaccttactacgataatgagacttgcgatttgatgatagaccagcaaaactgcatgaagtttgggagacccgacagagagttcctcaaatggaggtggaaacccgatgaatgcgagcttccactctttgatgcaacccttttcttagagcttgtcagaggaaagtccatggcctttgttggagactcggttgctcatcctgaggacattaccaagagatatgccacagatcccatatatttccgaaggtggttctatgcagattacaattttacggttgtgacactctggtccccatttttggtgagaaccagcgatattgacaacagcctcacgaaactgtatctagataaggcagatgagtcgtggactagtgaggttgaaaccttcgattttgtcattatctcagctggccaatggttctttcggccagcattgtattatgaaaaaggacaaattgtagggtgccacaagtgtgaacgaagaaaaatcaaagaccttagttactattatggatacagaaaagcattcagaactgcattgagaaccatagcaagtctcgaagggtacaggggggtgacatttttgagaacattttcccctgctcactttgagaatgctgagtggaataaaggagggagttgtgagaggacaaggccttatagcaaggaacaaatgaggtttgatgggtatatttttgagacatataagactcaagtggaggagtttagaacagcaagaaaggttgcaaggaagaggggtttgaagtttttgatgatggacacaactgaaatcatgttaaggaggcctgatggacatcctaataaccatgtctggcatgcagtgaaccaaaatgttacacatagtgattgtgttcattggtgcttgcctggccctattgacacatggaatgagttcttattccatatgttgaaaatgcatagtgtcaccagtgcagttccctacactgcacccaccattggcaacattctttctccaacaaacactctactaggtgctactaatattgtttctgagactatctcaggtgttaccaaaaccgtcacctcaaacactctctccgaaacttctgaccccatctcagaggtgtcaaagatcatctccccagactcactctctgatccttccaaactcatctcctcaaacctacttcaagatgtttctaaggtcatctctggcactgtctcgcatgtttctaaaaccgtctcctcaaacacttctgacatcatctcaaacactctttcagaaacttccaaaatcatctcctcatcaagccacccacttcaagatgcttctaagataatctttgacactgtctcagatgtttctaaaaccatcgcttcagacactgctgatatcctcaaaacgattccacgacgtttccaagatcatctctaa

SEQ ID NO: 65526 - DNA, 618 bp, Glycine max
  Peptide Sequence Number=SeqID_182304
atgatcttggaagcatctgaaagtgtgtctgagggattgatcttaggtgcacctgagagtgggtttgaagagataatctctgaagcatctgaaagtgagtctaaggggttgatgctggatgcacctgagagtggatctgagatgttattggagacatctgagacgatattggagacgtctgagagagtgtttgagactatattagaagtgtttgaagtgatggttttggcaacatctgagacagtgtcagtgatctttgaagcaacttggagtgggtttgaggagttgattatggaagcatctgggagtactgagtctggggagatgatcttggaagcatcagaaagtgggtttgaggagatgatcttagaagcatcagaaagtgattctgagggattgattatgttggaagcacctgagagtgggtctgagatgatgtttgcagtatcagaaagagtgtttgagatgatatcagaagtgtttgaggtgatggttttggtaacatctgagacgattgttgattactggaatggagggttgaactgcactggtgacaccttttgtgaggttcttcaacatcttcgcgaagtagtgttactgatgaatgatgagaaatga

SEQ ID NO: 65527 - DNA, 135 bp, Glycine max
  Peptide Sequence Number=SeqID_182305
atgcatcaccaaaagaggaaaactctagatgaggcttcacagttatcaagcgagtcagagaccaagcatgactacagatcaaccttcactccctatggctcacatagacccgggtataggtcccaacatctaaag

SEQ ID NO: 65528 - DNA, 448 bp, Glycine max
  Peptide Sequence Number=SeqID_182306
ccccgcgaagttattgcgtagcgctgttcgccaattctccattctccaattttttcggagccccatgaatttattgcctggcgctgttcatgtgtcctccaccatcgagtctggagccccgcgaatctggagccccgagaagttattgcgtagtactgttcgccaattctccattctccacttttttcggagccccatgaatttattgcctagcgctgttcatgtgtcctccaccttcgagtctggagccccgcgaatctggagccccgcgaagttattgcgtagcgctgttcgccaattctccattctccacttttttcggagccccatgaatttattgcctagcgctgttcatgtgtcctccaccatcgagtctggagccctccgaagttattgcatagcgctgttcgccaattctccattctccacttttttcggagccccatga

SEQ ID NO: 65529 - DNA, 555 bp, Glycine max
  Peptide Sequence Number=SeqID_182307
atgtcttctgatttgaactataagcttaacggacatgaagtctttaaggaactaccttctgagattgtgcaaagaaaccccaaagacaaatttggccatggtttcaaaggcaaaaagattgtacatagtgaagaagtcactgtttgttacttttgtggaaaagtgggtcatgaaactcataagtgcaatgacctccctataaagggtaacccatcaaaggggaataagaaagttctgatagctggtgtagggaatcagaaaggtctgatagctagtgtaggtaaggtctgtatccactcaaaaggtgtcatgcttactttcagccaaagagcatcactagtgtataactcaagaaccttgacagtggaagaggccattcatgtaagacttaatgacaataagcctgacactacaatgttagagctggatgggtcttttgctgagatgaaaatagaaaatatcatgaaatctgctgctaggtccagtcaagaccaatatgcgtccaactcaccagcggattatcaacctaaagaagtcagagaaccaattggatga

SEQ ID NO: 65530 - DNA, 775 bp, Glycine max
  Peptide Sequence Number=SeqID_182308
atggtagaggcttgcgtggaatcaatgagaaaggacaaaaaggaatcttcaagtgacgcgacgaggaacctgcgggttcttggaggatacttcgctggaaaggttcttggcataatagtgaagttgactgctaaggcgattgctcaaggcataggctgcgagcgtcgtggaaccaagttcatgaataacaggggaaatgaactagaagactacattgggggcactccttgtgaggaactgggcgaagattccaaggaaatatggaaccctattgagcaaggtgaagattttccaatagattttaaacaaggccattattcacaaacaaggatcgaaggacttcctggtacatcctttgacttgccccaaattctctttaactgctttggaactaaagtgatgaagaataagagcatagggaagaacatctaccacaacgttgtcctagcaaaggtttttcaggctcatggagtcataaggaagttcttgtatgagacactcgtggatgtacaagaaaaaatctactttgacggggtgtttatactaatgcagaaagcctttagccaagagaatatttcaaatatgagattggtagatgatggatcctaccaacagactccccagaaagctactgagcaagatgaaggaatggatgcaaacgcaaccacttctcaagttcaaaagaaaactaagaagaaaatggacacttcttcgtccaaggttgcttctacttaccagcgtccacctcccactctctttgctcctaacacaacag

SEQ ID NO: 65531 - DNA, 2022 bp, Glycine max
  Peptide Sequence Number=SeqID_182309
atggaagaagggttgtgtcaaaactcaattcctggttcaggttttgttgataaaactaggattgtagaggctaaaccccttcgtagtttggcacctgtgttgccaaaatctcttcaatcttccttctctggccggtatccgtctgtctttcctccatttgttttgtttgatgaacctcaagagtctcaaccatcacctgctcccatgccggctccattaaggtcctataggaatccactagatgaagaagaagcccctcatggatccaatggagagacttcttcacccatggagggtctcaacggtaatagcgttgacaatagccaaaagcgcgctgtgccgcctatgcacagctgcaaatattcccaaaagaggagtaagaaaactaaggagtcacagtttgatttgagtccttcagttggtggtatcagtgtggccacaagggaagatggtgatcgcgaattggttaatcttgtgctcatgacttatgattctcttcggagaaggctctgccaacttgaagatgccaaggagttgaacacaacgatggcaatcaagcgtgcagatttaagagcaagcaatgcgatgacagtcaaagcatttagaacaaacacgaggaggagagtaggagcagtgcctggggttgagattggggacattttctttttgcggatggaaatgtgtcttgtgggtttacatggccagtcgatgagcggaattgactacatgaccatcaaggatgagcttcaggaggaaccagtggctctaagcattgtttcatcaggagtatatgataatgacgccgaggataatgatgttttaatttatactggtcagggtgagaacttcaacaagaaagataaacacgtgattgatcagaaacttcaaaggggtaatcttgctttagatagaagttcacgacgccacaatgaagtaagagtcatccggggtttgagagatgctgccaacaaaaatgcaaaaatttatgtctatgatggtctgtataaaatccaggattcttggatagaaagagggaaatctggtggtggtgtatttaagtataagtttgttagattgcctggacaatccagtgctttcgctgtttggaaatcggttcagaagtggaaaatgagctcaagcacatcttcaaggactggtattattcttgcagacctctctacaggagttgagagtattcctgtatcacttgtcaatgaagttgacaatgagaagggcccttcttttttcacttatttccattctctcagagatccaaaaccattcagtttagcacaatcatcatatggctgcaactgtaacaaaacatgtgtccctggggatttgagctgctcttgcattcaaagaaatgaaggtgactttccatatactgcaaatggtgtcctagtgagtcggaaaccattggttcatgagtgtggcccattgtgtaagtgttttcctaactgcaagaatcgagtatcccagactggtttgaagcaccaaatggaagtgttcaaaacaaaagatagagggtggggacttagatcactggatcctatacgtgctggtacttttatttgtgagtatgcaggagaagttattgacattgccaaggtaaataagaataggggatatgatgatgagtatgtttttgatacaagccgtatttacgatacattcaaatggaattatgaacctagcttattggaagaaataagctcaaatgtctctagtgaggattatgatataccgtctcctctaattatcagttctaagaaatttggaaatgtggctagatacatgaatcatagttgctccccaaatgttttctggcagccagtcttgtatgcagaaaataatcaatcctttcttcacattgcattttttgccctcagacacattcctcctatgacagagttaacatatgattatggctgttctggtcatgctgatggtagcagtgcacccaaagggagaaagaaatgctcatgtggatcatcaaaatgccgtggttcttttggttga

SEQ ID NO: 65532 - DNA, 1269 bp, Glycine max
  Peptide Sequence Number=SeqID_182310
atggcagaggagaatatcaggcaaccattgttggagaaaaagtactatgaggactgccccggttgtaaagtggatcaagccaaagagttgagtaagggacagggtgtttccattagaaatcttttgataatatggatggtggtgttgtgttctgcattgcctatatcatctctctttccattcctttatttcatggtaagggattttaatattgcaaaaacagaagccgatattagttcttatgctggttatgttggttcttcctacatgcttggcagatgtttgacatctgtattgtggggaattgtagccgatcgctatggtcgaaaacctgttatagttatagggataatttcagttgtccttttcaacacactatttggccttagcacaagtttctggatggcttttatcatgagatttcttctggggagtttccatggtttgctcggaacagtgaaggcgtatgccactgaactttttcgagaagaacaccaagctctaggactctctactgtcagtgcagtttggggcataggtttaatcattggcccggccttgggaggctatttggctcagccagcagagaagtacccagatatatttccaaaggattccttttgggataagtttccctacttcttgccctgttttataatatcagcagctgcatttgtagtagctattggctgcatctggattccggaaacacttcacaaccacaattctaacaatgaatccatagacaattcagaagctttagaaaatggaagcagtggggctagcaatgaaaagacaatccaaaagaatgaaaacctcctgcggaattggcccttaatgtcatctatcctttcttattgtgttttctcacttcatgatattgcttatcaagaggttttctcattatggtctgtcagtcctcaaaggctggggggcttgaactttacaactaatgatgttggtaatgttctttcaatatcaggtcttgcacttatcacttaccaacttaccatataccaatctgtggaaaaagctagtggacctatcagtattgcccgcatctcagcgatgttatccatacctcttttgcaaagctaccccttcatagcattgttgtcaggcttagcactatacatagtgctaagtattgcttcaattctgaaaaatattctgtctgaacaacaccaaaggggggcagctaatggcattgctatgacaggcatgtctctattcaaagctattggccctgctgcaggtggtgcactgtga

SEQ ID NO: 65533 - DNA, 1849 bp, Glycine max
  Peptide Sequence Number=SeqID_182311
atgacggttctgcatctagggatatggccagagtctcctagtttcagagatgagggtataggggagattccttcaaaatggaaaggtgtttgcatggagggtcgtgatttcaagaaatccaattgcaatagaaaattgataggtgcaagatactataagattcaggctacatcaggtgacaaccagactcatatagaagcagccaaaggttcccctagagatactgttggacatggaactcacactgcatcaatagcagctggtgttcatgtcaacaatgctagttattttggtttagcaaaaggaacagcaagaggtggttcaccttctactaggattgctgcttataaaacatgctcagatgaaggatgctctggtgccaccatactaaaggctattgatgatgctgtgaaggatggagtagatataatctcaatctctattggactcagctcactgttccagtcagactttttgagtgatcctatagccattggagcatttcatgcagaacaaaagggggtcctggtggtgtgttcagctggcaatgatggtcctgatcctttcacagttgtgaactctgcaccatggatatttactattgcagcttctaatattgataggaacttccaatcaactattgtccttggaaatgggaaatatctccaagtaggcattaacttttcaaaccttactcattcaaagatgcatcgtctcgtctttggagagcaagtagctgccaaatttgtcccagcatcagaagctaggaactgttttcctggatcactagatttcaacaaaactgcaggcaacattgttgtttgtgttaacgatgatccaagtgtttcaaggcgaatcaagaagctagttgtacaagatgcaagagccgtagggataatactcattaatgagaacaacaaagatgctccctttgatgcaggtgtatttcccttcactcaggttggcaatcttgaagggcatcagatcctaaaatacataaattctaccaagaacccaactgcaacaattcttccaacaacagaagttgctagatctaagccttcaccaattgttgcatctttctcatccagaggtccttccagccttacagaaaacattctcaagccggatgtcatggctccaggagttggcattttggccgctgtgattcccaaaagtaaggaaccaggaagtgttccaattgggaaaaagccatccttgtatgccataaaatctggtacatctatggcttgcccacatgtgacaggtgcagcagcattcattaagtcagtacacaaaaaatggagttcttcaatgatcaaatcagcattgatgacaacagctacaaactacaacaacatgaggaagcctcttactaacagctcaaactccattgccggcccacatgaaatgggagttggggaaattaatccactcagagctctcaaccctggcttagtctttgaaacagatgtggaagactatctcagattcctttgttatttcggctattcacagaaaatcataaggtcaatctctgagactaacttcaattgcccaaagaactcctctgaagaccttatctccagcgtcaattacccatcaatatctataagtacacttaaaaggcaacaaaaagcaaaagtgatcacaagaacagttaccaatgttggataccttaatgccacatacaccgcaaaagtgcgtgcacctcagggattggttgtggaggtcatccccaataaacttgtgttttctgagggtgttcaaagaatgacctataaagtctcattctatggcaaggaggcccatggtggatacaattttgggtctctaacatggcttgatg

SEQ ID NO: 65534 - DNA, 420 bp, Glycine max
  Peptide Sequence Number=SeqID_182312
atggtcaggggaggaggcaaagcgggcgatgacgacgatctaggccttgacgtgggggaggtagtcggagtggagcatggagcggaggagagaagcggtgtagagagtgtggttggcctgggtggtggagatggcgaggaggctgaggtagttggcgtcgaggtggtgaagctagcgctcattgcggaggcgcatgacaatagattgggcatgcgtgagagaagagagtgtgttttgataagagagctgagagaccaagcaactgaggcaggtggggttagggaggtgcgtggagtgggagtaagcaagctaggcttctttggttttgcagttgcgaagaagggagagaagcttatggtcacggggttccagggaggttgtggtggtggcatgttggaaaggagagaatgggggttgtaa

SEQ ID NO: 65535 - DNA, 690 bp, Glycine max
  Peptide Sequence Number=SeqID_182313
atggatcagaggggtgtttctacttcatcccactattttgatgacatttcctttcgctctgaggatacactggttctcaattccaaaatgtggaaacaatggaatggtagcatcacctggcaacattttgaatgctataccccccttgatgtaaatgcaaaagctggcttactggtgccacaggctagtctacctggggataacatacattccacggaatcatcgaattaccgtcccaaatcattatttgatgcatgtctgcagtcaacacctacctcttatggcttaattggaaacaagattgtgaccaatgctgccccttttgaaataaggttattcgggaatgatgtttggtctgatcatcccactactgctggttctcctcccaaggaagaaccatataaatctcttgaagaaatagaggctgacactataggcaatctcattcctggtgaagatgatctattttttggtgttgttgatgagttaggatgcagttctcatgctagaacaaatgatgattttgaagattttgatctgtttaacaatggtggaggcatggagatggaaggagatgaacatttaagtagaggaaaaagaatgagtgctcttgatggagattttggtttctttgggatgaatttcgaagcaaaacagacccgaaggagtatattgagtaacctaaactaa

SEQ ID NO: 65536 - DNA, 738 bp, Glycine max
  Peptide Sequence Number=SeqID_182314
atgggaaaaaatgcaaccaaaaggaaggtgagggggaaaggagctgcaacgtcttcacctattgtggacttgactagcaaggaagatgcaataagggaaaacactattgccaccttaaaattaacaaaggcaaaggaggcgaagaacgtaaaggtgttgtacaaaattctgaaggaggagacatctaccatttcagaagatcaacataaactttggaaacaaattgttgatgaaatacttgaagataacattgaagaagaaatcatgaggtacttacgtgaaatgctactacaagcagagaacaacaatcaacctaaacgaagaagaatcataaatcgcaatcgtgaagacagacatagtcgcttgttgaatgactccttctgtgaaaattatatatacacagagaatgctatcagtaatcatgattcgtattttcgaatgagatttgatgtagttggtagaatgggtctttcaccattgcatattcgtatattggcatatggatcacctgttgatagtgtgaatgagaacgttagaattaccgaatgcactacaattcaatgcttagaagcttttgtaaagggtgttaacgagatatttggggataagtacttgagaaggcctaacaacaatgacatcaattgcctgctacaaattggagaggcgcgggggtttccaggtttgttgggttctattgattgcatgcattgggaatggaaaaattgtccagttgcatga

SEQ ID NO: 65537 - DNA, 1617 bp, Glycine max
  Peptide Sequence Number=SeqID_182315
atgggttttactaggaaacccatgtttcctgtgttgctggttttgttcatcacaagtcttcttgagccgccccatgttgcagaatctacttcttctgattactccactttggtctacaagggctgctcaaaggagcctttcacagatcccaatggggtgtactctcaggcactttcagcactctttggctcattggtttcacaatccaccaaagccaagttctacaaaaccacttctggctctggccagaacaccataactggcctcttccaatgcagaggggatctcaccaattctgattgctacaactgtgtcagcaggctcccagttctgtgtgacaaactttgtggcaaaaccactgctgccagagtccaacttctaggatgttatattctctatgaggttgcagggttctcccaaatctcaggtatgcagatgttgtacaagacctgtggggcaacaaatgctgctgggagggggtttgaagagaggagggacactgctttctcagtgatggaaaatggggtggttagtggccatggcttctacactaccagctaccagtccttgtatgtcatggggcagtgtgagggagatgttggtgactcagattgtggggagtgtgtgaagaatgctgtgcagagagctcaggttgaatgcggtagctctatttcaggacaagtgtttttgcacaagtgcttcattagttatagctattacccaaatggggttccttctagatcatcttcttcatcatcagcttcatactcttcatcttcttcagggcaaaatccagggaaaacagctgctataatattaggaggtgcagttgcggtggcttttctggttatattgttgctatttgcaaggagtttgaagaagaaacatgatgtggctgaatggtccattgaaccttcttcttcaaccacaaccttgcagttgttgtcgtcgatcacaacgattctggctttaatttctagtagcaccaaaagatcaagaattaaaggcaaaactgttgcgaacgacgataacagctatgagattgtggttgaagaagataatagttggataagtgatgaagaaatgacaagtaagagaggaagggaaaaggattggatcaacaaacctggaggcgagatctacctaggggtggggcgtggaggggaagggtggggcgagaatgggaaagggaggtcgcgaaggggaagggtggatgtagaggggaaggggaggtcacaatggagaaggagtgtgaaggttgaagagagaagagaaagtggtttagtgtggggtggggctgagttagacatgacaatggggcggggaggggacgagtattgtctccccaatccccgaccccgactccccaacatgtccccatacccgtacccgatacccgtcgggttaaaatttattatcccatccccatacccgtcgggtatcgggctgagtgctggtgagaaatgggaaacaaaagaggttatcagtgaaaggatgagtgtgggtgagaaatggttcaagggccattacaagcaagctgttgatttgaagaaaagtggttacatagaaaatgatgtcatgattaatgcatatgccatttggaaggaagacgaatga

SEQ ID NO: 65538 - DNA, 168 bp, Glycine max
  Peptide Sequence Number=SeqID_182316
atggtggatcgaagtaggttgagtataccatcgagtgttctattgatgagaatgaaaaaaagattgatgaactgcatctatggatggttgtcagtagtagatttcatccacaaattggacattgttgtttcaatattttccccgttaatgtgtattggattctcataa

SEQ ID NO: 65539 - DNA, 636 bp, Glycine max
  Peptide Sequence Number=SeqID_182317
atgcttcctgaacaatacacattgccgaaaaatcactacgaggcaaagaagattttatgtcccgtgggaatggagtaccagaagatctatgcatgtcgtaatgattgcatattgtacagaaatcagtttgaaaaaatgtgtaagtgccctacatgtggggtatcacggtacaaagtcaaggatgatgaattcagtgaagatgcaagcaaaaaaaatagtcatccagcaaagactagagaaaattgtgggaagacgggattgatgtgtgggatgggaatctgtagcagaccttcagcacaaggaaatttaagtggatatagtgtcaaaggacatcatgcatgtcttatatgtgagaaaaacacgagcttcatccaacttaaacatggaaagaagacattatacactagacaccgaagatttctaaaaccttatcacccgtatcggcgattaaagaaagcttttaatgaaagtcagaagaatgaaaacgttatgcatgtggagaaaaatatttgtgatagtttaattggtacccttcttaacattaaaggcaagaaaacggaaggtttaaaatgtcaccaagacccggttgacatgggaataccagagcagttgcatccgatatcacaaggtcaatga

SEQ ID NO: 65540 - DNA, 450 bp, Glycine max
  Peptide Sequence Number=SeqID_182318
atggagcacgcgacacgtggcacagcgcggtgcacgaggcagcagcagggtagcgcccttgacgcgggcgcgtctggtagcgccctgtcgctgggcgcgactggtagtgcccagcgcgtgggcgcgactggtggcgcccctgacgcgggcacgacccaggcacctatatacagcgcctgggtcgtgcccgcgtcaggggcgccaccagtcgcgcccacgcgctgggcactaccagtcgcgcccagcggtagggcgctaccagacgcgcccgcgtcagggacgctaccttgctgctgcctcgtgcgccgcgctgtgccacgtgtcgcgtgctccatggaagcgcctgtctggggggcgctttgtaataaaaaaacagacccccaggttggaacctgcaatccaaacatgcactacttagatggcaataacagcacttcggagacagtgtag

SEQ ID NO: 65541 - DNA, 1122 bp, Glycine max
  Peptide Sequence Number=SeqID_182319
atggacaacgcagctgctgaacttcaaagtgtggcagcagatcctgctcttcttcttcaccatcagacttgtgctggaaatgggattggtgacagtacctccttgattccagaatcctccagaagaccaagcctctcctctctgcaaataccagcgttgtcagtggaaaatgcattatcttcttttaacaagacagatggtcctatattgatatcaagtccaggttccagtagaggactgcccccaaggccaaattcagccagagtcatcaagtccactatgaaaactttactctctgaaaggagctttagggctaagaattcttcaatggatagtgaaaggacagttctcattattcctgatggctcaccatcagatggtcctgtggataataagccttcgacttcgcggtccctttctcttaacaagattttgttctcttcctcaacaaaagcagcacattcattgccggttactccaactgcaaattcaggtccagagaatgtacatggaagacatctagggtgtgattctgatttaagtaaaatgaaagtaaatcagcacatgactcgatcagtttcggttccagttaatatcaaaactgctaatttaaggcatacagattctagaaggctggttcgtgtaatttcagtaagatcactaccaggaactagtggcagcatttcagctgacaatgcttcaggatcagagattggtatcccttttgaatttcttgatcaagagtatgagatcagaaacagtgaggtgtttcggcaagcaagtatcttgctcactgcatcatttccagtcaatgaagatgcttctgaggatattccagaggaagatgcagtttgtaggatttgtttggtggagcttgcggaaggagggaatactcttaggatggaatgcagttgtaaaggtgagcttgcacttgctcaccaagactgtgcagtaaagtggtttagtatcaaaggaaacaagacctgtgatgtctgcaagcaggaagtccaaaaccttccagtaacactcttgaaaattactaatcctcaaactgttactcggcagccattgaatgcaccagaaccacaacagagagaagtaacttcttacaggcaagtttaa

SEQ ID NO: 65542 - DNA, 2493 bp, Glycine max
  Peptide Sequence Number=SeqID_182320
atggaagcgatactcgtggattgtgtgcagaagagtcttcggcatttcatgcacgccaacgccatcttcctctgccagcgtctctgcgccgagttccccaccgaggtccaagtttatttttggctctttgttagttttgtaagagtagtggatttatacgtgatggttttccctcttccaaggtttgaagttgcgtgtgtgcactgcgtgacaaatctccaattgttggctggatgttacttgcagaataatcaagcttattgtgcatatcatatcttaaagggagcgcaaatggctcaatctcgatacttgtttgcgatatcatgctttcagatggatcttcttagtgaagctgaagcagcactgtgtcctgttaatgagcctagtgtagaggttccaaatggtgcagctggtcattatctgttagggctgatttacaggttgctaatcagtcttacttaccgtcaaggatacactgacagaaggaaaagtgccatacataattttaagcaggcactatcaatggatcctctaatgtgggctgcatatgaggagttgtgcatattaggtgctgctgaagatgcaactgcagtttttggtgaagcagctgctctttgtatacaaaagcaatacctacattgcacgacctctcctaagttgcattcatcagctgaggattgtaatatagttgacactagacactctgtctcagaagacacaagtcctaggcaactgaagctcatgcagggcatgaaggattttcccggaaatcatcatggggcatctattttgggaggaactgctcaaccaaataatagtggtctgtctaacatatcattttataacacaccatctccaatggcagcacagttgtcaggtgttgctccaccccctttgtgtaggaatgtgcagcctaatggccaaaatctgagctcacttaatgctgacagttctcctaagtcaacagtgaactctaccattcaagcccctcgaagaaagttcgtggatgaaggaaagttacggaagatttctggaagattgttttccgattctggttctcgacgtagttcaagactctcgagtgatgcaagtgtaaatgcaaatgctaatgcaacagttgtatctggaaatggaactaataactcatctaagtatcttggagggtcaaagcttagcactatggcatttcgttccatggcagttcgtaaagggcagtcatgggccaatgaaaatgctgatgaagggattcataatgatgttctagatgattctcgcttaaatgtcacatcaacaacttctagttcttctcctaccatggaagctaaatcttatgagcaaaaagcagcaaattttccaattggtggacaaatagtgagtggttcaaaagtcatatctggtgcttcagaaatactgacccttcttagaatttttggtgaaggttgtagacttgcctacttgtataggtgccaggatgcactggatacctatatgaaacttccacataagcattacagtactggctgggttctttcccaggttggaaaagtgtactttgaattggttgattacttagaagctgagcaggcctttggccttgctcatcagattacaccttacagtttggaaggaatggatgtatactcaacagtcctttatcttcctgcttctatttcatgtctaattgctgaatacatatctgcatgcttaatgcttgaccaaaagactaacttatctctggtgcagcacttaaaggaagatatgaagttaagttacctggctcaggaactggtttcaactgatcgcttagctcctcaatcttggtgtgccatgggtaattgctatagcctgcaaaaggatcatgaaactgcactgaagaattttcaacgagctgttcaactgaatcccagatttgcatatgcacacaccctttgtggacatgagtatgttgcactagaagattttgagaatggaatcaaatgctaccagagtgcgctcacagttgatgcaaggcattataatgcttggtatggacttggaatggtatatcttcgccaagaaaagtttgagttctctgaacatcattttcggatggctttccatatcaatccacgctcatctgttataatgtcataccttggtacagctttgcatgctttaaagagaagcgaggaagcactgatggtaatggagaaggctattttagcagataagaaaaatccccttccaatgtatcagaaggcaaatatactcatgagcttggaaaagtttgacgaggcattggaagtcctagaggagcttaaagagtatgctcctcgtgaaagtagtgtctatgctttgatgggcaggatctataaaaggcgtaacatgcatgagagagcgatgcttcattatggtatttctttagatttgaaaccatctgcaacagatgctgctgctatcaaggctgccattgagaaattgcatgtaccagatgagatggaagacaacttgtag

SEQ ID NO: 65543 - DNA, 1215 bp, Glycine max
  Peptide Sequence Number=SeqID_182321
atggggagcaaaggccgcatgccgccgccccctcacctgcggcggccgcacccgcaggaccccgccgcaatgccgcacccgctcgtggtgccgtttgattttctccctccgcctcaggtgatggagcagaagctggcgtcgcagcacgcggagatgcagcgcctgtcgacagagaaccagcgcctggccgcgacgcacagtgtgctgcggcaggagctggcggcggcgcagcatgagatgcagatgcttcacgggcacgtggtggcgctgaagggggagcgggagcagcagattcgtgcgcagatggagaagatcgcgaagatggaaagcgaggcgcagggctcggagagcgtgaagatggagctgcagcaggcgcgtggggaggcacagaaccttgttgtgtcgagggatgaacttgtttccaaagcgcagcacttgactcaggagcttcagagggtccatgctgatgctgttcagattcctgctcttatctctgagtttgaatgcctcagacaggagtatcagcattgcagggccacttttgactatgaaaaaaacttatacaatgatcaccttgagtcacttcaggtgatggaaaagaactatgtttccatgagtagggaagtggaaaaacttcgagcagagctcacaaacactgctaatgtagatcggagaagtagtgggccatatggtggcacctctggaactaatgagaatgaggcttctggtcttcctgtgggacaaaatgcatatgaagatggttattctgttatgcagggacgaggtcccctcccagcagctgctggcagcggcggcggcaacgctactacaattactactgccggaggtcaacctggtccagctcctgcaggaactggttatgatgctcccatagggcctggctatggtgcatctacaggttccacttatgatgcacaaaggggtgctacttatgacactcagaggttgactggttccaatgcatttagaggatctgcttatgattccaagagaggttcggggtatgatatgcagagagcacctgcttatgatgcacctagagctgctggctatgatgcacagtcaagaggggttgctggtcctcatggacatgctcggccaatgaacaatatgccttatggatccacaacaccgcctgctcgtagtggaggtggatatgaacctgctcgcggtgtaaaccctgctaggagatga

SEQ ID NO: 65544 - DNA, 366 bp, Glycine max
  Peptide Sequence Number=SeqID_182322
atggatcaaatagaggttttaatgtacaaactaaaaccaggcaaggactggttgaaccttagaacagacctaggggatgccagcaaacagaatggtagaagcagtgagacaaacaaattttggcagggtaacgcatggccttcacatgctggcaaggcatcaaatgcatgcttgagagcacatgagcagtcccttagctgtgagattctgggttatggacaaactttggatgggaaatcttttggtaaggtagccagtcagagagatctgagcacaatgaaggtgttggagataggcagggtctatgaggctgattgccaacttataaacaaagatggaagagtctacttggcacctaacaattaa

SEQ ID NO: 65545 - DNA, 240 bp, Glycine max
  Peptide Sequence Number=SeqID_182323
atgtatgtggaagtggattttaaggaggtaactagtaaaaaggcagctcttattgagaattacagtcaattgaggaataaacttggtgaaattgcaaccatatcaagagagaaaggagaagtggtcagtgctcactataagctagtccctgcagatttgcgtgatatacaacaattaaataatattatatctgttgctggtatggacccaaggtatcatccctttctaggaaaagaataa

SEQ ID NO: 65546 - DNA, 501 bp, Glycine max
  Peptide Sequence Number=SeqID_182324
atggtggttgttaggtgtaccctgcaccgttgctggtacatccccaaccctgatgatgatggcagcaaaaaagttcctctggaccccccttttgttgattctatcagctatgtagttgtcgttaataagcctaaaactatcactactaaagcagctgaagtggcgccttccactgtatcatgcaagaaagttgttccacttgaaactcccatatctatgccctttgaggttgttccttccattgttgcattccaagaaattgttccagctgaaactagaacatctattctatctaaggtcatgccttccactgtcgtatgcaagaaaattgatcagtctcacatagcctcttctatggcaactgaggtcctacctttaactgttgcctccaacaagtttgatcaacctgaaacgagcacatctagggcaactaaagttgcccgttcttctgttgcatgcaagaaaatgcttgactttgctaagattaaggttgaaaagtag

SEQ ID NO: 65547 - DNA, 387 bp, Glycine max
  Peptide Sequence Number=SeqID_182325
atggcagagattatcttctctgaattccttacgagggagggttgtgataatgattggggagagggattaaaggctgagaaatctgttgcatgggacatgctgagaatttataacgattttattgatgctccggaaagacacaggattgaacgcctggaattgtttgatgaatttgaagagtggtacatgatgcaggagcactactgtgtggcttatgcaatcaatgatggcatgcaaattggtagaggcaacttaagtgatgcagggtctggtttggcttatgcaatcaatagtggatacgcatttattgtctggtttcctttcatgatgcagggtctttttggtgattttggttttgttaatgacaacaatgtgcttccttcatga

SEQ ID NO: 65548 - DNA, 720 bp, Glycine max
  Peptide Sequence Number=SeqID_182326
atgagtcatttgcaaggatcttcttcacttaaacggaaacgacaagacctggctttagtgacggggtctttgacagatggtgaaagggtattgtataatctcatccatagcaagaaagacatgggaatctggacaggagacatgaaacgagaaacaaacctgcctgacagcatagtaaaaaagtccctgaagttgcttcaatccaagaatctgataaaggaggttgttaacattcaaaacaaagggagaaagcactacatggcagcagagtttgaaccttctaaggaaatcactggtggggtttggtataatcaagggagacttgatacagatttcataaaccttgtaaaggacgtgtgcttgaagtacattttcaggcagaaagttgccacacgtgatggagttatggagtggagcagaaagagtggtgtcttcaatgttgaagtcacaacacagcaaattgatgagattttgcgaactttggttttggatgatgagattgtagaggtgaagagcactggatttggggatttttcatctgttcctgttggaagaatttgttacagatgcaaaagcaaaggtggcaatagaggggaacagaaacctggtgccatggcttccattccatgtggagtttgtccacgaataaacttctgtacaccagatggcattatctctccaagaacttgtgtatattatcagaaatggttggacttctga

SEQ ID NO: 65549 - DNA, 1011 bp, Glycine max
  Peptide Sequence Number=SeqID_182327
atggttttaaattgcggttgcaatcgcagtttcgtcatactgtgggaaattttggacaaggctgatgcaaccacaattgcggtcgcagagtctaaaaaccttgatgttgtggccaaaatcatgcatcatcctcaacctccaacgagctcacaacctaatctgttcgggaatgcattcaattctgctggttctggactcattcgaggtggattgggtgcgtatggagaaaaaatattaggatcaagctccgagtatgtccaaagcaatataagccggtatttctctgatccccaatactactttcaagtgaatgaccactatgttaagaacaaattaaaggttgtgttgttcccattcttgcaccggggtcattggactaggattactgaaccagtgggaggtaggctctcttataaaccaccaatttacgacataaatgctcctgacttgtacattccattaatggcatttggtacctatgttgttcttgctggcatctcattgggtcttcgtggaatgtttagtcctgaagctttgaactggttgtttattaagggattggttggttggtttatgcaaacagcactgcttaaagtcaccttactttcattgggcagtggggaagcacctctattggacattatagcgaacgccgggtacacttttgctggcttgtgtttggctgtttgtggaagaatgatatggagttactcctactactttctgatgctgtggacctgcatatgtatggcagtgttcttggttaaaacgatgaagagagttctttttgcggaagtcaggagttatgattcaagcaaacaccactatctcttgctcttcattgctttggctcagttcccattgttcacatggcttggaaacattactgacgctctagctgtgggttgtgtctccgctgtcaatgccgctcctcataactctgaccaccacggtaactccaaccgccaccatgagctcaagcgaaagccgaagattacctcttgttcttga

SEQ ID NO: 65550 - DNA, 387 bp, Glycine max
  Peptide Sequence Number=SeqID_182328
atgtctcaaattggtaatggtatttgtttaccaagtgctaatttttggttgtctacatcagaaaatatgcttgtttcaattcaagagaagataaaatgggctgatgcaatgagtgaaattgacaagaagcacaggaaggatgtggaagagaaggtagaagaagtaaagaagtccattttcaaggccgacatcgacttcagagggcatgaggagatctgctctgaatctggtggagtgatggattatgaagaagatcgaagccgaccaaagagaggatatcagcttttgcagacagacaagtatatctcatcgatattgcccttgtctgtcacaccacaaagcgagatagggacaaggaaaaaaaggagggaaaacctgttaatttag

SEQ ID NO: 65551 - DNA, 303 bp, Glycine max
  Peptide Sequence Number=SeqID_182329
atgggtggaaaccaaaaaaaaagggagaaaggtgtggaccagggtcttttgggccacgagttattataccgggtcacaaaccctacccacaaaaagccaaacaccaactcacacaaaagcaccatgccccatcgagcagcaattttcaacaacaatcctggacgatccaacgaaattgcgattctcaccagactgagactcgaagatggcaaagaagattgtaaactcatacaatcttatgcatcaaatcacaattttgactaccatggttatgtgatagatggggggaaaagtgtatgctag

SEQ ID NO: 65552 - DNA, 111 bp, Glycine max
  Peptide Sequence Number=SeqID_182330
atgacggacgcagcgtccgattcacgaaacgatgcagccgtgcaagccaccaacgacgacgcttccgccagattttgctcgttgtgcaccattgtagagattaaggattaa

SEQ ID NO: 65553 - DNA, 204 bp, Glycine max
  Peptide Sequence Number=SeqID_182331
atgagactaactccaaacaaattgacacctttagactcccacatcaacaacccatgcaccatctggccatcattgtttgaggagaagaggatagaggagatgagattcgccactgcaagggtcgagcaacgtgatgtgaagagtagtgagaccaaggtgaggtttcaggggcaaaaacatgggaggaaggggagcttgcgatag

SEQ ID NO: 65554 - DNA, 438 bp, Glycine max
  Peptide Sequence Number=SeqID_182332
atggctaaagtgaatgggcatttgataaccatatttcttttgtttttttggaccaaaggcaactatgtaaatggggttgctttggcatttatatcttgcacctctcaatatgaatcctacacctcacaaaaagcttcagtggtcaaaaataccctcaaccctaatacctctcctttttccctgtgttgcccaagcatgatcttgttggaggtggtgaagtttttgaggttgaagccatcagaggtggcaaagaaggctatgccatcgttgtccttgcatgcatcaacaaggcttactccgaactctcattgcaccggaagaagatcttcaagtaattttagttgtattttgtataaagatatagcagagctcatcaaagactgctcaactcaagaagcccgcttagcgcaagaaagccaacctagaggccaactgtag

SEQ ID NO: 65555 - DNA, 767 bp, Glycine max
  Peptide Sequence Number=SeqID_182333
agcatccaggtcgtgtttgtgtagcggggtctagtatcacaatcagtcaatactatggaagggcatcacgtggctccaatagttcctctacatcaatcactcaacaacagttggctgagataattggaagccttaaggaagagtggaggaatgagattatcggaaacctcaaggaagaagtcgggaatgagattgaagaagaaaacaagcagagtttagagaaaatgaaacaggagttgaaggatgccatcaaaattgattttttccaaagaggatcacagtactcaccattgattgaggtagatatacagacattaggtgcacgtgtcagcataaaagggagcaatgttgaaactgttgtgaacccattagatgaagaacatgatggtcatgtcataccgactatggggttatatgtgcaacgtgaaaattgtacacacttggtggccttgggaaaaatatatgagggggggtctagcattcatagagtggcttatgccaatgatgtggattcacatattagtccaaagaaactgtttgaacctgttcaaaggctgaataatgtttctacaggtttaggatgtagaagcaaatgtctttggtgttttgatgatgatcatgatgatttgatgcaaatgatgcaaatgggcttttcaagtttaaattcaagacagagattcaagaatacacgtcacaacatcaagatgatcactagtattttaggaagggaattcctaattgatttagcaaaaggtttggccaagtaa

SEQ ID NO: 65556 - DNA, 270 bp, Glycine max
  Peptide Sequence Number=SeqID_182334
atggaggtgcaaatgaaggctcaagaagagattaatgcaacatttgaggcagagataagtgtggacttgaaggaagagattgagggaataacgaaggatttgcatgggacaattagtgaaggaatagtgagggctctattaacgctaatttgcgagggaaatgtctgcattccaccacataattcgcgtggattttgtgaaggaattgcgagggaggagtatggaagtagcaaaggaattgcgagggactttcccgtcgctactttgtga

SEQ ID NO: 65557 - DNA, 426 bp, Glycine max
  Peptide Sequence Number=SeqID_182335
atgacaaatgataataaaaatcatgagcattcagaacagaagattcatttgcaaaaccttgatgaatctactgaaaatattatcaagaaagttaaggaagcattaaaaaatggggaaggatgccgggtttatggtgttttagatgttcaaagggttgctggaaatttccatatttcagtacatggactaaatatatatgttgcacaaatgatctttgatggagcaaagaacgtgaatgtaagtcatttcatccatgatttatcatttggccccaagtatccaggacttcacaacccacttgatgacacaacaaggattctgcatgataccagtggaacatttaaatattatataaagttattgaataatatggtcattcaatggaaaacaaaattaagattgtgcagaagaccaagacctgggtaa

SEQ ID NO: 65558 - DNA, 984 bp, Glycine max
  Peptide Sequence Number=SeqID_182336
atggaacgttggagtggagttttgagagtcccactgcatcctaacagcaggacattccatagagttggggcatctctctgcctttctcctgaaaccagaactctgcttgtacctaaagccaatgccatctttttctgtggggatcgagttgaagggactggtaacccagtgattgagaggctatcaaatttacaaaaactatctgaaattattgtgtccaaattcggttcattcaccaatgcttgggttattgaggcttctgcttttaatggacctttcgctgtctataaagacttcataccatctgtgaatcaatatggagagccaagttcataccatccaaatggattcccagcatctacatcaactgtctcactcttatctaattgccttgaagaagccaaaaaagtcattttaggaacacaagtagatacaaagtctggcttgagtccttcgtgttctttctctcgatccaagacattcatccttggatttagcaaaggtggagctgtacttaaccagatagttactgagcttggattctcagatattggatccaatgcgaattcacctgatgtgggacagcttatgggcagaaagttcgccggatctgaggagatttatgttgtacctaaaacaaaggaagacttgctgaacagcattagtgagattcattatgttgatgttggtctcaactctgctggggcatacttaactaaccatgatgtgtttgagagaatctccaagaggctcatgcaaggagcttctgaactccgttttatcctacatggaactccgagacaatggagtgacaagcggcgagattggatacgaaacgaaaaggacaaaatgctgcgtctgcttgaatctgaagccccaaagagtgggggaaaattaaaagtattagaaaggttttattttactgataagcctccaagcatgcagatgcactttgaaattatagaaagtttagatgcaagttag

SEQ ID NO: 65559 - DNA, 429 bp, Glycine max
  Peptide Sequence Number=SeqID_182337
gttctttacgacagggatactggaaaaagtagaggctttgcatttgttacaatgagttgtattgaagactgtaatgcagtaatagaaaatcttgatggaaaagagttcctgggcagaaccttgagggtgaacttctctagcaaaccaaaaccaaaagaacccttgtaccctgaaactgaacacaagctttttgttgggaacctgtcatggtcagtaactaatgagatattgacgcaagcctttcaagaatatggaacagtggttggagctagggtcttgtatgatggagaaactggaagatcacgtggctatggtttcgtttgctattcaacaaaagctgagatggaagctgcccttgcagcattgaatgatgtggtattttactccccatctcttctctcttgcttgtactggttatgcattttgtaa

SEQ ID NO: 65560 - DNA, 1287 bp, Glycine max
  Peptide Sequence Number=SeqID_182338
atgacaatagtgatgtatttatttgttcaagatgttgagaggttacactacatggcaggtctgaatgatctgatggagtctaaagttgggaagaagaagtcgtctagtagtaagtcccttttgtacgaagctcctctcgattacaccattgaagacgttcgaccacacggtggaattaagaagttcagatctgctgcttactccaacatggctggctcagctattggtttcgaaggctacgaaaaaagacttgagatatcattttttgaaaatggtgtgtttgctgaccccggaggattaggcctccgagcattgtccaaagaccaattggacgagattcttaaaccagcagagtgcactattgttgcatcactttcaaatgattatgttgactcttatgttctgtcagagtcaagcctgttcgtctatccttataaaattatcatcaaaacttgtgggactaccaaattgcttctgtccatccctgtcattctcaagttggctgatgctcttgacatagctgtgaaatctgtgaggtacactcgtggaagcttcattttccctggggcacagtcttttcctcaccgcagtttttccgaggaggtttctgttcttgacagctatttcagcaaccttggttctggtagcaaagcatatgttatgggtgacccttcaaagtcacagatttggcacatctactctgcaagtgcacagaccaaaggatcatctgaagctgtctatggcctagagatgtgcatgaccggtttagacaaggaaagtgcttctgtgtttttcaaggagaatacatcttcagcagcttcaatgaccgaaaattctggaattaggaagatccttccacagtctgatatatctgattttgaatttgacccttgcggatattcaatgaatggaatagaagggagtgctatatccaccatccatgtcactcctgaagatggtttcagttacgcaagttttgaagctgttggttatgactttaatgacatggctctaggtgaacttgtggaaaggattttagcttgcttttgtccagcagagttttctgttgctttgcacattgacatgcatggtgagaaacttaataaatttcccttagacatcaaaggatactactgtggtgagaggagcactgaagagcttggagtaggtggtgcagttgtgtaccaaacatttgttcaaggctgcgatggtagtgcatctcctaggtctattctgaaatgctgctggagtgaggacgagaacgaagatgaagtgagggagatataa

SEQ ID NO: 65561 - DNA, 192 bp, Glycine max
  Peptide Sequence Number=SeqID_182339
atggattctcagaaggcaagctacaacgctggagtgaccaagggccaaactcaggaaaaggccagcaacatgatggacaaagcttctaatactgctcagtcagcaaaagactccatgcaagagactggtcaacagttgaaggccaaggcacaaggagctgctgatgctgtgaaggatgcagtgaacaagtga

SEQ ID NO: 65562 - DNA, 1890 bp, Glycine max
  Peptide Sequence Number=SeqID_182340
atgaggcatcaatggcgtcttctccaccaccttcttcgctctcgcccccgcattacctatcactctcaggtacttccctattcctcttccatccctcgtcgtttcgccgccaattccacgttcccgttaaaccctagtttccgtcgtttttcctccgaacccgttctcgcacaagccgacactgaccacctcctcgttgccgacattttctccaagcctgtggattccgaggacttcaaaaccctcctcgggtcgaatcgcgtctccattacccacgacgcggtcctcgcggttctggggaagttcgattccaacgtcgacgcggcgcggaggttcttccaatgggtttcggagaaccaccccgagaggttgagctccaagtgctacaactcgatgctgtgcgttttggggaccaatggtttcgttgacgagttttgggacttggttaatgtgatgaagaaaaaagggtatggagtttccaagggtgtgaaggagagagtgttggagtcttttgaaaaaggtggaatggatggtgatgtggcgaagttgaagggtttgtttgataactccaaagagaagaatattgctatagtgtgtaggattgtgaggaacaatgtgtggggtgatgatgttgagaagcagattgaggacttgaatgttgggttctccagcgaagtcgttaagacagttttggagagtttggttttggaacctgtgaaggcgttgatatttttccggtggttggaggagagtggtctgtttaagcatgatgggagaacttacaatgcgatggcgagggtgttggggagggaggatttgattgatcggttttggaagcttgttggtgacatgaggagtgccgggtttgagatggaagctgagacgtttgttaaggtattagggcggttttgtaagaggagaatggtgaaggatgctgttgagctttacgagtttgctatggccggtgcaaataagcctacggtacagtgctgtgtctttctgttgaggaaggttgctgctgggaaagagttggatacggatttgttttcaagggttttgaaggtttttactggaaatgggaatgtgttgactgattctgtggctaatgctgtgctgaagtctttgaccagtgttggtaggactggggagtggaacaaggttttgaaagaaatggaagattgtgggtttgttgctggtggtagtttacagagtaaaattgcctatagacttggtgcagcgggtaacaaggaacaagctcatgagttcatgaatagaattgaggtgtctggatccaatccatatcgcaagacatgggaatctttaattcaggggtactgtgtagctgggaaccttgataaagcttttgaatcttttaaagagattgttgagaaagagggggttgcttctgcaggctattcttttaatgtgttaatgaattcatattgccaaatgaatagggcggtagatgcaagcaagattctttgccgactggtgaatgagaaacagttaaagccctggcattctacttacaagctactggtaaccaagttactggttcaaggaggatttacagatgcattgaatattttgggattaatgagaacccacggatttccaccttttactgatccatttattgaacacttgtcaaagagtggaagtggcgatgatgctgtactgtttctcaaggcaatgacatcaaagaggtttccatctacatccatgtttctccgtatgtttgaagcctttttcaagcacagaaggcatgaagaagcacaaaatttcctctcgaaatgtccacgctacatccgcaatcatgctgatgtcttgaatctcttttgttccttgaactctaaagaagctgcttcttctagtatgttggctgcttaa

SEQ ID NO: 65563 - DNA, 297 bp, Glycine max
  Peptide Sequence Number=SeqID_182341
atgactaatgagttctccaaagctctcctggtcaaccggtttgaagcctctcctgaaaaccagcataacctaagaactcctcaaatttcagaagatatggatccccagaagatgaactaccaggctggtcaggctcagggccaagctcaggaaaagactaacaacttgatggacatggctggcaatgctgctcagtctgctaaggaaaccgcacagcaggctggtcaaacagtgatggcatcagcacaaggagcagctgatgctgtgaagaatgcaactggcatgaacaaaaattga

SEQ ID NO: 65564 - DNA, 1248 bp, Glycine max
  Peptide Sequence Number=SeqID_182342
atggaccttacactctacgacataaaggaatcctcctctggtaaatttgttccctgtgatcaagagttttgcaaagagatcaatgggggtctgctgaccggatgcactgctaatatttcctgtccatatctggagatatatggtgatgggagctcgactgctggttactttgtaaaggatatcgtactttatgatcaagtgtctggggaccttaaaactgattcagcaaatggaagtattgtatttgggtgtggtgcaagacaatctggagatctaagttcttcgaatgaagaggcacttggtggaatacttggatttggaaaagctaattcatcaatgatttcacaacttgcttcttctggcaaagtgaaaaagatgtttgctcattgcttaaatggagtaaatggaggtggtatatttgctattgggcatgttgtgcaacctaaagtaaacatgactccattattaccagaccagccacactacagtgttaatatgactgcagttcaagttggccatgctttccttagtctatcaacagatacatcaacacaaggagacagaaaagggacaataattgacagtggtacaaccttggcctatctgcctgaaggaatttatgagccgctagtatataagataatttctcagcaccccgatctaaaagttcggactctccatgacgagtatacgtgctttcaatattccgagagttgcgctcccatagctgtggtgtccatggtgcgtggcataggtcacattaaaaaggcaaggtgtcaccatccttcaatatggcaattgaatgccatgttggcattgtttaagcttgctgtcatgagcattggcatctgtagtggttggtgtttgagatgtcttgatttctgtattgagtatgtattgttggagttctttgataactggactgctccctttgcatatcctatgcatttatgtctgtattatcagcttcatgtaggggtggggcttaaaggtgtgaatgtaggttctgacaaccttttgcaatttgctgatttagtgctttcaaataaacttgtcttctatgaccttgaaaatcaggttattggatggactgagtacaactgttcttcaagcattaaagtgagggatgagcgaacgggaacagtccatttagttggtttccactacatttcttttgcttgtggtttaaacatcaacttggtgatgattttgtctctacttgctctacttcataaatgggtatattga

SEQ ID NO: 65565 - DNA, 369 bp, Glycine max
  Peptide Sequence Number=SeqID_182343
atgtgcaagcggatgcgagtgcgcggtggaatgttgaaatccaagttgaatagaatcgcatgggagtgtcatgctagaaaattgttagagctcacaaagcgacagtcgattggtggttttcatactgcatggtgtggaaggaacgtgacctcgtctgtctatgagacatgttgttggagtttgggattagtctgggactcatttgacaattcaatgttgtttagtatcacatggaattccatggtgacaaagaacataaaatccctgttgaagtatatggaagactcattggtacattttgtccaggatcaagcaacgggcaaagagttggggctccatcttgaggatgagtgcacttggaagcggtag

SEQ ID NO: 65566 - DNA, 372 bp, Glycine max
  Peptide Sequence Number=SeqID_182344
atggccaaggcaatacaagaccctgttatgagacaagtactgcttgatatccaggaaacacattctgtcataatatcattcggagggtgggtgatggtgaatggtgtagcaactcacaagaatcatgctctcttcatggagatgaggaagtggaagggtcctgaatatgcaaagggctttcttagaaagattagccaagaatgcattctcactaattttaggagaatgttgtacccatggtactgcgtgcgaatgggggccgatacaacaggaagcaagacagggcacggtagctacaagcaaagtactacccgcaattggcattgcaataaaggacagaggcaggatcaagcagcgcagcaacaaaagtaa

SEQ ID NO: 65567 - DNA, 596 bp, Glycine max
  Peptide Sequence Number=SeqID_182345
atgatgactttagtgatgatgaagagttgcagtccccaattgacgatgttgatccttttgttttctttgtggatacaatcaaagtgatacaatcatcggatccatcgaggtttgtgaaccttacccaaacgcttgagtttaattatcaagctctcgctaatggtgttgcccagcatgctgagcagagaagggcagaaattgaaaaggagaaaatagagaaagtttgcagtattgaagtgcctggggcactgtgcaccgaagtagccatttgcccagagagagaggatgatgcattcagggaactgtggagtcagcagtttctccaggtcttagttcagcttattgtttggtgctttggggctatccttttggaggaaagtgcccattcttgcaaagactgtgtttgtccccttccacccctttcccttttgtgggctccttttatagtctccatgtatgtgccaacgtatttttgtttcatggatacgatttctgtaatatttgttgcctgtcacatagacggttttccaaacagctcgagttttccaaacaacaaacctgtggaacactggttttcatggtcaccagttgtttaa

SEQ ID NO: 65568 - DNA, 402 bp, Glycine max
  Peptide Sequence Number=SeqID_182346
atggcaataggaaacacaagtgaaatacttacctcaaaggagaactcgaacgcacgaataagaataagcagcaaagcacgaacaagaagtagcaacacaccaatgccacaaaatgaagcacgaacgctggaaaaggaaccaacacgaacaagaagaactaacaacgcaaacgatgacaacaaacgcgaagaagatgaagcaaggcgaacaacacacaggaagtcgaagaggcaaacaacacgaagcggaagagcaataggaacgcgaagaggaagcaagaaggcggaagagcagaacgaacgcgaacgcgaagaggaagcaggaaggcagaagagcaggaagtcaaagagaaagaaatggaaacacgcagtgacttgtacgaacgagtcactattcgtttaa

SEQ ID NO: 65569 - DNA, 453 bp, Glycine max
  Peptide Sequence Number=SeqID_182347
atgaaggtgttcttgtggagggttgctcgatggtgtctttctaccagggggaagctcattaggaaaacaatggagtgccccatatattgttccttttgtgtggagtgtgatgaaaatgattggcatatttttgtgggttgtgagcaagttgcaaaagtctggcaggaggcatctctgaagcaccaagtggatgatacgagagaattcattttcactgctctccaacaattctcttatcctaaaattgaagtttttgtttttgctatgtggactcaatggaagcatcataatcaaacttgtataagagacttgaggggcaactttatcttagtaatgacttcttatttttcgaggatcccaaccccttggaggatgaagccagagctctttctaatgcccttagctggatatcctcacgagaacacaacaattaaggtcattatagaaatctaa

SEQ ID NO: 65570 - DNA, 254 bp, Glycine max
  Peptide Sequence Number=SeqID_182348
atggtttggttggagtcccttcagtccaattggaggttgacatcctcctcaatcgttgtaaggaatggcatggttttcactgtctacggggaatggcatgaaaaagttgaaagaagaatcaaagacctggcgagggtgagagcggttgggatcccagttgatcatctggagggttgcaggagaagcttgcactggaagagaaagaggaaaaggatcagacggtgggaatggaatgggaaagatgagatccaaag

SEQ ID NO: 65571 - DNA, 219 bp, Glycine max
  Peptide Sequence Number=SeqID_182349
atggagattacaatttacaagctcagggttgaagtcaatcaatcaaattttcagctcagtaagggtgcaagggataattcattcatgaacaagaaaataaatgaaaatcctatcaataatcatcctgagctggtgtttgctcatcctgggctggtgcaggctcgccatgaggtgaggagggaacatcctgggctggttggggtgtctcttgatctgtaa

SEQ ID NO: 65572 - DNA, 739 bp, Glycine max
  Peptide Sequence Number=SeqID_182350
atggctaaattcgtcaaactcgttatcggagcacatggtgacgcccgccttgcggtaacgcatggtcgacggcaccaggtgaccggaagaactgtgcagttcatgcaggccaatatcgacaaacttgtgcagattgctgaggcgcacgccggcacccgccatgattaccgggccctgactggcctggcgcaaatcgcgcagcaacggcaggcccagttcggcgctctgctgctggccggaggtcagaatgcgcgccacgcccagctcgctcagttgctccaacgccaccatcgggttctggcacatatcgaacgcgcgatggaacgtcaccgccatgccctcgcacagcctcatcacttcgcgcatgcgcggcagatcgatgtgcccttcttcgtccagcatgccaaccactacgccggggaaccccatctcgcggatctggcggagatcctgtttgatcacctcgaaatccaccgcgccgtagcagaaatcgccaccgcgagggcgaacgatcggatgcaccgggatcgaaacccgctcgcgcgccagacgcagcgtgccatagctcggcgtcaatcccccctcgctctggctggcgcacaactcaatgcgatcggcgcccgcccgttcggccgtcagcgcgcagtcgacgctaaagcaacaaacttccagttttatcattgtcacccccagataacggccaacatacggcggcaattgttcatttcttcattctcac

SEQ ID NO: 65573 - DNA, 582 bp, Glycine max
  Peptide Sequence Number=SeqID_182351
atgtctgaaatctatgggattaagatggtcattgaccaatccttattttatgatttaacaaaattgcctagtgaaggtgtgccttttgagggtgcactgattgatgattggaaattcgatttttctgtgcatgatgcccgccggttggtttgcaccaaccaagcggatatgatcggaaggcttcttgccggttcattggcttttgagagccgcatcctccataaccttattgttcgcatcttactccctagatcttcaaaccttgctcaagtttctgaagaagatctcattgtcatgtgggcctttcataaaggtttacaaattgattgggcacaccttgttagatatcgcatgcataaggcattgcgattgaatgccctattgccttttcctcatcttgttacccttttccttcaacacttcaacatccctcttgattctgaaccttatgttccaatcaagagatcatttcttataggcgcttcagtcatagcatcatttggttatataaaggagcatgatggctcttgggtgaagaagggtgctagaaatgttggtgaagtaggacatgaaggagaatga

SEQ ID NO: 65574 - DNA, 1092 bp, Glycine max
  Peptide Sequence Number=SeqID_182352
atgaccagagttgccaaggtagttaaaatctcgacagaagagttggactgggtaaagcataataggaatggggtaattggagtaccaaggaagtgtttggaggaaaaggcaaaggccctggcaaatcaaggtgaatgggcttcttttattgacgtcttggcgttgttgatctttggagtcaccctttttccaaatgtggaacgtctagtggacctagtagcaattgatgctttcctcgcctatcaccatagcaaggaaaacccgatcatcgctatcttggtctatctctatgacacgcccgcctgtctactacaaggtcactgtttgtgtgccgagaaaggaaaggcgaattgggaccaactcttggctaggggttgtattaattataatcccgtcctcgccataagacaactcggctaccccatgagagtttcaccatcagagaaaagcatcataccttttcatcgcacggggtgtcagcgacctcaatgcgagggtgcttcaagaagtccacaaggcatgggatgcggcacaaaggaaggacaaagtgctcaggggaagcaaaaggaagaggctgaagctccgaaagaaagtgaggaggtacaagccctaaaagcggagcttgaacaagcccgagcagtcaaagagaagttcaagacatcaatatggccactgccgaagccttggaacgagaaaccaagagggcccaaaaagaagaacacggtcaaaacaagttgcgaggagctttatggggcagcaacaatgagcttaagctccaaagagacgaaaagggatcaatcgcgggttgaaggcatgatcttgaaagacgagttaaaggcttgccttaggtcaaaaagtggcttgtcgcagcagttaagtaagactgaaggaaatatgtgggctatcatcgatgaatacaaggaaaagctaaacctaacggtgactcacgagcaaaagctagaggatgatcgtaaacggtgtaaaaaagggctggacggcgaagggagacttttggtgcttggtgtagaaggagctgatcgcggagagtgggatcgtgttcagcgggagcagcatagagtagttgtcccatag

SEQ ID NO: 65575 - DNA, 738 bp, Glycine max
  Peptide Sequence Number=SeqID_182353
atgaaggccaacatgtcagctctgaaaaatcaaatggtttccatgatggaagccatgctaagcatgggaagattaatagaaagtaacgcagcaactgctaccgccgccagcaccgtcgttaaggcagatccgatttttctgtctgcaacaaatctagtacatcaactccccccagatatggtgggacgaggaggagacatattggggaataccagcggctcgcatcgggggtatagcaggaatgcttacccctatggcctacccccaaatttcacaccacctaccatgcacgagaacatggatcctgtcgttccctttaccttcaaagggaagcctccccagcctatagggggcgcccatgaagagcctcgggagcatgcctgttgcaacatgcccttttgcgggctagcgaggcgaggctcacgggtgcgctttccaaaggaggaaaagatgcgcgtagtcgccaccaacgtttatttgtggaaaacgtcggaaaagctgaaggaaaccagtcaaaaagatattccaagttcgggagttgtatttacgtttgaggaaggtattagcacctctcacgtcgacaaaagcggggctcttgctcctacgtaccctccatcgaagaggaaatcagacctacgggaggagcttgccacccagctcgcccaggtgagctcagctcgcccaagcgagccaggttgcttcctccagaagcaaccgccttctggaggaagaatctag

SEQ ID NO: 65576 - DNA, 516 bp, Glycine max
  Peptide Sequence Number=SeqID_182354
atggctccgaggaagctttcctcaaagagatctaggaaggaagccgcggccgcagggactagtgccgctccggagttcgatagccatcgtttcaggagcgctgagcaccagcagcgtttcaaagccatcaagggatggtccttccaccgagagagacgcgtccagctcagggatgacgagtacacagatttccaagttcgatctagatatagttctcgagttttacgccaatgcttggcctgcagaggagggcgtacgggacctccggtcatgggtgaggggccagtggattcctttcgatgcaaacaccctaagtcaattcctgggatatccgctagtcaagattttgcctggaccgctgcttggagacgggtgcgaatcatgcgcaccaacatgactaccttgacccagacatggatgacgttgttgctcagcaacatcctacccagcgatcataattccgacctccctctaccgaagtgtcaactggtatgccacctatcaggcaccctctag

SEQ ID NO: 65577 - DNA, 165 bp, Glycine max
  Peptide Sequence Number=SeqID_182355
atgaaagcaaaatgcaaccaaaggtggcttaggggagcaaaaaccgcaagcctcgatacagggctgccttgcaacgacgttttccacttgtccagagctgagaagggacgaagatctgtcggtcgtgaccctatcctccatttgcattcgtccctaagtacctga

SEQ ID NO: 65578 - DNA, 738 bp, Glycine max
  Peptide Sequence Number=SeqID_182356
atgactaccagccaatgcatctggagtttccagatgaagacatcaaggccttgttcgaagcatccagtggattcccttcgatgcagatgctctgagtcagttcctaggccacccactggtcttggcggagggctagcagtggagatgggtgcgaatcatgcgcaccaacatgacctccctttcccagatatggacaacgtgagtgtgcacatggctcagctgatttctgatgccatttatcagtttgcagggacagtgcctacgagacaccctatggacccggagaggtccaacagcgccctggggtttcccgctctgattacaggcctttgtcagttctatggagtgcctgtcacccccagcaaggtgatccggccacccattaccagagccttcatcgagaagtactgcacccccaggcaggcagccgatgcaccaccgtcacccccggagtccacatcggctcacctacgaagattggagcattgcatacgacatgtggctagccaaaaggtagccaaccacaggggtcagatggaagcggggcccgcggggacctctggaggtggggacaaagcccaggaggatgaggatatggccgacctgatagacttcctcctgaaatgtgatgcaatcctccctaggaaaggaccagttaccagagccatgagcaagaggctccaagaggattgggctagagttgataaagaaggccttagggttctcatgaaccttagg

SEQ ID NO: 65579 - DNA, 345 bp, Glycine max
  Peptide Sequence Number=SeqID_182357
atgcagagaccaaataaagtcgcctactccttttcggagacctcagtgtcttttgaccgagactattacagtctccattatgtcatccagagacattcaagtccaatggcatgcgaagaccatgatggtcactcactttcgatgctccaagactatcaaagttcccttatcatccagagacaagcagactgtcaagtccgatggcatgtagagacagacatagtcatctacttcccttgtcaagagactcaatgtctgttaaccaaagctactgaagtctcccttgttatcctgagacaagcgagtttgatggcatgcggagaccgtcatggtttcgatgattga

SEQ ID NO: 65580 - DNA, 1572 bp, Glycine max
  Peptide Sequence Number=SeqID_182358
atggatcactcccttttgattattatcatcatattttccattacctttcttaaagcatttagatcacacttgtttaagaaatccaagaaacaagaattgcccttgccccctggtcccaaaccatggcctataatcggtaaccttcctgaaatgcttacgcataggcctacattccgatggatacaaaacctaatgaaggaaatgaacactgaaattgcatgtatccgcctaggaaatgtccatgttatccctgtgacttgcccgaccattgcccgtgaattcttgagaaaacaagatgctactttcgcttctagacccaacagtataaccacttctcttattagtcgtggatatctctccacaacccttgtaccctttggggagcaatggaagaaaatgaggagaattgttagtaatgatttgttgtccaccaccactcaccaacgacttgaaaataagagggtcgaagaagccgataaccttgtattttacatctacaacaagtgcaaaaacaatgtcaacgataatgtttgccttgtgaatgtgaggtatgttgcacaacactatagttgcaatgtgatcaagaaattgatctttagtacaaggtattttggggagggtaagaaggatggaggtcctggtcgtgaggaagaggaacatgtcgattccattttcacaatgcttaagtacatttatgactttagtgtttctgactatgtccctttcttgaggggacttgacttagatggtcatgagggcaaggtgaagaaggccttagaaattgtcgagaaatatcatgatcccatcattgagcagcgaatcaaagaaaggaataatgggtccaagattgatggagaggatttccttgatattctcatctcactcaaagatgccaacaataatccaatgttgacaacccaggaaatcaaggcacaaatcaccgaattgatgatggcagcaatggataatccaacaaatgcatttgaatggggtcttggagagatgataaaccaacccaagttgctccaacgcgctgtagaagaattggacacggtagtggggaaagagagactggtccaagaatcagacattccaaagctcaactacataaaagcatgtgcaagagaagcttttcgccttcaccctattgtgcctttcaatgttccccatgtgtctctcaaagacacaatagttggaaactacctaatcccaaagggtagccacattctgttaagtagacaagaacttggtcgtaaccctaaagtttggaatgatgaaccgctcaagttcaagccagaacgtcacctaattaataagagtgatgtggttttgaccgatcaagatttgaatctcatatcattcagcacaggacgacgtggttgtccaggattcatgcttggaaccacaatgactgtgatgttatttgctaggttactccatgccttcacttggattgcaccacccaatgtgtcacacatcaaccttgccgagtcaagccatgatatatctcttgctcacccacctctcgcactagcaaagccaagattaccgccagagctttacaataaatga

SEQ ID NO: 65581 - DNA, 1611 bp, Glycine max
  Peptide Sequence Number=SeqID_182359
atgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctgtttcgttgcggaaaaagttgtcggctgcggtgggccaatcacctaaggccaaatttaaagaaaggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaatggtggcgataaaatgcatcctgatttcttgcagaaaaacagttatgagatacatgatgctatatttgacagtctaaaggataatcagggaatcttaccttatgtgcatgagctttctgatatttctgtttatggcaataagctaaaaggtcttgattcttctcagtattgtagttttgtgccaccaacatcacctaagcgtaagcgtcttaaagagtcaacaataccatttattgattcctgtgctatgaaaaaaaaggatttatatccatttgatcaaattcaagacaataattctgataagattgcacaatcatttggaatgcaagcaccccttgatcctggtctctcctcgcacagttcaatgtgttacagccattcactttcaaatggcaactcctctacttctaagccttatgaggctatgaagttggagctcccttcactccaatatccagaactcgatttaggtagctggggttcatctcctccaccttctttgctcgagtcagttgatgatttccttcagtctcctacagcaattagtacactggagtcagattgttcttctccacaaaatagtggccttctggatgctttactttatcaggcaaagactatgagcagttcaaagaaccattgttctgataagagttcaaattcttctactgcaacccctggtgacagagctgacagctctattttgaatgtgtacgagacagaatgggaagattatgctgaccctgtatctccctttggtgccacttcaatattgaatgagtgcccagctcttagagccaatgcaaattcattgaacggacagctgccagttcagacctttactggcaaccttccgaaattagaatctgttgaccaggtttggactcctaacaatgaaaatctaaccttgtccctgttgaatattactcgtccagacttcttgcttgcttcagattggtatgacctaggttctggacattgcaagaaccaaaccatcacaactgatgctgcaacggcctttcttggagatgatttagccactgacctcaagcatatgactgctggaatttctaaaactatgtttgaaaatccattccagcccctctaa

SEQ ID NO: 65582 - DNA, 2604 bp, Glycine max
  Peptide Sequence Number=SeqID_182360
atgacagcagcgttccaagaaggcggcggcggcggtggcggtggtggtgacgatgacgccaccatcgacgtgcataccacgcgcggcactcccatccgctaccttcccctcgaccacctctactccgccacctctccctgccgcgtcaccgccagcggctcctccaacgtcatgtcgaagaaaatcaaagctcgcaaactcaccctaacgcataacaaccattttaacaaccacgaccagaagaaaacggcgccatcttcttcttcgtccctgacccttcctcccaagccccctctcctcttcgtctactcgcggcgccggcgcaagaggcattccccttccgcgacggcgtcgtttgccgacggcgcggagaacgacgagagcgagaggaggttgctgaagaagaggaaaattgggagcactgagttggagaggctgggtgtggatttgaatactgcgattggggatgttgacgggcccagattgagggaatgcagaaatcaatttgggaattccggtgctgctgggaatgctaagtgtggttccttggagaatttgcccaaaatgttgcccgaatctcgcaatgtgaagaaatgggtcgggttgacttttgataatgctgatcctgaggcgtttgttggattacgatgcaaggtttactggcccatggatttaaaagcatacattggctatgtcagaagttatgataaggaaactaagatacatcatgtcaagtatgatgatggtgatgaggaaagtttaattcttgcaaatgaaaatataagattccatgtttcccgcgatgagatgaaacatttaaaattgaattttgccaaagttcgtgacaataatgtctctgattatgatgttgaagagatgcttgcattggctgctagtttggatgattgtcaagactttgagcctggggatatcatatgggccaagctaacaggccatgcaatgtggccagctgttgttctggatgaatcacttgctagcaactgtaagggtttaaagatgtttttgggaggaagatcagttcctgtccaattttttggcacccatgactttgcaagggttagactgcaacaggtgaaatcatttctcagtggacttcttactgatctacactcaaaatgcaagaaacatagttttattgaaggtttagaagaggcaaaaagatatttaagtgaacagaagcttccatcagagatgctagagttgcggaaaagatgtacagctgatgactgtaacaacataagtggagaggatggaggatgtacagattcaggtgatgattgtttaaatgacaatgggactttgacggctctggaaaccattgaaacttttccatatgaagtaggagacctccaaattctaagccttggaaaaatagttgaagattctgctttccgggatggaagattcatctggcctgaagggtacacagcagtgaggaagtttacttcagttactgaccctaaagtttctgcaccttataagatggaggtgttgagagatccagaatccaaagttcgtcctctgtttagagtgacagttgaaggtggtgagcagttcaatggttatacaccatctgcttgctggaatgaggtatacgaaaagataaagaaaatggaaaaggatgcttctgaaggtactgttgctggtggggaagaaaagagctacgaatctgggtctgatatgtttggtttctccaatcctatagtacttaaacttatacggggattgtctaaatccaaaatctcttcaaagaactcaacttgcaagttaggttccagaagatataataataacttgcctcttggttatagacaagttcatatcaattggtttgacctcgataagtgcaatgtgtgccacatggatgaggagtatgaaaacaatctgtttctgcagtgtgacaaatgcagaatgatggtccatgctagatgctatggggaacttgaacctgttaatggggtgctatggttatgtaacttatgtcgttcgggtgctcctcctccaccttgctgcttatgtccactcatagaattatatgtctttgggtatttaatggagtttcttctaggtggtgcaatgaagcctactacagatggccggtgggctcatttggcttgtgccatgtggatacctgaaacttgcttagctgatgtaaagagaatggagcctattgatggtttgagtagaatcagtaaggaccgctggaagttgttatgcagcatatgcggtgtatcttatggtgcctgcatccaatgttcaaataattcttgtcgagtagcataccatccactctgtgcacgtgctgctggtctctgtgttgagcttgagaatgaggacagactgtatctcctttctgttgatgatgatgaagatcagtgcatacgcttgctttctttctgcaagaaacataggcaaccatctaatgagccttctgttgctgatgaacgtatggtccgagttgctggtctatgttcagactatgaaccaccgcccaatctgtctggttgtgctcgaagtgtgtttttagtgccatctggaaagggaaatagtagcgtgctaggagctgggtggcagagtagctga

SEQ ID NO: 65583 - DNA, 1608 bp, Glycine max
  Peptide Sequence Number=SeqID_182361
atgtctgaagaaacacggagaattgtggtgatccactatgcatcaagagacttcaatacaagtgccattaaagttgtcatggagggatattcgcttgggcatggagacaagcttacacttcttgtagttcttcgccatgctaatagtcctagtaggattcccttcattgcatctgccagattgcgtggattatttgagactgatcacaaaattgttgagaaagaggttgccaagatgaaagaagagatccttaataatgcaagcataagggaaatctccgagcagtgtgaagcagaaaggatccagttccggatagaagtgcttcaaggcaatttacctgaggttgctgtaaatgctgccacccgtttggaggcaaaaacagtgatacttgatagacagatgaagaaatataagaagaatttcaagcagagtctctcttgtgctttactaataatgaaccgtgacaacactttgcgacacttgagaggaccaagggaaacgcagctgtcagatggaagcaatggcaatgcaaattttgcaagttcctattctaaatctccacaaagaatacagcaagtcgcaaatgcaattttctgctccaattccagctcttcaattcaaactcttacaaaggttgtgtgcccccaatctcattctcaaatgaaaaaattccttgacaatagagaacaagacatggcaagagggtattgcatattaccaacttctgatactcgaaatactaatcatactgacttgtatcacatagagacaccagtggaacatagcaacaaccctgaatcatatcaaatagttgaacaatttaaaaattctgtttgctcagtatgcaataacagaagaccaaaatttgaaccactgaaagaattcacatacgcggagctgcatgaagccacacagggttttaccccaaagaactatttgtcagaaggtggatttggttctgtctacaaagggaagctgcaaggaggactcaggattgccgtgaagcaacacaagtgtgcaagcttccaaggagataaggaattcaaatctgaagttaatgcactcagcagagcaatacatgagaatgtggttatgctgcgtggatcttgttcagaaggaaataacaggcttcttgtgtatgaatttgtttgcaatggctcgctcgaccaacatttatcgcgtaagagaaaaattttgataggagagactaactatgactacaatgatgcagaacactcacgtaaacctcttagctgggcagaaaggatcaaagtagctattggagctgcaaaaggcttattgttcttgcatcagaacaatataatacacagagatgtgagacctagtaacatccttgtcacacatgactatgaagcaatgcttggagattttggtctagctagaactgaacaaatggactccttatactccacagatgtagttggaactatagggtatttggcaccagaatatgctgaatctggaaaaatgtcaaccaagacagatgtgtattcttttggtgtggttcttcttcagctaataactggaatgaggactgcagacaaacggcttggagataaaagtcttgtgggatgggtaacaatctaa

SEQ ID NO: 65584 - DNA, 450 bp, Glycine max
  Peptide Sequence Number=SeqID_182362
atggaaggtgggtacggaaaccgtggttcctctttctcccaatcacgtcgtggtcgaggtcgcggtcgcggtcaaagatttccttcgaatcaatccaaagtttcaagttttgccgaaaggggcactccttcttctagtagtgccaacagagcttctgcctctgttatcagtaacacgctagaagacgacgcacaaccatcttccaattttgttggaacatgtccttacatgtgcccagggattgggcgtagcaaaagagttttaaggacacttattcacaaggttatggttgcgattactaatgtggctgaaaattggaaggaaatactagggagatttgcaccaatggaccatgacccaccacataagggtcagtcttcccctcgagcggaagtcattatcatctacatcagggagatttacaccaatgaaccacgagccaccacataa

SEQ ID NO: 65585 - DNA, 225 bp, Glycine max
  Peptide Sequence Number=SeqID_182363
atgcaatcgacaagattgactgaattatgtgcgagattggtttttctaacacaagcaacatctgatgttgttgctagtcttgacaaggttgatcaacaagtaggagatacaagggttgtggacaaggtcaaagttgttaaaccacctaaactagtgacaagaagcaaagtcaaaagtaggaatcgtgtgtatcaagaagtcagtagccttcctgttggacaataa

SEQ ID NO: 65586 - DNA, 3570 bp, Glycine max
  Peptide Sequence Number=SeqID_182364
atgccagtactagaaacccttggtggtgctctttttggtgctgtccttcaggtgctgtttgacaagctggattctcatcaagttttggattactttcgtggaagaaagctcgatgggaggctgctgaaaacgttgaagtggaagctgatgtctgtcaatgctgtgcttgatgatgcagaacaaaagcagttcactgataaaaatgtgaaagaatggcttgatgaggtcagagacgtgttgcttaataccgaggatctgttggaggaaatagactacgaattcaccaaaactgagttgaaagctgaatcccagaccagtgctagcaaggtatgcaattttgaatcaatgatcaaagatgtccttgatgaactagattctcttttaaatgtaaaggatactctacgtttgaaaaatgttggtggtgatgggtttggatcaggatcaggtagtaaagtgtcacagaaattgccatccacatctttggtggttgaaagtgttttttatggaagagatgatgacaaagatatgatccttaattggctgacttctgacacagataatcataacaagatatcaatactttcgattgtgggaatgggtgggatgggtaagaccactcttgcccaacatgtatataacaacccaaggatagaggaggctaaatttgacatcaaagtctggatctgtgtttcggatgattttgatgttttgatgttaagcaaaacaattcttaacaaaatcactaaatccaaagatgacagtggagacgacctagaaatggttcatggaagattgaaagaaaagttgtcggggaataaatatcttttcgttctggatgatgtttggaacgaagatcgagaccaatggaaggctttacaaactcctcttaaatatggggctaagggaagtaaaattcttgtcacgactcgcagtaacaatgttgcttcaaccatgcagtcaaacaaagtacatgaactaaagcaattacgagaagatcacagctggcaagttttcgctcagcatgcattccaagatgattatcctaagttgaatgctgagctgaaggagattggtataaagataattgagaagtgccaagggttgcctctagccttagaaacagttggatgtcttttacacaaaaagccatctatttcacaatgggaaggtgtattgaaaagcaagatatgggagttaccaaaagaagaaagtaaaatcatccctgctttattgttgagctatttccatcttccttctcatctcaagagatgtttcgcttattgtgccttattccccaaagatcacgagttttacaaggagggtttaattcagttatgggtggctgaaaattttgtacaatgctctacccagagtaatcctcaagaagaaattggtgaacaatacttcaatgatctattatcaaggtccttctttcaacgatcaagtagagaagagtgttttgtcatgcatgaccttctcaatgatttggcaaaatatgtttgtggggacatctgtttcaggttacaagttgataaaccaaaaagcatatcaaaagtccgtcatttttcatttgtaactgaaaatgatcaatattttgatgggtacgggagtttatatcatgctcaaaggctacgaacatttatgcccatgactgagcctctactacttataaattggggtggtaggaaactagtagatgagttgttctcgaagtttaagttcttacgcatcttatctttgtctctttgtgaccttaaagagatgcctgactctgtaggcaatcttaaccatcttcgttcgttagacctttcctatacttccataaaaaaactacctgattcaatgtgttttctctgtaacttgcaagtcttgaagctgaatttttgtgtccatttggaggagctaccctcaaatttgcataaactcaccaatttgcgctgtcttgaatttatgtacactgaagtgagaaagatgccaatgcatatgggaaaactgaagaatcttcaggtgttgagttcgttttacgttggaaagggcatcgacaactgcagtattcaacagctaggggaactcaatcttcatggaagcttatcaattgaggagctgcaaaatattgtgaatcccttggatgcattggccgcagatttgaaaaataaaactcatcttctggatctagagttagaatggaatgagcaccagaaccttgatgattcaataaaagaaagacaagtacttgagaatctgcaaccttcaagacatttggagaaattgtcaattcggaactacggtggtactcaatttcctagttggttatcggataattcattatgtaatgtggtgtccttaaccttgatgaactgtaaatatttcctatgtttgcctccccttggacttttgccatttctgaaggagctttcaattggagggcttgatgggatcgtgagtattaatgctgattttttcgggagtagctcttgttcatttacatccttggaatctttgaagttcttcaatatgaaggaatgggaagaatgggaatgtaaaggtgtgacaggtgcttttccacgtcttcaacgtctttctatagaggattgtcccaagctgaaagggcacttgccagagcaactatgtcatttaaattatctaaagatttctgggtgcgaacaacttgtaccttctgctctcagtgccccagatattcatcaattatacctagtagactgtggagagctgcaaattgatcatctaacaactttgaaagagcttaccattgaaggtcacaacgtggaggcagccttactcgaacagattgggcgcaattactcttgttcaaataacaatattcccatgcacagttgctatgatttccttctaagcttggacatcaatggtggctgcgactctctaacgaccattcacttagatatcttcccaatactcaggcgacttgatatcaggaagtggcctaatctaaagaggatttcacaggggcaggctcataatcatctccagactctgtgtgtcggatcgtgcccccaattagaatcattgcctgaaggaatgcatgtcctccttccatctcttgatgatctgtggatagaggattgtccaaaagttgaaatgtttcccgaaggaggtttgccatcaaatttaaaaagtatgggtctctatggtagttacaaacttatgtccttattgaaaactgccttgggaggcaatcactctctagaaagattatctattggaggagtggatgttgagtgtcttcctgaggaaggtgtactgccacactctcttcttactctagagatcaggaactgtccagatctaaaaagactggactacaaaggtctctgccacctctcctctctcaaggaattgagtcttgttggctgccccaggctcgaatgcttaccagaggagggtctgcccaaatccatttcaactttgtggatttggggggactgtcagttgctcaaacaacgttgccgggaacccgaaggcgaagactggccaaagattgctcacattaaacgcgtgtcgttattaggtaatgatgttgatgtttaa

SEQ ID NO: 65587 - DNA, 366 bp, Glycine max
  Peptide Sequence Number=SeqID_182365
atgttggaagcacggagagaggcaggaatatggtgggagagggttggaacagaggaggaaggggggttaaggtccactaaatctgcaaagtacaaactgatgaggttgataaagcaaggtgttggtttaaagcaaggtgttggtttcaatgtggaatttggagacgacgagggcgatactcatgacgaccatgaggtagaccacgagggcggaggtggaagcgagttggaggcacctagcagtgggggagggggtgaggaaggcaaggaagcatgggaggggggagaaggcaaaactagtggtgatgaggaaaggggagctgctagaggcggagtgagcagacaagatagaatggcgcacggttga

SEQ ID NO: 65588 - DNA, 237 bp, Glycine max
  Peptide Sequence Number=SeqID_182366
atgttgcctggactggcaggggtgccaatgttgaagattacaaagttctccttgagaatgactgcccaggaaagagaaattggaacaactccttgttgtgatgaggcaaatgtgaagagaggaccatggtcaacagaagatgactccaagctgaaggagtacatcaataagtatggcatcagaggcaattggattggtctacctctgaaagctggtataaaatatatacatgtgtga

SEQ ID NO: 65589 - DNA, 318 bp, Glycine max
  Peptide Sequence Number=SeqID_182367
atgacttgttggtcatgggttcgaatccggaaacagcctctttgcatatgcaagggtaaggctgcgtacaacatccctcccccataccttcgcatagcaaagagcctctgggcaatgggccacaagacaattaattcccaccatctggtacataggatagcccccttaactgaccatagcaaacctcctaaccaaccccaactaacttatgtttacaattggcttactcctcttcctaacattgacctgtttaactataggtctgctatcagtcagccacatggtgggaatcttactacttcaagacataaaccataa

SEQ ID NO: 65590 - DNA, 429 bp, Glycine max
  Peptide Sequence Number=SeqID_182368
atggaaggtaccaaactcaaatttagtttggcttaccaccctcaagctgatggccaaactaaggttgtcaatagatgcatagagatgtatttgcaatgtttaacaagttcaaagcgtaagcaatggccaactgtctcagttgggctgagtattggtataacaccaataatcatggcaccactgcatttgcctgctagcagctgtctactcctgttgatattcaagcattgcttacctttctatctgatgagtgatgaatgggagcttgagatacagcctgacgcagcaaaggtgctggattacagaatcaatacagaggatctcaccaagacaacggttgctacagataagtcacaaaatgaagaacaatccaaagtcattgaagagattgcagaggaaaagacaatcactgaggtgaatagtgattaa

SEQ ID NO: 65591 - DNA, 1113 bp, Glycine max
  Peptide Sequence Number=SeqID_182369
atgacggtgatgacgatgagtgtgacggcgaagacaaccgtgacgattgatggcagtgacaacaactggttgaggaggataatcgcagcgatgagagtggaggagttgacaaagctaaaggttgaccatgaccaactgggggctcgtctcaaacattcccaaggcgacgagaaaactgcccacaccttgcctgaacacacccaaggggaatcacacccccgacacacaagtaacactgcagatagcttaagtttctcccacatgcaccgtccagtagggtggactatctatcagaatgcttttgtcaattgcattatggaggcagacatacccttagggtggaaaccacttaacctcgaccggtacgatgggacaacaaatacaaacgagcatctggatgctttcctgacacaggcaaacctctacaccaatgacgacacgattctatgtcatgtcttccctatgtccctcaaggtggcaacattgacctggtcttactgcatgacctcgaccgccttagccagtttgcgaccagaagacgatgaataccttagaaaactcatggacagatttgggcgcacaggtgtccagatccaaaatcttaaccccaaggtagcattgcattccatgttcatcgccttacacccaagcaagatcatagatagtctgcgcgaaaaaccacccggttgcatggatgagctatgcgagcgagccaagggctacatccagatggaagaaatgtctagattccggaatgaagtccaccaagccggacagaggcacgacaagaacgaatcaaacaccaaagccaacttgcacaagaagcattcaaccttgaggtacccatccgactaccccagacgaaacctcctaggtcgggctcagaagcaaccaaatactacagatatcatcgtggctgggtacttagccaagtttgttaagagactagacagtcaccaagtaggagcaaaactcgaaggacataaaagcacaggaaccaggaagcagacagaagaagagcaaaagactgaggctgacaaagacactagcaacaacgatgtgagcgacaacctccacaagaataggaacctgcccagcaaatcagaggtgtaa

SEQ ID NO: 65592 - DNA, 1206 bp, Glycine max
  Peptide Sequence Number=SeqID_182370
atggaaaaggtcaagaggattcaagacaacatgaaggttacccataaaacttcagggactttcccagttggggccaagctttcccgcacagggatcttttctggctttacctcggactcacctaacgagattgccaagttgaaaggctcatgttccaacctcatattttcttcatcttgctattgctggaacaatagtctccttgtcgacggttcccggacttcaatggggatcatggcatctgtgccatatgcccttagacttgtcgagtctagtacgcagggccctgaggatgactctattagctgccgctacatgttcgaattcttcgtaagtttgagctttgaattaagtgtcaatggcgtatgggaggtcgtacctacaaatgaggatgtccattcctcacatggagaaaggccaaagggagctcagactgtgaagattgttaggaggagtgtgtggcacgtctgcaaactcttggcatcgcctggacctcttgggagtcatccagtttggttcttcctcttcttcggccataatttcctcaacatctatgatgggagtttggaacatctcttggatgatgatcttaaggtgcccagccttcttggtgcagcccagcttagagagcaggctttaaagttgagcttgagagctcattctagagtgatattgtcagggccttcgaggatgacccttgcctcgctttgttttatgttggatgcaccgtcaatcaatacgccggtgctagtgactggtgaggtccctactaagccgcatgcattgcccgggtttaggatcaagttgtacttggtagacgaccagggctcaaatttgagacacttcgtccatagtcatgaattgagtgccttcagcagttatgagacatctgatggtgaagctcctggagagcttaccttgaccaaaggtggtcatcaagtccacgtaccctttggtctctgctctctcacctacaaagccgaggaatggaccggagtgaggatggacggtgttggtttagacctcgagtctctagaaggttttctagtacaggatatcaattggattgctcttattgatgagggccttggacattatgaagttcgcaatgatgatggagacaaccatagggtcgtccttgttgacagggttgatgcccttgaagtccctgtccgtgaaggtgataggagggagacttcgctataa

SEQ ID NO: 65593 - DNA, 761 bp, Glycine max
  Peptide Sequence Number=SeqID_182371
atggcccgcaccaagaaaactggtcaaatgacatctgaggcagcaaaggaaattgctaacaagattgagcatgcctcacaaggaagctttgtcgcccatggacatcaggatgacctcccatgcatcttcatccatggctcccaaacacctggagtagctaatgcaaaaaatcagggaccaatgcaatcacaaggactcacactgcctcctgagcctaaggttagtccttctgctgctcgtgtcagcacaaaggagagttatgttgatccctcagggaacgacccagacacgggtgagtcagagaaatgtggattgtatgtcgaagaaaatcctccccgtctggttgcctttagaagactttatgaggggtcgaccaccattcacaacatccctttaggaaatgatcaagtgaaggttggtgttgaggaagttcgcaatgctgatgctcgcattcctgtacccactcaagaggttcagttaatggggcagacacttaacactttcccttcttggccaacacatcttgtcaagcgtttcccagaacatgataaatatggagctgtgggaccggcgaaacctgcaaataggtcagatcctgatgtcaatgatcccctatatttaatgacattgactatcccacagctttttctgaagccgttggatagagaaattggaacaactccttgttgtgatgaggcaaatgtgaagagaggaccatggtcaacagaagaagactccaagctgaaggagtacattgagaa

SEQ ID NO: 65594 - DNA, 156 bp, Glycine max
  Peptide Sequence Number=SeqID_182372
atggcttcatacagagctcattttgctgaggtgtgtcagaaagtgagttatgagcctaacgcaacactacaaaagtggctttttatcatgacggtatctttactcgatgtgggacttcaagatgtccccttttgtccacggctactcgccatgtga

SEQ ID NO: 65595 - DNA, 501 bp, Glycine max
  Peptide Sequence Number=SeqID_182373
atggcaaacctagttcttgatacgaggaagaagataacagagataagcagcagcacagagcaacatatatcagaagcaagcaaggaacacgaggagaatcaccacatccagcacactcagatcttgaagccaaggaccttcttggctactttctatccaaagcctatgacgtctgccacttctgctgctgcatgggaccgacttaaaaagcactatgctagtaggtcacataatcgcatcatgtccctcaaggagagtcttgcttcaataacaaaagacaccttaagtgtcactgaacgtctgctatccattttcccgttggctgatgaactctcacttattggtcgtcttgttgatgatcttgatttactcatcattgggttaaagggacttggccctgcatttcatgaattctctgcctccattcgagaatgtgattctcccttgttgtttgctgaacttttcaacaaacttgttgatagagatttttctccggcatga

SEQ ID NO: 65596 - DNA, 435 bp, Glycine max
  Peptide Sequence Number=SeqID_182374
atggccccccgcactgataaacctgacaaatctgtcgatgaggtcagtgcccagtttcgagaaatgcaattgtgtcttgaggcggtcaccaaacaacaaacagatttccaaaattttctcaccacacaattaccccttctcatacgtgaacaaatttcttcccaatctgcagcccattcatcctctccggttcgaaccgacccgccacaatcaaccatcaaattacccaaaataaccctatcttcctttgatgggaaagatcctcttgactggatcttcaaggttgaacactattttgacctaacggacacaccacccccccgccgcctcattctcattcccttcttccttcaaggtcctgctcttagttggttcaaatggctccattccaaccatttactcacaacttggtcggaatttctccacgcccttgag

SEQ ID NO: 65597 - DNA, 276 bp, Glycine max
  Peptide Sequence Number=SeqID_182375
atgaagcgaggaagaagaattcttgaaagaagaagtcatttctctcgaaggaagaagaagaagcggttttcagaaatgaacaatgactcgtacggacgagtcactgtaccgcttttatatgaaagggtgaagggcatttttgccctttcactcacgttgctgggtgtcccagcaaaaatgttgggtgccccaaacaactgccaacccttcccttcctttaggtctgctctgcaactctttttctattgccactctaatcaagccacgtcattgtag

SEQ ID NO: 65598 - DNA, 1365 bp, Glycine max
  Peptide Sequence Number=SeqID_182376
atggcaaggccacatgtaatggttgtaccttacccagcacaagggcatgtgattcctctaatggagctttcactgctcttaatcaaacaaggtatcaaaataacctttgtgaacaccaaagacaaccatgagaggatcatgagtgcattgccaagtgggaatgatttatcatctcaaattagtctagtgtggatatctgatggattagaatcctcagaagagaggaaaaagccgggtaaatcatcagaaacggttttgaacgttatgccacagaaagttgaggagctaattgaatgcatcaatggatcagaaagtaagaagatcacatgtgtgcttgctgatcagagcattggatggttacttgatattgcagagaagaagggaattagaagagcagctttctgtcctgcatcagcagcacagttggtgttgggattgagcatcccaaagttgattgatagagggatcatagacaaagacggaactccaacgaagaaacaggtcattcagctatcccctacaatgccaagtgtaagtacagaaaaacttgtctgggcttgcgtggggaacaagattgctcagaagcacattttccaactcatggtgaaaaacataaactccatgcaaaaaactgagtggcttctttgcaattcaactcatgaacttgagcctgcagcattttctctggctccacaaatcatacctatagggccacttctttcaagcaatcatcttcgccactctgcaggcaatttctggccacaagacctcacttgtttaaaatggctagatcaacactcaccatgttcagtaatatatgttgcatttggaagcttcacaacttttagtccaacccagttccaagaactgtgtttaggtcttgaacttaccaatagacctttcatttgggttgtgcagccagatttcacagaagggtcaaaaaatgcatatccagaagggtttgtacaaagggtggcggatcgtggtataatggtggcatggtcaccacagcagaaaattctgagccatccttcagttgcttgcttcataagccactgtggttggaactccacactggaaagtgtcagcaatgggatcccagtgttgtgttggccatactttgctgatcagtttctaaataggagctatgtttgtgatgtttggaaggtaggattggggctagaaccagatgggagtggcatgatcacacgaggcgaaatcagaagcaaaatcaagcaacttttggatgatgaacaattgaaagaaagggtcaaagatttcaaggagaaagttcaaattggcactggacaaggtggtttgtcaaagaataatctagacagcttcataaggtggctaaaaacttaa

SEQ ID NO: 65599 - DNA, 648 bp, Glycine max
  Peptide Sequence Number=SeqID_182377
atgttgatttgtgaggcaaagtattggtggcatggagctagtcaactcatggaatctagtgaagaggctatcacaggggcaagcttgaaagaacatttcctaagaaagtattttccaatagaaggagaaagaattgagatacagaaaacaatcatcccggtgactattagagagttcccaaagctagttgaaaggatcaagacagttgagtgtcttgagtatgatgttggatttatcactgccaaccaagcacatgctgctttggaagaaaaagctcaaggatacatggttctatcttttctagaagtcaaaagttatctagacctaaactttgtggatgttgttagacattttgccaaagtttctccaaaagatatacatgatttgtctctaaagcgagagatcaagttcatcattgatttagttcttggagtgagaccagtgtcgattgtaccctatagaatggcacctgcagagttagttatgttgaagaagcaagttaaggaattgcttaagaaacaaatgataagactcaatgtttcaccttggggagcaccaatattgttggtgaagaaaaatgatattggttcaagactatgtgtggattatcgtcagttgaacaaggtcacaatcaagaataagtactag

SEQ ID NO: 65600 - DNA, 591 bp, Glycine max
  Peptide Sequence Number=SeqID_182378
atggcagcagaatttgttggtggtgctcttctttcttctttccttcaggttgtttttgacaggctggtttctcgtcaggttttggaatactttcgtggaagaaaactcgatgagaagctactgaacaagttgaaggtgaagctacggtccattgatgctctggctgatgatgcagaacaaaagcagttcagggatccaagggtgagagagtggcttgttgctgtcaaagatgctgatattcctataaatagaatgaatgcaacgaagaaagaggatctgttggatgaaatagactatgaaatcaacaaatgggctgtggagaatgattctgaatctcaaacctgtacctgcaaggaatcgagtttcttcgaaacatctttcagttcatttaacatgaaaattgaatcaaggatgaaacaagtccttgctgaccttgaatttctctcaagccaaaagggtgatcttggtttgaaagaggctagtggtcttggggttggatcaggtagtaaagtgtcacagaaattgccatcaatatctttggtgactgaaagtgtcatttatggaagagataatgacagaaattatccttaa

SEQ ID NO: 65601 - DNA, 3561 bp, Glycine max
  Peptide Sequence Number=SeqID_182379
atgccagtactagaaacccttggtggtgctctttttggtgctgtccttcaggtgctgtttgacaagctggattctcatcaagttttggattactttcttggaagaaagctcgatgggaggctgctgaaaaagttgaagaggaagctggtgtccgtcaatgctgtggttgatgatgcagaacaaaagcagttcactgatgcatatgtgaaagcatggcttgatgacgtcagagacgtgttgcttgataccgaggatctgttggatgaaatagactgcgaattctccaaaactgagttggaagctgaatcccagaccagtgctagcaaggtatgcgattttgaatcaaggatcatagatgtccttgatgacctagattctcttttagaccaaaagaatgatctaggtttgaaaaatgttagtcatgttggggttggatcaggatcgggtagtaaagtgtcacagaaattgccatccacatctttggtggttgaaagtattatttatggcagagatgatgacaaagaaataatccttaattggctgacttctgacactgacaatcataacaagatatcaatactttcgattgtgggaatgggtgggatgggtaagaccacgcttgcccaacatgtatataacaacccaaggatacaggaggctaaatttgacatcaaagtctgggtctgtgtttcggatgattttgatgttttgatgttaaccaagacaattcttaacaaaatcactaaatcaaaagaagacagtggagacgacctagaaatggttcatggaagattgaaagaaaagttgtcggggaataaatatcttctggttctggatgatgtttggaacgaagatcgagaccaatggaaggctttacaaactcctcttaaatacggggctaagggaagtaaaattcttgtcacgactcgcagtaacaaggttgcttcaatcatgcagtcaaacaaagtacatgaactaaagcaattacaagaagatcacagctggcaagttttcgctcagcatgcattccaagatgattatcctaagttgaatgagcagctgaaggagattggtataaagatagttgagaagtgccaagggttgcctctagccttagaaacagttggatgtcttttacacacaaagccatctgtttcacaatgggaaggtgtattgaaaagcaagatatgggagttaccgaaagaagatagtaaaatcatccctgctttattgttgagctattaccatcttccttctcatctcaagagatgtttcgcttattgtgccttattccctaaagatcacgagttttacaaggatagcttaattcagttatgggtggctgaaaattttgtacaatgctctcaagagagtactcctcaagaagaaattggtgaacaatacttcaatgatctattatcaaggtccttctttcaacgatcaagtagagaaaagtgttttgtcatgcatgatcttctcaatgatttggcaaaatatgtttgtggggacatctgtttcagattaggagttgataaaacaaaaagtatatcaaaagtccgtcatttttcatttgtacctgaataccatcaatattttgatgggtacgggagtttatatcatgctaaaaggctacggacatttatgcccacacttccaggacgagatatgtatatttggggttgtaggaaactagtagatgagttgtgctccaagtttaagttcttacgcatcttatctttgtttcgttgtgatcttatagagatgcctgactctgtaggcaatcttaagcatcttcgttcgttagacctttctaaaacttacataaaaaaactgcctgattcaatttgttttctctgtaacttgcaagtcttgaagctgaattcttgtgaccatttggaggagctaccctcaaatttgcataaactcaccaatttgcgctgtcttgaatttatgtacactaaagtgagaaagatgccaatgcattttggaaaactgaagaatcttcaggtgttgagttcgttttatgttggaatgggcagcgacaactgcagtattcaacagctaggggaactcaatcttcatggaaggctatcaattgaggagctgcaaaatattgtgaatcccttggatgcattggccgcagatttgaaaaataaaactcatcttctggatctagagttaaaatggaatgagcaccagaaccttgatgattcaataaaagaaagacaagtacttgagaatctgcaaccttcaagacatttggagaaattgtcaatcgggaactacggtggtactcaatttcctagttggttattggataattcattatgtaatgtggtgtggttaagcttgaagaactgtaaatattgcctatgtttgcctccccttggacttttgccacttctgaaggagcttttaattggagggcttgatgggattgtgagtattaatgctgatttttacggtagtagctcttgttcatttacatccttggaatctttggagttctacgatatgaaggaatgggaagaatgggaatgtatgacaggtgcttttccacgtcttcaacgtctttatatagaggattgtcccaagctgaaagggcacttgccagagcaactatgtcaattaaatgatctaaagatttctgggtgcgaacaacttgtaccttctgctctcagtgcccctgatattcatcaattattcctaggagactgtggaaagctgcaaattgatcatccgacaactttgaaagtgcttaccattgaaggttacaacgtggaggcagctttactcgaacagattggacacaattacgcttgttcaaataagaatattcccatgcacagttgctatgatttccttgtaaagttggaaatcataggtggctgcgactctctaacgaccattcacttagatatcttcccaatactcggggtcctttatatcaggaagtgtcctaatctacagaggatttcacaggggcacgctcataatcatctcgagactctgagtatcatagagtgcccccaattagaatcattgcctgaaggaatgcatgtcctccttccatctcttgattctctgtggataattcattgtccaaaagttcaaatgtttcccgaaggaggtttgccatcaaatttaaaaaatatgcgtctctatggtagttccaaacttatctccttattgaaaagtgccttgggagacaatcactctctagaaagattatctattggaaaagtggatgttgagtgtcttcctgacgaaggtgtactgccacactctcttgttactctagacatcagtcattgtgaagatctaaaaagactggactacaaaggtctctgccacctctcctctctcaagaaattgcatctttctaactgccccaggctccaatgcttaccggaggagggtctgcccaaatccatttcaactttgagcatttacaattgtccgttgctcaaacaacgttgccgggaacccaaaggcgaagactggccaaagattgctcacattaaacgcgtgtcgttacacggtaatgatgttgatgtttaa

SEQ ID NO: 65602 - DNA, 282 bp, Glycine max
  Peptide Sequence Number=SeqID_182380
atgagtttctggagaaccacgacgcgcgtccgcagcaacacgatgtactctgcggtttccttgaacagctggtcgggtttcaccgcttcttcttctccatcgtgggttgttgttgttgttgttgttgtggggattaagtgttgtgaatttctgggttacactgtctggggtgtgaatgtgatcagagaagagagggttctgggtttaagtaatggggattcaagagtttgccacttgatggtgttggttactacggaaatgccactttcctttttgttataa

SEQ ID NO: 65603 - DNA, 369 bp, Glycine max
  misc_feature (21)..(21): n is a, c, g, or t
  misc_feature (37)..(37): n is a, c, g, or t
  Peptide Sequence Number=SeqID_182381
atggagaacaatgatggtttntggtggctaatggtgnctgtgggtgatggagaaagttcttggaactttagaaatggctttggaagaaagaaagaagaagaaaatgacgttttttctaagctacacgaaagcaaagaggcttcctacaaaagcttcattaagaggagtctagcacactccagacatcttctcaaagatcccaatggtcagattatggacaattgtcttttgaagttgcagaccaaatttcgagaagatccaacggttaatgaaggttggacagtgtttttacctaggcagcttcatgtagctttctctagaagcttcattaagaggcttcctccagaagcttcctcgtggcttctttga

SEQ ID NO: 65604 - DNA, 1632 bp, Glycine max
  Peptide Sequence Number=SeqID_182382
atggttagcactcaatctggcctcaaacgcgagactctttttgaaagctccaacccttcactagcagttatgacagacacaaatactcttcagcaactccaaaaccgcattacaaagatggagcgatgccatgagaaggagctgagaaagctaaatgctgactatgatcggccggagacttatgtcagacgtccccaagacaacgagctcttcgctcacacaatgcctgagcgcacccaaggggaatcacaccctggacgcacagtcaacactccaaatgacttaaatttctcccacatgcaccgtccagcagggcagactactcatccatatgagcatctagacaccttcttgactcaggcgaatctatatactaataatgatgtgatcctatgtcacgtcttcccaacgtccctcaaaggagtggcattgacctggtatagtggagtcccaccaagatccatagacagctttgacacctttgttgaacgctttaatggcgagtccctcagaaaattcatggacagatttgggtgcactgctgtgcaaattcaaaatcttaacccagaggtagcgttgcattccatgctcctcgccttacgacccgacaagcacaacccagacaagcgttacacacccctgacggtcaatcacactacaattcttgaggaaactttcaacttggaggtacccatcaagctacccctaacggaacctcccaagtcggggtttgacgcgaccaaatattgtagtttgtcaaaaggttggacaaccattaagcaagaacaagacctggaagacaccaagaagagcaacatagaaaccacgaagcagacaaaagaagagatagagtggaagattgaggtagatagagacaccaacaacaacaacatgagcgataaccttcacaagaacagaaactcacccaacaaatcggagcgaagtctccctcctatcactttcatggatagggactttaacggtatcaatccccttaaccaggatgacctcgtggttgtctccatcatcattgcaaacttcatggtttccaagagacccgaggtctgccctcacactgtccacacttacaccagtccactccatggctttgcaggtgagatagtagagaccaaagactacgtggacttaatcactactttcggtcaaggccagctctccaggagcttcacaataagatatctacttgttgatgcagacacatcatattttgctttgatcggcaagaagacacttaatgagcttggagccatagtctccatgccgcatttgaaaatgaaattccctaccctaaccggggagattgtaaccatcaagatcaggatgcatgctccagacgaggagaaaacgacattcatcactgaagatgacaacttttgtgcaaggcaagttcctcggctttatgatcactcaccagggattgaagccaatcccgaaaaatgcactgccatactagagatgcgcaacccgaccaacattgaagaagtccagaaactaaatggaaggctagcatccctgtccaggttcctcgtgaagctcgccgaaaaggcaaagccattttacaaactactcaaggaaattgggcccttcctatgggacgagacttgcgaataa

SEQ ID NO: 65605 - DNA, 165 bp, Glycine max
  Peptide Sequence Number=SeqID_182383
atgtgggagaaatttaagtcatttggagtgttgactgtgcgtccagggtgtgattccccttggtcccatggtaggcgccaaatgtacttaccaaaatctagagctagcacacgtcagggtggatgtggccaaagtggggtcttggaattcgtacgttggctttga

SEQ ID NO: 65606 - DNA, 1110 bp, Glycine max
  Peptide Sequence Number=SeqID_182384
atgggtgacttcatctgtaggccacttatgaagcagatcgaacatgtgggtggtgttatgctactgtctactgctcctgttattggagaagagggtcaacctcctgctgagaagtcgagggccccttcgagcattcttgccctaaggaaagttgcagggttgacgtccggtgtgggtcgcccttcaagtgtgcaggatgttcctctaactccatcggtcatcgaggctcctgctgctaatgttgttattgttattactcttgatcctccacctaggcatggcaataggacggggcgagccccacaggtcgatcttattactgctgaagagagtgtgccagctgctttggctagttctgttgtagcatcctcgtccaccaccgttgcgcctttattaagtgttggtgtggtgaccaccaatgcccttgtggtgcctcctctttccccttcgactccaatgggtgcaaacccaaacagaagaccccgaatggctttgtctcagcctttgaaaaaaaatcttattaggtcaattgagtttcaacacgctatagattctgccaagaggctgaagttgccaaatggagggcgactacttgcactgtctagagagtggaacaccataagtgtgttggccaagttgctgcacaacaggttggacggtgatgaactgcaagaagagaaaaagaacttggttggcaggatggaggacgttgcggcggagaaggatgagccttccaagaaggagtcagagtctaggctggaggagttcgagctgcaggctgctagggacagggaggtcaacagggagcttgaggaagagctgctcattttcaagaaggagggcttcaacaaggctgtcaggcaagttgggttcttcgccaaggaacttagcttaggtctttttaacccattcaaggacgtgaaggacgatgttctgcttgacgaggacgatattgttgtaaaggaagaggctgttgtaaggagcagggatctgaagttgagcttgagggcttgctctaggatgacgttgctagggccttcgaggatgattcttgcccccacttccttttacgttggacgcaccgtccacatagaggctccaccagtttaa

SEQ ID NO: 65607 - DNA, 507 bp, Glycine max
  Peptide Sequence Number=SeqID_182385
atgaattcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaacgtcacttcccatcttcttcagcttcacctccacacttcaccttctgctttctatcatgactatgattaccagtatctcttcgatgaggaagcttataggagatggagctttggtggagagataagtccttgtttggctgatttaaagcatttgaattacttggacttgagcggcaatagatttcttggagaaggtatgtcaattccttctttccttgggacaatgtcctccttgactcacctagacctctcttatactggattctatgggaagattcctcctcagattgggaatctctcaaatttg

SEQ ID NO: 65608 - DNA, 150 bp, Glycine max
  Peptide Sequence Number=SeqID_182386
atgtgtctattggggaaggaggaggaaacactgggtccaacaaagataggagaaaatcactcaaagtgtatcaatctcacacagtgcgtggcgagaaagttgctagcgcacaggattttgtcggcaatcaaagggagaggatcactttag

SEQ ID NO: 65609 - DNA, 597 bp, Glycine max
  Peptide Sequence Number=SeqID_182387
atgatgcttaagatgctggaaaaacaagtgaagccgaaacagcgtgatgcttaccattgcttgcttggcctttatgcagggaccggtaatcttggggaggttcatagagtgtggaattccctcaagtctgtctcccctgtcaccaacttcagctatcttgttatgcttagtaccctccgaaggcttaatgatatagagggtgctcacttgaatcagaacaagctggaagaagctgaatcggtatttgaggaggctagcaggaggagcaaagggcctttctttagggttcgggaagagttcatgaagtttttcttgaagaagcatcagttggatgctgctgtgaggtacttggaggcagcgctttcagaagtcaagggtggtaaatggcgtccttcaccacaagttcttggggcttttctgaagtactatgaagaagagacggatgtggatggtgttgatgagttgtccaagattctcaaggctaacaatttcgatgattcctggattaaaaatcacattactgcgtccgaattgtctcctgaaattgatccaggattcaaggaagattctcgagtctaccatgcacaggagaactag

SEQ ID NO: 65610 - DNA, 955 bp, Glycine max
  Peptide Sequence Number=SeqID_182388
atggtgtttggcgatttcttcaggaacgtgatttttgtcaatcctgaagcgcatccggccatggagcatctggcacatcattaccatgaatttatgcacagccctgctggcatggcgattcatggttttagcagcctgccatttatcctggcggcatctggcgtgttactgtcctggttcttctatatgaagcgcccggatatcccggcagcaatcaaggcgcgttttatcgtgatctacaatatcctggataacaagtacggtttcgatagctttaacgagaaattttttgccggtggttcgcgttgcctgggtaacctgttatggaagttcggtgatatcacgctgattgacggtgccatggtcaatggtaccgccaataccatgggtaaaatcgctgccaagctgcgtaacttgcaatccggattaatctatcactacgcctttgccatgattattggctctggccgtctggctaccggtactctccggtgtgctggtattggtgctaggggtttcctggtgacggtgcccttgtacacgcagtttgatgtacaggatggtttcttccagtttgaagagttattgccatgggtgccggcattcaatatgcattatcacttgggcatcgatggtttctccatgccgctagtgctattgaccagctttacaactgtgattgtggtgctggctggctgggaagtcattaccaaacatgtcgcccaatacatggcggccttcctgattatgagtggcatcatgattggcgtgttcactgcgctggatgccattctttattatgtattctgggaagccatgctgattccaatgttcctggtgatcggtatctggggtggacctaaccgtgtttacgcaaccatcaagtttttcctgtataccttgctcggctccttgctgatgctggttgcctttatttacctgtaccaccagacag

SEQ ID NO: 65611 - DNA, 135 bp, Glycine max
  Peptide Sequence Number=SeqID_182389
atgaaggaattgccagcagcaccagcggcagagtcaccacccagcctggaaatacaggcggaaggaatagaaggcggtgacaaacacgccgacaatcacggcaaaataggcaaagccgctaccaggaatatgtga

SEQ ID NO: 65612 - DNA, 540 bp, Glycine max
  Peptide Sequence Number=SeqID_182390
atctgcaccgacgaccgctccgcccgggctcgcgccctgggttttgcagcgaccgccgcgccctcctactcatcggggcttggtccttgccccgacggccggaactcgcccgcgggctccagctatcctgagggaaacttcggagggaaccagctactagacggttcgattagtctttcgcccctatacccaagtcagacgaacgatttgcacgtcagtatcgctgcgggcctccaccagagtttcctctggcttcgccccgctcagcatagttcaccatctttcggtcccgacaggtatgctctcactcgaacccttcacagaagatcagggtcggtcggcggtgcaacccacaggaggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 65613 - DNA, 184 bp, Glycine max
  Peptide Sequence Number=SeqID_182391
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtg

SEQ ID NO: 65614 - DNA, 447 bp, Glycine max
  Peptide Sequence Number=SeqID_182392
atgcccttacggagtaggattgcatcacttacctttagagggctacacgccctcgccttcaaagggctagacatcctcgccttcagaggactacacgtcctcgccatcagagggctgcacgtcctcacctttagaggactgcacgtcctcgccatcagaggactacatgtcctcaccttcaaagggcttcatgccctcaccttcagaggactgcacatccacaccttcagaggactgcgcgtcctcaccttcagaggactgcacatcctcgccatcagagggctgcacgtccttgccatcagagggctgcacgccctcaccctcagaggactacacgtcctcgccatcagagggttgcacgccctcacctttagagaactacgcgtccttactttcagtaggctccacatccattccttaagagaatttaaggtcctctgcccttaa

SEQ ID NO: 65615 - DNA, 225 bp, Glycine max
  Peptide Sequence Number=SeqID_182393
atgtttgaatgtggctcgagaatgcttcccaaaatgaacgaaatggctccgaaaaagctttccgcgaagaggtctaggagagatgtcgcggctgaagggatcagtgcctcccccgagtttgatagccactgtttccggagcgccgagcaccagcagcgcttcgaggccatcaaaggatggtcgttccacaaagagaggcgcgtccagctaagggaggatgagtaa

SEQ ID NO: 65616 - DNA, 819 bp, Glycine max
  Peptide Sequence Number=SeqID_182394
atgaaaaaagccgatttatatatccgtgtgtcaactgatgagcaggcagataagggatactcgcaaagagatcaggaggaacgattaaaacgttattgtgaaaacaataacattaaagtaggtcaaatcatttatgaagattactcagccaagacttttatcaggccagagtggattaaattactggatatgctaaagaaaaaaagctcaaaaacggatctgctgctttttacaaaatgggatcgcttcagcaggaacgctggcgatgcgtatcaaatgattaacatacttaggaaaattaacgttgaaccgcaggccattgagcaacctttagatctttcaattcctgaaaataaaatgatgctggctatatatcttgcagcaccggaagttgaaaacgacaggcgcgctctgaatacttattatggaatgcgccgtgctaaaaaagaaggcagattaatgggaagggcaccttatggctacgctaacagaataacggagaacggggaaaagtatgtaatcccgaaggaaccggaagcttccaatatgaaatgggcatttaatgaaatgtccaaaggcgtttattcagcgagccaaatcatggatatgatgaacagaaaagaaggaaagtcagttaagataagtgcctttcttgcaagtttacgcaataccgcatattgtgggaaaatttacgtggagcaattcaatgaagaggaggctcattttgttaaaagtattcatgaacctttgatcagtgaagaactattcgaaaaagttcaatgtataatggatggaaatgtgaatccagccagacctaat

SEQ ID NO: 65617 - DNA, 813 bp, Glycine max
  Peptide Sequence Number=SeqID_182395
atgggtagcaaaatatttgctcaacagatgattcctaagcaaattggtgttgaatttacctattcggtatttccaaaatctccagaaaagcaaaattatgtgtttagtacggggcttgtttcttactcgaagaatggtaattacttctttggactaacagaatttagcagaaaatattataaatacactagctgcgatattccgatagatacattcctgctgagtggtggttacagtttttatctatggggagacttcatgcgaaatgtcaatcttaatctgggaattggaggtcttgttggttatgaacaggttaatagaggcaatgaattgctatatgacggttcaatgttaacagcaacgaataattttatttatggagcaaatgctaaaatacaattaaagtgtttcttgctactatttgtgattggactatttttacaatcatgtgagaaagatgatttggaaattcagcagaattatccttttaaggtgtcggttatgcctgttcttaaggatatcgctaaagacgagtatgtggagatccgtatcaaaattattcctgaaggtaattttgctgacaccaaatattatcttcgatattttcagtttgagggaacaggaaagctgcagtattataacactcaaccttactttcctaatgatatttatcctctttatgagaaagagttcagattgtattatacttcaacctctgaagtttcacaatcatttacggtatggctctcagacagttttggaaatgaggagaaaattgaatttcaattcaacaacaaaaagctaaacggataa

SEQ ID NO: 65618 - DNA, 1050 bp, Glycine max
  Peptide Sequence Number=SeqID_182396
atgttgtgtgtgatttatggggtgacagacagcaatgaattgaatgtttcccaggaagggtatagtggtttttattctcgcaatacaattccattgacaccaaaggttgtgaatgacatccacaaacgtggtggaaccatccttggtacctcacaaggagaaggaggcaatgataccttaaagattgttgatagcatccagcatcggggaattaatcaggtttacatacttggaggagatggaactcagagaggggcttctgtgatttttgaggaaattagaaaacgtggcttgaaagtttcagtggttggaattccagaatctgttgataatgacatcccggttatcgataagtcattcggttttgacactgctgttgaagaggcacaacgagccataaatgctgctcatgtggaagcagaaagcactgagaatggtatcggtattgtcaaactaatgggtcgtcacagtgggtttatatctatgtatgcaactctagcaagccgagacgtggattgttgcttaattccagagtcacctttttaccttgatggtccaggtggactctttgagttcatcaggaaaagacttgcagaaaacgggcatatggttatagtaatagctgaaggtgcaggtcatgagcttatttcggaaagcctatctgctacaaataagcaggatgcttctggcaacaagttatttctagatgtcggtctgtggttatcacagaagattaaggaccacttcacaaaaagtcgaaagatggatataactctgaagtacattgatcccacctacatgatccgagctgttccaagtattgcatctgataatgtatattgcactctccttgctcaaagtgctgttcatggtgcaatggctggatacacgggcttcgcagctggcgcggtcaatggcaaacatgcttatattccattttatcggataaatgagattgagaagaaggttgttataactgaccgcatgtgggcaaggttactgtcttcaaccaatcaacctagcttcttgaaaccactgtcatctcattaa

SEQ ID NO: 65619 - DNA, 1182 bp, Glycine max
  Peptide Sequence Number=SeqID_182397
atggccgtgcctaactcccatcctcctccttcaataggcgtcattttcggttgccatataagttctcactttctgctgcactcaatgcatatccaaaggaacaaaaatattattaagatgatcaacattattggagcacttgttctactctttgcatttctcttcctcagttgtgtgtatgcacaagacacaacaacccttgtgcctgcaatcataacttttggtgattctgctgtggatgtagggaacaatgactatcttcccacccttttcaaggctgattaccctccttatgggagggactttgttaaccaccaacctactgggaggttttgcaatggcaaattagctactgatttcactgctgacacattgggtttcaagacctatgctccagcatatcttagcccacatgcatcagggaaaaacctccttattggagcaaactttgcttcagctgcatctggttatgatgaaaatgctgctactttgaatcacgcgattccgttgtcccaacagttgagttatttcaaggaataccaaggcaagctggccaaggtagctggcagtaaaaaagcagcctcaatcatcaaggatgcgttgtatgtgctcagtgctggaagcagtgactttgtgcaaaattattatgtcaatccttggatcaacaaagtctacactcctgatcagtattcgtcctacttaattggttcattctcaagttttgttaaggacttgtatggattgggaggcaggagacttggagtgacttcactcccaccattgggttgcctacctgctgcaaggactatatttggtttccatgagaatggttgtgtctcaagaatcaacactgatgctcaaggatttaacaagaagctcaactcagctgcaacgagtcttcaaaagcaacttcctggtcttaagattgcggttttcgacatttacaagcctctctatgaccttgttcaatccccttcaaaatctggttttgtggaggcaaacagaggatgctgtggtaccgggactgtagagacaacatccttgttgtgtaatccaaaatcaccaggaacttgttctaatgccacacagtatgtgttttgggacagtgtccatccttcacaagctgctaaccaagttctagctgatgcattaattctacaaggcatatctcttgtcacataa

SEQ ID NO: 65620 - DNA, 1920 bp, Glycine max
  Peptide Sequence Number=SeqID_182398
atggaaagaatagttagaaggtttttcaatgtggtaacaagagaagagaagggtatgaagcctttgctccagaaatgtggtttggctttggctcttacctttgctggatttctctactctcacatcagaaccaacgctacttcttccagagagcagcacccttcaggtcatggaaaggatgataattttggaagaggtaaaagggttgcatctagttcttgcagcactgtttcagaagaaaatgttttggataatgaagaaacatgcattggcaaggtgattagaaaaaattccccatcgggtccctctccaagaactagacaaagcggagagaaagatgagttcctccttcttgaatttaatgatcttaccaaggaagcagactttggagccaacatttcaggtagttcttttaaggagttagattatccaaagaaaaagaaagaggttgaaacgccaaggtcaaaattaggatctcctatggcatatgcaaatcttgacaaagatgattgtgagatagaaatcaggaaactcaggagcatgatcataatgcttcaagagagggaaacaaatcttgaggttcaactgcttgagtactgtggcattaaagagcaagaagcagctgtgatggagctccaaaatagattgaagataagtaatatggagacaaagatgttcaatctgaaggttgagaccctgcagtctgagaatcggagattagaggcgcaagttgttgatcatgcaaaactgatgactgagcttgagactacaaaaacaaaagttaagtttttgaagaagaaacttaagtatgaagctgaacaaaatagggagcatatcatgaatcttaaacaaaaagtagctaagttgcaagataacgaatacaatgcttctgctaacgaccaagagattcagataaagctgaaaaggctaaaggatcttgagtgtgaggcagaacagttgaggaaatctaatttgagactgcagttggacaattctgacttagttcgaagattggattctactcagatccttgcaaatgctgttctagaagaccccgaggcacatgctttgaaggaagaaggtgagcgtcttcgacgagagaatgaagggttgacgaaagaacttgagcaactacatgctgatagatgtttagatcttgaagagctagtttatttgaggtggataaatgcttgcttgagacatgaactgcgaagttatcaacccccacctggtaaaacagttgcaagggacttaagtaaaagcctaagtccaacatctgagaagaaagccaagcaacttatacttgaatatgcaagcaacgaagggcgagggagcgtttctgatatggactctgatcaatggtcctcttcccaggcttcttttctcacagaccctggagagcgtgaagattattttcctcttgataattcatctgagctcaaagcaaccaacaacacaagcaagtcaaggatttttggcaagcttatgaggctaatacgaggcaaagagagccagaatcaacgcgatcgagctacatctaaagaaaaatcaatgtctcgagaagacagcaataccaactctccacatttcagcttgagtatatcaactggaaccgagggtcttaggagcgagaatgcaactccctctgccacatctagaacttcctttgattttaaccagacaatgagtatgaaggaagaaagtagtagaaattcagatagccataccccaggaagctccaagaatctcagtccaaggagaacaagatcagtagatttcaaaaaccaccttcgttctttctcagaatcctctggctcggagaaatctaatttggtcaaatatgctgaagctataaaagattccagtggaaccctcaaacaaagaacacatagaagatcagcatcgattagttcattttaa

SEQ ID NO: 65621 - DNA, 1206 bp, Glycine max
  Peptide Sequence Number=SeqID_182399
atggctaactttgtttataactctgggtttgaaggctcattgactttaattggtggtgatcctggtgttgggaagagtactttgttgttgcagatagctgcaattattgcaaaaggtgacagtgatggtgaagcatgtccagttgtatatgtctctggtgaagagagtgttgagcaaattggtaacagagcagatcgccttaggattgaatcagatatttatttatattcaagtaatgatgttgaggacatactgaagaaagtacagtatctctcccctggggctcttattgttgattcgatacaaactgtttatttaaaaggaataatgggaagtcctggagggattatgcagattggacatgtgacaaaatctggagacattgcaggacctcgtgtcttggagcatattgttgatgttgttttgtatatggaagttgttggtaaagctgatttgtgcttattgttatactttctactacttgtcatgtttcttgggtttctattcccttttagatatggtgagaagtactcttctcatcgtatgcttcgagctgtgaaaaaccgatttggatctgctgatgagaactgcggtatgcttggggtttttgagatgtcacattcaggacttcaggctgtttcaaatgccagtgaaatgtttctcagtgaacagctcctggattcagaaatattagctggactagctgttgctgtaatcatggatgggtcccggacattccttattgaaattcaggcactttgtctttctggttcaacaggttcaaggcaagttaatgggatccaacaaaaaagagctgatatgatcatatctgttcttataaagcaagcaggtcttcgtctccaagaacatgctgtatttttgaatgttgttagtggattggcactgactgagactgcaggagatctagctatagcagcagcaatttgcagcagttgcttggaaatccctattccaaatgacattgcattcattggtgaaattggccttggtggtgagcttcgcatggttcctagaatggagaaaagggtatataccgttgcgaaattgggttacagaatgtgtatagtacccaaggtggctgaaaaagctttgggaaccgaaggtttagaaaagatggaagttgttggttgcaggaatctgaaagaggttattaacactgtattccttaatataatgaggaggtag

SEQ ID NO: 65622 - DNA, 309 bp, Glycine max
  Peptide Sequence Number=SeqID_182400
atggtgattctagtggtagaacatgacgacagcgaggggattgcacggtggcattggggtgtctgcatagacttcaacattgaagttatggttttataccatttttatggcaagaaaattagctatccaactgtcatgacatgggatacgtacccaaaaggggggtcccatgtgtccaacatgagtatcttctctgttcagtcgaagaagcttgtcattttgaaccgagttctagtgttctcaatagtaatcaatctggatggagacgagtgttggatcgagcacttaccattaggccaaaagctatag

SEQ ID NO: 65623 - DNA, 1287 bp, Glycine max
  Peptide Sequence Number=SeqID_182401
atggccctccaaaggcatcacctctcgttactttttatcatgttttcttttgttgcttgtcatagcaccgtgctatttgatgatggtagtacgttcaaggactttatcaaacaaaagagtacagatgttttgagcttaaagaaatttgtcaagttgggtgacatttcttcttcgcttaaaacggttaacgtcaatgattatggagctcgtggagatggcaaaactgatgacactcaggcattcaatgacgcttgggaagtagcatgttcttctgggggtgcagttcttctggtgcctgagaataattatctactcaagccattcagattttctggcccttgcagatccaacatcgaagtccagatttctggaaccattgaagcatcagaaaacctatcagattacagcgaagatctcactcactggcttactttcgacagtgttgagaaactatcagttaaaggtggtggtaccatccatggaaatgggaacatatggtggcaaaactcatgcaaagtgaacgaaaagcttccttgcaaggatgcccctacggcattgactttctacaagtgcaacgatttgacagtggaggatttgacgataaaaaatggccaaaagatgcaagtttcattccaagactctgagaatgttaaagtttccggtctcactgtgacagcaccgggggatagcccaaacactgatggaattcatgtcacaaacacccaaaacattcaaatctcaagctccgttataggaactggtgatgattgtatatcgattgtaagtggatccaaggatgtactagccacagacataatctgcggaccaggccatggtatcagcatcggaagcctaggggctgggggatccaaggacttcgtttcaggaataacggtgaaaggagctatgctttccggaactacaaatggactaagaattaagacatggcagggagggtcaggaagtgcaagcaatatccaatttcagaacattcaaatggacaatgtgaccaaccccatcataatagatcaaaattattgtgatcaagagacaccatgcgaagaacaaaaatccgctgttcagattaggaacgtgatgtaccaaaacataaagggcacaagtgcttctgatgtgggtgtgcaatttgattgcagcaacaactttccatgccaggggatagtgttgcagaacatagacttgcaacttgaaggtggaggaggggccaaggcttcatgcaacagtgttgaattgtcctacagaggagatgttatccctctctgcccatag

SEQ ID NO: 65624 - DNA, 321 bp, Glycine max
  Peptide Sequence Number=SeqID_182402
atggcgttggaaatgatccacggtcacaattctacagcacctggactttacttttcttcttctcattttccttctacatttctcctctattttcttcagtttcaaaaccccttaaacccttcccttgcatggctatttataggaaaaggccatttggtgcaggggaagccgcctaggctagctggagctcgcccaggcgagctaacacttgatgcaatcctccctaggaagggaccagtcactagagccatgagcagaaggctccaagaggattggactagagctactgaagaaggccctagggttctcatgaaccttagg

SEQ ID NO: 65625 - DNA, 330 bp, Glycine max
  Peptide Sequence Number=SeqID_182403
atgtctgctacttctgcttctgcatgggaccgacttaaaaagtactatgctagtaggtcacatactcccatcatgtccctcaaggagagtcttgattcaataacaaaaggcaccttaagtgtcactgaacatctgctatccattttcctcttggctgatgaactctcacttattggtcatcttgttgatgatcttgatttactcatcattgggttgaagggacttggccctgcatttcatgaattctctgcctccattcgagaatgtgattctcccttgtttgctgaacttttcaacaaactttttgatagagatttttctccaacatga

SEQ ID NO: 65626 - DNA, 537 bp, Glycine max
  Peptide Sequence Number=SeqID_182404
atgagtcccaaaatatcagattttggattagcgagggcatttgaaaatggaaaaagaccaggcaaatacaaaacaattaatgggcactttgcttggaacatgtggtgtgcaggaaaatgttttgagttgatggatccactggaaaaatccttcatggccaatgaagttgtgaagtccttacacattggtttgttgtgtgttcagcaagatgcgatagttagaccgactatctccaccgttgttctaatgctaggaagtgacacaatctcccttccaaaacccaaccatcctgcattttctgttggaacaatgaactcaaataatgaagaatttagttttagaagttcgaagaatatttccattaacaatgagagcaggcaatgcgggacaaagaatattgcattccactctttatccaatatctatatcaaaggagagcagagaagtttccccgagcctcctcatgtaccggatcttgttaacatagagaagagaagaaacataatggagaagaagaaagaggctaaggttccataa

SEQ ID NO: 65627 - DNA, 2037 bp, Glycine max
  Peptide Sequence Number=SeqID_182405
atggagggaaaactactccatgtgtcaacatattcctttgttttcctgctatttctaagcttcaaacaacatgttgttacaaaggcacaatccccaaactatgtaggagctgactgccaaaacaccacccaacaaaaagctctcagcagtgcataccagaccaaccttaacagtctcctctcatggctctccacagatgcagccacaagcaaaggctacaaccacaacagctttggcaacaacacccctggaggagatgattctgctgtgtatggcctctataattgccgcggcgacgtggttggatacttttgtcaattctgtgtctctactgcttcaagagaagttctccagcgctgccccaatagagtatctgctattgtgttgtatgatttctgcatcctgaggtactctaatgaaaacttctttgggaatgtcacggtgtatccatcatggcacgccgttcaatcgaaaaacgtgtctagtaaggaagagatacaaaagggtttggattttatgagaggtttgatcagaaaagcaactgtggagaccaatctgttgtactatatggatggcttcaatttgagttccactcagaaaaggtatggcttggtgcaatgcagtagagatctcacaagtgatggatgcagagagtgtttggaggctatgttagcacaagttcccaaatgttgtgaacaaaatttggggtggcaagttttggctgcaagctgtctcataaatgtttattgcttctggttcaggaaaagatctagaagaggaagaggaaaagatggaaggatacctgataccattgatcaatcatcatatcacaatgttcaaactgaggaaacacttaatgtagacttgcctacaatcccattaatcacaattctaaagagtactgataacttttcagaagcatctaagttaggggaaggtggatttggccctgtttacaagggaactctaccagatggaagacaaattgcagtgaaaagactctcacaagcttctggtcaaggctcagaggagttcaagaatgaagtgatgtttatagccaaattgcaacattgcaaccttgataaaaaggctatatctagagaaatgaagggaattctgatttcttctgtgtttatcttgtcagatgagagaaagaaaaggcaacttgattggaatctaagattaagcattatcaatggcatagcaaaaggtcttttataccttcatgaggactctagactcaaagttattcatagagatctcaaagctagtaacattctgttagatgatgaaatgaatcccaaaatatcagattttggattagcaagggcatttgaaaaaggccagaaccaggcaaatacaaatcgagtaatgggcacctatggatacatgtctccagagtatgctatggaaggattgttttcagtgaaatctgatgtcttcagctatggagttcttgttctagaaatcatttgtgggaaaaagaacagtggaaaaagtttggaactaatggatccagtgctggagaaatcttgcattgagagtgaagttatgaagtgcatacacattggtctgttgtgcgttcaagaagatgcagcagatagaccaaccatgtccactgttgttgtaatgctagcaagtgacaaaatgtcccttccagaacctaaccagccagcattttcagttggaagaatgaccttagagggtgcatctacatcaaaaagttccaagaatctttccattaatgatgtaacagtcactaacattttaccaagatctaacggaccaaatcatttaattaagatgggtcacataatgatgctcactgatctttaccaattcccctcactccttcatatgccatttgcaacagcaataaatactggctcacataagccgaagcaacagatagaagccaaggacttctttgtagccttagccaatgcagcttcttcctttttcctcagacggggtgaagtgagggttgagggtttggagtctcagcatctcaacttcagaatcttggtccttaagtga

SEQ ID NO: 65628 - DNA, 1929 bp, Glycine max
  Peptide Sequence Number=SeqID_182406
atgtccccatcagtgaaatcaaaatccaagtcccaggaaaaggcccctgcaagggctggtcaggaacaacataagacttctccaaagacttccaagtctccaactcatgggagtggcactcctgctagtgcacgcaatcccatgtcggcaacctttcaaactccagaaacctcattggttgcttcttctactctagttcatgacaacagtcaattcccaaaactagatgatgctgatgagcattctagtagtcctcaaggaacggtgtctgagtgtgactcggtttctaacagtggtagctgctctggtgaatcagaagagtctaaagagaaggtaacggcaacaagctcttctactcggccagatagtatacctggttgtgataatgatagaagggagaagatccgcttgaagaatgagaggaagcaccagaggcagagggaaaggagagcgcaagagttgcatgaccgttgttgcgggtacctaatgtcgagaaagctagaatcacttgcgcagcagttagtggcaatggggttctcttccgagcgagcgacgttggccttaatgttaaatgatggcaaattagagcaatcggtatcctggctatttgaagggagtgaagaatattcacaacccaaggatactactagccttgtaagtgagggtgatatgaaaattgacataagtgatgagcttgctcagatatctgccttggaggtgaagtacaattgttcaaagcaagaggttgagagagtagttgttgcttgtgaaggtgatcttcaaaaggcagaaaataccttaaaaacacagaagcaggaatctcctacgacccaattgaagtcagaagattctgctcaaaataataatagtctggtgagatcacaaggattaccagcagcatcggtttcaatgcagtacagagggaatgaaagtgacttcaaccattacaacaaggtaggtggttctgattccatgttcctggatgttgaaaccgggaatgtacattctctgcaattgaatcatccaaacataacgactgagaaaagatggagtggtgttccagggtcaatcccatctgctatgttcggcatggcaccatccatgcaagcaatgtctccatttgctaaaatggagggcggtcggtctattgcccatacaaacgaaggaagaatgattcaacaaggaccaggaagggagccggtaatgatgcaacatccacaattcacaaatgccaaacagaactctatgatgtctttaaattcctttccttcaggagcagcaggttggcatgtaaatagtattccaggtgctgacaatgtgaggccaaatgggaagttactacaaactcaaagcataagaagtgtgagtccaaatcatttggagcaatttggtcaaactccttataaagaatattctcatttccttggaccagcagactactcatctgctggagtgggtggttattgcaagccaatgggtgcatcatcatcccctccacctacaattcctccttggcatcaaggttcatggagcacaagcacgccttcaccttcgctcacggtgccaacttcccttggactattttctggtcatcagaatgcagccagaacattcagctcacattcacacatggattggaacgctgggggcttcatgccggaatttgactacaccagcatagattggagtttgaatgcgccatcttcttccgtgtcaggtggactgaggctagggatctcttcagtgttgagaaacagttatggagataggaggggcagtcaatgcgtgagtggattgcaaatggctagggaaacttcatcatctggtggattgagagagtggaccactccttttgctgggaaggacatattcagtgttcctaggcagggattggtacttgaaaaaaagtgtcttaatggttgtttgtga

SEQ ID NO: 65629 - DNA, 987 bp, Glycine max
  Peptide Sequence Number=SeqID_182407
atggagggtttgattacaaaagcaactatagagaccaagcagttttgggcagtggaggagttcgattggggtgacaatgagacattgtatggatgggtgcagtgtgatagggatcttccaagtgatgagtgcaggaagtgtttgaatgcaatgttagagatatttccacaatgttgtgggacaaaggtacaatgggcagtttttgctccaacctgtgggatgaggatggatgatgagaagttctaccagaaatcagagactaaagtgactacgcttcacagttttggggaccagttagaatattcacccaactttgacgacaatggtactagtacatcaagaaagttgattatttcctttagtgttctggggtcagttgctctactatgtttcagtgtctactgcttcttgtacaggaaacgagttagaaaagatgagatgatgctcgatgaggaaacattgaatggagacctgcctacaattccattaatcacaattctaaatagtactaataacttttcaaaagcatctaaattaggggaaggtggatttggccctgtttacaagggaattctaccagatggaagacaaattgcagtgaagaggctctcacaattttctggtcaaggctcagaggagttcaggaatgaagtaatgtttatagctaaattgcaacatcgcaaccttgtggaggcactgttggttggtgctattgggtttaaagtagtaaggtggaacttaatacgatatgatgaaaagaaaaagcaacttgactggaaactaagattaagaattatccatggaatagcaagaggaattttataccttcacgaggactctcgactcagagtaattcatagagatctcaaacctagcaatgttctattagacgatgagatgaatgccaaaatatcagattttggattggcaagggcatttgaaataggacagaaccaggcaaatacaaaacgtgtaatgggaacttag

SEQ ID NO: 65630 - DNA, 567 bp, Glycine max
  Peptide Sequence Number=SeqID_182408
atggctgggatttcaggtgaggaatctggagtgggaaagtctgcggagggaacttttagtgggcagcgttgtcaatctggggaagcattggcagaatggcggtcttccgagcaggtggagaatggaaccccatcgacttcacccccttattgggacattgacgatgacgatgatggaccgaaaccttcagaattgtatggaagatatacatggaagattgaaaatttttctcagattaccaaaagggaacttcgtagtagtgcgtttgaggttggcagctacaagtgcttctgtactttctggcgagaaattgatcaaacctctaggcgccgcatgtcaagggagaagacagacgctctcgaaggccagaataaatgcaagaaaggtagggtaaaattgttggatgctgaagaaatgcccgcaccaattgtcggtgctgagaaagatatgtttgtattggtggatgatgttcttctgctacttgagagagcagctaaagaacctctgcctccgaaagatgagaagggtcctcaaaaccgcacaaaggtgagaaaaataatgtgttga

SEQ ID NO: 65631 - DNA, 1734 bp, Glycine max
  Peptide Sequence Number=SeqID_182409
gttcaaaggatgaatagtgcatatttcccaacagttaataccatttaccaacagatgaatagaaaactgcaacagcttgagtcttctcctcaagaaccaaacacagtggaaagaatgagattcaatatgaaattattagaacagattttggcaatcttgagagtgaataaatggcagattactactgaattcaaggagaacctagacaaagcagaaaagtttatacaatctaaatttttctctaagaatgtttcttcacatcatcaaggacaacaacgttcagctgatgtgcaatccaggcaacagtctggtccatcacattctagtatttccccattgatgatacttgaaatgaaaccatcaccacaagcattggggtcacagaactatcatccgatgaaggatgtttctcagcaaaacaaaatgtgtttacaagagaagcaagcggcaaaacaatatggtggttcacagcagtctggtccatcacattctagtatttccccagtgaaaacacttgaaatgagaccatcaccacaagcattgggaacacagaactatcatatgatgaaggatgtttctcagcagaacaagatgtgtctacaagagaagcaagtgacaataaaatatcgcaacttacaacaggatgtaaatcaactctctatcataaaaggtacatctatcaattcactcagtgctgtgtacatttttgtatatactactttttccatgttatctatgcctgaggttactaggaaacatttttacaatttgtcgatatcaggtgctggcaatactgtacaacagcaaacacaagggacacaaaaagcaactgaagcatttagtgtcagtgtcaacagtcagggtatttcagcttcacccttgattgaaaactgcaataatcttaaagaaatttcccgtaaacctacactcacttctgatgagccaagtgctgcaatgcaatactttcttaaagtgttaacctccatatcacctgaagcattgagtgcatcgcttggtgaaattagagaggtagtctatttgaatgatgcaataccaagtccagaattgatgcatggaccaccagagatggttcaacaacaaatgcaaccatgcctcatctcacaaacagggataaatttagcatcggatattgagccatgctcacaagctagatacatcacttgcaatgattttgttccaacaggaaggaaaaggtcttgcagcatgaattcaatgactgcctttgacacttctagtacttgtgctagttcatgtgacagtaaccagttgactgatactgagaaacctgacttgactttagtcacatcaaagcatcctagaattgtggaaaaatgttctcttttagaagaaataaaggagataaataatctattgatagacagtgagatagttattggagaaaaagacagcattcaaagtgcagctggaggagctgctgaagatggtgaaggtttggttattaaattccttttcaatgcagtaactttcaatcagaacctaatatcccatctttctgctgataaaaagtcaataatcaaaccgttatggttgcttgttcccgcaagttatccattttgcccacctgttgtattagacaaaatgccgttggaagtcagatattcatctcctctagataacgaaattgtgaaatattcattctctatccactatattgagttgaaaaaatcaatgattttggaacctgttttctaa

SEQ ID NO: 65632 - DNA, 714 bp, Glycine max
  Peptide Sequence Number=SeqID_182410
atgatgaagttctcaggtgcaatcctgaaagcatttgaatacagcactgcaggtcatgtcaaggagcagatctctggtagtgccgcagtacctgaaaaaaggcaatcagaatcaagttttcctatccaaagtcagactcaaaaagactataatgcaatacatagtcgccagcttgataatttttccacaaatgatatctcttcgttgtcttctaaaaaattaaaagtaaaaaagaaaggtggtgatggaatatccttagcacctgattctgctgagcttcaaggtacctacattgaaaggtttcgtgagtttttggaggacttgtgcaacaatgctgaatttcatagtgatgatcgagatgaagcagaatggttgccattgcctcttacagatcttagattacttgtcaatgagataacatctattcgtgaaaagaaacttctgcatttggttcctgtagaagtccttgttagactattaaaggttctagatcatcagatacatagagcagaaggcctgtcaattgaggaatgcgataattcagattcagaattagtttcatctgttttaattgcattggagtccattcatgctgcactagcagtgatggctcacactgatatgccaaagcaactctataacgaagagttaatgatgtattacaatttctctgaggtcaccatgggaatggcagagttcacagataatatttaa

SEQ ID NO: 65633 - DNA, 429 bp, Glycine max
  Peptide Sequence Number=SeqID_182411
atgtcccagattcccacaatttatgtgttacccttaaaaaaaacatacccaagtgctcagaggctcctcgctatgcaaaggtacatgggaggatcattgtatgcaaccttaccttgcatatgcaaagaggttgtttccggattcgaatccatgacctatgggggagggcgagctgcacaacgcgtggaaggggtaattaagcaaagtggtttacctttggcacgcttaaatgggcttgttcagtttctggaaagatttgaggcaaaagtgaatgctgctgccaaaaatgaggttgagtaccttaaatcgttatctgaaaaggtaaaagaaatatcttcacaactaaagactgctgaatccaaacctcgtccctcgaactctactggctcagtggaagtctgctctgctcaaggtattgagatgggataa

SEQ ID NO: 65634 - DNA, 150 bp, Glycine max
  Peptide Sequence Number=SeqID_182412
atgaattatgggcaaggaatcccgaggcttgtattggtgggaatgattaatggtattggcaattgccatgtgaagaatgatgaagggaatgggctgattagaaggaaaggaaatgagattgaaagacaagagatcataccttctcattag

SEQ ID NO: 65635 - DNA, 276 bp, Glycine max
  Peptide Sequence Number=SeqID_182413
atggtatatactgaaatgctgaatttaacacagcagggaaacgggtatcgagcttcttcctcatggcagcagattagggttttgaaagctgaagaattgggggaatcaaaagaagcagaagaaggagacccagaaagtaaaatcgaaagctttgaacagaaagagcgaccctatcatcaacaggatgaaatcgaagaaactcatttcagatccaaaggccactcactctctctaagattcattcaacgaaatatgcctcagtggcgggtttgttag

SEQ ID NO: 65636 - DNA, 252 bp, Glycine max
  Peptide Sequence Number=SeqID_182414
atggcagcggagagagccagctgcagtcacccttccgaggtattggggtttcgctatctgccatgccgaacactctgcgacctcccttatgccaccaccaacctctgctcttccatttgcattgtcaatggaggtgtgaatgatgggtcgggtccttgggtctttatagggcctgctttttcttttttcttatctgttgggccttgggcctcaagtgcaacatttctctgctatatatttttacaagggtga

SEQ ID NO: 65637 - DNA, 888 bp, Glycine max
  Peptide Sequence Number=SeqID_182415
atggtggtggcggagaagatcaaaatcggcgtctgcgtgatggaaaagaaggtgaaatgtgactttgaggttttctcggcgcctatggggcagatttttgaacggttactagcgtttggtgaattcgaggctttgaactctccaactgcaacgacttgcttttgtggtgtggttttctcaagggctagtgcacaactagcctatgtgagtgccgaggctatggagcgtggtgggatgttaggatccaaatgcaaggtatgggacttgagtctcacactgggagtatgggattctggtgtagggtttataaggctttggactctccaactgcaatgcttagcttttgagcgtcttgaaatgtttggaatccctgttccaagatatgcccttgtaattagggatgccccgtaccaacaactggattactttatcgaggaagaagattttgttgaggttcatggcatgcggttttttaaaccatttgtggagaagcctgttgatggtaagcttgtttctcgtgttggcaataggtccagtgaatttcacccagaagtgagaagagtgaggcgtgaaggatcctatatttatgaggaatttatgccaactggagggacagatgttaaggtgtatacagtaggtcctgaatatgcgcatgctgaggcaaggaagtctcctgttgttgatggtgttgttatgagaaatcttgatgggaaggaaggtaaggctgcgtacaacatccctcccccataccttcgcatagcgaagagcctctgggcaatggggtacgaagttaggtatccagtgttactgacccctgctgagaaggaaatggcaagagatgtttgcattgcattcagtcaagcgggtgtcagactccttgtttgttag

SEQ ID NO: 65638 - DNA, 198 bp, Glycine max
  Peptide Sequence Number=SeqID_182416
atgttgactacgcaatcgagtccttccttttgccctcgcagcgctctaaatctgaagaccgataacaattccaccacggaccggtcaattccagagtttttccttttggaaaacgacgccactgtccacggagccgagttttcacctctaccatctgtgatgctgctgttgcaatgcaatgttcaaattttcctctag

SEQ ID NO: 65639 - DNA, 447 bp, Glycine max
  Peptide Sequence Number=SeqID_182417
atggttcaacaagacccaacaccaaaaccttcaaacaactatgtctcaaaaaacaaattttataatgttttgcaaatggagccagaatattgggacaaaaatccctttaaggcaactgcaaaaaccttcccaccaggattccattataggccaacagccctcaataagaccataaaattttacgaatttatcttagtggatacaaattcagtatccattaaacatttcaaagacccaaaagatccaaatttaaatacccattcaacaatccaaattttaaagttagcagcatttctggctggatccaaatctaaagaaattcttgcaaagaatctgaaggaagtcctccatctacttcaacaggaagaagaagaagaaaaaccttcaaaaaaggaaattgagtcctccgatgaaattgatgatcaagacgatgatcccttctactag

SEQ ID NO: 65640 - DNA, 165 bp, Glycine max
  Peptide Sequence Number=SeqID_182418
atggcaattcagcctgttgtgcctattatgagacaaattgatgaagggaggtggaaaacgagtcctttgaatagaattcagacaggggatcaactttggaaaatgaagattatatcggatgaagataagctagcatgcccattctacaaagggttgggatggtga

SEQ ID NO: 65641 - DNA, 228 bp, Glycine max
  Peptide Sequence Number=SeqID_182419
atgcatagaagtcaaggttaccttagagaaactacaaaagaaaggattgagagcttgtttctctaccgaatcgttgaggtggattctaaggattccgctttgattaaaatgttcctctacatgcggcaagcaacgatggcttgtggtggccatcggtggtcgtgggtggtggagaagtacgctaatctcgctgagcaaattttctcctcgggttggaattttgcttag

SEQ ID NO: 65642 - DNA, 858 bp, Glycine max
  Peptide Sequence Number=SeqID_182420
atgacaacaactaacattatgcaaattgaaaattttagaaaggtcggcatcaggcctccccatatgttttcagactttactaataattttggattcccaaataggttgcacaacaaattggcatgctccagtgcaacttcttgtggggaagggctgaagaaggatcaaggtggcctagaggtgtggaatatagaacaatataatagagctctaattggtaagtggtggtggagggtgttatgtgaaaaggatttgctgtgggtgaaggtattagaggccaagtacagaagccttaaggtcccttctgttgatctacatgtacaagggcaatctcaatggtggaagggtgcactcgccttatcagaggaaggtgtggagcctagttggtttcaaatgaacttagcttgtgcattaggtgacaaagcaatgtttagcttctgggatgatggctggtctagggaagatgcaactcccccccatggtgatcagcctgggtcacaagggagttccaagccgagtgacatgccaccaaggatatccaacttggtcactgcacccccatctacatacataacatatatcatcataatgacattatcaacattaacaacacctcaccttaatgtcactatcaacttcaacaccatctcatctggatgtcattatgaacatcaacatcatcccatcacaatgtcattctcaacatcaacatcatctcatcccaatggcactatcaacatcaacaccatctcatctgaatgtcattatgaacatcagcatcatcccatctcaatgtcattctcaacatcaacatcatctcatcccaatagcactatcaacatcatctcatctcaatga

SEQ ID NO: 65643 - DNA, 1788 bp, Glycine max
  Peptide Sequence Number=SeqID_182421
atggcggccacgcctccttcgttctctccctctcgcacaacctgcgcctctctcctccgcgaattgcagatgatatgggatgagattggggagagtgacaacgatagagacaacacgcttcttcaactggagcaagagtgcctggacatttatcaccggagagtcgaggagacgaggaagcacaaggctgacctgtatcagtggttggctgaagctgaagcggaagtagccaatattgtttcttcccttggagaatgtaccatacttccacggaaagactttgtgatcttaactcttaacaatggctatacaggaggcattgatatacaggcaggcattgatatgcctgcctgtatagggaaaggaactctgaagcagcaaatagctaccattagacctgtcatagaggacttgaggtcaaagaaggatgacagaatcaaggaattttcgaagataaagtctcaaatttctcagatatgtgctgaaatagcaggttgtggacaatacaatagtgtcacagattcagataatcaaagtgacctgacaacaaagaaattgcgagaactcaagtcgcatctccaggagcttcagaatgaaaagatcttgcgccagcagaaagtgaagagtcatattagtactattagtgagcttacagtagtaatgtcaatggattttagggagacactaaatgaaattcacccaagcttgggagattcatcgaaaggtacgctacagagcatcagcaatgacactcttgccagattaactggggttattcattcattaaagagggagaagcaaaaaaggctacaaaagatacaagagcttgctaaattgctggtagagctatgggaacttatggagacaccaattgaagatcagcaggcctttagccatgttactagattaatttcagcatcagttgatgaagtgtctacagaatgttgcctttctgcagaagtcattgagcaggttgaagttgaagtccagcgactaaatgttgtgaaagccagtaagatgaaggatttagtgtttaagaggcagaatgagcttgaagaaatttacagaggagttcacatggatgttgatagtgaagctgccagacagattttgaccagcctcatcgaatctggtaatattgatctgtctgatttgcttcaaagcatggatgatcaaataagacaagccaaagagcaagctctaagcagaagagatatcttagatagggtagagaaatggaaatttgcagctgaggaggaaaagtggttagatgaatatgaaagggatgaaaaccgatatagtgcagtaagaggagcacacaaaaatttgaaacgtgctgagaaagcacggattcttgtcagcaagttaccatctattgttgagaatttgactgcaaaagtaaaagcatgggaaatggaaaaaggaatacctttcttatatgaaaaggttccattgttacataacttggatgaatatattgtacaacggcaactgagagaagaagagaagcgcaaatatcgggagcagaagaggctacaagaacaacacgctgtagagcaagaggcactttttggttcaaggtctgcaacaaaaaagcctctgggtcagagcactcatgctaacaccatacttgggacaccaactgggcgtcgaatgctttcgacgccttctggccgccatggaaactcaggaggaaaggaccgtagagaaagtggcagagtgaacagcataattccagtgaactatgttgctcttccaaaagatgactctgtttctagggggaattaa

SEQ ID NO: 65644 - DNA, 543 bp, Glycine max
  Peptide Sequence Number=SeqID_182422
atggacctaaggttgcggaaaaaacatattttggtctctgcctcagtaactgttgcttttagcatacatgagttgggccacactggcagtactggtaggggaagaggccgaggtagaggaagaggccgtggccgagggcgaccacctttaaatagagagatatatcatcaggatgctgaatctgagccttgcacttctgttcagccaagcaacccacaaaatacaaacacaagtgttgcaatggatagtggttctgagtcaaaggaaataccaaaggagcagaacattgcagttcctgttgaaagcactgattcgctccggaacatcgatctgaatgccattacgaatgaaaacgatgacaaaaaggctagcgcagcagcggatgcctctgtgcctgaacctccaacagagagcaagcatgaagaaattccagggtggtctctttctgatgtggacaagatggccattgattcgctgcagcttgcacaacttggtaggccactagaagaggatgaagaagactatgatgaagaggaggggtaa

SEQ ID NO: 65645 - DNA, 672 bp, Glycine max
  Peptide Sequence Number=SeqID_182423
atgagagtccacattccgtgtttagacaaaacagtgaggagggaaatgattgaacctattgttagtagaaatgaaagacacaatgaaaaaactgagaaccaacaaatcaatactaagcaacagggggttgccgcgggtggcaacgacagaaattatgctcaagcgatgaggagagatgaagtatatattgtgggtggtatgggagaagtaaaactgaaatatctcggggatgacatggtgcttttgaatggaatcaagaaggaagaggtgactcaaggaaccagagtagaggatcaagaatggtctagaaatttcaaatgggggagggctcaagatctccaatgcttagtgttaatcgagatgatgttgataaagagattgaaagaaaaggaaaaggaatgcagcaaaggtggcccaggaagggggatattgtgtggaagaagtaggggtgcaataagtaaggatgttaagaatgggttgggcttcaaacatgatacaatggttacaatttctaaaaatagtgaaggtggacctaactacagattgaataatggttgcaaagggggggactttgttattgaaggaccaaatggtggatgcgttactccactggctaagagggaaacacgtgggaatagccagaatttgattactaatgcagattctacataa

SEQ ID NO: 65646 - DNA, 363 bp, Glycine max
  Peptide Sequence Number=SeqID_182424
atggttgtctacttctgcaatgatctctctatttttgtgttgctaatcatgacaaatttcttccagaaacagaacaatcggaaagagaaggataaagatagagaggagagacctactgtggttgtacatgacaagcagcaagacattgctgctaatgagaaaaaggattctaagatggaggaagattctgtggatgggatcactaaggtgattcagcttgattctgaggacagagataagttcatcctccaactgtgtcgtagcaatgctataggtagtatttcatctgtacgaaaaggaatggctgagaaaaggagcagttcggtaatggacgacagtccttcagcatgttccactgattaa

SEQ ID NO: 65647 - DNA, 219 bp, Glycine max
  Peptide Sequence Number=SeqID_182425
atggccccctctcgtctagaagaagtacaaggtgaagctcatcatgaagaccctaactctccaaggctgcgatctgactattctgcaagcagagaacaacaccatcaggctgagatttgcctaacttgccactttcggacttgttacatcaacaacatctgcagcagaatcggatatttgactatccatttcagttgtccaactgcttgcattacatga

SEQ ID NO: 65648 - DNA, 291 bp, Glycine max
  Peptide Sequence Number=SeqID_182426
atgaagggaggtctagaagaggcaaccttcggaatgggtttcacgtgtggtctatgttggttgtcgttattggtggtggttgtcgtccttgtccaaggtgttgatggtgattgtcgtccaaacattgtttgtgtaaagaattttaaacaactaaaaatctggaatttcaagtttattctaaaaagtgagaaattgaaattttttttttaccgtcttcttcaagaaacaccgtctgagactgtggaatatcgatcggacctgagaacgtcttcttcaagaaacaccgtctga

SEQ ID NO: 65649 - DNA, 423 bp, Glycine max
  Peptide Sequence Number=SeqID_182427
atgagggatcaggacccaactgaccagtttcactcacagagagtgaaactagaggagacaacagaagcaatgggtcaaggagcactagaaggacttgacatcatagccagttgtgccatggatcttttagttagtcttggaggtgaagtccaattgttacttgtgatacagaagttaaagatgaagatgcctctttatcagtcaattgtgaggcaccaaaagatgttttcccgacatgaacagatagagttcttggaggactactatttgaggatgttgttctctttcggcaggccttcatcgtcaacagctctttttacattaacttggtcttcaatgctctcaatcttttgtggtgaaaagaacatcctcttcctatcaaataggaaagcaaaagcccatgacatcaggctcaaattataa

SEQ ID NO: 65650 - DNA, 537 bp, Glycine max
  Peptide Sequence Number=SeqID_182428
atggagtgggcacgtactagagtagaagtcgtgcgtgagtgggggagcgtcgtggtgcaaaattttagggcaccacttcagctcccgccaattaccgaagattccgccttccctttaaatggagtgcaaggactctggggctcaattgagcaacccatcatcgatcgaaaggtcatcttaataagcagttccttgtccgaggatacttgccgagagagggtgagggtctcacgtcgaactagtgggggcacttctcgccttcacggaggggcgtggccttccgttgctgccggggagcctgtcccgattactatgatcctcccctcttctgcttttgggggtgttaggagcgataatggtggtggagatgctagggcgtctccccacgtgcaacgtagccaaagcattgggttgttgtcgtccaccctagccattgctggctatgagtgggtgatggatgactttttaaaatataagtcctctctgacctcggtggcgagtgttgttgcgcttcagcaccaggcaaagcaagcttag

SEQ ID NO: 65651 - DNA, 255 bp, Glycine max
  Peptide Sequence Number=SeqID_182429
atggaacactcgaaggctcccaacagtcagaatggatgtagtccaacatggcctttgttttgtgcacaacctttcaaaactttgtcctatgctacttcccatagacgcaatgctcacaaaactgaagaggtttcaccttgtgatttccatgtaagcctcacttgcccagaatatccagacatttttcactcaagtggcccagatgcaaatgccatagagaattatcagatgagccattggacgcatggcttctag

SEQ ID NO: 65652 - DNA, 774 bp, Glycine max
  Peptide Sequence Number=SeqID_182430
atggtggctcgtggtggccaccggtggtcatgggtggtggaggaggagtttctaggatgcacaatacctcttgggttgggatttgcactgagcgcgacaattcgcactaagcgcaattcctcttgtgctaagcgcgacaattctagctcagcgcaattccctcttgggttggaattgcacttagtgcaattcttgaatgatgttattttgaaaatcccaacagtcaaatggtggcgagatgcgttagggacctacaggtgttacccgacacaccttcatacgtgttttgtagccctagtggcaactctggacatggagttagagcaactcaatgtcaaaactacctttctctatggaagactggaggaagacattctgacgcaacaacttgaaggcagtggtacaggatatttgatgaggtcattgtctcttatgggtacatcagaagtccttgtgactcatgtgtttatcatagcaaggaatacatgttttgggatggcatccactaaactagtatgcactcctttgacaacatccattcttctatctgaactcaatactactcagctagaattagagaaggaatacatgtcccatgttccttatgcaagtgttgtaggtagtctcatgtatgttatggatgtgaaacatatactcaggtaccttaaggatagaattgatattggacttgtctactatggagacacattttgtgctctcactggttactcagattctaacatgttgcgggtttggatgcaaagagatttgtga

SEQ ID NO: 65653 - DNA, 3054 bp, Glycine max
  Peptide Sequence Number=SeqID_182431
atgggtcagcaaacccgccgggagtcctattccggccccttgccttccactgcacatcgaaaggattacaattataattactgtcaccaccgttgtcatcattatcatcgtgacccacgtttcttcgagtttgtcagcaagaacgagactagtgacttagtcttgcctttcgacaaactcgagaagctaagtcaggatgacattagggaatgtgcttatgaaatttttttcactgcttgccggtcttccccaggatttgggagccggcaagcgcactcgttctcgtcatggaataacgaggcaaagtcaagcaatgtggtgatgtcgccgacaagtaaggtgaagcgggctctagggttgaagatgttgaaaaggtcaccatcaaggagaatggtgtcgggtggcagccgcgggccgtcatcgccagtgggcggaagcagcccttttcatcagactgggccaccattgaggccacggcggccgatgacttctgctgagattatgaggcagcagatgagagtgactgagcacgacgataaccgcctaaggaaaaccatcatgaggaccctcgttggccaagcaggaagaagagcagaaactatcattctccccttagaacttctgaggaacctaaaaccttcagagttcaatgattccaatgagtaccatatgtggcaaaagaggcagcttagagtccttgaagtagggctcctcacacacccttcagtccctatagaaaaagccaccaccttcgccatgcgccttagggacatcatacgtagtggtgagtccaaaatcatagacactggcaaaaactctgacaccttgagaaccctttccaattcagtggtttccttggcgtggagaagttccaacggtacccccaccgatgtttgccactgggctgatggattccctttgaacattcacctctacacttcacttcttcaagcaatttttgacaatagggatgacacattagtccttgatgaggttgatgagctccttgaactgatgaaaaagacatggtccgtattggggatcactaggcctattcacaacgtgtgcttcacttgggtgttgtttcaacagtatgtggcaaccgggcagatagaacctgatcttctatgtgccacacataccatgttgagtgaggtggccattgatgctaagagggaaagggaatcattttatgtgaagctcttgacatcagtgctgagttcaattcagggttgggctgagaagagactgattgattatcatgagcatttccagagaggaaatattggccaaattgaaaatgttcttcctgtggtgttgtcagtcacaaatattctcggtgaagatctcgtaatatctgacagtggggaagggggagagaagggagatataaccatagtggactcatctggggatagggttgactattatattcgatctaccataaaaaatgcatttgaaaaggcaattgaggcagtgaaagccaaggctggtgaattggaaataaagggagaattcagtgaatttctgcttcatttagctcaggaggtagaagatttggcaatgaaggaaagagagaattttactccaatgctaaagaaatggcatccagcaccaggtgcagttgcagcaatgatgttgcacagctgctatgggcatgcgctgaggcaatatttaggtgatgtgacctcactgactcatgagacagttgaggtgttgcaaagggctgaaaaggtagaaaaggttttgctccaaatggtggttgaggaggactatggtgagggtgaggataatgccaaaacagttatgagagagatggttccatatgaagttgattcaatcatattgaatctcatgagaaaatggataaatgagtcattgagcaatggaaaagagtgtctgctaagagcaaaagaaactgaaacatggaatccaaagtccaaatcagagccatatgcaccatcagccgcagagttggtgaaattgaccaagacaactgtagaagaattctttcagattccagtaggaataactgaagatatagttcaagaacttgctgatggattggaaagtctctttcaggactacatgatgtttgttgcagcatgtggtacaaagcagagctatattccttcacttccccctttgacaagatgcaaccgtggctcaaagttgatcaagttgtggaagaaagctagcccttgtggtgctaatatctcagagctagataacacaaatgaaggtcataatcctaggccatcaactagccgtggcacccagcgcctctatgttcgtctcaacaccttacactatctcctctctcacatccacacccttgagaaatcactctctcacacccctggtgtagtcccttcttcaaaccgtaaacatagtggtccctattttgaaatagtcaattcctccatcccagcagcatgtcaacatgtctcagaagttgcagcataccgtctcatattccttgactccaattcagtcttctatgacagcctctatgttggtgatgtagccaactcacgcattaggccagcattgaggatcctcaagcaaaacatcacactgatgactacacttgtggcagatagagctcaagcacttgcaatgaaggaagtgatgaaggcatcctttgatgcattcctcatggttttgcttgctggtggaagctcaagggtgtttaacaggtctgatcatgtgatgatccaagaggactttgagagcttgaaccggcttttctgcacttgtggggagggactaatagcagaaaatttggtccagagagaggctgcagtggtagagggtgttattgcattgatggggcaatatactgaacagttgatggaagatttcagcattgccacatgtgaaacaagtgggattagagtcatgggtaatgggcaaaagttgcctatgccacctaccacgggaaggtggaataggtcagatccaaacacaatattgagggtgctgtgcagtagaaaggacagagctgcaaatcatttcttgaagaggacattccagttagcaaagagaaggtga

SEQ ID NO: 65654 - DNA, 501 bp, Glycine max
  Peptide Sequence Number=SeqID_182432
atggagcaacaccacgaggaggagctgagaaagttaaaggctgatcatgaccaactagaggctcatgtcagacgtccccaaggcgatgaacaatccgcccacaccttgtatgccgtccgccagcatcattttgttgacaacattatggaggctaacatacccttggggtggaaaccactcaatctcgagcggtatgatgagacaacaaatccagacaagcatctgggtgcattcccgacacatgtgaacctctacaccaacgacaacgtgattctatgtcgtgtctttccaacatccctcaaaggagtatcattgacctggtacagtggacttccacctaggcccatagatagcttcgacaccatcatcgaacaattcagtgtgcagtgcagcaccagcagatttgggcacacatccatcgagatccaaaatctcaaccctgaggtagcattgtattccatgcgaaagcaagggctacatccagatggaagaaatgtctag

SEQ ID NO: 65655 - DNA, 249 bp, Glycine max
  Peptide Sequence Number=SeqID_182433
atggatgtgagagaattgatgagaggcaacgaggtatgttttatcgcggccccatggtggacgccaaatgttcttacccaaatccaaaattgtgacacctcagggcggacatggttgagtggggtcccgaacttcacacatcggcttggatcgatacctttgacaggaggggggatctacaaaacaaagaactctgatgctcaaggagggagcccgactgctaaggatcgagcgtctgcgctcttataa

SEQ ID NO: 65656 - DNA, 516 bp, Glycine max
  Peptide Sequence Number=SeqID_182434
atgaacttcaccatcagatatctactggtttacacagtcatatcatactttgccttaatcgacagaaagacacttaacgagctcagagccatagtctccatgcctaatttgaaaatgaaattccctaaatttacagtggagattgtaaccgttaaggctgaccaaaagcaagcacaacagtgctatgcagagagcctgaaggtagcaccatatcctcccattcgggagccggccatgccttatcccataacagctgaaggcactcaagtcatgaccatggatgaagggcctcaaatccaagccctgaccgtctaccaagccatccagggcagtgaagttgacatagatccacaagacgaaaccttcaacagaggcccaaaacccatcaaagagcttgtccagctacaactcggacctaaacccgggcagtgcatgcagctctgtagggacttcaccagtcaagaacactggtggattgccaacctactatgcagaaatgcagatttatttgcctga

SEQ ID NO: 65657 - DNA, 303 bp, Glycine max
  Peptide Sequence Number=SeqID_182435
atggagactatggctctgagctcgttaagtgtctttctgtcgattaaggcaaagtatgatatgacttctttggaaggttttccagtacaagatatcaatggaactgccttggtcaatgtggaccctggacactatgaagttcactatgatgatgaagactaccatggggttgtcttggttgacgaggttgatgcccttgaagtccctatccgtgaaggactggctggattatcctccataggaaaatctgctagtgatggtgttgattacacctctgatgtgaagggaaggttcttgttctag

SEQ ID NO: 65658 - DNA, 168 bp, Glycine max
  Peptide Sequence Number=SeqID_182436
atgcagggtcctctttcaaagaccctattacaaaaattagcgtatgccgctgtaggtgacaaatacacgataaagatgccattttttttttttgtctataattggagccagtccactgctgctgaccgcatcatcgtcatcaaatatgagaaggctgaacgtttctaa

SEQ ID NO: 65659 - DNA, 292 bp, Glycine max
  Peptide Sequence Number=SeqID_182437
atgaattcattgcctagcgttgttcatgtgtcctccaccatcgagtctggagcaccgagaattgattgcctatcgctgttcgcctatcctccatcctccaatcttattcggagacccatgaattcattgcctagcgctgttcatgtgtcctccaccaacgagtctggagccccacgaattgattgcctagcgctgttcgccaattctccattctccaatcttattcggagacccatgaattcattgcctagccttgttcatgtgccctccgttatcaagcgtggagcctctg

SEQ ID NO: 65660 - DNA, 639 bp, Glycine max
  Peptide Sequence Number=SeqID_182438
atggatggggaagcggtctcttggtactatgattcaagctccccggacggcaccggtgcttcttcatcggtggcatctaagtacattgtctccgagaggaatagaaggaagaagctcaacgataggcttttggcacttagagcagtggtccccaacattaccaagatggataaggcttctatcattaaggatgctatagagtacatccagcacttgcatgaacaagagaagagaatccaagctgagattttggatctagaatctaggaataagttcaaaaatccaacctatgaatttgaccaggacctccctattctgctcaggtctaagaagaagaaaacagaacacctatttgattctctcagttcaagaaattccccatcaattgaaataattgagctgagggtaacatacatgagagagaagacgtttgtggtgaacttgacatgtagtaaaaggacagacacaatggtaaaactgtgtgaggtgttcgaatctttaaagctcaaagtcattgcggccaatatcacatctttttcaggcacgcttttgaagaagacagccttcatcgagggtcaattgatgaaaattaaggaccttatggcagtactgtccgattcaaatcaattgatgaggtaa

SEQ ID NO: 65661 - DNA, 803 bp, Glycine max
  Peptide Sequence Number=SeqID_182439
atggcaaagattggcatttttacaggtacggtgtacggcaacgcgctgctggttgccgaagaggcgcagccggtgctggaagcgcaggggcatgaggtgaaggtgtttgaagatccctcactggccgactggcagtcttacagcaaagaggtcgcgctaattgttacctcgaccaccgggcagggcgattttccggacaatatcgcgcggctgtatgtgcaggtgcgcgatgaactgggctatcagcctgagctgcgctatggcgtgatcgctttaggcgacagcagttacgaccatttctgcggggctggaaagacttttgatgccacgctgcaggagcagcaggcgcagcgtattggcgaggtgctgctggtggatgcgacggaaaatccggagcccgagtcagtgaccacgccgtgggtggagagctgggggatgaaacttaatggttcacccgaacagcttcctcttccgccaggtttgcgcacatcacgtcaccggtgccggattgaatactgccagctgaatcagctcaaacagccgccagccgacctgttcaatactctcttcgcccgtcgcgatggtgccggcattgatgtccatcagatcatgccagcggttcgccagcgcgctgcgcgtcgccatcttgatcaccggaattgccgccaggccgtaaggcgtgccgcgcccggtggtaaacacctgcagcgtaatgccggaagccatctgctgggtgccacagacaaaatcgctggccggcgtggcggcgtaaatcagcccacgctgcgtcgggcgctgtccgg

SEQ ID NO: 65662 - DNA, 390 bp, Glycine max
  Peptide Sequence Number=SeqID_182440
atgcggctaggttccacccggtccacttggtcgattttggttaaaaccaatgaccagatcgattttgtggcccagaccagtgttgttgcatcgcacgaaggaggaggacttattgttgtcgttgcatcgcatagaggcacccatagtgacttctcaagttttggtcatttgggttgtggtgaaggaaatatagaaagaaaaaagttgaaaaaatggagaagaactaattgtaccagagaatcaaagaaggtgtgggatgactcgcaagtggcaatgggtagagtattcagggaggcaagcaagggtttgtttctgctatctggaagctattggctgagcaatggactgttaagcttgttcatatttatggagggacatgctgatgtttga

SEQ ID NO: 65663 - DNA, 273 bp, Glycine max
  Peptide Sequence Number=SeqID_182441
atgcaatgggaggttttggaggcaaagattggaaattggattcattacatgagaattgctgtcaaattgttgatttccggagagaagaaaatttgtgatcaaatatttgatagtgtggactctttgaaagctcaatgttttgctgaagtcactgctagtagtgtggctatgcttcttagttttggagaggctattgcgaaaagcaagaggtcacctgagaaattatttgttcttttagacatgtatgagataatgagagaacttcaaccagag

SEQ ID NO: 65664 - DNA, 498 bp, Glycine max
  Peptide Sequence Number=SeqID_182442
atgggattgagtcaggcgccttcgcttaaaaagaggttctatcaagtcaaggtcaagagcctaggagtcgctggtctgaaagagttaggacagttgatgggtcaactccaacaacaagcttttcacaaagcttacggtaagatctgggacctagccatggtagaggtctccacagaggccattgcctccctcgcccaatattatgaccagcctttgaggtgcttcacctttggggacttccagttatcacccacggtggaagagtttgaagaaatcctgggatgccctctgggaggaaggaaaccatacctcttctcgagattctatccttctttagctagaatttctaagatagtccaagtctcgacgcaggaattagatcgcggaaagcaagttgaaatggggtggttggagtaccaaggaaatgttaagaagcaaaagcaagagtcttggcaggcagcgatcttcgcttttctcacctttcatttgctatcttag

SEQ ID NO: 65665 - DNA, 132 bp, Glycine max
  Peptide Sequence Number=SeqID_182443
atgaaaccctacaagagagagtgtgagagagaaaaggaagttacggggtcttgcaggatctcgcagcacggtgcaagctcagcacgagcacgtcatcgcgatggatctggtcttggaggcattgacagcgag

SEQ ID NO: 65666 - DNA, 696 bp, Glycine max
  Peptide Sequence Number=SeqID_182444
atggtagggtttcccatggaggcaaggcgtactgacgatggaaaagagattgttgatagggctacttcgcatcagccttacaaagaaaagctgatggttcctatgggggaaggaaaaatggagtggaatgagaaagagtatgatccttttccagatataagggtcttagatgaaaaactcaaatcatggagtagtgtgtggaaaaatgctttggttgtccatgtgcttaggaaaaaggtgagctttaaagcattagaagcaaagcttcatcatggctgggagaaggaagggtggatacacgttgatttgtctcaacatttttatgttttgcaattcttacctccggttaggagaatgacactatctttgaaatatgaaggccttcaactagtctatttttcatgtggtagatatggaggtcgccaaactatatgtttggatggacctatcctagaggtgaaagttgatgctatcactattggtgagaaggtctctaaagaacatgtggtgatggaattagcaacattgttgattgtggctaaagaaggaaataacgatgaaggtgttaaggcggatttagcaggcatgctctttgtgtgccctaacctcgaccaccatatcaacgacacaatcattggcgttcttcacaaccacaacgaagcctctgagacgtatccacttcccgatggcgattga

SEQ ID NO: 65667 - DNA, 3306 bp, Glycine max
  Peptide Sequence Number=SeqID_182445
atggctcaccttcatgaagatgccttacgggaatatgatgaactagaactctgctatcttgaaacagttaacatgactggaaagcagagagactttggaggggcagatcatggtgacgatcaagcagcattggttaatccaggaaataaagcattgacacagattgttcaagaggactcatttcaggagtttgaattcagacagtatctatttgcctgtcagtcaaagctcttattcaagttaaatcgtcccattgaggctgcgtcacgtggctattcattcataataagcttctccaaatccttggcattgcatgagcgtattctgcctttttgtatgcgtgaagtctgggtaacaactgcttgcttggctttaattgaagcaaccacttctaattataatgatggacatgtggcgcctgacgtagagaaggagttctttcgtcttctgggtgacctatattctctagctagagttaagttcatgaggcttgcctatttaattggatatggaactgatatagaaagaagtcctgtcaacagtgcttccctcagcttgctaccttggcctaagccagctgtctggccttcagttcctgctgacacatcaacagaggtgcttgagaaagaaaagaaaaattgctcatctcttatgtctctgatagcaaatggttcagaagaagtaggaaaatggatatttattaggaattcgtctcccctggcccatcaccagggtggtggcagagtagaggaaaacagaaataaacacaatacggtcactgaaactgaaaatgaaagaaaacaaatcagagtaggaaaacttctctgccctgtggcaatagacactcacaactacccaaatgattaccaaccctctgatttcccctctcttcccttatatccaacatactcacaatacttcccacactttttgccacatatgcagctgattctacaaacaacttctagaaccaagcactttggtatccagaggaaacccctgcctcttgaacctactgttcttctacgagaggccaacaggcggagggcttcactttcagctggaaatgtgtctgaaatatttgacagtcgccagggtccaatggatggatcaggttttgatgcatccactagaatgtcaccacaaaaagcacttgcaagttccatgtcacgtacaaattcttcaccaggaaactttgatagctcaattgaccgaccaatgaggcttgctgagatttttgttgctgctgagcatgctttgaagcaaacaatttctaatccagaactggggaaatcattatcatcatccgaggagtttgagcaaaaatatttagagctaactaaaggtgctgctgacaattatcatcgttcctggtggaaaagacatggtgttgtccttgatggtgagatagcagctgtggattttaagcatggatgttttgatcaagcggcaaagtcatatgagaaggtttgtgcactgtatgctggtgaaggatggcaggatttgttggctgaggtccttcccaatttagctgagtgtcagaagagtcttaatgatcaagctggctacttattatcttgtgtgaggttactttctcttgatgaaggattatttttgaccaaggagcgccaagcctttcagtcagaagttgttcgtcttgctcatagcgaaatgaaggaccctgtacctcttgatgtatcatcattagttacattttctggaaatcctgggcctccattggagttatgtgatagggatcctggcatcctttctgtaaccgtatggagtggttttccagatgatataactctcgattcaatcagtcttacattaaatgcaacatataataccgatgaaggtgtaaaggcattgaagagttctacagccattgtgttacaccctggtcggaatactattaccttgaatctaccacctcagaaaccaggatcttatgttctcggagttcttactgggcagattgggcatttgaggtttagatctcatagtttttcaaaagttggtcccgctgatagtgatgattttatgagttatgaaaagccagctaaacccattctgaaggttttcaaacctagagcccttgttgatcttgatgctgctgtttcatctgctttgttgataaatgaagaccaatgggttggcattttagttcgacctgtaaattactcgctcaaagctgctgtcttgcatattgatactggtccagggttggagattaaagagttgcatgtaattgagatggaaaccgatgctgctggtgtatctcggggtgatgatgaccaggtgcagaatgatggtgctcagataagaactctaaattctgataaaaaatttgaatgtttgactcttcatgatgccacaacaaggagagaaagtattgtagatggaatgagaacaatagctctgaaacttgaatttggagcattccacaatcagatatttgaaaggaccctagcagtgcattttacgtatcctttctatgtgaggacacgtgttactgataaatgcaatgatggtaccctgcttctgcaggtaatacttcactctgaagtaaaggctacattgaccatttatgatgcctggcttgatcttcaagatggatttgttcatactggacaaactgagggtagacctaattcaagtttcttcccgctaaacatatctcccacttccaaaggaggaatattgtttagtatctgcctagacaacacaaatgcagaagaagccaggaagcaatcagaaagcatattaaatgtcaaatatggaatttctggcgatagaacaattggagctcaccctcctgtcatgaatgaatctactggagttgatggtgccagacaagagttaatcttcaggagtgcaattactttgcaaaggcctgtgcttgatccatgcctagctgttggttttcttcctctcccttcagatggcctaagagtaggacaactagttaagatgcaatggagagtggaaaggttaaaggatttagatgaggaaggagtttctaaacagaatgatgagatgctatacgaggtaaatgcaaattctggaaattggatgatagccgggaggaaaagaggatatgcatctctgtccacaaaacaaggggcaagaatagttatctcggtactatgcatgccactggtggctggttatgttcaccctcccgtacttgggctgccagatgttgatgaggcaaatataagctgcaaacctgctgggccacatctggtttgtgttttgccaccgcctctcagctcctccttctgcattccagttaattcatga

SEQ ID NO: 65668 - DNA, 141 bp, Glycine max
  Peptide Sequence Number=SeqID_182446
atgttgagttcgatgagcgagttcgagtatgaagagttcggaacttcagagtgtgagaggtcacggcccgcagagtatgagaagaatttagagaccaagagacggctagaagttatgcaacaagtcatatggatgacgtaa

SEQ ID NO: 65669 - DNA, 189 bp, Glycine max
  Peptide Sequence Number=SeqID_182447
atgatggagttcaacaaacctaatgtttgcacgtctgttgtggagattcccaagttcgatacagggataatggagataggtttgcatgattttgaggaagcaatgggtgactgtgatttgattaaggcttccaaggttctgcttttacttggaagcgtggcaatcttgaagagaggcttgatcgtctag

SEQ ID NO: 65670 - DNA, 489 bp, Glycine max
  Peptide Sequence Number=SeqID_182448
atgttatttcaggctactggagaggattattcagtggaacctgccgagagcaggaggccattccgtgcactccttgatgttggtcttgttaggactacaacaggaaatcgcgtctttggtgcccttaagggagctctggatgggggtttggatattcctcacagcgacaagaggtttgctgggtttgataaggagaagaaggagcttgatgctgagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataaggagcccccgaaggagcacaagaggtacaacatgaagaagctgacttatgaggaaaggaaggctaagttgattgcacgcgtggcggctatcaactctgctgctgatagtgatgaagatgatgagtga

SEQ ID NO: 65671 - DNA, 1326 bp, Glycine max
  Peptide Sequence Number=SeqID_182449
atggacatgttggagagtctacttggggttggtctgaaattcaaccatctaagggccaaacgttttggtggcggtgttagtgctcttctcaggatctctttgctcgccacgcgcctcttcttctcccctggctccatgccggtctggaccggggaaccacggccaagtacctacctttgtgctgcccataactcaaatcacccaccctgtgcccggaaaagggcacctttggtgaaagttgtgaactttcttcggtttgttgctcaaattccgaaacacccctatgaaggaggatttgaaaagtggaaactttgtgtggattttggtttggaagaggttttgaaactcccttatgaaggaggttttgttgaggttgagactttggtttggtttgaaactagggatattatattgaagggaagcaaggctaaccctaaatcgctcttactctctttcgtcagtttcgggggaagagatccagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgtgagcaacaaggacattgttgcacaaataatatctgctagcattgccggcgatttagttcttgctacagcatattcacatgagctgccacgatatggtcttgaagtaggacttacaaattatgcagcagcttattgcactggtctcctgttggcccgaagagtcctcaaaacacttgaaatggatgaggagtatgaaggaaatgttgaggctactggagaggattattcagtggaacctgccgagagcaggaggccattccgtgcactccttgatgttggtcttgttaggactacaacaggaaatcgcgtctttggtgcccttaagggagctctggatgggggtttggatattcctcacagcgacaagaggtttgctgggtttgataaggagaagaaggagcttgatgctgagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataagcagcccccgaaggagcacaagaggtacaacatgaagaagctgacttatgaggagaggaaggctaagttggttgcacgcgtggcagccatcaactctgctgctgataatgatgaagatgatgagtga

SEQ ID NO: 65672 - DNA, 1284 bp, Glycine max
  Peptide Sequence Number=SeqID_182450
atggcgtcggtccccagcaccgtcgctccccgcaccttcctgccgtcgattcccaagccgagagctcctcttcacgccgcgaaatccgtcgccagcgccgcgcgcaacttcccgagactttcgcacaacctcattctctccggaaacaaacgcgcggtggcggtgaactcggcgtcggaggagttcgacgtgatatcggtgcagagcgaggacattaccgaccagcaggagggcgtcgtggtgagccgcgtcgagatggaaggtggagacggcgaattggcgacgcaggtgagccgattcggcgcgaacgagggtttgctgtcgttggaagggttttcttcttcgtcttcgccgtcgtcttcgtctctgatcgggagtgagagcgtggacatggagaagctaattgatagaactatcaatgctacgattgtgctcgcagctggcactttcgccgtcaccaaacttctcaccattgatagtgattactggcacggatggacgctatatgagatactaagatatgcacctcagcataactggtctgcttacgaggaagctcttaagacaaatcctgttcttgccaagatgatgattagtgggattgtttactccttaggggactggattgcgcagtgcgttgaaggaaaacctctgtttgagtttgaccgtgcgcggatgttcagatcagggcttgttggttttactcttcatggttctctttctcatttctattatcagttttgcgaggagctatttccttacaaagaatggtgggtagtacctgccaaagttgccttcgatcaaactgcatggtctgcactttggaacagcatatattatactgttgttgcattactgcgtcttgatcctcctatgagtattttaaatgaattgaaggcaacgtttttccccatgttgacggccggatggaagctatggccatttgcccatctcattacttatggtgtgataccggttgaacaaagactcctctgggtggataccattgagcttatttgggtgaccatactttccacattttcaaatgaaaaatcagaagcaagaaactctcagtctatggtgccttcagaggtgaaatccaccacatatgttcatcctcctgagatttttgatgcggaatgtgaaaaagctaattatatatacgttgcatcccgcggaaattcatcccataggtgtagcattagtggggaatcctcagttcatgtgcggctacgccggctagagtgcactgatatattgcatgcgatgtgtggacctggctga

SEQ ID NO: 65673 - DNA, 1407 bp, Glycine max
  Peptide Sequence Number=SeqID_182451
atggagggtgcaaagagttgctcttgttttgctacaatatctgtggcattggttttgctccttcttccgaatgtggctgtggtttgccatggaggcaagacaagcactttcatcagaaaggttgagaagactgaggacatgccgcttcatagtgatgtatttgtttccccttcaggctataatgctcctcagcaggttcatataacactaggtgaccaagtgggaagggccatgatcgtgtcatgggtgactctggacgaaccaggaaagagtctagtgcattactggagtgatgactgcccgcacaagagggtggccaagggaaatcatttcacctatagatacttcaattattcttctggttttattcatcactgcacccttagagatttagagtttaacacaaaatattattatgaggttggaattgggcatactaccaggcaattttggtttgtgacccctcctgaagttcaccctgatacgccttatacatttggtgatctgggtcaaacttttgattcaaacaagacccttgctcactatgaatcaaaccctcacaaagggcaagctgtgttgtatgttggagacctctcttatgcagataattacccaaatcatgacaatgttaggtgggatacatggggaagattcgtagaaagaagtactgcttatcaaccttggatatggactacagggaaccatgaacttgactatgctcctgaaattgatgaaacagaacctttcaagcctttccgccaccgttatcacgttccttaccaagcatcgggaagtactgaacccttttggtattctatcaagatagcttctgcacacatcatagttttggcttcatattcagcttatggcaaatatactccccaatatgaatggcttgaggcagagctaccaaaggttgatagaaccaagaccccttggttgattgttcttgtgcactctccatggtataatagttacagctatcattacatggaaggtgaaaccatgagggtaatgtttgagccttggtttgtgaagtataaggttgatgttgtgtttgctggtcacgtccatgcctatgaacgaagtgaacgaatctccaacattggatacaacattacgaatggtcgatgcgggccttcgaaggaccagtcagctcctgtatacataaacattggtgatggagggaacattgaaggcttagcaaggaacatgacaaatccacaacctgagtattctgcatacagagaagcaagtttcgggcatgcaattttggaaataaagaacagaacacatgctcattatagctggcaccgaaatgaagatgaatatgctgttacagctgattccatgtggtttttcaacagacactggcatcctgttgatgattccaccacaaccaagtga

SEQ ID NO: 65674 - DNA, 192 bp, Glycine max
  Peptide Sequence Number=SeqID_182452
atggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgtggtaaaaatgattttgcctcaacctagattcgactag

SEQ ID NO: 65675 - DNA, 621 bp, Glycine max
  Peptide Sequence Number=SeqID_182453
atgaatgtcttggattctaatgtggaagctctagccttcaactacttgagcttcggttttctcactgccctcaacaacctatggacctggctcgctctcttaaccgccgccctcagcttctggaagattcgctccgcgggctgccccaagcccaggcccaagaccgaggcccaagcccaaccttttttcaggcctgaggctgtcgcggatttgttaatagtggagaaaacggagccgacgaaacaacatgcagcgacggctccgttttctccaccgttattacgaggagaaaataacagtgaagaaaacggcgagaggaaggggaagtttaccgtttattacgaggaggaggacatgggcatgcaatgcacgtgcgatgagaatgaggggttgttaacggcgtggaaagagaaagaggggaccgaaacggagtggtggaataggtgggagaggttgttgcagttgagaaatggggagagcgagaacgggtggtacaggtggcaggacttgacggagcttaacggcagcgtcgttaggatatgggacggtgggttaagtggttcttccgttagggaatcgtggtacaacaactacaactctagctgtatgcatgtctggtaa

SEQ ID NO: 65676 - DNA, 1851 bp, Glycine max
  Peptide Sequence Number=SeqID_182454
atgtctgattatgatcgtttaaccattgcttcggttcatcttgaccaagatgtgattccctggttccaaatgatgcaaagggctaatcctttttcctcttggcatgtttttacaagagccctcaagttggattttagtccttctgtttatgagtgtccaagatccactttgtttaaattgatgcaaattggtactgtaggtgaatactatatggattttacatcccttgctaacatagttgacggtttgagcagtgaagctttgatggattgctttcttagtggtttaaaagcgaacaaatgtagggatgtccgagccatgtcccctagtaccctggccaaagcagtagcactagccaaactgtttgaggaaaggtatgaaccaagttctaaacccaaattctctaatagccaagccaaaacctcaactaccaaccaaccttaccagaaatacacttacaaccccgtcaagactgatgcttttggcaaagccttattgccacaacccctgaaatttgccataaaatcatatcagaaaggtttgaaaagtctcttggatcaatcactacaaactcctaaacagcaagcatggttgcataaatccattggtaatgattttcgaattgaatacaagccagggaaggataatgtcacgactgatgctctttcccgagtgttctttatggcttggtcagaaccacaatttcaattgattgataaattgaagagagaaatgcttcatgatgaacagacacaagtcatcatgaacgattgccaaaatgctcagctaccggattatccatataagacaagatgtgaaggagtttgtacgaacttgcaccatttgtcagcaagccaagtcggagcatgtcgtactgctggtttattgcaaccattacctattcctaaccaggtatgggaggatatcgctattgattttatcattggattgcctaactctagtggatttactgttattatggttgtgattgatagattgacaaagtatagtcattttgtatcaatgaagtctaattgcaccagtaagactctggctgaagcttttatgtgccatataattaagttacatggtgttcccaagtccatcgtctcggatagagataaagtgtttaccagtaatttttggcaacacctattcaaaatacaagggactaccttagctatgagttccgcttaccaccctcaaacggatggacaatcggaagctcttaataagtgcttggaaatgtatttgcggtgttttacttttgataatccaaaggcctgggctaaggaacctccagctttacttagatacaatggtagctctcaagatccgccagtagtgcgggaagttttacataacatacaaatgctattggacaggttgaaagggaatttgatcaaggcacaaacagctatgaaaattcaggcggataagaaaaggcttgatagaaagttccaagtggaagatgaagtgctatttcctaacaccgcaaagattcaccctgttttccatgtttctcaactcaaacaattccaaggagctgccatagagccttatgtgccactaccacttaccacatctaaattgggacccttattgggccctacaacaatgcttgaaactcggaccattgttaaaggatccactctaattcctcgagtactcattcaatggaaaggttgtagtacgacagagacaacttgggaggatgttgcagaaattcaagccagttatccacaattcaaccttgaggacaaggttccttttaaaggggaaggcaatgtaatgaacttgccaggcagcagactgcacttggccaatagcaagctaagggattttgtgtga

SEQ ID NO: 65677 - DNA, 138 bp, Glycine max
  Peptide Sequence Number=SeqID_182455
atggtgctttcggtgtgtattctctgccatgaagatgataaaaacaccaaatgtaaggcttttgtcaataaggctttgccacttttggtgaatattacgtttgttgacctcaatcttgaacataaattcttgatctaa

SEQ ID NO: 65678 - DNA, 123 bp, Glycine max
  Peptide Sequence Number=SeqID_182456
atggaagctgcaaaagctgcaataacaggtggcattttagttttggagattgtggtgtcaacctcaggttctacaacagctggtgaaggagcatcctacaatggccctagaggtatgctttaa

SEQ ID NO: 65679 - DNA, 264 bp, Glycine max
  Peptide Sequence Number=SeqID_182457
atggagaggaaacacatgttgaagaaaatactgattcagtggtcctttacgatcccatcaactgttgcttttttggaaaaagatcttacgttcacattggacaccaaagataacaagaaagaggtgaaaattaaaaagaaacaagcggaagaaaaacaaactgatgagttgaagtgcaataatccttcctacgcgcaatggaagtggaccacgacatacccaaaaaagtacctgttgatgggatcgaagagaagcaacgaatga

SEQ ID NO: 65680 - DNA, 372 bp, Glycine max
  Peptide Sequence Number=SeqID_182458
atggattccgaggatgttaatggttgcctcatggataaacataaacctgtggtggcttcttctttggtttgtgaaaaggttgaagatcatgtaaacggagaagatgatagtgattccaattctttgttgcctcctcggagaggtggcatgtccagaaactgtgaaaagactcgccggaaagtgcagtggaatgataggaatggaaacaagcttgctgaggtgttggaatatgagccaaggaaaaggaaagaagagggtagtgatgacatgtctgtaaatatagtggtttgtgatggtaagatggagtatttggatcaacttaagaactactactctcttaaaggttggcctatgtaccatgtcatggcttag

SEQ ID NO: 65681 - DNA, 162 bp, Glycine max
  Peptide Sequence Number=SeqID_182459
atgttgtttgaaattcaattgcgcacactttcaccgttgggatttgaatcgcataaagacagtacaagtggaggcttcaatctcttctccgtctctatgacgttggagaattctatcggagcagtcggaggaaaaactggaggaatctcagggaaccgctag

SEQ ID NO: 65682 - DNA, 306 bp, Glycine max
  Peptide Sequence Number=SeqID_182460
atggagcccatgcaaatcgcaggagggaatggcgctttccctgtgaatgcgacagctggccatggtgtcgccattaacgatggcgttttgctggagcttggactcgccagtcaaactggcgagttgatgttagggcactgtttgcccagcctacgcgtgcagcaggaagttgcagagagggacaggcttttgcagatgaaagcgccagtgccactagcgatttgggctgcagttgggagtagccagtggcactggcgatttgaggttgatgtagccattcccaatggcgatttcagccctttataa

SEQ ID NO: 65683 - DNA, 234 bp, Glycine max
  Peptide Sequence Number=SeqID_182461
atgtggtaccatggagaccagttagggtcacgatgttttgcgagaatgctccaaccatatgggattagcatcgacttaaaggagcactcaaacccggtgacccccaaggcctacactccgaagagtctgtcagggcctctccctcctgattcaggtccaacccctaaaatcattttagacacagacactgctcgtgaattatataatacccatgacctcacactcgtgtgttaa

SEQ ID NO: 65684 - DNA, 258 bp, Glycine max
  Peptide Sequence Number=SeqID_182462
atggtaaggacgtgttgtcctctgaaggcgagggcgtgcaaccctctgaaggaaaggacgtgtagtcctctgaaggcgagggcgtgtagcctcctgaagaggaggacgtatagtcctctaaaggcgagggcgtggagccctttaagccattctcttatcctgggttatggagaattcgtccctaacagtcaaccacttaatccaagtcaccacatacaccagttagcccttcgtccattaagcatgaatacaagttag

SEQ ID NO: 65685 - DNA, 267 bp, Glycine max
  Peptide Sequence Number=SeqID_182463
atgtgcgctaagctcattagggttgtgcttagcggcaccatgaaattcagaaaattcatgaagtatgggagcttagcgagccagacccgcttagcccaatggctgccgcaaagaaatgtgcttagctcagcctcacttagccacaggtatcttaataggaggatgagtgttcatcctcacaagatgaactcgcatagcgcgataggcgcgcttagcgagttcgtctggaaacgcataaattcaatgaatattgatgaactcgcttag

SEQ ID NO: 65686 - DNA, 141 bp, Glycine max
  Peptide Sequence Number=SeqID_182464
atgatgctccacagcctaaataaaaggctcctgctaggtggattgttgtcaagtattttaacgatcctagaccattggagcaaagagattaaaggcgctttggatccaatgggcacaatattatctccgagttacagctga

SEQ ID NO: 65687 - DNA, 387 bp, Glycine max
  Peptide Sequence Number=SeqID_182465
caagcatccgctaagcacatcactcacgggctaagcgcgaggaagactctggaagaagatgagttgtacaggcttcctggttatgaaaagctaaatcctttgttggatcttccttgtagtggaaactggtctgattctaaagtccttgatagtacagggctatgttgtcatactatcacgaggaatcgggacatttgtagagatggtttccaagttgatggagaggaacaaggtgtcattggatttgatggagtagaaggtgttagcataggaaagggactcaaacgtggcattggcattgctgggtttctttgttgctgcaaaggaggtggagggagcaagggagaaatggataaggagagaggggaagaaaaggaagaggaatag

SEQ ID NO: 65688 - DNA, 108 bp, Glycine max
  Peptide Sequence Number=SeqID_182466
atgctagagaatcttcaggttcctccgtcgacaacggaatcggccccagtgctgaagcgctatgctccacccaaccagagagatattacaagaacccaattaaagtaa

SEQ ID NO: 65689 - DNA, 198 bp, Glycine max
  Peptide Sequence Number=SeqID_182467
atgtctcgactgagccttagccccatattaagcgaggtcgtgtgggttagggcccctgtaaggtcccttattaaggagataaggcctgctagggctattatggagggccaagcgggtattttgatgtacggctctaagaggatgatgttaggggggttaaaacccatacccatggaaaagtcaaatagactcgcttaa

SEQ ID NO: 65690 - DNA, 1383 bp, Glycine max
  Peptide Sequence Number=SeqID_182468
atgaaacggggccgcgttccggccccgctggcgcgactagtcggcgcggctcatgtagcggcgttcggcgatatgaatgcgaattttgtcgccggcgctgaggtattccggcacgtggatcaccaggccggtcgccatggtggccggtttgttgcgggcgctggcggaagcgcctttgatgcccggcgcggtctcgacgatttccatatccacggtctgcggcagctccagtgccagcacctggccttccagcgtcagcacctgcatgcccggcaggccgccttccggaatgaacagcagctcgtcttcgatctggtctttcttgaagatgtacggggtgtagtcttcgtcatccatgaacacgtattcttcgccgtcgatatacgagaagttcaccttgcggcgcgacagggaaatggtgtccaggatatcgtcgcccttgaagcgttcttccactttcaagccggtgcgcacgtcggagaagcgcattttgtacagggtgctggcgccgcgggcgcttgggctctgcacgtcgatatcttttaccagcagcagcttgccgttgtagctgatcgccatgccgcgcttaatttcgttagctcttgccatttcaattcatccgcaatgaagagtattagagaagttgcgacaaggtactcgcgccgccgatttcaggcaatagcccggcgtaaaaacagtgcgggaaagggagggcgatcgccctcccgtcggggattagcggaagaccggcagcaggccgaacagcgaaagaatatgcgcggcggcgttgatcaggccgaacaggatgacgaacaggatcacgccgttgccgcccggtgcgcggtaaccggcctgcgggtggcggcggcggctggcgcgcgccatcagcgccggcacgatcaccgcccagacggtggccgccagcccggcgaaaccgatggcgtacaggaaaccgttcgggaacagcagcgcggccagggtcggcggcacaaaggtcaccagcgcggtcttgctgcgtccgacggcgtcgtccttgaacttgcagaagtctgccaggtagtcgaacaggcccagcgacacgccgaggaacgagctggccagcgccatataggagaaggcgttcagcagttggctgacggtctggctgctggagacgttgcccatttgcttgagcaggctgccgatgttgccgccctcggcgatcacttgcttaaaggcgtcgcgcgcgatattgccctggatcacgtactgccacaggatgtagatagccaatgccagcagggtgccgtacaccaggctgcgcaccacggagccgctgtccttatggtaatacttcaccagcccgggaatgttgccgtggtagccgaacgaggtcagcagtaa

SEQ ID NO: 65691 - DNA, 612 bp, Glycine max
  Peptide Sequence Number=SeqID_182469
atggccttcggcgtgcagtcgatcgaccgccagacgctcaagaacaacgtggtgggcctggccaaggccgcgcgcactttcaacatccctaccaccatcaccaccgtcgaaaccgatggcttctcgggcaacacctaccccgaactgctggccgtgttccccgagaacaagatcctggagcgcacctcgatgaactcgtgggacgaccagaacgtgcgcgacgcgctggccgccaacggccgcaagaagatcgtggtggcgggcctgtggaccgaagtctgcaacaccaccttcgccctgtgcgccatgctggaaggcgactacgagatctacatggtggccgacgcctcgggcggcacttcggccgacgcgcacaagtacgcgatggaccgcatgatccaggccggcgtggtgccggtgacctggcagcaggtgatgctggaatggcagcgcgattgggcccgccaggaaacctatgacgccgtgaccggcatcgccaaggaacactcgggcgcgtacggcatgggcatcgactacgccgtcacccacgtgcacaagctggccgagcgcgtgacgcacggcgaacgcatcggccccaacccggccaagtaa

SEQ ID NO: 65692 - DNA, 276 bp, Glycine max
  misc_feature (143)..(143): n is a, c, g, or t
  Peptide Sequence Number=SeqID_182470
atgagacctactggtggcgtactgcacactgaatcgttcgatgagggtgtcgaagctatctatggatcttggaaggcgtccaaatgctcgtctggatctgttgtctcatcataccgctcgaggttaagtgatttccaccccanagggtatgtctacctccataacgcggtcgataaaaggatgccaatggacagtctgtgttgttggacgatgcatgagagagactcagatcgtctgcaatgttgcttgagtgtcgggggtgtgattcccctataa

SEQ ID NO: 65693 - DNA, 463 bp, Glycine max
  Peptide Sequence Number=SeqID_182471
cgcgcattagtgaatttcggcttagcacggcttttctcgctcagcggatggaccgaagcggtgcacttagcgggatggcccttcgctcagcgaacaagcacagctcatccttcttccagattcttcctcgcgcttagccgaggaatgttgcactcaacggatagctcgttaagccagcaaattggctcagcgagaggggtaggttgtgacaagaggtttaaaggaagcaacgatgaggtcgatggtgctggcttggttgtgcttgttgtcgtgattgcaaaatcaaaggtggttgtatggtatcgtggtggcgaagagagttgtgatagtggtatggttcgtggaggcaaggcgacaggcgaggttatggtgagagattttggattcatggtggtggcaaggtcaccatggtggaggcgaggtgcggaggtatggggagggaagggttgggttcacggtatgg

SEQ ID NO: 65694 - DNA, 333 bp, Glycine max
  Peptide Sequence Number=SeqID_182472
atggggtggtgtatttcttgttgggatggttttgttcatggggttgaatatggatttggagcacatgaacgcgacacgactgggatttttgaagtggagccgggacactgccctggattcaccttcaggaaatcgattttcattggatcgacggacatgggaccgaaggatgttcgtgtgttcatggagaggctggctgatgagtattctgggaacacctaccaccttatccagaaaaactgcaaccacttctgcgaagatctttgtttcagattaacgggaaagtctattcctcgatgggtgaatcggcttgctagacttggtaagggataa

SEQ ID NO: 65695 - DNA, 141 bp, Glycine max
  Peptide Sequence Number=SeqID_182473
atggataccttagagccctacactgggacaatgagagacaccatgcatgaggctcaagcgaacctatgggcaaatcaaaagttctcacccggaaccatcgctaaaccagcgggaagagcaatgcaaacaatacatgcatga

SEQ ID NO: 65696 - DNA, 198 bp, Glycine max
  Peptide Sequence Number=SeqID_182474
atgttgtgtaaactggttccgcgcaagaaaaaacccggttcgaacccggtttaccttaacgtctacgacctaaccccaattaacggttacgcttattggcttggcctcggagtttaccattctggcgttcaaggaattaaacaaaatttcggtgattgggcatacccaatttcaattcatatccttggaattgattag

SEQ ID NO: 65697 - DNA, 609 bp, Glycine max
  Peptide Sequence Number=SeqID_182475
atgtcaaaggttgaaggttccaagtacgaggaacttagaatgcaaagaattacagaaaatcaagcaaaaatagaagctttagggttgtccaaattggccaccattttcaaggatagaattcaaaaagctaagaaaaaggataaaaagaaggccaacgatgatgatgaagactatctacctaaatatgaagggggacttggatcaaattcttcaagcaagcatgtcataaagaagggacgtgggcatacaataaatgcaaaatttcaaaagaaaaaggaaaatcttatggcaaagggaaaaaatatcgacatccaatctcctccaccattttataaaatttgcgggaaacatacaaaatatttcaagtctgaggcacaagtgtgtattcaccagaaagctcctttacaaattaatggttggagtgaaattagtaaggatgatgtagatgaaatgtggcgacatatgaaggatgctttcagtttatctaacgaggtgaaagaatatgcaatgaagcaaattcaatctcaatacaagaataagctttatcatttacatcaagtttatcttaaagaaaagggtagaccaaaatacgtatctccagaagattga

SEQ ID NO: 65698 - DNA, 210 bp, Glycine max
  Peptide Sequence Number=SeqID_182476
atggcggcactgcttgtcaatggttctcgcaagatgcactggcgagtttcatgcatacgtgggggaggcttctcgccagtggtgctggcgacacacccacgtcaccatgcatctcgccagttgtgctggcggcacatgtaccatgtagccacatcacgaagcttctcgccattgataatggcggcacacctatctcgccaatcctgctga

SEQ ID NO: 65699 - DNA, 207 bp, Glycine max
  Peptide Sequence Number=SeqID_182477
atgaaaagcttggttccctgttctgagccatgctccgccaccctacaccctggttcagccgcactgtcttccttggttcaactgcttgtttgtgctgcatggactcctagtcacaagtggaagcaatggaagttgcgaagaagaaacccagcaagaaggagaacagaggagagaactctaaagagaccagatactcatagaccatag

SEQ ID NO: 65700 - DNA, 279 bp, Glycine max
  Peptide Sequence Number=SeqID_182478
atggaggagttgattaataaaacacaactctctcccaaaataatcccaacttcatcacgtcagctcggtggctccacgaaagaatctcacttcttgtccactactgctgtcattctgctcccacgaacaaaggtttgcgatcatcacaggtaccaaccacacggtacaaaaattgcgagggggacatccaacaaggtcactgcacccccctcccccatgaacatacacatcacacaacgtatgaaacatgggcaccatcaatgcactgaccgtggataa

SEQ ID NO: 65701 - DNA, 420 bp, Glycine max
  Peptide Sequence Number=SeqID_182479
atgggaagtccaaattggccaacaattatgttggccttcaatcgtggattcaaagttttgatggttcacgaacagaagaaggcaaaatataaagtattgatgtgggggcatacaactttagttacaaaaggaagtgaagtgcgcacaaatttatggagattcccaattgtgattcagcacatgaggggagagtataagtgcaacacgattgccttagaagaattctatgatttagctaaacaattgcttagttgttttgctgatgtaactatagaacatgttttcaaaggagaaaatgatgaggttaatcaacaagctcaccatgcctttggatataagaggttgaaagatgaaactttgaaatcaaccatcaaagagtattgcataatggaaattggactagtgaatccacaacaatag

SEQ ID NO: 65702 - DNA, 714 bp, Glycine max
  Peptide Sequence Number=SeqID_182480
atgacttcttctctcattcgaacgctccaaagagcttctgcatcgctcattcgaacctcgagaccgttaagcccacacgctgccaccacgcgtgtcggagccagaacctacgcagcagaaccaaaaccagaacccgcgaccaaatcgcccttcgattccaacatcatacgaattctccgaaacgaaatcgagtaccaagaagaatacgctcctccacaccagcctgagactaaattcaattcgtttacggttgaagagctacgtggggagcaagtggtcacgattaaagggaaatttggtgaatgtgaggatattaaaattgaggctaccatgtttgatgggtgtgagcatgttccggcgtgtggagatgatagttctggggtgaatttgcgtcttcaccttagtttaattgtagatatagcaaaaggggaagaaggtgacagtgagttggagtttgtgtgctcggcgtggccggattgtttgaatgttgagaaagtttacatgttaagacgcagccggatggcggctaggccttacgttggacctgatttcagggacttgaaggctaaggttcaggagacgttttacgagtacttggatgtgaggggagtgaataatgagcttgcaattttcttgcatgaatacatgatgaacaaggatagaattgaacttctgcggtggatggatagtctcaagtcttttatggaaagatag

SEQ ID NO: 65703 - DNA, 225 bp, Glycine max
  Peptide Sequence Number=SeqID_182481
atgatgcttgatttggtttgctttgcctatgtggatctgaacagaactgctcacgtgagcgagcctttgtcttcagcgagacagcaagagagagtggatgtgcagcggccaagctttccgtttagatttgacggtgaaatttgcgaacaaagttacaacaattgttgtttggtggttgaggatttaacaataggagattcagtatattacatagggtatctatag

SEQ ID NO: 65704 - DNA, 462 bp, Glycine max
  Peptide Sequence Number=SeqID_182482
atggagtccgaactcaaagaccttaattcaaagccaccgaactataatgacaacgccaacagcgttttcgacgaccatcttctgctgaagttggagcctccggcctctgccgatagcattgctgagatggagaagaagtatgccgccgtgatgtgtacgacaccatgggatgcaacgagtttccgaaaaaggagaagctctagctcagcttttcattggatttgcactcttttctctgcttcgaccggcgaggaggaacagaaagattacgctcacatactgcgtatgagtttgctcaatgcttttgctattgatagtgatgctggaggaattgaaaaaaataataatattaaggctattgatcttctacagaagaaccaggataatgctaaagccagtttacaagttcttgccgctgatatacatttcttgagggaccaggttacattaacccaggtctga

SEQ ID NO: 65705 - DNA, 192 bp, Glycine max
  Peptide Sequence Number=SeqID_182483
atgcctacttctcacacaactcttttattctttaggtcacaaagaagcaaagagtgcccaatctgttggcaatcacttgctttgaaagatcctgttagccaagagcttgtagctgcagtggaagatgagaaatgcatgagatcaagaaacattgctaattctcgtgccccccttggaattatttttttgtag

SEQ ID NO: 65706 - DNA, 204 bp, Glycine max
  Peptide Sequence Number=SeqID_182484
atgacgtgtacgtatcagtttcagaggcaagcatgtgatacaatcagaacaattgagggttactctgatataattgttatgcggcaacatccaactcagttgggtaaccctgaaacatctaatgctgaggactggatgggtctggttgattatgcttggagccatgctgtgatatctgatgaacacttgaacactttaaggtga

SEQ ID NO: 65707 - DNA, 774 bp, Glycine max
  Peptide Sequence Number=SeqID_182485
atgctcatgatggtgctggtcattttcgcacttcttcagctcatctccggcgggctttttttctcgtcattaaaacaaaaccaggacagctctgcggcctcgaacgatctccgcctgcagcagagtgaactcacctccacgtgggatctgatgctgcaaacgcgtattaacctgagccgctcgtccgcgcgcatgatgatggatcccaacaatcagcagagcagcgcgaaaaccgatctgttaaagaatgcccgcgccacgctcgctgacgccgctaaacactacgacgccttcaaaaagatcaccccgcagcctgcgatggagcaggtgagccagaatattgatgaaaaatacaacgcctactatgccggtctgacggagctgattcagttcctggagagcggcaacatggacgcctatttcgcgcagcctacgcaagggatgcaaaacgcgctcggtgcggcgctgggagagtatgccaaagccagcggggatctctatcactcggcctttactgaaagccagaatgactaccgctttgcaaaatggcagatggcggtgatggcgctggcgctggtcattgtgctggtcgcggtctggtacggcattcgtcatatcctgctgaacccgctcggtcgcgtcattgctcacattcgtgagattgccggcggcgacctgaccaaaacgctgaccgtgtccgggcgcaatgagatcaccgaactggccaacagcgttgaccatatgcagcgttcacttatcgataccgttgccaac

SEQ ID NO: 65708 - DNA, 231 bp, Glycine max
  Peptide Sequence Number=SeqID_182486
atggagatatgtcttaggaagcttcgtacaaaatttgaagatgatccaacgggtgttacacaatgcatcactataagaggaaaactcaagatgaggcttcattgtcatcaagtgagtcggagacccatcatgaccacagatcgacctccactccttatggctcacatagacccgggtatagggcctagtatctcaatgtgtgtgcaaggtgtaggtgtcatgtgtttgtag

SEQ ID NO: 65709 - DNA, 840 bp, Glycine max
  Peptide Sequence Number=SeqID_182487
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctcaggagcacaggtcgctcgagcaaactgaccaatggcttgcacttgaaaatcctgatgagtcattagagacatctaacaacaactttcaaaattgccccatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 65710 - DNA, 309 bp, Glycine max
  misc_feature (247)..(247): n is a, c, g, or t
  Peptide Sequence Number=SeqID_182488
ggcatctccgcatgtcatcggactcgccgtctctggatgacaaaggtgcagatgatgacgttagtctcggcgtgtcaatcggctcgcttgcctctggtgcagaagacgacgttagtctctgcgtgtcaacgggctcgcttgcccctggtgcggataaccactcgggtatcttcgcctgccacctgagttcacgggtcaggattaacagaaatcatctttgtacggataaccactcgggtatctccgnctgccaactgacttcacgggtccagattaacagaaatcgtctttgtacggataaccactcgg

SEQ ID NO: 65711 - DNA, 207 bp, Glycine max
  Peptide Sequence Number=SeqID_182489
atgcaatgcataaaatactacgatccattgattggtgcaaggtttagattttacaagattttattgtcccacgctcctggcacacgctgtggtttggctcagaaaagttcatggacctccttgctttctaactggggcgtggagaacacaggttttgactcgagactaagatgctcgtctaggccaagcactttccagttgaattga

SEQ ID NO: 65712 - DNA, 157 bp, Glycine max
  Peptide Sequence Number=SeqID_182490
atggatgactcaattagtaatcccctttgtgacgtcaatgatgatgaaattgaggttgaggatgtcgaaaaagaatataagtttgttgaacctgataagaaaaagaccaagtccacaacattcgattgttggaaatttttcactaagattggtgtgg

SEQ ID NO: 65713 - DNA, 576 bp, Glycine max
  Peptide Sequence Number=SeqID_182491
atgattggaggctacaattctgaacattatattaacatcatattaatcttccaatgcaatgcatataagaaattaaacacgactgctgatgggaaagttcctaaaactggaccccagtggcttgaactgaagactcacattcaacgcggaggctatgagtgtgggtattatgtgatgcattggatgtggaacataattggcgcagagttgaagagtgattggagtgtgtggttcggtgatggctcggcactagacccggaggcgatcacaacattacgtaaaaaatgggtagcttactttttgaaacttagaaccatccaatgtgttatcttcatctatgagaggtcgcaaacatacaatagttactgcagagaccatcaaggagatttgaatatcagtattgctatccaattaaaatatgctgaaaatagaaacaagcatggaaagacaagggtggcaattggagtattggtatttgccagtgactggtggaaatggcaattggttagatggcagagtcacctagagctaactgatcccctttgctttagtctcagtagtggaagaactggttga

SEQ ID NO: 65714 - DNA, 261 bp, Glycine max
  Peptide Sequence Number=SeqID_182492
atgagaaaatcttctgtttccatagattccttgataaaacatcctaaagaaattgcaaagtcattgaataaatgtcctcatcaaccagtaattgaagaatggatccacgacaaaatgaatccatatgtggtgctgcagacaaaggatctagcagggcagcacatgcgttatgcttgtgcttcagggcaacttagaatgaggcggattgtcttaccagaatctcacttctttacccctctctccctttgtgcgcatttttga

SEQ ID NO: 65715 - DNA, 464 bp, Glycine max
  Peptide Sequence Number=SeqID_182493
atggcagcacctttttctgcagcatctctttttgcaatcagagaagaggatcagaatcagatgaagcagcagcagcattcctcaacaccatcatcatcaaccactccagctgcaccaccccagaagaaaagaagaaaccaaccaggaacaccatgcaaatccagatgcggaggtgatagcactatctcccaagaccctaatggcaacaaacagcaaaagaccaacaaagagccaaagagaaaggtttatctgtgtcccgagcccacatgtgttcaccatgacccttcaagagcccttggagacctcactggcattaagaaacactactctcgcaaacatggtgagaagaagtggaagtgtgataagtgctccaagaaatatgctgttcaatcagattggaaggcacactccaaaacctgtggcactagagagtatagatgtgactgtggcaccctcttctccag

SEQ ID NO: 65716 - DNA, 240 bp, Glycine max
  Peptide Sequence Number=SeqID_182494
atgtgtgcgagaaaagagaaagctcaatgcaaggaacatttcttccaccacaaacataatttccaaacttctaatgatgttacacatagggtcataagggatgatgggaggctaagggaggaggggtcaaggtacatgacgatggcagtgtatgactttccacaccaacaacgacgcaacaatggagaaaccttccacggcgaggcaaggcaagagacacctacgacagtcggtgagtga

SEQ ID NO: 65717 - DNA, 465 bp, Glycine max
  Peptide Sequence Number=SeqID_182495
atggttccaatgggagcttcctttggtgctctattttttggagggctaggaaggtgtcacggcgttcaacaagctcaacactgccagccaatcagtcactttttactctataactattggtggcttgggaaaggaaagacaaaatattggagggtggtttggtgtgctatagcttggtcaatttggagttaccgaaacacattgtcttctatgaggggtgtgacaatatttattgctgggaagggtttggtttgtatacgggccattcacgattcagtttcgcgcaccttcgccgttgggatttgcgatataatattcacagagagagaaaaagaaatcgcacgaggacagtacaagtggaggcttcaatccgttctcagtctatatgacatttgggaactctatcggagcagtcagaggaaaaaattggaggaatctcaaggaaccgctgctaccgatgtctga

SEQ ID NO: 65718 - DNA, 543 bp, Glycine max
  Peptide Sequence Number=SeqID_182496
atggtgatagtggtggaatcagctctggcgacaatagatatactagtggaggttgtgatggcagtggtggcagaggttacagtggtggtggtagtgatgtttttggtgtcagtggcaatggtagtggtgctaatggtgatagacaatggtggtgacggtggtgacagtgacagagatgatattggtgatagcggtgatgataatggagcgatggtggtggtagtagcaatgtcgatgggtggtattggtagtggtggtcgtggtagtagtaatgtcaatgatagcggtggtgataatggtggtagcgatgacattcgtggtggtattggtagtggtggtggtgacaatggtggtggcaatggtggtagtaatatcggtggtgatgatggtgtggtggtagtagtaatgttagtgagaatgatggtgtcgacaaccagtggtgggggtatggtgggggtggtggttgtgacaatgttggtggtggtgacggtgttagtgacattggcactaacgattgtggtggtggtggtagtagcgataatg

SEQ ID NO: 65719 - DNA, 2043 bp, Glycine max
  Peptide Sequence Number=SeqID_182497
atgaaggattcaggaaatgcagccattgtccaagacggttatgaatcatctgaagtattggtggtgtctaatgataatctagaaattgaatcgattatggattcatgttgttcttggcgcatgactccaaacatatcctgctttgatgaagagtttagtgatcaagcagaaagattagtgcttcttcaaaacaataaaccttgcaagattgctggaattaggtctataaggttcaggctttatgatggggttgaaaggcttcttattgagggtgaacaaggattactaaaagcagtgaaaggatccatggttgttatgaagggaattaagaaaaatggcttgtattcattagaaggtgacatagtaattggttcaacaacttctatatcagaaaagttggtgtccaagactgagttatggcacatgagagaaaatggaattgcaaggcacaggacagttgctggtactcctcaacaaaatagtttagcaaaaagattcaacataaccattttggaaagagtgagatacatgttgttgagtgtaggtctgccaatgattttttgggcaaaagcagttatgaaatgtccatccactgcccttgaaatgagaactcctgaaaaagtttggtcaggtcaccctccaaacttgaatagacttaaagtgtttggttgtctttcctatgctcatattaggcaagacaaactgaaacttagagtagtcaaatgtatgtttctaggctacccagaaggagttaagggatacattcatgatgttgtcttcaatgaaactcacatggcttataaaattgactctggtatgtcaaaatctagcaatgatcagaatgaaaaggatgaatatgaaaaattaaaccttgaggtggagcctaaggacaaggctgataaaggattttacaaggttgaaaagaaatctcaaggaccgcaggtcgcttggggactggatgtaggcacaggtataaaaggtgttgaacctgatagattcaaggccaaacttattgctcgaggttttactcaaaaggagggagttaacttcaatgaggtattctcaactgttgttaagcatagatcaattagacttctcttagctatggtagctgaacttgatcttgagcttgaacaaatggatgcaaggaagagtatgtttgcaagcttaagaggttcctttatggcttcaaatagtctcctagacaatggaataagggatttgatgaattcatggctcacatactgttcaaaaggagttagtatgacaattgtgtttatttcaaattcccttctgaaggtcaaagctgaattgaatagagaatttgaaatgaaggttttgtacctatctcaagaggcatatctcaagaaagtttttgaaaggtttggaacgtcaaattcaaaacgtgttatgacacctatatctaagcaattcaagttgagtataagtcaatcccccaagaacattgaagaattggcttatatggagagtattccatatgctaacattgtaggatctataatgtatgctatggtatgtactcgacctgatatagcacatgtaatgagcttgctagggatagaaaaggaacaacaacaaatgaaggtgacggtaggggatggcgatggtggtaacgatgttgatggtgtcaacagtaatactggtgatgacaacgatgacgttagtagtggttctagcaccaacattggtgatggtgtgacaatgatggtaataatgttggtcttgacaaccaattgtgacagtaattgtgacaacattgatgataattatggtgataaaagtggtattgatgttggtggtggtaacaatgacactcttagtgacaatatcgtgatggcaataaaaggttgccgcacgcgaccagattggaagcacgcactgccagggtggccaaatcggagggaggttggggcgacaagcgaaggctgggaagagaaagaaagcttgggcggaggagggtgttcttggaagggggaagaagagaaaaaagaggagagaaagaaagaagaaagagctgtgtaa

SEQ ID NO: 65720 - DNA, 252 bp, Glycine max
  Peptide Sequence Number=SeqID_182498
atggaaacccgcagagagtgtgacctcttcggaaagcaccgaaaaagggcgaaagaagagctacctcgcaggaaaatgtgtggagggacagtggtgacctcgtcggatttaaaccatgtcagaaaaagcgagaggagaaaagttgtccgtcgacattcgacaccatcgttcgtcaccgatcgtgctggtagaagcagccgcgtgaacaggaaaggaattttggtctcgtgtatgaaagagactgaatattag

SEQ ID NO: 65721 - DNA, 2836 bp, Glycine max
  Peptide Sequence Number=SeqID_182499
atgggtgaaggtaatactagtactagagatatgagcaccataaataacacaatgggggaaggtagtactagtactagagatatgagcaccgataaaataaatgttgatttaaatgaatatccaattgaagatatttctttagagaatggttattcaggaacagttagtgaacattttgatcatgatattgtggcaaatgatgtattagaagttgaggaaattgaaacttatgagaaagaaaatattgtgtcttctagtcagaatattgagataaatgaatttgcagaagaagttgatagagatgaaacttataatgagacaaatattgttccttttgttggtcaaatttttcttagcgaggaagaagcatttgcattttataagaggtatgcatatcagcatgggttctctgttcgaaaagaagtgcgttttttaccggctaaccgaactatctctgaagatgatattgaacgcattttcttgttaaaagaaggggggctttcagttagacaattgatgcgtgtcatagaattagagaaaaatgtgaagcatggttatcttccatttattgaaagggacattcgtaatctttttgtgaaaaccaagaaaaaagttgaaagaaatgatgccaaagatcttctcaagtactgtgaggatgcaaaaaagagttgctctaaatttcagtatgcatatacacttgatgaagagagaaggttagagcatattttttggtctcctgcttcttgctctgattggtaccaaaaatatggtgatgttgttgtgtttgatactacatacaaggtcaattcttatgaaatgccatttgggatttttgtgggtatgaatagtcatgggaagactgtactttttggttgtgcactcttacgaaatgaaacaatatctgcatttcgttggttaatgaagccaccaaagactatactaacggatcaagatccatggatgaaagaagcaatttcaaaagacttgccatcaacaaaacatagtttttgcatatggcacatcacttttaagtttagtagttggtttaatgctatacttcgggacaaatattcaaaatggtgttctgatttttacgagttgtataaattggagacatgtgaagaatttgagcatcaatggccaaaagttgttgctaagtataacttgcagtcaaataaacatgtgaaaggattgtatgaaatcaggaattactgggcactcgcttatcttcgtgaccatttctttggtgggatgacaactaccggaagatcagagagtattaatgcatttattaaaagatttataaattctcacacaagtttaagtgactttacaaagcaggttgatgtagcgattgatgatattaagcaaaaagaagaccatgacataatgttagaaaagtgcaaaagaattaacttgaagcttatgtcacccttgcaagagcaagctcatggtgttcttacaagatttgcttttcagaagtttcaagaggagtttgaaaggtccacccaatattcaattcatcatgaaaatggtaatgaatttgtgttgcggtattataaagatgctaatagtagaaaacacatggtcttttgggatgattgtcatgaaatcccttctaactacttgccgtcacgatggcggcttcaaacatcacatgacgatgatgaagtagatccccaacaagtcaatgttgtctttgaggaacaagtcgatgttgttcactgtcctccaccttccaaaacaaaaggtcgtcccaaacgaagacgtcttaaaggtggaaaagagctatcacataacatgaatacttgtggattgtgcaaagatggcaaggagattagcccaatgtttccaaggttgcatgttaaggatgcagagaaacgagggccaaaagcacccccaaggaataaaatggcactctatgaacaattcagcatcccttctcaaaattttgcaccaggatcaacatccttgtttccactcccactcagaaactacacaggtcctacatcatctagccacattagtagcaatcaaagcatccaattttgcacctctagcatgccttctattctggctgagaagagtcaagcctacaattccagaaagactaacttaaccaaattcacgcaagatgatttcataaacagtaagaattctctgaaagcacttgacggtgaagatgcttttatatcttctggttctgcacatagaaaaaactcatactgtagcatcatccaaaataataaagatgaaggcaaactttcttgtagtaatttgagttgttcgcataaaaggctgaattcaattagaaaggtgaattcacctggtgctgtagacctgatgtcagaacagtatgagaagaaccagatagaggagcatacagaagtgagtcaaattggtcagaagccagaggaagtgcttcctcactcattagatggttttggtgatatgacagatgcatcattaatctcattggagaaaggtaagaattctaaatcaatgaataaagagcatagatctttgaaggaagaaaacagaagtatttcagtagatagcttgaaaacattgcaaggtagcagtgtccgtacacaggaagagcttgcagcttttagggaccaaataaagtcaagggaccatcacattgagaagccagcagctagtgagctacataaatgttctggtgagttagaaattggtagaaggtgcttcctggacaaggtaaacaggaatgaagatgaggagacatatagtcattatgatgctgtaaataaatataactcagaatgtacatcggttatggatatttcccctgacaatgttgtaggagctatag

SEQ ID NO: 65722 - DNA, 402 bp, Glycine max
  Peptide Sequence Number=SeqID_182500
atgaaaacaagaacgttattaagaaaaacggtggagattgaaataaaaaaggacaaattcattctaattaacaaaaaagatgagacaaattattgttttcctcttcgaattcaaaccctagataacaaatccgaaagtgaaatgttgtcggcttctggatcctcgacatcatcaacaacatgctacagggcccctgccacggtggatgacggtagcgcatggtggccgaaaatcgcttcaaggtggaagatgctaaaattaggggggttttcttgtggacatggagaggaggcgattgatggtggtggtttcttcgttcatgaccgaagttggctggaaaaaggaaggaaaaaaatgttagggtttatgagagaacaaaaggaaagaactgtaacaccctaa

SEQ ID NO: 65723 - DNA, 1014 bp, Glycine max
  Peptide Sequence Number=SeqID_182501
atggtgtacggggaagttggttgtctgctgcaatatgttcaacaacaattattagagaatccctcattttttcatgcataccagatgaacatcgatgaacaaatcacaaatgtattatgggcagatgcaaaaatggtgttggctttattatatgatgaaacaaatgaatctttcaaatggctatttaagacattctcaaaagcacatagtcataaaaagcctcagaccattttcactgatcaagacaaaacaatggctaaggcacttgttgaagtaatgcctgagatgcatcatggtttatgtacatggcacttgatgcaaaacggaattaaacacctcgacaatttgatgaaaggaggaagccattttttaagagatttcaaaaaatgcatgtatgaatttgacactaaggttgagtttgaggaggcatggaccaagttgattgcaaactacaatcttcaagaaaataattggattaattcaatttataaaagaaaaatgggcttcttgttacatgaaggaagcattcacacttggatgcgaagtactcaactaagtgagagcttaaattctcatttcaaagctttatttgaagcaaatgatataaaggttgttcccgaaaaatacattcttaagaggtggacaagagaaggtcgtagtggcactatacatgattttaggggaagagaggttgaagaggatcctagactttctagcacaaggaggtgtcgacatttggcatctaaattgattagggtggcatctgatgtatctccttctaaagaatattttcaactggtaggggaaagtatagatgtcgtgtgcaagaaaataaaagagctttgcttacaagcacaaagcattgacaagaacaaggatgatgctgttgcattggtgatcaattatgatacacaacctaaggggttcaagcaacaacctagcataaagaggcacaaccaaaaacgtctcaaaagttggcttgagttacaattaaagaagaagaaaaaactctaa

SEQ ID NO: 65724 - DNA, 1158 bp, Glycine max
  Peptide Sequence Number=SeqID_182502
atgttcttcctctctttgcccttctcttcctgcttcagagcttcacaacccaaccacgatcccaccaccctctcaacgaacctcaccacctacatctaccacaccgaatacggcaccgtttcgctgacatggtcacgctccatgctaggccgctccctccacgtgaacctccacaaccactcctcctttcacctccacgtcaaaccctggaggaaaaaagggtccaagaagctttctcacaacacggtcttcctctggaacctctcctccgcgagattcgaatccggacgacccgaacctcgctccaggttctacctcgccatcgaggtagaacacagcctcagcctcctcgtgggggacttatcccccaagagtaaggccaagaagcccagcaaaacacagcagcagctccttgttctcaagcgggaccacgtccacgtggcgccacaccgcagccgggtgtatcaaaccaaagcgagactcggaggtaaggtaagggaaatcgaaatagattgcgacggttacaacggtaacggtggcgggtacgagaacgagaacgagagtagtttaaggttgttgttcggtgtggatggagagaaggttctggaagtgacgcggctgaagtggaagttcagagggagcgagcgtgtggagatcgacggggtgcacgtgcagatctcgtgggatgtgcacgattggcttttcgagaaggataaggataataatcattgtagtactaataacaataacaataataacggtaatgagggtcacgcagttttcgtgtttaagttcgaggaggacgaggtacgaggtggtggtgggaaggaggaggagcaacagtggagtttggggagtggtggggagtggaggaatgggaagagttggtcttcttcatctttgtcggtgtcttcttctgttgggtcttttggggggagttcttcggttatggaatggtccagtgcggaggagaatgagttggtggttcctcttgggttttctttggttgtttatgcttggagaagggaaatttgctatatgaaagttgttattggcactgttgttattgtcatcgggtgtgtgattggaactttctactcgtgttgtgcacgccaaatgttcgaccaaatggcggcatctcagcagcttgttgcctaa

SEQ ID NO: 65725 - DNA, 399 bp, Glycine max
  Peptide Sequence Number=SeqID_182503
atgagagagtcagagagtgagatacaagatgggagaaggagagggaaactaagaaacaagagaggagagggagagggagaaacgacaacgtgggagagtgagagggaaaagagctcactattggtggttaagttcgaagggagtggatgtgttgtagggtggcagaaagctagaaagagagctcatccaaatttggccaaggattatgtgtggattagggttgagcaacggggtcggggaacaaacatgagaagagaagaaaagaaaagaaaaaaaatggacatgtcgtctgaccttcatgtatggactcacccactaggaggactttcgattcaagtgattcccatgtccatagatccatcgtcgttatcttactcatctaaaccaatcatcgagtag

SEQ ID NO: 65726 - DNA, 548 bp, Glycine max
  Peptide Sequence Number=SeqID_182504
cgtcgcctacttcgccgccgacctcctccacctcgccgtcttcttcgccggcgctggggacctccccttcgtcatccaccacctcgccacgctcttcgtgcttctcacgtgccgccatgcggcctcgcgcggggcggtggcggtgcttgccctccttgccctcgccgaggtcaccagcgcgttgcagaacacgtgggccctggcgcgtgtgcggaggagcaattgctcctcctccacacacgtggcgacggcatgcgacgccgcgctggcgttgccgttttatgggttgtattcgattgtacgaggtttgttggggccttacgttgttttcagaatggtggtgttttattcgggtggaggcgctgagggtgctattgccacatgggtttgggtttcttgggttgttgtggtgtccatggccattgctgggagcgttgcgtgggtttcgaatctctgggttgaagtgtacagagaaagcagtaacgatcgaagcagcggcgatcatgttagtggtgaccacaatgattatagcggcgatcgcggtggtg

SEQ ID NO: 65727 - DNA, 337 bp, Glycine max
  Peptide Sequence Number=SeqID_182505
agtccagcacgaggctctggaatttcgtgttttcggcggcgaagcctcggtctgcggcggagaggattgcagcggcggcgaggagcgtcgccggagtgccgtggaagatggaaatgaaacagctggaggcttcgggtcggatcttggggctccacttgcggaagatgatgaagtagccgaagagactggaagaatgtatataaggatgagttttgggcatgtcttgttggtggggttttgtggaaaaagaagagcagaaaaagtgagagatgaaagaagaggagaaggtggtgggagggggatcaacggtttttgtagggttggtgagaaaaagtga

SEQ ID NO: 65728 - DNA, 766 bp, Glycine max
  Peptide Sequence Number=SeqID_182506
atggttctaggaaaggtgattgataattgtcaaagtgccttccttggtgagaggaaacttttatatagagtacgtgtggctaatgcgtttacatggacttcggtattggtgaatggaagtccttcacaagagttcaaatgtcacaagggacttcgtcaaggataccccttggctcctttcctctttttagtggtgaccgaagagggaagtttgtggagtgaggtgttaataccaaagtatgatggttggaaaggtctagtgagggagggtgagcttttgcgggaatcattgtggtggaaggacttgaaaagaatttgtggaggaaatagtagagagaaatggttcgatgaggggattgagtggaaaacagggcaagaggatgtggtttgtgagatgggttgttggaggttggatagatgggtttggaagttaaattggagaagagagacttttgagtgggaacttctcgagcaattgcaaatactcttaaattctgtacagatacttagtaatgagttggattcatgggtttggcaaaattgcaattctggaaaatactctacaaactgggcttataaactgttgttggaagatgatgacagctcaacatatctttctgacatgccctatgatttggcagctatggcttcaatgccattcttggatgcttccttcaatgtcaacaatactttcagcatctttggagagccatttcaatcagttttcgggtttgggaaggtcaaaaagtgcaacggaatttggtcag

SEQ ID NO: 65729 - DNA, 513 bp, Glycine max
  Peptide Sequence Number=SeqID_182507
atggtccaaaaggcaattgatgaaggaagattaaagtttgaagacaaaccaatgaagccaaatactggtacattccatatccagacaattctcaaaaccaggaacatattgatcgattatgctagaaagggttatttcggtgacctttctctaagtcccaaggtagtttgggttatacaagtttcctattttactcctcatcgaaatcctgtggttttcaatcctcctactgatgatatgaggtgccatacgaagacacccaatttgacaactatgggaatggatacatggagtaggagtagtgccatcaacagtccttcaaaagaagcggatcaatcatcgcatggaatttacactatatttgcaagtgaaggtgatcaagcaatgagaaggagtgctctgctcgaaatcgaagattctttctatgtgaataacaaattaggtaatgaaaaagacatagaaaaggacgaataccaatgccatcaaaggaaaaagaaaagtgatggatactga

SEQ ID NO: 65730 - DNA, 453 bp, Glycine max
  Peptide Sequence Number=SeqID_182508
atggtggtttcttctcaatgtaacaccctcacagaccaagacgtttctgctaatactgagaggagcacaccactgcaaacacccatagtgtcatcgacgacatcagacaaaggtattgagttgatcttgattctaggtcacgaagaggaatgcaagaaggtgtgggaaacccataagcctacatgccctgaaacttctttctggtccaattactttaaccttattgacatagctgccattactggtcttaaacctttgggtaggacctatgctataggtttaattgaagaccaaatggaaaggaacaatataaaaatagacttcagtgctaaggcctatggtgctttcattgagaaaaatgcaaaagacactaaagagacttcagatgaagaatatgtagcatttttaatgtattgggtgtcttcgcatcttctttgcactcgctctctttag

SEQ ID NO: 65731 - DNA, 375 bp, Glycine max
  Peptide Sequence Number=SeqID_182509
atggtgattttcagccatggagttgcagtggaagataaaggagaagagcctaacacatgggaagcttccttgagaagcaaggaaggtagattccttgggaagctagaggaagaaagcttccttgagaagacagaggtgggctactcacacccctccaatagcttagctcatccccattccaaaatacatgaaaatacaatgggaagcttccgtgagaagcaaggaagggtaccctacaaacctaaaatggccaaaatacaaggcccaaaagaagaaaaacctattttaatatttacaaagaaaagtggacccaaccttggcctatgggctccgaaatctatcctgaggttcatgagaaccatagggccttcttga

SEQ ID NO: 65732 - DNA, 732 bp, Glycine max
  Peptide Sequence Number=SeqID_182510
atgaaatctcctcgaaaagaaaaaactctttcttccagcaatacaggacatcagggatcaaagaaaactaacaaagccaagattgacgacaaagtgaagcttccaccaaaaccacccaaattccaacaaccatcaaagtccactacctctcaaccttcaaagaccaatgcctcaaagggattagatgattctgatgaagacatgcccatcaattctttttttaaaccaacctcttctgctaagaccaagcaaaaggatgacaaaataatgaatctttcatcatcacaagatccttctcaagtttgtgatggtggggaaaaagaaaatcaagagtctcttgtcgttaactcaagtgcaaagatcgtaaacaaggaaacaattgattcaaatataccagtttcgacaacgggtgcaaacaatactggaatggtagaagatctagaagaacaaaaagatgctcaaagccatattgaacaacacattccgactacaggagaggtacttgggttcatagatcatgctaatgtttctgtcctcatttcggttgtcaaaaccaatgagccaacaactgaccaaaatatagaaaatcttcaaggagaaacaaatccattggatgttgatcctttttctttcatcgacgtttggtcttctgattcgatgccatctaaagcttctgaatctagtcataaaataccattcacacatttcgatgaagttgtggaaaagttttga

SEQ ID NO: 65733 - DNA, 297 bp, Glycine max
  Peptide Sequence Number=SeqID_182511
atggtgaagttttatcaagacagctctgggtttctacggaaatggaaaaggctacgatgcgaagtttatttctcttatctccgacatgatttcgaaattcccaacggtgggaatgctgggaaatgggatgcgaacctggtgcttaaatttcacgatgatccaacggtgaacgagtccaagatcgtcatttattctgagacaggtttggtggtctgtgggaaaaagagagggttttgggaggagaaggggaaaaacgaaaatgaggggaagaggaggcatcgttggtgtgaaaactga

SEQ ID NO: 65734 - DNA, 915 bp, Glycine max
  Peptide Sequence Number=SeqID_182512
atggcacgcaatgagtgggcggtcagtcgttatccgctggtgccgggccacgagatcgttggacgcgtgctggagaccggaactcaggttacgcgcttcaaagccggtgatatggtcggtgtgggcgtgatggtggattcctgccgtgcctgccacttctgccagcagcaggaagagcagtactgcgaagcgggcttcaccgccacttacaacggcatcgataaatacaccggcgacagcacctggggtggctacgcgcagcatgtggtggtcgatcagcattttgtcgtgtcgatcccgcaaaatctggcgctggcgggcgtagcaccgctgctgtgtgcgggcgtgacggtgtggtcaccactgcgccattttggcgtcaaagccggcgataacgtcggggtagtggggctggggggtttgggccacatggcggtaaaattggccagcgcgctgggcgctgaggttaccctgtttactacctcgccggaaaaaggtgctgacgcacgtcgtcttggtgcgacgcgcgtggtggtgtcgcgtgatgccgcgcagatggcggcatgccagacctcgcttgatttcatcattgactgcgtggcggcaccgcacgatctcgatccttacctcgcgacgctgaagaccaatggccgtctggtgctggtcggcattcctgaccaaccgcatccgtcgccgaacgtcacgccgctggtgtttcgccgtctgagcatcagcggttcatccatcggtagcatcaaagagacccaggagatgctggatttctgcggcgagcataacatcacagcagatattgagctgatcgccggtgaagagatcgaaacggccttcgcgcgtatgctgaagggcgaggtgaagtaccgtttcgtcattgatatgctggcgactcgctggtaa

SEQ ID NO: 65735 - DNA, 255 bp, Glycine max
  Peptide Sequence Number=SeqID_182513
atgaccatcttatatttaacttatgtcaagactgctaccacaaccaccaccaccgtgatcactgccatgaccaccatcattgccaccaacatgatcgtcggtggtggtgacgatgacaacaacaatgatcatgttggtggcaacagtggtggtcatggcggtgatcacaatgttgtgacagtcatgacaattgtggcggaaacggtcacaactgttgtggtggtcattgatggtgatatgtttaggatactttag

SEQ ID NO: 65736 - DNA, 222 bp, Glycine max
  Peptide Sequence Number=SeqID_182514
atggctctggtgactggtcccttcctagggaggattgcatcaagaactactaagtcatattacaaatccataagctttgaagctgattccaaagagggttttgataacaatcagaacccaagtatcaggaacacaacaaccacaataggagcccaagttagcaagcccaaaaggaccacaagcaagctagcttaccttgaggactatgtgtgtccttcgtga

SEQ ID NO: 65737 - DNA, 717 bp, Glycine max
  Peptide Sequence Number=SeqID_182515
atgggtctgcccttttgcatcaagatgacgcctatggcgctactagaagcatcagtctccaaaacaaatgggatgagaaatctggggatatcaaaactgaggcctagtagatgggtcattgcacaacctgaaaggcatgacacagtactcatagtgactgtgatcatgtcggaccgaagtaattcgaaacctgcttctcgatttcaaatttttggaagtaagggtgtccgtaggagcggacatttatggggctggtggaaggctgaagagatatatgatgaacaaggtcacgagggcactgatgtgggtcagaaacttggctacccgaggctagataaaactatgggtgctgccactatcgataagaacaatgaggagaagaatacggcctcggcatttgtgggaggaactccatttttcatcacaattatagcaaaggcctttttcacgacgaaggaccatttcctcgagagttcgatgaacaaaggattgtcgagaattaggagaaggagggtagtggcctgtggtaaggatatgggttgtagggcaaggacttcttggcaaattttcatggatagtccaaaaaggaagatcattgtaatacgtcagagcaaaatgcgactccaaggcttacaagaagcctggccaggaggtgatgaatatgttacggtgattgaggcaatcgagaagggtatcgaccttagaatcgaggtctaa

SEQ ID NO: 65738 - DNA, 867 bp, Glycine max
  Peptide Sequence Number=SeqID_182516
atggcgtcaatacctcctcggacacaaattcataatcctgacagactatcagagttgaaaggagttgatgacccatatcatttagatgccgaaacaacaatactatttatccaaattattgggggtatgattacaaaatacaatataaaaagcagatcctcaaacgtggtagctgatgccctttctcgagaaaagcttcagttaatctcctctaagcccacgacgtacccaaatttccaattgaataatggtatgataatgcataagggtagtatctggcttaatgtcgataactcttttattcctgttttggtaatggaattccatgccacacctatggacggacaccttggcgtgaccaagaccattcatcgactccaggcaaattttacttgggatcatcttcagcatgatgttaaatcatttatcaagaattatcagacttgccatcaaatcaaacatgtcactcgcaagccgggaactattcaaattaagtggtacatcccttaccgccaaatctctgcatcgggcgctgcacaccacaagttaagcaaaggtttctttggaccatttgaactccttgaacacattggaaaggttgcatatcgtgttcgcttgccagagaattcaaaaatccatccgatctttcagtgttccttgctccgattgtaccatgaccgtctcctaccaagctccacgccgcttccgcccttggcatataatcatcatcctattatggaaccacttgctattttggctcataggatgtacaccataaccacacctccaacactgatgggtcctagtgtaatggcagggattgccgccagaagagacttcatggaaaaaatggcagacaacgtctga

SEQ ID NO: 65739 - DNA, 360 bp, Glycine max
  Peptide Sequence Number=SeqID_182517
atgtccaagttgcaccatgaaaagtcaaatagaaaccaggctcaagggagttcacaaggagctagagtattaatcataggcaaatctcattttgctgaagaaggatctccaaagtgttttgatgaagatatcattaaaagtgaagcttcaaaatacttcaaggatctcttccaaactcaaagtatgtgtgctccttctagtctcattttaaactcaattcattatatttgccttgagatgcacaatgatctaatgaagctcgtcacaatggaagaggttaagtttgcaatattctccatggactcttataaagccccaagcgtagatggtttccaatcaatcttcttcaagggtttctag

SEQ ID NO: 65740 - DNA, 744 bp, Glycine max
  Peptide Sequence Number=SeqID_182518
atgggacaaccatgctacctagaaatgaaaaggcttgctcttcttgctacgaggattacaaaaactaagaaggatgtggttgtggttcgagttatgaggaggaagaagctcaacaagggtgtgaggaaaattcaatctccaatcaacattggccatgcatctatccatcgttttgtgaatatgatgagcattagtaccattgcaatgctagggaaagacaaaaggctcgaaagccctagaggtgttgccaggagtggcttttgccaaagttgccgccaattgtacttgagagaccttcatgtcttcagtatggtcatgaactccctccttagaggtctgcatgccatcttgtcttggcgtattaagatcaaggttcaaaattgttctgttgccattattcggatcggtaattccgacatgcccaagggctatgtgaggattagtgtgtcaatgggaccagccctattagggtttgttggaccattgactacggcctcctgttgtggttatgctagtagcacttgttcaacgttgttctctaccaatggtgtgcagaaactagtgtttataacaacaaggaacgatgttcacaacaaaaccgaaaatagctacaatgtttcaacaaaaggaacgaggggaaatcaacaacatagaatcagcgttctgcaactaaaccatcaccggttcagaatagcacctgagattaaggagagtagaaaggttcagagaaggtgtagagaataa

SEQ ID NO: 65741 - DNA, 291 bp, Glycine max
  Peptide Sequence Number=SeqID_182519
atgcacagcttgcgagagttggctcagaacaggacaatcgtgcctctggagtattttcttgagaaagtagtctggtctgaagctcaacttccattggtgagacccaatgaggttgctcctccagagcccgcaccggcacaggttgaactaatgtcagctgagccacaaactccagtgctgaagaaacagctgacccccctgcttccccagttggaggaattgctgatctttttgattcgtcatctggagaagttgttgctctcactgatttcccagtttagacattgttga

SEQ ID NO: 65742 - DNA, 1237 bp, Glycine max
  Peptide Sequence Number=SeqID_182520
gatgatgattcctttgaatgaggcattgaagcagaaaattatgcatgagtttcatgcttctaagattggaggtcatgaaggagtcaccaaatcagtttccagaatttataaacaattttattggcccaaaatgcagcaagatataagggattttgtgaaaaagtgtagtatttgccaacaagccaaagtagaacaagcgctgccagctggcgtattacaaccacttccaattcctcaaagaatttgggaggacattgctatggactttattacacatttgccatcatcacatggttactctactattcttgttgttgttgatagactatctaaatttgctcgttttataccattaaaagctgaattcaccagcaaatctatggcgaatgcctttattgttaatatagtaaagatgcatggctttcctaagaccattgtttcagatcaagatcattcggatggccaaacggaggtgttgaacaagacactagagatgcacttgagacgttttgtgtttgatcatcctaaagcttggtttgagatgcttccttgggctcaattttggtacaacacttccttttgtcatagcattggtatggctccctttaaggctgtttttggtagggatccaccatctgttattccttatgaatgtaattcaaaagatccaccctatagacaacattcggtggcattgagaaaaaatcagaaattgggaatgaagtattttggtccatttcaagtggtggatcgaattggcacagtggcatataagttgaaattgcctgaaacatctcgtatacatcctatttttcacatttctgcattgaagaagttcgttggtagctcaaatcagccttatttaccattacccttaacagtgggtgaaagtggtctaatggttcaacccatagcagtattggattcaagggtgttattgagagactcttcccaagtggaccaagtgttgattcaatgggaaattgctggtcctgaggaagctacatgggaggatgtgacttgggttaaggcaagttgtcctcacttcaaccttgaggacaaggttgtttataaaggggagggtaatgttacatgcgggaagcaggaaggaaaattggcatgtaagtcagctacaaaggaaggacacgtggctgatgatctgcatgtgggggtgaacactcttcctgttgcttctctgatccttctgttaattccttattctctacaccttctctga

SEQ ID NO: 65743 - DNA, 264 bp, Glycine max
  Peptide Sequence Number=SeqID_182521
atgtttgtattgaatagtgctttagaaggatttgacgataatccacaaagtaaatccaaagctgctgctaggtgtattgttgttaaatgtaatagacaaaaaggaagcactgagtatggatattacgtcatgcactggatgtcaactataatcttaggaggtttcaagaataattgggaaacgtatttcaataatgctagaccattggaaccaaagattgaaggtgctttgcatccagtgggcaaactattatttgaaagataa

SEQ ID NO: 65744 - DNA, 621 bp, Glycine max
  Peptide Sequence Number=SeqID_182522
atgagcgaggcaatcgaggaagtgttccatgatgctacacatagactttgtgggtggcacttgcagaagaatgcttttgaaaacatgaaaaattcttcacttctccgtattgaggaacatgttgcaacactttatacaagatatatatataacaaagtgaaggtgcagattgttaatgtcagtggactgaatgtgacaccgaggactgaagctttggacaagttgactaaagttttgcagcaacaaagacacatgcatagcagtgatagtcatgctgaagatgatgtaggtgatccggatgtggtcaagacaaagaaaggtagatgggacattggttgtcaaacacgagtgaaggatacaaaggaaaagtcagctggacaaaagtctacaaaggaaaatactaaatgtaaaggtaatgacaaaaatttatcagtagccaaagatgtcaacctgaatagttctactctaaattcttcaaaagaaaataaacattgtggtccttcaagtgttgaaactaaagaaactaatgcaaaagatgttttaccctctcaacaaaacaatagtttcccttattctggacactctcatgggatatcttattataatgcatatggagtataa

SEQ ID NO: 65745 - DNA, 144 bp, Glycine max
  Peptide Sequence Number=SeqID_182523
atggaatacatgtctcatgttccttatgcatatacaataggtagtctcatttatgtaaaggtgtgcacaagactgtacctagcacaagtagtccgtgaggtgattctaactacgttgcaaattgagatgcaagatagactatga

SEQ ID NO: 65746 - DNA, 306 bp, Glycine max
  Peptide Sequence Number=SeqID_182524
atggcgacgatgggagttgtttgcgttttaaaagacagaaacccttgcctagtgcttatcaccattgctaggggagaaagggagaggcgcgaaaatgagcggagcgaaggggaagaaaaagggagcgagcttcgtgatccattgcgagaaaggaaagagacgttttccagaaaattgctcaactacgtaaccctactcctcctcaccgcaacctcactttcttcacaccgcaacctctcgcaaccccttgcacttactcatactcacaacctctctttcaggagaattataagcaattgggcttaa

SEQ ID NO: 65747 - DNA, 219 bp, Glycine max
  Peptide Sequence Number=SeqID_182525
atggagatgtccaggtcaatgttgaatgagaagggattgcctaacacattttgggcagaagtagtttacactgctatctacatactcaacagatgtttgactaaggcagttcaagacaaaactcctattgaagcatgtaatggacaaaagccattagctaaacacctaagagtatttgggtctctactacatgcatgttccagaccgaaagagacataa

SEQ ID NO: 65748 - DNA, 339 bp, Glycine max
  Peptide Sequence Number=SeqID_182526
atgtgtaagaagcgggcgaactggtctggtccgctgccaatgcgagcttatgtgggcgggccttacgtgggcaggctggcccacttacccatccctaattttcggaccgacgatgcttcctctttcccccattttcatttttctctcttctccttccaaaaccctctcttttctcgcagaccaccaaacatgtctcagaaaaacgatgatctcagactcattcaccgttggatcgtcatgaaatttaaacaccaggttttcaactcaattccgagcattctcaccgttgggaattttgaaataatgtcggaactgggagaaatacacttcgcattgtag

SEQ ID NO: 65749 - DNA, 261 bp, Glycine max
  Peptide Sequence Number=SeqID_182527
atgggtagttgtggaagagaaggtgtagtgaggcagtatataagatcaaaggttcctcgtttaagatggacccctgaacttcatcgttgctttgtttatgccattgagactcttggaggtcattacaaggctactcctaagcttgttctgcagctgatggatgttaaagggctcacaatttcacacgtcaagagccatctgcagatgtacagaagcatgaaaggtgatcgctcctgcagacaaggtaccaaacgctgttaa

SEQ ID NO: 65750 - DNA, 396 bp, Glycine max
  Peptide Sequence Number=SeqID_182528
atggctgagcagaagggaataaagaagatttgtgtttgttcaatatggcagcagactcaacccctttccacaacctttcctatgctaccaaagcaagaatcagattttctccaggttgccaaattaaatgataagcaccctctgaatgaagttgggaatacttggagggtaggactaggagcagaggatgaagacatagaaggttgtgaattgtcattgtcaatctcattgccacaaccccatccttcctctcagaaaagtaataatgcttcttcagtcagtgagaccagtgaggcattttcattgtgcccagagtttagcaacaattacatgggctgttctagttcttccaatgtccccaaaacaattaacttggacctttctttggccatttga

SEQ ID NO: 65751 - DNA, 368 bp, Glycine max
  Peptide Sequence Number=SeqID_182529
atggtgatcgattaccagagagtaaaaactctgagagaaaaaagagagagagagacacaaagagtgagggaggatccctatcagaatcaagccggaaacaggaatggacaaagacagagctataatcaagctaattggaggggttggaaagatattgcatcgttctacttcactcattatccagaagatgctactgagaaagagctatggcaccacatcaagaagtttggtgacgtaagggaggttttcatctccaagaataggaacaagaatgacaggagatatggtttcgccagatttaaagacgtggaggacgtgtatattctagaaaggaagctagataacatcatctacggtggccttaagat

SEQ ID NO: 65752 - DNA, 934 bp, Glycine max
  Peptide Sequence Number=SeqID_182530
atgacttccttgactcacctcaacctctctgatactggattccgtgggaagattcctcctcagattgggaatctctcaaatttggtgtatcttgacctgagatatgttgctgccaacggaacagtaccctctcagatcgggaatctctctaagcttcaatatcttgacttgagcggcaattatttacttggagaaggtatgtcaattccttctttccttgggacaatgacttccttgactcacctcgacctctctgatactggattctatgggaagattcctcctcagattgggaatctctccaatttggtgtatcttgacctgaacctcgaaggttattctgtttccgaacctcctctgtttgctgaaaatgtagaatgggtatcaagtatgtggaagcttgaatatcttgatttgagtaatgcaaacctatccaaagcatttcattggctacacactctccaatctcttccttctttgacccacctatatttgtcagactgcacactccctcactataatgaaccatccttgctcaacttctcatctttgcaaactcttgatctttccggtactagttattcccctgccatttcttttgtccccaagtggatattcaaattgaagaaacttgtttctcttcaattacggggtaataaaatcccgattcctggtggtatccgaaacctcacacttcttcaaaatcttgacttgtctttcaattcattctcatcatctatacctgattgcttatacggttttcatcgtctcaagtctttggacctaagttccagcaacttgcatgggactatttctgatgccctgggaaatttgacttctcttgttgaacttgatttgtcatataatcaacttgaaggaaccattccaacttctttgggaaatttgacttctcttgttgaacttgatttatcac

SEQ ID NO: 65753 - DNA, 423 bp, Glycine max
  Peptide Sequence Number=SeqID_182531
atggtttttgtttctcagattgaaccaagaaacatagatgaagctttgtatgatgagcattggttgctagcaatgcatgaagagttaaatctgtttaaaaggaatgaagtgtgggacttagttcctaaacctatcccccacaagtcaatcgaaactaaatgggtgtttcaaaacaaacttgatgaatcaagcatcatagtaaggaacaaggccaaattggttgcaaaaggatacaaccaagaggaaggcattgactattatgaaacctatgcacctattgcgaggttattccaaatggatgtgaagagtgtttttctcaacggatacattgaagaagagatatatgtagaccagccgccaggttttgtagacttcaaacatcctaatcatgtttacaagctaaaaaaggtctatatggtttga

SEQ ID NO: 65754 - DNA, 453 bp, Glycine max
  Peptide Sequence Number=SeqID_182532
atggagccggagtattgggacaaaaatcccttcaaggccatagccaaggcatttcctcttggattccattttaagccaacagctatcaataaaaccagaaccttttatgaattcattttaatagattcaaactcagtgtctattaaacacttcaaagacccaaacgacccactaaatattcctggagcagatatagcaagacgaaaaacaacaagcaatattcatcccttcaacgacatgcatttttcaagtggtggaatcagtttgatgcatcaaaggccgaaccagataagctcgtcatcttcatcctcaacctcagacccaagaaacttaaatttgcttactgaacaagataatcaaacccacgaagtcacccctaaacataacctcttcgatgaagaagtacgcttcgaggagataaaccaaaacatggatgactggagtattccataa

SEQ ID NO: 65755 - DNA, 465 bp, Glycine max
  Peptide Sequence Number=SeqID_182533
atggttgttcttcacaagcttcctagaggccttcactcgaaaacattggtggaactttccttttccaagatgtcggatcctttctttttcttagtgataatggataaatttgaatactactccattaggaaggctcagaaagagaaggttgaaaagaccaaggccgagaaagccctagaaggtcatggtcctttgggtgaaggtccttcaaagaggcaaaggctgaagatggttttggttgccgctccttctatcatagagagtattcctactttcttaactatgaaagaaggggctaatgttgataaggttgaagagaagctgaagattgatcttgatgaggtcgaagttgagatcttgaagacccatgaagtcgggtttaacaaggctctccataaggacgttactcatcaaggggagttggtccgtgaaatggatatgcctatgaaggaagttttttactag

SEQ ID NO: 65756 - DNA, 192 bp, Glycine max
  Peptide Sequence Number=SeqID_182534
atgacgcctctcatctccacgacaactttgctgccactagtgaccaaatctctggcattcctgttggttaatgaggaagttgggtcctacacaagtagtttcctaacctatgagtccattgttgagtttctcaagctggctgaattttgtcacatcgatcgctcagatgtgatgtttgttgagtcttgttga

SEQ ID NO: 65757 - DNA, 1272 bp, Glycine max
  Peptide Sequence Number=SeqID_182535
atggaaaaacaacttcatcccttcgttgatgtgatcatggaagcacaattaccacttagatggaagatgttgaacatagaccgttatgacagactcttggacccggatgagcacgtagacccatttgtgacacaaatgaacttgttcaccaatgatgatgctatcatgtgtcgagtgttcccgacaaccttgaaggacaaagaccgcacacgagatcaaaagcgagaacgagaaaggattcaagagtgcagtaagactcgagaaaccattaaggcacaacaccataggaacaccccactcgaaactcagttacgaggagtgattaacacgatagttggaggattcatgaggggaagttcaaactcggcaagaaaatggcatgtgcgcaacctcaaaatgatcgattcggtggaaggggagaagaagcccactagaagcatgccacctatcattttcatagatgaagactttgggaacattgaccaatgccataataatcctatggttgtcaaaattgaggcagcaaacttcctaatcccgatgttcaaacaagatgaggataaaaccacgttcatgaacaacacaactaactattgttattcgattatgccatttggactaaagaatactgaagccacttatcaaaggctgatggacaaaatattaaccaatcaactaggaaggaacttggaagtttatgctgatgacatggtggtcaaaagtagaagcaccacctctcacgcagaggacatagcaaaaatctttgctaagataaggaagtacaacatgctcaagtatgaactaaggggaccaatgaaggcacagtgcctaacagactttgtaatcgaattggtggccaacataaagccaaaatttgagtggtggaagttgttcgagtttgaaaccaagaataaccaagccgagcacaaagctctcttagctggcctgagattagctaaagaagtaggagctaaatatctaaagtgttggagcgactccaagcttatcactggtaagttgaatggagaatatcatatcaaggatccacagatgacaaggtactaccatatggctactcaactcaaaaaggctttctttaaatttgagattctacatattgctatagaaaacaacgacctagacaaggtggtagccagtgtaactcccatcgaccgagaatggactgagattcgagacatcctagagaaaggctcactcccagaaatccaacaacgacaagaaagctcaaaaggaatgccaactattatgtga

SEQ ID NO: 65758 - DNA, 949 bp, Glycine max
  Peptide Sequence Number=SeqID_182536
ttttcttatttatcaccgttgtcctcgaccccaacctgtggaaccaccccttactgaagaaaccggtacatcatctcttgccccaatcatccatcctgttgcggtcgactctgacttgtccatcaccatccacaaagcttctggaaaaatggagaaggcaaaacaggtagttttagatccaatcataccaaacaagagcttaaatgaaatcaagagtgtacttgtctcagctcttgcatcacatgggcaattgtccgaggctcttcttgtatatgaggagattaagaaagctggacataatttgcggccaaaagccgttataactctgattgaggagctcactaaattcaatggggagttggatggactgctgcttctacttgaggaaattagtgatctagactattgggttgatggttgtttcaaggttatcatgtactgcatacgtaacaaaaatttgagttctgctattgtcttgtttaaacaacttaaggacaagttcaaaaatgatgaaatagtaacagaagctctttttgatgcagtattttctctgattgcagtatctgagttcactcatttacagattggcctggacttgctttgggcaatcaaggatgagcttggccttatggcttcacggcagtgtcttgattttcttctaagtgcttgtgccaatgctggagatttgaataatgctcgcttgatttggagagagtacgaggttgctggatttccttacaatgtattaagttacttaaggatgtatcaggcactcttggcagcaggagatgatacatctgctcacttaatacttaagaaaattccacaagatgatgccgagatttgttctgtcatcatagcatgtcaggaaacttacaatggtcttaattctgtagaagagaagaaaaagcaaggaaaaaaaagaaagaaaaaaaagagtaagacttga

SEQ ID NO: 65759 - DNA, 342 bp, Glycine max
  Peptide Sequence Number=SeqID_182537
atgcagaacagtggggtcaccctaagggctgaatctcaacacttcgcaagtgtgcatgacgccaatccctgtgtagcttccattccttactttgggttcatggatgaaatttgggaacttaactatgtgaaatttactgtttgtgttttcaaatgtaaatgggttgatagcaacaccatgtatctcattaattgttttatggagaaacagagctcacctaagcaaggaaaactgccagggaaccacattataaacgaaacctcaaagagagttgggcttcatcctcaaaaggaaacaacaccagaatatttagccttccatagattcaaacagaaaacgtaa

SEQ ID NO: 65760 - DNA, 339 bp, Glycine max
  Peptide Sequence Number=SeqID_182538
atgaggtatgtacagtctagcctctctattgccaagaagagccttgctatggatgattctgaaagaaattcaaatgcttctattaatgcaagtgatgacagggatttcagctgggatgtaggaaccaatcaccaacgccaagaaagcaatggggcaagattaatgagtgctactttgagtgttataagtcggttggctgaagaatttgagcagaggagtcaagtgtttggtgatgatgcaaagttcttggtagaggtaaaatctggtcaagttgaagcaagtttgaacccaaacagagaagtcaagtttgagcaagttgagtcaagttgcgaaggttga

SEQ ID NO: 65761 - DNA, 924 bp, Glycine max
  Peptide Sequence Number=SeqID_182539
atgaatggaaaaattgagaaatttagaggatcagacaaacctatgcatatgtctggtgccagtgaatcttatgagcaagtcaccttgatggtcagcatggagggcactggaattggaattcctttcttagccaaagataggattttcatgccttttgtgcaggcagacaactcaacatctcaacattatggtggtactggcattggcttgagtttcagtaaatgcctggttaaactaataagtggtgagataagtttcataagccaactacaggttgggagcacattttcatttactgtagattttggaacgattgacaaaaatgcaataactgacatgaagaaacataatttggaagatctgcctcccaattttagatggcttaaagccatagtggttgatggaaaacctgttagagcatcagtgactggataccatttgaagagactagggatacaagctaaagttgcaaatatcatgaataaggttgccaagtgcaaggttttgcaagagcaatatgacattgaaagcattgctcaacatggagttgaattgttgtatgcaactatgacaaagatatttagttcattgcaagaaccatgcaaagaaacaaatgcagtgaatgcaacaatgctagaagtggtgttggttaggagaacccttgcttgggtaacaagaattatattgctcatttcaatccttatgggggtatgcataaataaaagagctatttccttattatgtgaaagaggtcatttttgcagtagtgaagtgaaagaggagacgaaaggtcacgtgagtcatgtggggtctggaatagttcacatcaccattaaagtggttagggttggaatttggttcggccatcgaagtggaacactctactttcaagtttctgctttctggttactgcttctgctttag

SEQ ID NO: 65762 - DNA, 1014 bp, Glycine max
  Peptide Sequence Number=SeqID_182540
atgaagttgttgatcaagtttccaacgaagtgcactttcattcaggcacatagggcatggctgcctaagtttttggtgttgtggatccttctcatggctctaattggttgtttcatctataaggtgttgggtagcctctgtgatcaaagggcaagaatgctgcaagatcaattcagtgtcaatgtcaaccatgtccatgcccttgccatccttgtttcaaccttccattactacagaaccccttctaccattgaccagagtatacaactcggacaacatttgaatgaccattactcaatgggggtggcttatgcacaaagagtagttaactcagagaggggaacatttgagaagcaacacggatgggttataaagacaatagaaagagagccttcactagttagagatgagtatgcaccgatgatatttgcacaagaaacaatctcttaccttgaatctcttgatatgatgttcagggacatgcaagaggaccgagagaatattttcatggctagggccactaggaaagttgttctcactagtccttttaatttgttgggttctcatcatcttggtgtggttttaacatttcctgtttataaatctaagctccctccaaagccaacaatggaagagtgcattaaagcaactgtaggatatgttggaggatcctttgatgttgagtccctcatggagaatttagttggtcaacttactggtcacgaagcaattttggtgaatgtatatgatatcaaaaattctactaaccccttaatcatgtatggaaaccaaaacaaagaagatgatatgtctcttgtccatgaaactggaaatcacattgtcaaagtaaaggatgattttcatcaaatggaggaattaaaagttcgagcagaagtagctaatgttgccaagtcagaggtgctttttcctggcatactgttagcacaattcattagttcctttgattactcaccaatcactaaaactagtttttcttttaatgttagtttctag

SEQ ID NO: 65763 - DNA, 471 bp, Glycine max
  Peptide Sequence Number=SeqID_182541
atgtttcctgaagaaaacacattaccgaaaaatcactacgaggcgaagaagattttatgtccaatgggaatggagtaccagaaaatttatgcatgccctaatgattgcatattgtatagaagtcagtttgcaaaaattcataagttccccacatgtggggtatcatggtacaaagtcaaggatgatgaatgcagtgatgatgcaactacaaacaatagtcatccaacaaatttgttcatcaagcgaaaatacaatatgctctatatgatgatagcaggttcaaggcagccagggaatgatattgatgtgtatctcactccattgattaaaaacttgagaaaattgtgggaagacggggttgatttgtgggataggaatctcaagcagaccttcaggttacatgcaatggtgttttgtaccattaatgactttccagcatatgggaatttgagtggatatagtggcaaatga

SEQ ID NO: 65764 - DNA, 198 bp, Glycine max
  Peptide Sequence Number=SeqID_182542
atgataaaaataccgaagggtgtgcaaaatgttcctcctgaatttgataagttacatataaatgtgttctacctgatcgagcaaatgaacaacgttgtgaccaaggccaggagaattccggcagctaatagtgaacggacaactagtcaagatgtggcatgttgtttcggtgttggttgtgcagaatggacaagttag

SEQ ID NO: 65765 - DNA, 1374 bp, Glycine max
  Peptide Sequence Number=SeqID_182543
atgcacattcttgaacaaccaaatgaggagattgaagatgctctaaatggaattagtgacttaaaatcgcctggagttgatggctatagctctaagttttttaagtcatgctggaacatagtgaaaaaggatgtggtcaatgctgctcaggaattttttgctcaagatcagttattcttgccctttaatcaaactgtggtgacattggttccaaagagtgataatgcaagtactgttaaggagtacagaccaattgcagtttgtacaactttctacaaaatcctgtccaagattctcactgctagactgaataaggtgctccctagtgtggttagcctctctcaggcagcttttatcccaggtcaggttattcataaccatataatgcttgcttatgaactgttaaatggttatgctagaaaaggaggtacccctaggacaatgatccaacttgatttacaaaaagcatatgatatgatagactggttttctttagagactgtccttagggagttaggtattcctggcagatttattagttggctcttgatcatgttgaagactgttacctatattttcaatatcaatggtgatctctctgatgtgatgcaggccaaaagaggcattaggcaaggggatcctatttcccccttgctttttgtagtgatgatggaatatcttaacaggttgttggttaaattgcagctggaccctaattttaatcaccatgctaagtgtgagaaattagggatcactcatcttacttttgcagatgatgtactcctgttctgtagaggtgatgttatgtctgtggaaatgatgcttcatgtgataaataagttctctgccactacaggccttgtggttaatcctaacaaatgcagaatttattttggtggggtagatggtactaccaagaataaaatccagcagatttcttcttatgaggagggccagctgccagttcgttatcttggggtgccactaactagtaaaaaactcaatataaaatactacctgccgctgattgataagattacgactcgaattcgacactggacttcaaagctgctcagtatggcagggagagttcagatggtgaattgcaccattactgctatcgttcagttttggatgcagtgtctacctattcctatgagtgtcataaaaaagattgatagtatgtgcagaagttttgtttggtcagggagcactgaaattactagaaaaagccctattgcctggaattctgtctgtagacctaaaggccaagagggtctgaatattttcaatctgaaggtttggaatcatattaccatgctcaagtgtctatggaacctgtgtaaaaaggctgataatctatgggtgaaatag

SEQ ID NO: 65766 - DNA, 1428 bp, Glycine max
  Peptide Sequence Number=SeqID_182544
atgtcccaagattttcaacaaggaatcttcagcttcccgaatgggttggagagaggaaggctagtgagtccgcagcaacagatccggagggacaaagtaaggttcgaggcggcggcgccattggtagggatagaggaggaggaaccggtgtacgagaccgccgggatgttgtcggagatgtttaattttccgcccgcgacggaattgttggagcagcagcacgcgacggcgacgttccgggcggcgaggcaagccggagagtggtacggaaacagacagcaacagcaacagatttcaggcattaatgctgactcagcagcagccatgcaactttttctgatgaaccctcaaacgaggtctccttctcctcctcaaacccacgccactccttcgtcaacgcttcacatgctgcttccaaatccttcttcaaattcttccctccaaggatttactggttcggccgcgggagggtcttttggtcaattcacatgggttcctgagagtgctcatcaacaaggaggcgtggtggaagggcaaggtctttcgttatcgttgtcttcttcgctggaagcagcaaaagccgaggaactgaggatgggggatagtggttttctatattacaatcatcaacaaggtggaggtggaggaggtggttcttcttcttcttccgcggttcagtttcagtacaagaataataacaataaccatcaccaagcattgcatttgcaaggggcgatgggacacgacaacaaccaccagggacatgttgggtttgggtcatcctcgttaggtgtagttaatgttctaagaaattcaaagtatgcgaaggctgcacaagagttgctggaagagttttgcagtgtagggaggggtcagtttaagaagagcaagttcaataggcagaattcaaaccctaattcaaatgccggtggtggtgcttcgccttcatcaaaagatgctcctcctcctcctcctttgtcagccgctgataggattgagcatcagagaaggaaggtggacaggagatacaaccattactgcgagcaaatgcagatggtagtgaactcatttgacctgatgatgggttttggggcggcagtgccgtacacagcactagcgcagaaagcaatgtctcggcatttccggtgtctgaaggaggcgataacagcgcagctgaagcaaagttgtgaggtactaggagagaaagatggagcggggaactcaggaggtttgaccaagggtgagaccccaaggcttaagatgttagaacaaagcctaagacagcagagagccttccaccagatgggcatgatggaacaagaagcttggagaccccagagaggcttgcctgaacgttctgtcaacattttgagagcctggcttttcgagcattttctccacccgtacgtaattccttctattgcttaa

SEQ ID NO: 65767 - DNA, 1518 bp, Glycine max
  Peptide Sequence Number=SeqID_182545
atggaacattctcaactgtccattgtcattaccttctttgttttcttgctcttgcttaggctagttaaaaatcacaagccaaaatcgagtcacaagttgccccctggtccatggaagttacctatcattggtaaccttcatcaggtagcactagcagcttcacttccacatcatgctctccaaaaacttgcccgtaaatatggacctctcatgcacctccaacttggtgaaatttcaacactggttgtgtcctcccccaagatggccatggagataatgaaaacacatgatcttgcttttgttcagaggccccaacttctggctcctcaatatatggcatatggggcaacagatattgcttttgctccatacggtgaatattggaggcaaatgagaaaaatatgtacgttggagcttctaagtgccaagagggtccaatctttctctcatatcagacaagatgagaacagaaaactcatacaatcaattcaatcatctgcaggctcaccaatcgatcttagtagcaaacttttctcgttgttgggcaccactgtttctagggcagcgtttggaaacaaaaatgatgaccaagatgagtttatgtctttggtcagaaaagctgtagcaatgacaggaggatttgaactggatgatatgtttccttcattgaagccgttacacttactaactgggcagaaagccaaagtggaggaaattcacaagcgggcagacagaatcctggaagacattctgagaaagcatgttgaaaaacgaacaagagcaaaagaagaaggcaacaacagtgaagcacagcaagaagatcttgttgatgttcttttgagaatccaacaaagtgggagcctcgaggtccaaatgacaaccggacacgtcaaagctgtcatatgggacatatttgctgctggaactgatacctcagcatcaacgttggagtgggcaatggcagaaatgatgaaaaatccaagagtgagggaaaaggcacaagctgtaataagacaagcattcaaaggaaaggaaacaatacgtgaaactgatctagaagaacttagttacctaaagtcagtgatcaaagaaacgttaaggttacaccctccttctcagttgatccctagagaatgcatcaaatcaaccaacattgatgggtacgaaataccaataaagagtaaagtcatgataaacacatgggcaattggaagagatccccaatattggagtgatgctgagaggtttatcccagagagattcgatggtagttatatcgatttcaaagggaatagctatgagtatataccttttggggcaggaaggagaatgtgtccaggcatgacatttggtttggctagcattacgcttccattggctttattactctatcactttaattgggaactcccaaataagatgaaacctgaagatttggatatgaatgaacactttggaatgacagttggcaggaaaaacaaattgtgtttgattcccaccgtttaccaagctacatga

SEQ ID NO: 65768 - DNA, 681 bp, Glycine max
  Peptide Sequence Number=SeqID_182546
atgggttggtttaccaagttgcttaagggctctgatcataaaattttacgaggacaataccatggcaaatatggagaggacagaatttgggataatcatcatagttcaatggatgatttgactgatattgagaaagaagacattgaccgtgcaattgcactttctctgtcagaggaggatcataaagggaaaaaagttgttgaaagtgcatgtgttaatcaattaattatttccacaccaaagcataaccaaaaggtctcatgttttttgtctcataataccctacattatgactctcaatctgaagatgaggaactttgtaaaattgatgatgatgaggaggatgaacatcttgttaaagttcatctagatgaagatgaacgtcttgctaaaattcagcaagaagaagaagaacgtcttgctaaaattcaacaagaagatgagcatcttgctaaaattcaacaagaagaagaagaacgtcttgctaaaattcaacaagaagatgaatgtcttgctaaaattcaacaagaggatgaacgtcttgctaaagctcaacttgaggaagacgagcaacttgctagggcaattcaagaaagcttgaaaattggttctcctcctcaatatgacaatggttcttcaattctatcttttcctcaccttttcccccctggatacaggtaa

SEQ ID NO: 65769 - DNA, 264 bp, Glycine max
  Peptide Sequence Number=SeqID_182547
atgcaagttagctcacctgggcgagctgagctggcttgggcgagcaacccctacacgaaatgggttaaaaaggggaaaggggaaggtttctgcaccaaaaactcttccccccccccccccccctcattcaaaaagaaggctatgggaatcacaaattttgcagcccataggtcatcatttttcacgtttttgattccattttgctctattattcatctccaacaacatgaagtgccttacaaaatgcttggatgggtagcgtaa

SEQ ID NO: 65770 - DNA, 138 bp, Glycine max
  Peptide Sequence Number=SeqID_182548
atgtgggctctagaccgtaatattgacgcgtgcactgtgcacgatgctcctatatctgttgctatctccgtcatccataaacaaagcgatcaaactagtgctgtgaaattaaagacagcgctatcagaatgtgcttga

SEQ ID NO: 65771 - DNA, 327 bp, Glycine max
  Peptide Sequence Number=SeqID_182549
atgatgatggaagctctcttcgaagaaacagaaaaggaaaggaaaggaataacactgaaagtcaactcctcaaaggaagaatacaaagataattctagcagtgaggaagatgaagtccaaagacagaaaattcttcaagtcaacaacctccgaagatggaaaatttccttagaaaatatggtgaaaagaaaagaaagaagaccaaaaaatgtggaagcaaagcttcatgatgaatcaaaagtgattcaaaggtgttttgatgataacaatgatgatgacaaaggtgatgaacaaaaagctcaaaagatcaaagaacaactcaagtga

SEQ ID NO: 65772 - DNA, 438 bp, Glycine max
  Peptide Sequence Number=SeqID_182550
atgactgatcattcattgtcgtcaccaaaagtaatcatagtaactaaaaagaacgaatgtgctttacgacacccttaccgaacgcgcgccagagctagaatcatgagtgaggtagaggaagttcaggagcagatgaaggctgacatggaggccaagaaggaccaaatggccaccatgatggaggccatgttgagtatgaagagaataatggaaagcaatgcgactgcagttgccactactagcgccaccgctgaggtggatccgacccacctatctggcataaatcaaatgagtcgtccagtcctaaacgtggtaggtcagggaggagaagcattaggaagtatgggcggtccccatgttgtgcaaagcaagaattctctcctactatacggcttgcctcccaactacacaccacccaatgttgtacaccaatgttag

SEQ ID NO: 65773 - DNA, 666 bp, Glycine max
  Peptide Sequence Number=SeqID_182551
atggtcactaataatagcaaggagtgtgatgagggcagtgctatattatacaggactatcgattcaagtacaatggcttttaattcgcaagtgagatcctttaccttcaatagcctatttggccaaaaatatctaggcacttcaagctcaacgtgggacttatgctgtaataggaaggaatatagaagcataaaactgaaaaccattcaccagcttcataggagcagaaagttcaacctgaaaaatagaaccaggccattcaccaactgttttggagcagaatgtttatccagaaataatagaaccaggccattcaacaaccgctctggagcagaaagttcatgcaggaaaaatagaaccagaacattcagcaactgctctagagcagaaagttcgtccagaaaaatagcagcagaccatgaagttgttgttgcagagaagatgcaagtgcaaccaagagttattgcagataatatgacttcacaaattaagaatttggataatggaagtccaacagaggaagaatggcaagcaagaaaagaaccgagagcacctgtcttcttgcttactaaacaaagatcagtcacagataggtacaggtggcctcaggaaatttttgtgaaggcttatgagatggaacttggaagccagaattacaccaactga

SEQ ID NO: 65774 - DNA, 477 bp, Glycine max
  Peptide Sequence Number=SeqID_182552
atggttaagaaggatgtttgttttgattcggttacttgtaatatacttgctaaggggtattgccgaattggattggttcaatatgctgagtggattatggggaacttggttggtgggggtgttccattagatgttgtaggtttgaacacattggttgatgggtattgtgaagccgggatgatgagccgtgcgttggatttggtggaggatggtcggaagaatggtgtggagcctgatatcgttacttataatactttggttaatggtttttgtatgagaggggatcttgcgaaggcggagtctgttgtcaatgagattttgggatttgggagggatggggaatctggtttgttgaatgagtgtagagttgaaactcgggatgggataagggatttgcagccaactgttgttacgtggacgacattaattgctgcgtactttctattctctatgggctttgcagacatggtaaattag

SEQ ID NO: 65775 - DNA, 342 bp, Glycine max
  Peptide Sequence Number=SeqID_182553
atgggtcttcgtgggagggatcaaaatcgaatctttttggatgtgggaggagaatcttcttctgatgggtatcaaagggtggaagaaggttctggaagaggaggaggagaaaatgaacacatgggtcttcttgctttggaggttcttaagtttagctgcacactgctatggcgtggtggagtggactatgggggaaacggaagaggaacaacaaagaagagattgttaccgcgctatgttatttttatccttaatcctcaatttcctacgtttgggcttcatgaccaacgacaacggccccgtgtgtacgaggctacatttggacataattttgtttgttga

SEQ ID NO: 65776 - DNA, 1038 bp, Glycine max
  Peptide Sequence Number=SeqID_182554
atggatggctactttaaagaaggaaacgagtcagctgctctttctatagtacaggaaataacagagaaggacgtgcagtttgatgttgttgcctacaatgctttgactaaggggcttttgaggctggggaaatatgaaccaaaatctgtgttttcaagaatgatagagttgggtctgactccagattgcgttacatataactctgtaattaacacatacttcatacaaggtaaaacagaaaatgctttggatctgttgaatgagatgaagagctatggggtaatgccaaatatggtcacttataacattcttataggtgggcttagtaaaactggtgcaattgaaaaagcaatagatgttttgcgtgaaatgctggttatgggattaaggatgactaaaaaagcaaatgtggtgctcagggaaatggcaacaaaaggaatttcagctgacattgttacttataatgctcttattcgtggttattgtacaagcagccatgcggataaggcttttagtacttattcacagatgttggtggatggaatctctccaaatattactacttacaatacccttttagaaggtctttcaactgatggtttgatgagagatgcagataaattagttagtgagatgaggggaagaggacttgtcccaaatgcaactacttataacatattggtttctggccatggtagggttggaaataaacgggattctataaaactttattgtgaaatgataaccaaaggttttattcccacaacaggtacctataatgtgcttattcaagattatgcaaaagcaggaaagatgcgccaagctagagaacttttgaacgagatgttgacaagaggaagaattcctaattcttcaacatacgatgttctaatttgtggatggtggaaattgtcctgtcagccagagatggacaggttacttaaactgtcatatcagaatgaggcaaaaatattgttgagagaaatgtgtgaaaaaggacatgtgccatctgagagcactctcatgtatattagttaa

SEQ ID NO: 65777 - DNA, 264 bp, Glycine max
  Peptide Sequence Number=SeqID_182555
atgggccatttttgttttgcgaagaatcctataccttgcgcggtggaccgagttgacggtgataacctcctcccttctcctccgccagatctcatcctcgccgccgccgccgccgccgccgctgccgccgaatttctcctcgtcgttttgtctccacctctcactctctgtatgtataaagtgaatctggtgttgtgcaggctgaagcttattaaggaccgacagcatgtgccggcaaaattctccggtacaccatgccggtga

SEQ ID NO: 65778 - DNA, 108 bp, Glycine max
  Peptide Sequence Number=SeqID_182556
atggcaccaaaggagtgcacttcactgaagggtcagcaccttaaccagcaagaggtgctggctcctgctggccctccttttgttgcctttgatttcactagcaaatga

SEQ ID NO: 65779 - DNA, 3234 bp, Glycine max
  Peptide Sequence Number=SeqID_182557
atggttcataaggttgctgatctaaggcttactatgtggaagccccctaatgagattgcgttaaatgtgggtggtagtgtccatggagatccccaaactgcgggatatggggggcttagccaggacttgttagcgttcaagcctctgatgatgctaacaccatcaacaccaccatggatagcactcttgcaaggccaactcgcaccgaggtccctacctcgaattagggcatcactctctctctctccacttcccttcttccttcttcccccttcgcgccaccacgaccataacaagtggtccgacctgccaccgcggccattgccatggctgatcacgggaccagagacaaccacagaccgtttagaagacgctatcgcccgtctttccacaagccaggccaacctcaacgaacggtacactgatctttccggtaaggttgattctatccttgatcaccttcggttacgcgatacacaccaaagccagtcctccgtcaacaccatgaacagccaccgcaactccgttaagctcgacatcccgcggtttgatggtcgcgatcccctcggatggagcttcaagatgaatcaactctttcaataccagaacacgtcggaagaagagaagatcactgtggcttctctctacctcaacgacgctgctcttagttggtaccagtggatgcacaataatggcctcatcacttcgtggcaggcattcctcgaagctttggaatcacgattcgcaccaacattttatgatgatcctaaaggtgctttgttcaagctagttcaacgaggttccgtgaacgattacttaacggactttgagcgcctggcaaatcgcgtgataggtctccctccaccattcttattgagttgctttatatcgggattaaaccccgagctccgacgggaggtattggccctccaaccaatttccctcctccaagctaccgccctcgcaaagctgcaggaggataagctccgggatagacgaactctgatgccacgcccctatccaccctcatcagctcccactaacttgacctctaaacctaaagctccttatgtgcagcgtactccagaagaaatggccttctgcagagagaagggcttgttttataactgcaatgacaagtggagttcgaaccaccattgcaaggggcgcatactcctattcgtggcggacgattcagtcccagattccggcgaaccagaagccatcatccctagttccagctcagacactactatcagtgatcttgacctcacaacggaaaccacccctccccacattagccttcacgccatgtctggtttaccctcctccgaaacctttcgcgtgtatgacacaatcagaaacgcatgcatcactgttctcatcgatagtgggagtacccacaatttcctccaaccccgagtggcccacttcctccacctccccatcgaaagtacccacccccttcgtgtccttgtcggcaacggctttatgcttgattgcgacaaacgctgccctaacacacaactctccatccagagtcactccttttcgatcaatttccacttactccagatcagaggagcagatgttgtgcttggcatcgaatggttgaagcaactcggccctattaccactgattatacttccttcctcatgagattcactcacatgggccaggagatatccctccaagctgatgttgccactggaccggaacctgcatcggtggcccaagtcaaacacatgatccacacagggtcgacttcggccttatttcacttatgtctcttatctgaaacccccacaggtacaaccacacatcctccacctattatcacaccaatcgcaaaccttcttctccgatacgataaacttttccaaccacccagaagcttgcctccctcacgcgaagtaaaccatcgtatcacccttctccctgcaacagctccggtcaacgtacgcgcttataggtacccacactttcaaaaggccgagattgagaggcaaatcgcagaactcttatctgcaggcttaataagatcaagcacgagcccatattcgtctccagttcttctcgtgaagaaaaaggatggaacatggcgcatatgtgtcgattacaggtctcttaatgttgttacagtccgcgatcgatttccaatccccacgattgatgaagtattagatgaactcgatcaagcttcatggttcactaagcttgatctcagacaaggatttcaccaaatccttatgaacgaagctgatatcgagaaaacggcttttagaacgcaccatgggcattatgaatacttggttatgccttttggcttatgtaatgcaccctcaacctttcaatcagcaatgaatcatcttctcgcaccattccttcgtcgatttgcagctgtattctttgacgatatactcgtctacagcaactcactctcctctcatgttcatcatttggagctgatcttccaggctctactacgaggtgagttctatctcaagcaagctaagtgtctttttgcccagagggaattggagtacctcggccatatcgtttccgctaaaggatggccaacaccggcaaccgcaaaagaactccgagcctttctaggactaacagggttttatcgcaagtttgtccaaagatatgcagcaattgctacaccactcactaatctactatgcaaagatgctttcgaatggtccatcgagtcgcaggaggccttcgacaagctcaaggctgccatgaccagtaccccggtactcgcccttcccaactttaatgaaccatttgtagttgaaactgatgcttcaggcaccgccatgggagccgtgctcaatcaacagggtcatcccttagcgttctttagtaagaacttcaatccccgtctgctgaatgcgtccacatatgtgagggagcttcacgccattacctccgaggttcgtaaatggaggcaataccttctcggcagcccatccaccatcttcactgatcacaagagtctccgagagcttatgactcaagtgccacaaatgttgttgcggatgcactctctcgccggccagctactcgtgctttcagttcctcagtttgactttctgcgcgaaatccaacaaacactcgagcacgactttgattttcagacgttacgggacaaggttcaacatgatccttctagctaccctcagtatcgcgttcataatggctatctactcttcaatgattga

SEQ ID NO: 65780 - DNA, 485 bp, Glycine max
  Peptide Sequence Number=SeqID_182558
tagtgttgagccacatgtaaaggagaagccagcaacaaccgtcaacaggacatgccttgaagtgggtcaccagttttgtaaaaaatcgctgagtcatgtgcacatccaatttgatgaccaactcagaccggtgataccaccggttttcggtctgattggcctatatgagccgcactggagtagagcggatgttgcgtctcggtttcatgatgcggtcagagcaaccatgataatggcaatgttttctggctgtgctatgttttcttttgctttttgggtcagagagaggcctatggcactagaacaagtgttatcagaccgtgatagtgaagacgaagttgatgacgacattgcagatcttgaagatagaaggatgcttgatgattttgtggatgtttccaaagatgaaaaacagctcatgcatctctggaactcttttatgaggaagcaaagggtgctggcagatggtcatgttccgtgggcct

SEQ ID NO: 65781 - DNA, 459 bp, Glycine max
  Peptide Sequence Number=SeqID_182559
atggtgtaccaccctctgcacaacaatattgcctattttctctccgtaataattatcaacgacggccacccaaaacaaaaaattgttctgtcacaaccaccaccagccactatatcgagacccaccagcaaccgtcgtactcagatcccgtgtcgttgtaccaccacacgattgtccaggaccacaacactcctctatgttggaatcgcgatatttgtgatccagttcatggtgagaaaggaatatagacgagcaaagcagagactttaccaccatgaaatgcaaagaggttggttaaggccacgtagaaaaagaagaagaaggaaggacacgagaagaaaaacttccataagcttagatcatttctgctcgtgttcgtcagcgacgtctaatgtgcacaacgacgacgatgataatctcaaagggtttttccttgaactgcatcccgcaaggtcatag

SEQ ID NO: 65782 - DNA, 387 bp, Glycine max
  Peptide Sequence Number=SeqID_182560
atggctatgattattctagtgaattatcgatgcctttcaaggaactacggaataaagccacatattggtctggcactgatggaggccaaattttttcgctttctcaagattgtgggtgttggatacaaagctagagctgaagctgcgggtcgtctattgtatctcaaattggggtacagtcatgaggtggaattaactgttcctcctgctgtccgtgttttctgcttcaaaaacaatgtaatttgctgtactggaatagacaagcaaagggtgcaccagtttgctgctactgttcggacttgtaagccacccgaagtttacaaaggcaagggcataatgtatgttgatgaagttatcaagaaaaaacaaggaaagaagtcaaaatga

SEQ ID NO: 65783 - DNA, 375 bp, Glycine max
  Peptide Sequence Number=SeqID_182561
atggaagcattgagtttaaagtctcaaactgaggaaagaaagaatgtgaaggagctatttgaaacaataggaattccatatgaagcagcttttggctctccagacatgaaaggttttatgaagactcctcccagtaagaagaccttattttctgatttgactgctaataaagatcaatctaggagaaatcaagccagtgcaatgaagagttttgaaccagaaacggctaggaggaggagagactcacttgaccagttttgctcatacaaatatgccaaagaattgagcagacagattgaggagaattctgtagtgattggaaagagaaaaggaaacaagaataaggagaaggtggggaaagtggagaggcaataa

SEQ ID NO: 65784 - DNA, 1923 bp, Glycine max
  Peptide Sequence Number=SeqID_182562
atggtgcgtggtcattccacagaaactaaagatttggctgctgaaaagtctactgttcaaaagtttgatttaatctctaatagtgaaaataagcctactctgctttggaaattgcctcaaaacccctcaatccctacctattcaaccacagaaacaccttcaatgaagattaaatccagtgaaatgccctttccaaatagtaaaatgactatggcttcaagttccacaaccggagacaaactttctagttcatttactcctgagtcttggggaaaagacttcccatcctctgggtcacatttatccactatttctgcaccctcaaccttccttggaaaagttaccgagttccatgttgataaaagcttgcccaaagaaaatattcctgcggtgcccacatttggtggttcatttaaatctctatcattcccaactattaaaacatcaccctctccatcgtcatcatctgtctcatctgcagcagtgtcagtggcatcaagcagtttgactagttcaaacaccagtacagattctaatcgtgtcatgtcatcatcttcaacatcagcttttcttcacttatctaatcaagcacctaaagacacagtgccatcattacctaacccacctggcttgaagttaaccttagagtcacttaagtcagagattccaccagctgctgcacttaaatcagatatgcaaccagctgctgtgtctaattcaaagactgttttagatgcttctgcagaggtagtcactcggccaaatgaacctttaaatggtgcatctgaattgaagcttggaccctcaagaaattacagtcctactattgaacaacctttcaacaatacaacaagttctgatctcaatgttgtctcagtttctcaagcagcacagccttctgatgcttctttgcagctttcaacttctttcctttcttctgctagtgtttcaaacgggaaaaatgagggtttggattttggaatctcacatgaggatgagatggaggaagaagctcctgagacaagtaacaacacaactgaacttagtttgggaagctttggcgggtttgggattagctcaagccccaacccatcaatgcctaagacaaatccttttgggggttcatttaataatgtaggaacaagtttatcaagctctacagttacattctctgttcctagtggagagttgtttaaaccagcatcttttaatttctcaagcccccagtcatcttcaccaacccagacaacaaattcaggtgcattctctggtggcttcaatgctgtggcagctgttcccgcacaagctccaggtgggtttgggcagccagcacaaattggatcagggcaacaggttcttgggtcagttctcggtggttttggacaatcaagacagcttggtagtggttttgctgctcccagtggtttcggtggtggatttgctggcagtagttctcctagtggcttttcaaatactgcaattggtggagggtttgctggcattgcgtctacaggtcgaggctttggtagtgttgcatccaccggtagtggtggattttctggaattgcttctgggggtggatttggtggtggtgcagcccctggcggtggttttggtggggcggctgcccctggcagtggttttggtgctgctgccgcccctggtggtggttttggtgctgctgccacccctggtggtggttttgctggtgctgctgcccctggtgttggttttggtgctgcttcttctactggtggatttgcaggagctggttcaggtggtggttttggagcatttagcagccaaggaagtggtggttttggtgcttttggttcagttaaaatgattggaaagctcaagttgagtttatattgtgaaactccacaaagaaattacgcacgtactacgactactatatcttga

SEQ ID NO: 65785 - DNA, 429 bp, Glycine max
  Peptide Sequence Number=SeqID_182563
atggttaaggaggagtgtaaggaggtaagtgtctcctccaagaggttagctaagaaggaaaatcattttacaataaagaaaaacattaaagaaacttcccctcttagaaaacctccacattttctcctttgtaaaaaaatacttgttagcattgccacacctcttgggcttgagtttattcctcaagtaaaggagttgttggatgagggtttggttcgcaagagcttaaatctttgtgctttggtgggactcattagtgatcaaagggttcccatgaaccctaagagaataaaggttattcctgagtggcccactccaccaagtgttgaggataaaagcccaaagtttcaagaacctcgggatttgaggtcaaatccttttcaagggggagagaatgatgcaatcctatcccgcaagagcattggatag

SEQ ID NO: 65786 - DNA, 591 bp, Glycine max
  Peptide Sequence Number=SeqID_182564
atgaggttgttcttctacaaccagaggttgacttccttaagcttgttcttctacaactcgaggttgacttcccggtcggcgcgaaccttctcgactcgaaatcgcaggaagatgcaagtcacgaatgagttattgatgaacaatagctactgggctaaaagagtttttctccttgcagacattaaagggtttcttactgatgtaaagcctgcactgctcagtgccctggatacagagtatgagaagaatccatttgagggagcatctgcagttaccaagagaactgtcaaggcaaaagactcatcttcaactgttgttgctggtggactggatagcttgccccgggaagacatcagtggaaagatctcaccaactctcctgaagagcttggaaagccctgattggaaggcgtatgctaagaaccacaatgatactaaactgttggtggaagtaatgaggcttttgaagaagaatgatttaccactgcaactaggcactacagatatagttttcagcatttgttataatacagatgattgggagttgattaataagtatccagcattcgttctaaaatcatttcaagtatag

SEQ ID NO: 65787 - DNA, 249 bp, Glycine max
  Peptide Sequence Number=SeqID_182565
atgagtgaagggagagggagagaaggggcacgaaattttgtgcctcaaatgagtggtagtggccaaaacattgatgctactggtggtggcaatgacaataatgattgtgttggaagagatattaatagtggtagtgatgggaactatgaaggtgacaataacaatagtagcgatgatggtggccataacgacaatgtagtaatggcggcgatgactattatgattgtgaggagtcatttttcagagtag

SEQ ID NO: 65788 - DNA, 603 bp, Glycine max
  Peptide Sequence Number=SeqID_182566
atggctaaagctagagctgcagtcaaagaattgaaagtattccttgtatgtgattctgcagaggaaatgaagaagaggcttgataaattgtttctggttttgatcttgcggagcttacgttcagattatgatcatgtgcatgatcaaattctgtctggtgatcaaaatccttcaatgaacagcctagtcactagacttctccacattcctactttggtgaaaggtgaaaatgcagctgcagctgttgggacttcagccatggttgcctctcatggtataggtagagggggttgtggtaatagaggaggaggacatggtggtagaggtggtcatgcctgtctttctcaatctatggaaggtcaaggtccatggatagttgattcaggtgcctctaatcacaattcttgtaataattctgatgaagaatatcaggagtacctgaggctgaaatctagcagccaagctcaatcctctcttcagtaccaagtgtttcaacagcatgcatttctcaatctgtggaagttcaagaaccatggtacaggccggctgattggcgtaggacatgaatcacgagacctttaccatttgcttcttcatctctaa

SEQ ID NO: 65789 - DNA, 279 bp, Glycine max
  Peptide Sequence Number=SeqID_182567
atggacaatgttgatgctgttgattggggtttgaaaggttcatttgttgctgtggcgagtaagagtgttctaagcattctatcgactaagtttgaagaaagagtttcaatttcactatccttcagatcatggattggtgattttgcagcagatggtagcataaaagcagtcttggaccaaggtggaagatacaaagtgaatgatttctctgaatattcgagagatctggactctgctccactctctaaaagtctaatcttttcccaaatgacaagctga

SEQ ID NO: 65790 - DNA, 1284 bp, Glycine max
  Peptide Sequence Number=SeqID_182568
atgcacttaagcaagtttgtcaattcactttttccagaaaatggtgatgataatttgctcttggggctatgcattgataatgtttcaatctatcaaaaagttggggttcaaattgatgtggaggaaaggacagagctcttaccacattgtgttcttatatgccttacattagagggcaaactcgtcatgttccatgttgctagccttgcaggatgtaaaacttcacctgagattgattctgttctgcacaatgatgaagatacttctgtaaaccttcatgaggatgaaggttgcactcttcctcagggattgcagaaacaggaatcagataagacttttgaggttagtgggaatctgacagccaagccctctggtaatcctcaacaaataacacgtactgacactaactacacagaagtggaattagtgggaaattcagagagtctaaagtctaatgtacagcaagttgttcctgatgtagatgcaatccaaaatacaggtaatcaaaatccatttcttccaggcgaacagcaaaaaaacttgggacaaaagaccgcaacacttggaactagcattggttctttaatggtaaacagtcattctgtttcttctgggttgtcaagttataacaatttacaatcaactactgagaagactagggagctgtggactgcaaatagttcaagggactcacagagagcttctttgccgggtgaaacattttcattcccaaaaaagtatgatgtttcttcaatttcagcttcaagctatgctgatggtgttggttttcaaaataaaaaatataccatgggtgctacaaatgttcctgggagcatgggtggaaaacccattcttgtacaggatgtgaatgacgtatctccagccatcgattctgccagtaggctagttcagagtgggggacaactatctaccttagttgctggtaatatgcaaccaatcttgaatagcagctcacgtttttcatctgatggaaatattgcagctgtaaagtcatctgctcggaagttccttccttctaatgagcagcatggtactccatccaagcttgggatattcggttctgatttatcaaagcagtttggcaatattaatgagatgactaaagaattggatctacttttgaaatcagtagaagagactggtggctttagagatgcttgcacaaggtcactacgaagttcaattgaagcagtggagcaaggcatggatgctctgtctaaaaaatgcaaaatattgacggtgatgtttctttattcattttga

SEQ ID NO: 65791 - DNA, 1020 bp, Glycine max
  Peptide Sequence Number=SeqID_182569
atgttcatcctggaaaaaaccctccgattccactcgagtcctttcctgaattggaagaattatcacacatgggtgaaatggaagaagcgtgcgctgattttcatgaacaagtggaagttcttggatggatctctggttccaaatcgatttgacccaagctatgatgcttgggaaagatgcataaatcagattcattcttggattgttaattccgtttcgtcgttgattgctcagaattgcaacaagaattgtattcattcaagcaagagacaaaatgggttagatgaaggagatcaaaatcaagtagacataaatgctgctgatggtaacagattttataaaggaaagaattcaggaggtaaagtttgcacatactgtggaaaaacttggcacactattgaaagttgttttcggaaacacagtttccctctggcttctaagccaaagggatatggctcagctgtaaataacatcactggagatggagatgatcctgatgagaagcttgaaggaggctatgtgagcaagaagaattcaccagtttcaggtcttgccaatgaagagtgcagaactttgttgaacctgttgcagaaaaccaacattcagagatccactgttgctgatccgcagagtgttcaagtcaaccaagcatgtgttggcagccccattccatggctcaatgaaggtactgattgtgcattttcttgtagtattgttaaaggtaatcaactatggataatggattcggaggttacaggtcatatttgcacatccatggactggtttgagagctaccgcaagataaatcatattcctgaaagcttgcccaatggtagtgtagtgatggcacaattagctggagatgtgaaattttcagacactcttattcttaggtatgcattgttcttacctgaattcaacatcaatctagtgtccatttctaaacttacaaaggcagctcaatgtaatttaatttcacatttgttgaaaatgtctgttcaattcaggattcagcgttga

SEQ ID NO: 65792 - DNA, 469 bp, Glycine max
  Peptide Sequence Number=SeqID_182570
atggaactgtgtgtttttaacgatttaggcttaggtggaaggttccaactacattttcagaacggtgttctcttgctaagtccactttcctggcctacccaactacgtaacagatattattatagaattgatgcttctcactctccttcacgattagtgtttgatgaattggggaatatttatgtggagacagtcaatgggacaagaatccaacctcaaggaccaacatggggcaactcaagtcttgatcctaaggggtattactacagggcaacacttgaattcaatggagttttcacacagtatgctcatccaaggagcaacaatgcctaccaagggtggacaattatgcggtttgttcctgacaacatttgcactgcaatattcaatgataacggtagcagttcctgtggctataatagctactgctccacggaaaataataggtctacttgtaaatgcccttatg

SEQ ID NO: 65793 - DNA, 2325 bp, Glycine max
  Peptide Sequence Number=SeqID_182571
atggagaagaaaatatcttgttatcttcagacacagctcatattccgagtggaagagtatgtcacactttttgcaaaagttgagctgaataagccacttactaccgatgacaataatgcatggcgttcagcttcgggcgaatttgctttcgggtttcggcaactgaataatgacaccaagctgttcatggttgccatctggtacaacatgatgcccggcgaccagaccgttgtttggagtgcaaaaagaggttacaaacttgcaacagcaccgacaggatcacggattcagatcacctcagaagggctagtgctgacaggtcccaaaggagattccatatggatagcaaattcaaaagatattgtttcggaaggagctatgcttgacagtggcaactttgttctcctaaacggaaactcggaacatgtgtggcaaagttttgactatcccacggacaccttgttgcctaaccaatctctccagctcggaggtgtgttgacttctcgattgacagacacaaatttcactacaggaagattccaactttattttcacaaaggtgacagtcatgtcttgctctgcccccttggctggccttctcaattgcgttacgaatcttatcatacaattgatgactctggcaatgcttcacagttagtgttcgataaatcaggggatatctatgtagagaccaccaatggtactagaatccaacctcaaggatcaacatggggtaactcaaacctcgatctcgacaggaattactacagagcaacccttgacttcactggagttttcacgcagtatgcttatccgaggaacagtactattgcccaaccagggtggaaaatcatcaggtatgttcctggtaacatttgcgaagcagtcaatcagtatggtagcggttgttgtgggtataatagctactgctccatggaaaatcagaggcctacttgcacatgcctttatggatattcactggtggatccaagtaatccatttggtggatgccaactcaatttcaccctaacatgtggagcagatgttcaagcacctccagacgaattatatgaaatgcatgaattcaaaaactttaattttcctctggcagattatgagaagatacaaccttacactcgacaggaatgccaacaagcttgcttgcaagattgtatgtgtgctcttgccatttcaggtgacttttgttggaagaagagattgccccttgtcaacggaagagaagtgaatgtcactaatagacattttgcctatgtcaaaacaagagttagaggctacttttatcctgactcaaatggggaacttctccagctcggaggtgtgttgaattcttttgcctatcctgaattctttggggatcacttattgcttcctttgtcgttaacgccgaaactgaaaaaggtagtacaagcttccagtcttttggaaacaaatttgcattcgtttagttatgaggcattaaaagaggccacatggggttttagtgaagaactaggcaggggttcctgtggcattgtttacaaaggcaaactagaagcagcaacatcttgtaacttgattgccgtcaagagattggatagattgacacaagaacgagagaaagaattcaggactgaattgagcgccattggtaaaacctgccacaaaaatctactattggtttacgagttcatgagcaatggtactcttgcagacatcctatttggacaatccaaagcacccatctggaatacaagggttagacttgctttggggattgcaagaggattgttgtacttacacgaagagtgtgactctgccatcattcattgcgatataaaacctcaaaatatactcatagatgaacatttcaatgcaaagatctctgatttcgggttggccaagttgctgttgtttgaccaaagtagaacgaatacgatgatccgaggaactagaggatatgtggctcctgaaagcttcaagaacgttgctgtgacggttaaagtggatgtttacagttttggggtaatgttgttggaaatgatttgctgcagaagaagtgtgatgaccatggaagcaggggaagaagagaaggcaatattgacagattgggcttatgattgttgtgtggaagggaagttacatgatttggtggagaacgataaggaagccttgtctgacattggcaggttagaaaagtggataaagatagcaatttggtgcattcaagagcatcctgaaatgaggccaactatggggaaggtcaaccaaatgatggaaggtttggttgaagtccctaacccaccatcgcctaatcctgatgtttga

SEQ ID NO: 65794 - DNA, 276 bp, Glycine max
  Peptide Sequence Number=SeqID_182572
atgatgccagatagggaggagattttcatttacatcaacattcagcacaataacaacaaataccttattgagaaagctctcaaccgagtaaaaccgaatgtcgccagagacagaagccgcaagcgtcgaattatcggtggaaagagccaatgcgcgaaccctcccaacaggaacatcgacgagactcagttgctccactggagagccacttcccttgtccttaagctccttcgcggaatcaataaggtccttcgtctttgcaacgaaaaaacctaa

SEQ ID NO: 65795 - DNA, 283 bp, Glycine max
  Peptide Sequence Number=SeqID_182573
ctttggtgtaatgttgttggaaattattcgctgcacaagaagtgctttgatggtggactcaggggaagaagagaagacaatactgacagattgggcttctgattgccatatggaagggagaatagatgctctggtggagaataatgaggaggtcttatctgacaatggcaggttacaaaagtgggtcaaaatagcattaaggtgcatacatgagcaacctgaaatgggaacaacaatggggatggtcatgcaaatgctagaaggctttgttcaagtcccctaa

SEQ ID NO: 65796 - DNA, 615 bp, Glycine max
  Peptide Sequence Number=SeqID_182574
atggggggtttagcctcttatggtcacgagaggctttacactttaggagttaatgaggatggaagaagaagaatagggatggagagagaaggaatggctatagagctggaaagaactatatcccctgaacaaattgttgacaaggagcttggatcacatgaatatccaagtagtggtgtgtttgaggtggaacctagaagctgccctggcttcatctttcgacgatcagtgttgttgggcagcactgatatgtctaactcagaatttcgagctttcatagagcacttgtctgcaaaatatcatggagacacttatcatcttattgccaaaaactgcaaccattttacggatgaagtttgccagcatctaacaggaagtcctatacctggatgggtaaatcggatggctcgtgtaggttctttctgcaattgtcttctgccagaaagcctccaggttgctgcagttagacatctccctgaacgtcttgcatttgatgatgatgatggatcagcatctgatggtctttctgcatccctggagggtgaagaggatgagtccaatcaccatttactaactggaccaaatggtgatgttgcctttctaaaggagaaacca

SEQ ID NO: 65797 - DNA, 1038 bp, Glycine max
  Peptide Sequence Number=SeqID_182575
atggagctgaaatccttaacttccaattctgtatgcacttcggagtttgtccatgtgggaagaacaagaacaggaacctattcctctttgctctcaaatttcaggagcgttagagtctctagacaactcaactgtttcggtgggttatttcgaaggaacaacgaagcctcgaataaaatttacttggctgataaagctgtcatcagttcagttggcccacataatcttgcggcagaaacgagttttcatcatattaatggcacaaatggctcaacttctagtttgtgttccagaaatctgagagtacttgatgcctttgatgatgtgtatgagggggttgttattgattcagaccggttaccagacaacccttctaccttcgcagctaatttgcgtttttctctttctcattggaaaaagatggggaagaaggggatttggcttagattgccatcagagcaatctgattttgttccaatagctattaaggaaggctttcgataccaccacgcagagccaggatatgtgatgttaacatactggattcctgaaggaccttgcatgcttccagccaatgcatcacatcaagtaggagttgggggatttgtcatcaatgacagcagtgagtcagaggagctatatgccggagccattagagaagtgaaggaagaaactggagtaaggctgcgatatatttctctgattgatactgaatttgttgaagtcatagcattcaggcatgcacgtaatgtggcatttgagaagtcagatttgttcttcatctgcatgttaagacccctgtcagctgagatcattgttgatgatcctgaaatagaagctgcaaagtggatgcctctagttgagtttgtagagcaaccacttatccaagaagattctatgttcaagaagatcatagatatctgtattgcttgtctcgagaagcgttattgtggcctaaatgctcatcaaatggtttccaaatttgatggaaagtcatcttccctgtactataatgtcatcaactgtattggcagttaa

SEQ ID NO: 65798 - DNA, 679 bp, Glycine max
  Peptide Sequence Number=SeqID_182576
taaggtgacctattcaacaaagtgcggagatgcaggccctgaaatccactatccatatcagataaaaggtcagcagcaacaacagaatgatgccctttctggttttgagcttctttgcaaagacaacctcaccactatccactttccatcttatgggaatttggtagttaagtccatttcctatgacaccaaaaacattcacctccttgaccccaacaactgtgcccatcgtgtctttctcaacctcaacctctccctcacaccgttccactatttttatgttctgaaaaactacacgtacctcaattgctccaccacccttccacgtcctttcgtggaggttccgtgtttaagtgcttcgagctatcatgtgtacacagttgaccctgctgtgcctgtgccgggttcatgtgaaggagtcaaaaccgtagccattccttttgcgtatagcccttatctctcagacaaaagtcttggtcttagattaacatggcacttgcgtgaacttgaaggcaacgaagcagtaaacctgaatagaagttcccacaaatcgcgtaatatagttataggctttagcatctgtgttttcgtgatggccatgctattgcttataagcataaaggttcgtggtgccacgaggaatctccatcagaaagaagaacagttattgcagagctag

SEQ ID NO: 65799 - DNA, 375 bp, Glycine max
  Peptide Sequence Number=SeqID_182577
atgacattaccactggatgagatgctagcccttcaatcaattttattaataggtatcttctgtgttcttgcagacaccctcatcaagggagaggtttacagtagctatattcaagaacacttggctcctagtggatatcttaaattaccgaacgccatacctgattatttggagaactgtagatttcttccagtgcttaacaatgaaataccagataagagaaattccacttacaaggaaagatttagtagcttgcagaatttggtacttatcatgttagagcacgacactgttttaataccaagggaaacttcctggtttggatattacccagatggctacttcaagcccgttttaccaccacaatcgatatga

SEQ ID NO: 65800 - DNA, 144 bp, Glycine max
  Peptide Sequence Number=SeqID_182578
atgacaagcgttgatcacgacaccacatattccaccgcaggatcacggagtgggacccactcagatgatgttcccaatgatttgtcgcggatgccacgtagccgtgacagtcctttgctccgaatattacaatgtcagtggtaa

SEQ ID NO: 65801 - DNA, 477 bp, Glycine max
  Peptide Sequence Number=SeqID_182579
atgtataagttttctccttataaaagctcatgtcttgcccttctatttgattatatccaaggcaagaacaactacaagcaaaaaattgagatgacagcgcctgtgatcacagaagtttcacctagtgatggacccttttgtaaatcctcatttgttgtcagcttctttgtgccaaaattgaaccaagcaaaccctcctcctgcaaagggtctccatgtccaaagatggaacaatatgtatgtggcagcaaggcagtttggtggacacgtaaacgattcaaatgttgcggtggaagccgctgtgttgcgagctagtattgaaggcacaaaatggtctggtgccattgacaaaaaccagaaagctggccatgcttctgtttacactgtggcacaatacaatgacccttttgaatatcagaatagggtgaatgagatatggttcttgtttgaaatggaaagtgaaaggcatgcaatttga

SEQ ID NO: 65802 - DNA, 357 bp, Glycine max
  Peptide Sequence Number=SeqID_182580
atgattttcattgtgttggattccaggaaagaaaaagatttaagaggaaagttttttcatgtcatagttactcttaagaattcatcgcatgtcatagttattcgaaagattagttggatagagttgaaaggaggggcagaagcatccaattccaatcatagaaaggacaaagcagggctagttggtaatttgatccatctccgcatatatctccaaagtcgaaacacagtgcgaatgaatgaacgtcagggtccggagttcacgcgcgaatcacgtgatgaacggacccaaggagaaaagattgggcccataattgaattgtcgtcaaacagtgagtttctattattgggtgcctga

SEQ ID NO: 65803 - DNA, 2835 bp, Glycine max
  Peptide Sequence Number=SeqID_182581
atggatgtaagaatgaagaaaaagaaaaacaaaaaagcgtttcaaaaaccctccaattccaatctgtatggagtttttccctctacgagacacagagttgttccgagtacaaataaatctgcaccgtttaataatctcgcacctcatttctcagtgcttgatcaaatctgtctcagttctccgtttggttattatttctcagtaatggataggaggctcaacggacccaccgtttcgtccagctccaacggcggccccgccgtcggacgatcttctcctacgcttcaaccaaactacagtagccgattagttcaggaagcattggaacacttggcatccattgatctgattgagttgtgcaaagaagccaaagttgagcgctgtcgagcaactcgagacttgagaagctgtggtcgctatgtccaccatgtcttgaattcctgcagacatgcctctttatgcgaagaatgtagtcaacggtgtgatatctgcccaatttgtagaatcccaatttcaaaaagtggtgctaaagtgcatctccgactttattatgagtgcatagaagcaggccttatttccaaaaggtgtgatgagagatttcaagaaagagaagatggggagaaagacctaactgctgatggcatatcgaatgtgctagacattttggagtcatcttttaagggtactctttcagcacaactgcacgatttgcagaatctccaagagagcatcatgaagacaaaacagcatatggatgttattatttggtgtacaagacatcaatttttggaaggtgtgaggtcacgttttactgatggttcatcatggtcatcagttgttcggatacgaaaatcagaagcaattagacgagcatggcctgatgcaataaatcaatctgtggagtcacaaggacatgatgggtctctatttattgaagatgcattgaataatcttgatctggaggaggggtttaggaatgaaattgtagagggattagaaattgcatccttgcagaaggatagtgcatcatttttggggtcaaatactgatcagatgctgggttactatcccttcaaaaatcttcgttctgctgttgacttgctctttttacatggaggctctgatatggtggttgcaaaacaggccatttttctgtattatttatatgatcgccactggacaattcctgaagaggaatggagatacatactggaggactttgcagctacatttagtgttaacaggcactcattacttgagtctttgactttttaccttctggatgatcacacagaggaggctttacaggaagcttgccgccttcttcctgaaataactggctcaacatcacatcctaaaattgctgaagtactattagaaaggggtatccctgatacagctctcatggtcttgaggtgggctgggcgtgatggtggacctcacttgacttcactcagagatggtgtcactgcagtgcgggtgagggttgagtgtgggcttctgactgaagcatttatgcatcagagagtgctctgcaccagagtgaaggaaaagaatttcaataaaacagcatctgggaatacttctgagaagcaaaaaggccaatttagtaattgggtggagtgggtggaggtcctggtgactgagatttgttgcctctgtattaggaggaacttggtggatcgaatgctagagttgccttggaattccgaggaagagaagtatatacataaatgccttttggattatgctattgaagaccctctaaggacatcaggaaatctacttgttgtgtattattttcagcgccacagatactctgaagcatatcaagttcatattaaacttgaaaaggtggagcaagattgcatttcaaaaggttccataagtcaagaaaatctgcccatattagaaaaggctattcacattagaggcaatttgattaatagatgcttggaattgttgccagaagttgagcagcaacaactgaggagcggaaacttgactgaaggtgttgttacttgttgtgcagaagttgaaattcctgacaaatttgatgttccccagattcaggatttcttgtcgaccagtttgttgattccttcatctgcaaattcttccctgacattgcataaagatcatccgactggcttgttgagttcgtcgactttaggaagatcagccaaaataggcatgtctttccctactactggcactgagcttggtaattttggttccttttcatatcatcatgatgggttatttacaaataacgagagggttccaagtcatctaagtaaaattggcaaaaatctaagaaatgataacactccaactccaaggaatcataggatccgtttcatgaatggttcacccctgaagggatttaataggacatcaccaagcaattcccaggaaaataggccagacaaaatcttgcctgaagttgaacaaaatctacattttggccataatcaaactaccagtcctatgtactcctggaaggctacagtcaaccctgttactagatccacacttagctatcctaaagaatttgcaaatgatctctcaaatatatctagtaggaatgtccaatcacataaagatgatagaagttggaacatggggtccactaatgatccaatggatgtttctcagagccttgttgagaagaaattaaataccgaagtaaacatcaatggtggacctagatggagatctgatgatgcaagtgatgaggaagatgatctggatctgggaagagctatggatatagcttattatgcaagtcctccaattcggacgacaagacgaagcagagtttccaggagatga

SEQ ID NO: 65804 - DNA, 282 bp, Glycine max
  Peptide Sequence Number=SeqID_182582
atggattttgtcgtttggtgtccttatgggcgccacataggtgttaggcctttcccccaggaagcccttttctctggctttatcaggtgcaaaacgaacatgttgccttatcttccagagaggatgctaaggcaatttgatcatgttcaatgcacccccgccatcatcgtagcgtctcacgatcgattatggatggcgtcaggcgccatgcaaagcttgctagacctcaaaattatgccagatggcacgagtcatcatcaaaccatacaccaagctctataa

SEQ ID NO: 65805 - DNA, 591 bp, Glycine max
  Peptide Sequence Number=SeqID_182583
atgaatctccctatcatagatctgtcctcacctgatcctctttccactgccatttccatccgtcaggcgtgcattgagtatggtttcttttaccttgtgaaccatggcgtggagaatgacttggtcaaagcctttgatgagagtaagaggttcttctcacttccaccaggagagaaaatgaagttggcccgcaaggaatttagaggttatactcctcaggatcctactttaggcctccatggtgattcaaaagagagctattatattggtcctatggcggattcagcaagtgttaagctgaatcaatggccttcggaagtagttattgctgtttttgtctgccacagtgaagctggaaaaaagttgtattctctaattgcactttccttgaatatggatgaagatttctttgataagataggtgccgtggacaaaccatcagcttttcttcgccttttgcgctatccaggtgaaatgggacctcaccaagagatatgctctgctcattcagatactggcgcgctcaccctcctaatgactgatggagtcccaggactacaggttctaacttcccttttggtgcaactttaa

SEQ ID NO: 65806 - DNA, 835 bp, Glycine max
  Peptide Sequence Number=SeqID_182584
gatagaatccagtttgggaattgaagagatgaatcttcctatcatagatttctactcagctgaatcagaccgtctttccactgccatttccatccgtcaggcgtgcattgagtatggtttcttttaccttgtgaaccatggggtggagaatgacttggtcagagcctttgatgagagtaagaggttcttctcacttccattggaagacaaaatgaagttggcctacaaggaatttagaggctatactcctcctgatccttctttgggactccaaggtgattcaaaagagagctattacattggtcctttgtcagattcaacaagtgctaatctgaatcaatggccttcacaaggtacgcttgctccatgcggagttggaaaaaaactgttatctctaattgccctttccttgaatatggatgaagatttctttgagaagataggtgccgaggacaaaccagcagcttttcttcgccttttgcactatccaggagatgaaacaaaggatagaatggaagggaacccattgcaattcattccatcaaattctatcccagcgtgtcgagcaagacgtagatgtcttcggatgtcgttttggtttatgagaaggcgtcgtgtcgtggaaggcgcgtacggcttggcgcggggttggggtgaggtggctttggtccatttcgacgatgagttaccatgcacgtcgaattggcgaatcttggccatggtgtcgatgaggaggggtgggggtgagggtgatgctgtggagctggagggtggggttgtggtgctgcaggaggagcttcgagaccagtttgacgtcgcttttgtcgcgaggtga

SEQ ID NO: 65807 - DNA, 819 bp, Glycine max
  Peptide Sequence Number=SeqID_182585
atgacagaattatctaagaagagaaaatgttcaacttcaaccaccaccgctgcaggccaacactatcacgacacttctggtgactctcccacaccacctaatccctccctttcctccccatgctccttaactctattttcctccaacgatcaacgtcaaagtcaaggtgtacattttgaggacaccttggttgatgaatggaaacatatttattctagtcatgatgcccgcaaaatggtttgcaaagaaaatgttgatatgacgggccgtttgcatgctggctcattcactttcgagtgtcgtatcatgcactatattttgtgtcgtgtcttgcttccctgttccaaaaatcttgctcgggcttatgaggaggatttaattttgttgtgggcctttcaaattggtcgtcaaattgattgggcccatcttgtccgctaccgtatgcataaggcattacaggcaaatgcacctcttccttatccccaccttgctactctttttctccagcactttaacattcctttagatgatgagtcttttgttaaagttaaacaatcttttgccattggagccgctgttgttgcatcttttggatatcggaaggatatggatggtcaatgggtgcggaaacaagaccttccacctactgctcctaatgaacgcacaccctctccaccaccacaaaggaatcccttctcttccttgctaaatgatgttcttcatgagcttcgagattttcgtgcctttgttggtgaccgatttgatgctatggattcacgtatcacatgccttgaggatgatatgagctttattcgttga

SEQ ID NO: 65808 - DNA, 276 bp, Glycine max
  Peptide Sequence Number=SeqID_182586
atggagcatcgatcgggtgtggacgtagagggacacgtagaattacacttgtcagtcaggggagcaggcatcgctatccatcacatgatggaggtgctcgctggcacagagggtctgggtcatgcgggtgaattgtttgatattctgagaccaataagatccttcttgttgttagtgttgttggactttactcctttcataatctcaagtttgttgttgaatgaatttgtggttgagtgtagtggtgtacgccgccgtgtctcgatctccctatga

SEQ ID NO: 65809 - DNA, 582 bp, Glycine max
  Peptide Sequence Number=SeqID_182587
atggaccgcggttggaaagacccaacactatttactacagcaaacggacaagcttcgttctggcgaagaatggcggcgccgggctcagatggcggcggcggagggacggcgaaggctacggtggccaagcagatctcgcaggtggtgcagtccacctccaacctcctccaacttatgcagcattcttctcttgcccaggctcaattggttaagcttcctaagaaccttttgacgaaggttcctaccatcaagaacactgagcaggttttggagcagttgcctggggtgatatcatctctggatgcacatatggagaatgggttacaaaagtctgaaccttctctttgttccacatctaaagactgtggttcaggtactttcaaatatggaaagtacccagcttatctcgcaatcctgaccccatcctctccagaagtgaagtttaacatttggagtgtatgttctgatggcagaaagctaggaacaggaaggcttgatgaccaagtctttcttgtttgtctaatgctatataagatgaactctgctctacctgggaaaaaaagaaaggaagaacgaatataa

SEQ ID NO: 65810 - DNA, 201 bp, Glycine max
  Peptide Sequence Number=SeqID_182588
atgataaagatagaagataaagatgatgataatacgtttgaatgcttaaaggctcccgacaatgggggtttagcctctcattgccatgagaagctttacactttaggggctgagatggatagaagaagaagaaggatggataaagaaagagatggggagaatggctatagaaggagggtttcccctattagagaagcttag

SEQ ID NO: 65811 - DNA, 594 bp, Glycine max
  Peptide Sequence Number=SeqID_182589
atggaagaggaagataaccaagtccataacttgacagaagagaagaaaaaaagtgaaaacgaagaagtgagtgttgagagtaacgataagaagaagaagaagagaagcagtgatgggaagcacccaacgtatcgcggtgtgcgcatgcgtaagtgggggaaatgggtatcagaaataagagagcccaaaaaaaagtccagaatctggctcggctctttttccacgccagaaatggcggctcgagcccatgatgtcgcggctctcactatcaaaggcacttctgcgttccttaatttccccgaattagcctcacaccttccgcgcccactcaccacttcccctaaggacatccaagccgccgccgccaaagctgctgcactcaactttgaggcccaagtcgaagcccaggcccaggcccagctgagcataccaagttcctcctctgaggttgagttccctgatcttttactggactcaagtcacagtgcaggtgagtttgattactcggcgccgtggctagtagccgaagctgaacatctagacttggcttttcggctcgatgaccctcctttccctgcttgggggtcttactaa

SEQ ID NO: 65812 - DNA, 177 bp, Glycine max
  Peptide Sequence Number=SeqID_182590
atgtgtgtatggatgaaagtccaaagggatgcagttttatgttttatggaatctttggatggatacatgcaggacctctcagcaagcttcatgtcatttgctgatggtggatatcatgtttccaatggcataggtcctttggctggtgcactagcaattcttcaaggtgctagctaa

SEQ ID NO: 65813 - DNA, 2132 bp, Glycine max
  Peptide Sequence Number=SeqID_182591
aaagcttgatgtttctgtgttggatgagttgaagacaaagttgttgacacttaacactgtgctcaatgatgctgaagagaagcagatagacaatgttgcattaaaggaatggcttggtgagttgaaaggtgttgtcttagacgcagaagatttgttggacgaaatcaacacaaatgctctgagatgcaagcttgaagcaatatctagaaggctagaacattttgagacagatattcttggcttgcaaagtgttactaggagagtctcttataaaatagtaacagattcactagttgattctgtggtggttgctagagaggatgacaaggagaagctacttaacatgcttctatctgatgatgattccatgtctaatgatatagatgtgatcacaatattggacatgggagcatgggtgtcagacgattttgacattcccaaggtaacgaagaaaattgttgagtctctcacatcgaaagattgtcatattactaatcttgatgttctttgtgttgaattaaagaatagcttaaaagataagaaatttttgcttgttcttgatgacctttggaatgaaaagtataatgataggcatcacctaatagcacctcttaatagtggaaaaaatggaagtaagatcgttgtgacaacccgacgacagagagttgcgcaagtcacagatacatttcccatttatgagctgaaacctcttaaagatgaaaattgttggcgcatactagccagacatgcatttggaaatgagggtcatgacaaatattcaagcctagaagaaattggtaggaaaattgcaagaaaatgcaatggcctcccattagcggctaaaacattgggaggtcttctgcgattaaatgatgatgctgggaaatggaatagacttctaaacagcaacttatgggcacatgatgatgtttttccagcttcgcagataagcttccttcaacaaatcgatagagagaaagcattggaatcagtaggtatcacatggttggttgccaaaactaagataatgcgagcattgtcattctctaagtacagaaatatacctgagttgtctgattcaattggcaatttgttgcacttgcggtatctggatctttcctacacttccatcgaaagcttaccagatgaaacatttatgctttacaatttgcaaactttgatattatcagattgtgaatttcttattcaattgccaccacagataggaaatttggttaatttgcgccaccttgacatcagtgacactaatttgcaagagatgcctgcacaaatctgcagactacaagatcttcgtactttgacagtttttattcttggaagacaactaaggatcaaagatttaagaaaacttccttatctgcatggtaaactttccattttgaatctgcaaaatgttattaaccctgcagatgcatttcaggctgacttaaagaagaaagagcagattgaggagcttatgctggaatggggcagtgatccacaagatccacagattggaaataatgtacttgagaacctgcaaccatcaacaattttaaagaaactcaacatcagatgttatggtggcactagctttccaaattggacaggagattcttcattttcaaacatcatagtccttagtatcagtgattgcaaccattgcttgtcgcttcctccatttggacaactaccttccctcaaggagcttgccatcaaaaggatgaaaatggtgaaggatatgtcagaatggcaggagtggctaccatttgaaggtgaaggcagaaacttcccttttccttgtcttaagcgtttgcatttgtacaagtgccccaagctgagaggaacattgcccaatcgtctaccttcattgacagatgttagtttctcggagtgcaaccgtttagtaacaaaatcatctgatctgcactggaacatgtcaatcgaaataatacatatgagagaaggacaagaaggactgttgtctttgcttgaaaacttctcttatggtaaattattgactgaaaagtgtgacagcttgcagtctttgcctaggattatactcggtgcaaattgtcttcaagagttgactcttaccaacatcccatctttgatttccttcccagctgatg

SEQ ID NO: 65814 - DNA, 552 bp, Glycine max
  Peptide Sequence Number=SeqID_182592
atggcacccccgaggaatgttgaaactgctaagaaaacaaacaacagaggagcatggaccgcggaggaagatcagaagctagcccagtgcattgaaattcacggtgcaaagaaatggaaaactgttgcaattaaatcaggtctaaacagatgtggaaaaagttgcaggctgagatggttaaactatttgagaccaaatatcaagaggggcaacatatcagttgaggaagaggatttgattattaggcttcacaaactgctgggaaacaggtggtcattgatagctaagagacttccaggacgaacagacaatgaaattaagaactactggaatacttgtttgtgcaaaaaagttaatcacaaaaaggtgaaacctgaaacttcaacggcacaaacaacgcatacgactcagaataccgaggaaagagcagcggtagagaataaagagggcactgatgatgggagtggggactcagaagttaactttgatgtgaacgaattcttcaacttctccattgaatctggaccctttgcgttggattggatgatctaa

SEQ ID NO: 65815 - DNA, 1698 bp, Glycine max
  Peptide Sequence Number=SeqID_182593
atgtatacggaggttggattagctgcttttgatttgaggtcagcttcactgcatctttctcaatatattgaaactagcagctcatatcaaaacacaaagacgctactgcatttctacgatcccattgtgatcattattcctccaaacaagttagcatccaattccacggctggagttacagaattggttgatagattttatggttcagtgaagcaggtaatgctggcccggggttgttttgatgacacaaagggtgctatcttaataaaaaaccttgctgccaaggaaccttcagcacttggtttggacacttactataagcagtattatctctgcctggctgctgctgctgccactttaaagtggacggaagcagaaaaaggggttgttgttaccaatcactcattgtcggtcaccttcaatggatcatttgatcacatgaatattgattcaacaagcatccaaaatttggaaattattgagccatttcattctaccctacttggaacaagcaacaaaaagagaagtttgtttcacatgctcaagacaacaaaaactattggagggagtagactactccgtgccaatctgttgcagcctctaaaggacattgagacaatcaatgctcgtcttgattgcctagatgaattgatgagcaacgaacaactattttttggcctctgtcagattttgcgtaaatttccgaaagagactgatagagtattatgtcacttctgctttaaggcaaagaaagttacagctgaggccttggcagttgatcgagctaaaaagagtcaagtgctagtttctagtgtaatcctccttaagactgccttggatgcccttcctttactatctaaggttcctctctctcatacacacacaagaatcaggcaggttcttaaggacgtgaaaagttcccttctttcaaatatctacaagtcagtttgtgaaaatgagaaatatgatcttattaggaaaaggataggggaggttattgatgaagatgtacttcatgcacgcgttccttttgttgcctgcactcaacaatgctttgctgttaaggctggaattgatggcctcttggatatttcacgaagagcattttgtgaaaccagtgaagcatatcatatctgtgttctcaaagcatttggtgttactttcacagccatccacaatcttgcaaacaattatcgagaggattttaagttgcccaatttaaagcttacctataaaaacaggcagggattccactttgttataccacagaagaatattcaaggaaagcttccaagcaagttcattcaggttgtaaaacatgggaacaacattcgttgctcaagtttagaactagcatctttgaacgctaggaataaatctgcagccgcagaatgctatacaagaacagagaaaaaaattacagaacttatggatgacattcgtgagaatgtctctgtgttgacactgcttgctgaggtcttgtgtttgctggatatgattgtaaattcatttgctcatatgatatcaactaagcctgttgatcgatatacaagaccagaatttacagagaatgggccgttggcaattgattctggtagacacccaatcctggagagcatacacaatgacttcgttgccaataatatatttctgactgaagcctcgaatatggcgattgtgatgggccccaatatgtaa

SEQ ID NO: 65816 - DNA, 279 bp, Glycine max
  Peptide Sequence Number=SeqID_182594
atgagaaagttctttggaaattctcttcttctggtgattacactgttcgaagtccttaccacaattatggagaatatcattgacagtagtcttctaagatgtgaaggagatttggaaactacaagaccaccaaagataacactatctatggaggactcctccccacatgttggagcaaaaataggagtcattctatggtgcatgtggaagaacagaaattccaaactttgggaaggaaacataatgcctccacgagtagctctatccgtggccatgtag

SEQ ID NO: 65817 - DNA, 660 bp, Glycine max
  Peptide Sequence Number=SeqID_182595
atggcttttggtcgttctggtggaattatttgtgttacctgtgttggaagtgcctacaagtatgtttcagagctatggcgcaagaagcagtctgatgtcatgcgcttcttgcagcgggtgaggtgctgggagtataggcagcaaccttccattgttcgcttgacaaggtcgacccgccctgacaaggctcgtcgcttgggcttcaaggctaagcagggctatgtgatataccgtgttcgtgttaggaggggtggccgaaagaggccagttcccaaaggtattgtttatgggaagcccacaaaccagggtgttacccaactgaaatttcagcgtagcaagaggtcagttgctgaggagcgagctggacggaagctgggtggacttagggtcctcaattcttactgggtgaatgaggactctacttataaatactttgaggtgattctggtggatgtggctcatgctgctattagaaatgatcccagaatcaattggctcgccaatccagtgcacaagcacagagagctgcgtgggctcacctctgctgggaaaagcaacaggggtttacgtggcagaggacatctgtaccacaaagcacgtccatctcgcagggcaacctggaagagaaacaacaccctgtctctccgccgttaccgctaa

SEQ ID NO: 65818 - DNA, 777 bp, Glycine max
  Peptide Sequence Number=SeqID_182596
atggaaggtggtttttttccaccttggaaaaacgggtcttggcaggagttaggttcagaggatgtgcaggaaagtgagcaattcaaatcttttccaccgttggctgagccaccgacaccccgtgaacctatggagttcttatctaggtcatggagtctctctgcctccgaaatctcaaaggctctctcagagaaacaaaaacaaactttcctcgataataagacctcagacacattgccagaacctatttccgcacctcaattagcaggagggaagatgatagtatctggaaattgtagaaggatgggtgcgattgggaaatggttacatcagaagcagtacggcaatacgaacgtctccgttaagaagaaagaccgggcgcgcgtggaaaacgcgcgtgtacattctgcgctgtccattgcggggttagcctctgcggtggctgctgtggcggcaacagaggaccctcgcggtggctctcgttctaaattggacgttgctctcgcttcggccacgcaactcttggcctcttattgcgttgaaatggcggaggtagctggcgcggatcgcgagcgcgtggcttccaccgtcaggtctgcggttgatattcaaacgccaggggatctaatgactctcaccgctgcggctgcaacagctttgcgaggagaagcagccttgacagcgagaatgccaaaagaagcaaagaagaatgcgtcaataagtctgtatgataaagtgatagcggaaacgcagtggcttcgtgcgtttgacggtcag

SEQ ID NO: 65819 - DNA, 573 bp, Glycine max
  Peptide Sequence Number=SeqID_182597
atgcctgacaatccatgctttgaaaattttcatttcagcccaaagaaaggccttttttactgtgtggtttacttgaatcctggagattaccatcgaatacactccccagctgattggaacattcttgtacgcaggcatttttctggtcgtctttatcccttgaatgaacgtgctataagaacaattagaaacctctatattgagaacgagagggttattcttgaaggtctatggctggaagggtttatggcacttgctgcaattggtgacacaaatattgggtcaattgagcttttcattgagcccgaacttcatacaaacaggccaaggaagaagtttctacattcagagcctcctgaagaacggatttatgaatgtgaaggtttaggtagaatgctcaagaaaggggatgagttaggtgctttcaacatgggatcaacagttgttctcgttttccaagctccaatttcaaaactccatgagggcgattcatttcaagagttcaggttctgtgttggacgaggggatagaattcgtgttggcgaggctctagggaggtggcatagttcgtga

SEQ ID NO: 65820 - DNA, 1410 bp, Glycine max
  Peptide Sequence Number=SeqID_182598
atggaggttgaggtaactccaactctagagaatgacacaataacaacactctatgaagcatcactaaatggctctgtaagtaccttaaacaccctgatccaaaggaaccctctgattctgcatagagtttcactctctccattcagtgaaaccccattacacatagcctctttgctaggacatttggaattctgtgaggcacttcttaaaagaaaaccaagtttagcaagtgaagttgactctgaaagacgttcccctcttcatttggcttgtgctgaagggcacactgaggttgtgaaagctcttttgcatacaaaccctgatgtttgcttggctatggacaaagatgaaatgcttcctctccacttggctgtgatgagaggacacattggagttattaaggagttgaccagagccagaccaggctcaattcaacagaacactattgatgatggttctgttttgcacttgaaccaacaacagttcctgcttgccagagacaaagagggtgacacagttctgcatttagcagtgaggctcaaacaaattaagaccataaaacacctacttatgctacctgaaatgagaacagcggttagtgctttaaacaaggcaggtttaacagctttggagatgttggtgcgctgtccaagagattttataagcctaaaaattgaaaagatgttacttgaagctggagttcaaactggcactgcacaacaagggtcaccatcaccaagaatagctactcaaccatcacatcaatccaagagaagcaatatatgggaaacattatggttaagatacttaaaataccaaagtaattggatagaagagaaaagaggaacattgatggtagtagccactgtaattgccaccatgacttttcagtcagcaataaatccaccaggtggggtttggcaagaagacacaataactggtggactcaactgcactacttatggcatttgtaaagcaggcactgcagttttagcatatgatttgccacatgggtttctgaaattcatgaccttcaacaccacctctttcttctcctctcttgctgtggtgctgcttctcataagcggttttcgccttgagaacaagctcatgatgtggatcttgaccatggctatgacttcggcgatcacattcatgggactcacatacttttgggcacagagcttggtcacccctgatcacattgttgataaagttaataggatgggaattcctttgtccatagtgtgggtgatcatgcttctagtggttgaagtttgtaaagaagtggaagcagaagctgctgcatggctaaaagtcattgctcttgtgggtaaagaagtttgtaaagaagtggaagcagaagctgctgcatggctaaaagtcattgctcgcgagttagtccagtga

SEQ ID NO: 65821 - DNA, 444 bp, Glycine max
  Peptide Sequence Number=SeqID_182599
atgggtcctcgacagtgccaagtctgcaaccaaactcagtccaaatacaagtgcccttcatgttacttaccttattgttctctggtctgtttcaagaaacacaaagaatctccatgcgtcaagccacagccttcagagaccaaagcaactgctgtttcagaatcatttgtagaaaagccattagttgctgatgaatcaagtgaggtgttgcaaaaattccaactggaggccatagcctcttccagtgagattcgtgatgctttgaatgatgaagcccttcaagaactaatttgccgtattgatggttcctcaaatgcagagaatgagcttgataaagctatggcagaggaggcttttcgcttgttcactgacaagctttgccctgtgattcagcttttgatgtatgataaattttgtatcttcattgaggcattgtattggtaa

SEQ ID NO: 65822 - DNA, 3282 bp, Glycine max
  Peptide Sequence Number=SeqID_182600
atggcgagcgagggcggcaacaagagcttcgcgcggcgtgatcgtctccgcgagatcgaatcgaaggtccagaaatggtgggaagagaaagatgtcttcagagccgaaccgggcgagaagcccccttcttcgcctggcgagaaattcttcggtaacttccctttcccttacatgaacggctacctccacctcggccacgccttctccctctccaaactcgagttcgccgccgcctaccaccgcctctgcggcgccaacgtcctcctccccttcgccttccactgcaccggcatgcccatcaaggcctccgccgacaaactcacccgcgagatccagcgattcggcgacccgcccgtcttcccctccgaagtcgaagaacaacaacaacaacaacagcagcagcagcaagaacaagaagaaccaccttctggcgacggtgctcctcctgataaattcaaaggtaaaaagtcaaaggctgcttccaagtcaacggggcaggtttaccagtgggagattatgcgtagtgtagggatttccgatgctgagatatccaaatttcaggatccttataagtggctttcgtattttccacctctggctgttgaggaccttaaggcttttggattaggttgtgattggagaaggtctttcgttacaaccgatatgaacccttattttgattcgtttgtgaggtggcagatgaggaagttgaagtccatggggaaggttgtgaaggatgtgaggtatactgttttttctccattggatggtcaaccttgtgctgatcatgatagagctagtggtgagggagttcagcctcaagaatacactatcatcaagatggagttggttgctccttttcccgaaaaatttaaggcattggagggaaagaaggtgtttcttgctgctgcaactttgagacctgagacaatgtatggtcaaaccaatgcttgggtgttgccggatgggaagtatggggcttttgaaatcaatgacagtgaggtgtttgttcttgctcaccgagctgcgcttaaccttgcctaccagaaccactcgcgggttccggagaaaccctcttgcttgcttgagctcactggccgtgacttgattggtcttccattgaagtctccactttcattcaacgaggtcatttatgctctacccatgttgtctattctgatggataagggtactggggttgtcaccagtgtgcccagtgatgctcctgatgactacatggcattgcatgatttgaaggcaaaacccgcgctcagggagaagtatggggttaaggatgagtgggtgctgccttttgagattgtgcccatcattgaggttccccagtttgggaataaatgtgccgagacagtttgcttgcagatgaaaatcgtaagccagaatgataaggaaaaacttgtagaagccaaaaagcaaacgtacttgaagggtttcactgaagggacgatgattgttggggaatttgctgggagaagagttcaggaagctaagcccttgattaggaacaagcttttagaaacaggccaggctattatctacagtgaaccagagaaacgggtgatgtcaagatctggcgatgagtgtgtggtagccctcacagatcagtggtacattacatatggagaatcagaatggaagaagctagctgacgagtgcctttctaacatgaacctgtattctgatgagacacgacatggatttgagcacactttaagctggttgaaccagtgggcttgctcacgatcatttggtcttgggactcgcataccgtgggatgaacagttcctagttgagtctttatcggattccaccatttacatggcgtattacactgttgcacaccatttgcagagtggtgacatgtatggatccggcgagtctgccatcaaacctcatcaactgactgatgatgtctgggattatattttctgtggtggaccatatccgaagtcaaccgatatatcatcatcccttttagaaagaatgaagcaggagtttgaatattggtatccctttgatcttcgagtttctggtaaggatctcatccagaatcatcttaccttctgcatttacaaccatactgcaattatggccaagcatcactggcctcgcgggtttagatgcaacggacacattatgctcaattctgagaaaatgtccaagtccactggaaatttcaggacgttgcgtcaggcaattgaggagttttcagctgatgctactcggttctctttggctgatgctggtgatggtgttgatgatgcaaattttgtctttgagactgcaaatgctgcaattctccggctcaccaaagagattgcatggtatgaagataatctggcagcagaatcttccatgagaactggcccaccatctacatatgcagatcgcgtgtttgccaatgagattaacattgctgtccagacaactgagcaaaattacaccaactacatgtttcgagaagctctcaagactggcttttatgatcttcaggctgctagggatgagtatagattctcatgtggggctggaggttgcaatcgtgacttggtgtggcgttttatggatgtgcagacacgtcttatagcacccatctgcccacattatgcagaatttatttggagagagcttttgaagaaggatggttttgtggtaaatgcaggctggccgacagctgatgctcctgatctcacactgaagagtgccaataaatatttgcaggactcaattgttttgatgaggaagttgcttcagaagcaactttcaggctcaaagaaaggtaataagaaaggtcctccagctgcatcactgacagatagcaaggtgacaggcttgatatatgtaaatgaacagtttgatagttgggaagccgagtgcctgagtattcttcagaaaaaatttagcagagatactcgaacttttgctccagagtctgagatattgcaggctttacaacagagttctgtaggtcaatcttctaattttaaacaagtccaaaaacgttgtatgcctttcttgaggtttaagaaagaggaagcaattgcacttggggctcaagccctggatttgagattgccatttggtgaaattgaggttcttaaggaaaacttggaattgatcaagagacagataggtctagaagatgtggaaattttatctgcagcagatgctgattccttggctagagctggaccactagcttctttactaaatcaaaatcctccatctcctggaaagccaactgctatctttgtaactctgtag

SEQ ID NO: 65823 - DNA, 891 bp, Glycine max
  Peptide Sequence Number=SeqID_182601
gcttcaccaccttcagtgagggcttctaggttctcaagtccgttacatgacaacctcaccggtaacaagaaaactttttcaaatcctagagcatccttggaaaaagatgttgaacagctacagctacgcatacagcacgaaaaatctatgcgtattctgctcgagagagcaatgggccgtgcctcaagtactttatcacctggacacagacactttgcagctcagacaaaagatttaattgctgaaattgagttacttgaagaagaagttacaagccgtgagcaacatgtgcttgccatgtacagaagtatttttgaaaattgtgtcagctggccaccttctgaacaaaattctggtgtggcttcaccagctcatccaagttatgctcctttatcatgtggcaagggcgaagtttattttggaaagacttgtcctgattccaccaaggttaatgagaagttttccacaaaggagaaaactccagtattgcgaactttaaaatatcatctaaaccagtgcccaaacaggctttctgaggagatggtgaagtcatccactcatgctgcacagacaagacatggtgttggggaggatcaagactgttcttgcaaatcagtagtggagatatcttggatagctacacgtaaacgtcattcttctcatgcttcttacgccattgacaacttcagagtactagtggaacaacttgaaagggtgaatatcagtcaaatggaaaatgatggacaaattgcgttctggatcaatgtgcataatgctcttgtgatgcatgcatatttagcatatggaattccccagggctctctcaagaggctggccttgtttcacaaggattttacattccgtgaagcgctcttccccagccaaccttag

SEQ ID NO: 65824 - DNA, 3214 bp, Glycine max
  Peptide Sequence Number=SeqID_182602
cgcccaatacacaaaccgcctctccccgcgcgttggccgattcattaaggcagctggctcgacaggtttcccgactggaaagcgggcagtgagggcaacgcaattaatgtgggttagctcactcattaggcaccccaggctttacactttatgcttccggctccagcttgttggacctttaagcacacaattgtcagatcgaaggtctagcattgtgaagcaggactttttgggtgattttgaagcatgtgctgaattgttgataccggtccttctgaagctggttgtgattactgtgcttgtaattgcggaatctgcagataactgcataaaaacgatgttgcgcaactgcaaagcagctcgtgtacttcctcggatagctgattgtgccaaaaatgatcgtaatgctgttcttcgtgcaaggtgttgtgattatgctcttttgatactagaacattggcctgatgcagcagaagtacaacgatcggctgatctatatgaggatatgataagtgaacataactcgcagttaataaacgaagaggatggaggaatgcataggcgacatgcatcaccgtctgttcgtgatagaggtgcactgatgccaataactagtcaagcttcagcaccctctaatttaactggttatggaacttctgctattattgcaatggaccgaagttcaagtttatcatcggggacttctatcgcctctggtgttctttcacaagccaagtcacttggtaaagttactgaacgtagtttggaaagtgtgttgcatgcaagcaaacagaaggtcactgctattgaaagcatgcttaggggtttggatttgtctgataagcatggttcatctgctctccggtcatcgagcttgggtctaggagttgaccctccctcatctcgtgatccaccattccctgctgctgtcacagcatctaatcatctgactagctctttaacggcagaatcaactgcagctggtgccaataaagctagtaaccgacatggtggtttgggtttgtctgacataatcacccaaattcaagcttccaaagattctggcaggttatcgtataatactaatgttggtattgagcctttatcagcattctcatcattctcaagtaaaagggctactgaaaaattgcaagaaagaggttctattgatgaaaacagtgatatgagggagactagacgctatatgaaccccaacatagataggcagtatatggatacccattatagagatggcaactatagggattcacagaatagttatgtgcctaatttccagaggccactattgagaaagaatgtagctggacgtgtgtctgctggaagcaggaggagttttgatgatagccaattatctcttggagagatgtcaaattatgcagatggcccagcatctcttcatgaagctctgagtgaaggacttagctcaggttctgactggtccgctagggttgctgcctttaattatcttcactctttgtttgagcaaggtcaaaagggaattcaagaagtagtccagaattttgaaaaggtaatgaagttgttttttcagcacttggatgatccccatcataaagttgcacaggctgctctctccacacttgcagatattattctggcatgccgaaagccctttgaaggttacatggaacgaatgttaccccatgtgttttctcggttaattgaccccaaagagctagttagacaagcatgctcaatgaatttggaagttgttagcaaaacatacagcatagattctctcctacctgcattgctacgatctctagatgaacaaaggtcaccaaaggcaaaattggctgttattgagtttgcaataagttcatttgataagcatgccatgaatcctgaaggtactgctaatattggcatcctaaaattatggcttgccaagctagtcccattggttcatgataaaaatacaaaacttaaagaagcagctattacatgcattatatcggtgtactctcactttgattcatctgcagttttgaattttattcttagtttgtcagttgatgaacaaaattctttgaggcgagcccttaaacagcgcacccctcgcattgaagtagacttaatgaattatctgcaaaataagaaagatcgccgttctaagtcttcctatgatccatctgatgttgtgggagcatcctctgaagagggatatgctggtttgtcaaggaaagctcagtacattggaaggtattctgctggttcactagatagtgatggtggcaggaattggagttcccaagattccaccctgattaaagccagtcttggccaagcagctactgatgaaactgaagaacatactgattctaatagtggtgcttttggtttaaaaactaaagagcttgcttacacagccaattcaacgggtcaaaactttggcttacaaactagccatggacatgtggacagtagcattaattttgaaggtctatcatctgatctgaatgttaatggtctgatgtcatcagaacatttaaatattactgaagactttggacatgacaaagaacatcattcagctgaagatgtgaaagtaaactacatgacagacaatgggcctagtattccccagattcttcatatgatatgcagtgggggtgatggaagccctatttcaagcaagcggactgctcttcaacagctagctgaagtgtctatagccaatgatcattctgtttggaccctgtacttcaatcagattttgacagttgtgcttgaggtgctggatgattcagattcctcaatcagagagcttgctctgtctctgatagttgaaatgctgaaaaaccagaaagatgctatggaaaattcagttgagattgtagttgaaaagctgcttaatgttaccaaggatattgttcccaaggtttcaaatgaagcagagcactgcctcaccattgttttatctcagaatgatccgttcagatgcttgagtgttattgtccctctactggttactgaggatgagaaaactcttatcacttgcataaattgcttgacaaaggaggaactgatggctcagttaccctctttcctgcctgctttgtttgaagcttttggaaaccagagtgctgatgttcgcaagtatgaactgcctgttgctcaggttggttggtcaagcttagcatttcttagcctctggattggtggctgctattga

SEQ ID NO: 65825 - DNA, 168 bp, Glycine max
  Peptide Sequence Number=SeqID_182603
atgctggatccgtccctggctcagccccacaacatcgatagaaagacaaagagtagtgtggcaaaggggcgtaattcagcggcaacaatgagagaaagagagaggggcttagttgttgaagttgaagggaaagcttcttttctcctaagtggaagtaggggtgtgtag

SEQ ID NO: 65826 - DNA, 4206 bp, Glycine max
  Peptide Sequence Number=SeqID_182604
atgaactttgctggcaacattttatgtgtaaaccaagtttccatatcttctgcttttgtaccggactcttacattgagttttgtgaaacaggaggtggaagccattccctaactgaaaaggaaaataatcaagttgaggcttcacctactcagaacccccaagtttctgaagatctaaaggagaataatacatctaaagatgaaagaaggtcaactcctgaggtaaattcagtgaatgatttgtccaaaaagggtgctacagctgatgttggcaagatgcaaccaattcctgttactgaaaccgtcaaaacatcattgacttctcatattttcccttcctccactttgttgttgaaggctgtggaggagggatctccttcaacttctgggcgaggtccctcaaaaatcaaatctgttggagatgtagcacatggtgcttctaaagctacacctgagcgcaaaactagacgagcatctaataggagtgctggaaaggaatcttctagaagaggaagtcatgcaaaggacactacactggctagacagactgatagaggtgataaatcaaccaaagtttccctgagcccatctcctggttttcagatgatgcagtcaaacgaggtgcagcagtttgggcatattgactcaaatagtacaaagtcatttgctgttgtaaatacttcaacatctagccttccagatttgaacacttctgcttctccacctattttgtttcatcagcctttcacagatcagcagcaagtacaattacgtgcacagatcttcgtatatggagctttgattatgaatccacaatcatgcatttttttcacttattccctacaaaaaccttgcataacatcctcacccccatgtcaaggcacagtaccggatgaggcttatatgatatcagcttttggaggatcagatggtggaaggagcctttgggagaatgcttggcgtacctgcatggaaaggcaacatggtcaaaaatctcatcctgctaacccagaaacacctctgcaatcaagatctgttgctagaacctctgatttgccacataagcaaagtgctgctcaaggaaaaggtatctcttcgccacttggtcgaaccagcagcaaggctactccaccaattgtaaaccccttaatacctctttcatctccactttggagtctatcaactctaggtctaggtagtgattccctgcaatctagtgccattgcaagaggttctgtcgtggattatccacaggcaattactccattacatccttatcaaactactcctgtgaggaattttcttggacataacacaccttggatgtcccaaaccccccttcgagggccatggattgcttctccaactcctgtaactgacaatagcccccagatttctgcatcacctgcctcagatacaattaagctaggatcagtcaaaggatctctgcctccttcctctggcataaagaatgttacttctggtgtctctacttccagtacaggtttgcaaagtatctttacaggaactgcctctctgcttgatgcaaacaacgtgacagtatcacctgctcaacacaattcagatccaaagcccaaaaaaagaaaaaaagttgtggtctctgaggatctaggccagagggctttgcaatcactggctcctggtgttggtagccatacatctactcctgttgcagttgtggcccctgttgggaatgtgccaataactactattgaaaaatcagttttgtctgtatctcctcttgctgatcaatccaaaaatgatcggaatgttgagaagaggattatgtcagatgagtctcttatgaaagttaaagaggctagggtacatgcagaggaagcttctgctctctctgctgctgcagtgaatcatagcctagagttatggaatcagttggataaacataaaaattctgggttgatgcctgatattgaggctaaactagcttctgcagcagttgcagttgcagctgctgcaaccattgcaaaggcagcagctgcagctgccaatgttgcctcaaatgctgctcttcaagcaaaactaatggctgatgaagcattgctttcatctggttatgataattccagccaaagtaatcaaatttctctttctgaggggaccaataacttgggaaaagctacccctgcttccatcttgaaaggtgctaatggaatcaatagtcctggttctatcattgttgctgccaaggaagctgttaaaaggagagtggaagctgcttcagctgccaccaaaagagctgaaaatatggatgccattgtgagggctgctgagctggcagcagaagctgtatctcaagcaggaaaaattgtaactatgggtgatcctttgcctataagtcagttggtagaagctggcccagagggatgtttgaaagcaacccgagagtcttctcagcaagttggattattcaaagacattaacagagatatggtgaacaataatgtgagagatattcctgaaacttcttatacacataacagagacattttatctggtggcatttctgctcctattaagatcaatgaaaagaattcaagaggagcaaagggacacaaggttgtttctgatttagtcaagcctattgacgtggttcctggatctgagcctgaaattcaggctcctccttttactgttagtaatggatctgaaaatctggtggaaagtagcatcaaggagggcttactcgtagaggttttcaaagatgaggaagggttcaaagctgcctggttctcagccaatattttgactttgaaggataataaagcttatgtaggctacacttcacttgtagctgctgaaggtgcagggccattaaaagaatgggtttcacttgaatgtgatggagacaaaccccctagaatacgtgctgctcgtcctcttaatactttacaatatgaaggaacaagaaagagacgtagagctgctatgggagattatgcatggtctgttggggatagagttgatgcatggatacaagaaagctggcaggaaggagtcataacagagaagaataaaaaagatgaaacaacatttactgttcactttcctgctagtggagaaacgttggttgttagagcttggcatctccgtccatcccttatctggaaggatggaaaatggattgaatcttacaaagtggggacaaatgacagttctacccatgagggtgatacaccaaatgaaaaacgacctaaattgggtagtcatgtggtagatgtaaaagggaaagacaagatgtcaaaaggcattggtgctgtggagtcggcaaaacctgatgagatgacattacttaatttggctgaaaacgataaagtgtttaacattggtaagagcagcaagaatggaaataaatttgatgcacacagaatggtgaggactggacttcaaaaagaaggatcaaaagtaatttttggtgttcctaaacctgggaagaaaaggaaatttatggaagtaagcaagcattacgtggcccatgaaaacagtaagatcggtgatagaaatgattcagttaaacttacaaatttcttgatgcctccaagttccggacccagaggatggaaaaatagttccaaaaatgatgccaaagagaaacatggagccgactccaagcccaagacaagccatacagaaaggattaaggattcttcaaatctcttcaagaatgctgcttccaagagtgaaagtaaggtggagagagcaccccactctgcaagtgatggagcaacaggaccatttttgttttcatcgctggcaacttcggtggatgctcatcccactaaaagggcatcctcatcaagagcaagtaaagggaaacttgcgcctgcacgtgttaaatcaggtaaagttgagatggaaaaggctttaaacgacaatcccatgaaatcagcatccgacatggttgagccccggagatccaatcgcaggatccagccaacatcaagactattagaaggattgcagagctctttgatcatctcaaagattccttcggtttcacataatcgtaataccaagaaggtttgttcatcaaatgataacataacgcgatgctctactctactctacatgccaatcgctgcattcactagtaccttctcttctaactgctctagttcgcacatatttcataacctatctagaatctgcgttaattatgacttatga

SEQ ID NO: 65827 - DNA, 1136 bp, Glycine max
  Peptide Sequence Number=SeqID_182605
ttaaaccagatctgcacccggccgcgccagatccgatggaggaagcgctcgagctcgcgcgcgcaaaggacgcgaaggagcgcatggcgggcgtggagcgcctacacgaggttctggaagcttccagaaggagcctcagctccggcgaggtcacctcgctcgtcgattgctgcttggatctcttgaaggacagcagcttcaaggtctcgcagggcgcgctccaggcgctcgactccgccgccgtgcgcgccggcgaccacttcaagctccacttcaacgcgctcgtccccgccgtcgtcgaccgcctcggcgacgccaagcagcccgtccgcgacgccgcgaggcggctccttctcactctcatggaggtttcatctcctacaataattgttgaaagagcagggtcctttgcatggacaagcaaaagctggagagtcagagaggaatttgcgcgaacagtcacatctgcaattggtctattttcatctactgagcttccccttcaacgtgctattcttcctcctttgctgaatgatctgaatcctgctgttagggaaacagctattttgtgtattgagtcggagcctgcaaagctgacccggattgttattacgaccagcgtttttggatcgtgtgaggaagcttcagaatcacgaatcatgcgatacagagatcaattcaagcttaaaaacgatcatgctacgatttgtatcgctgaaatgtatacacaagctgggtcccaatttcgtgatgaacttcagcgccacaatctcccttcatctttggtgaaagctattaatgccaggctagagggaattcaaccaaaagttcactcttcagatggtatttctagtggttataatgctggggaaattaagcctgtgggtgttaatcccaagaaaagtagtccaaaggctaaaagttcatcaagggagacctctctttttggaggagaaggtgatgccactgagaaagtcatagaccccatcaaggtgtattcagagaaggagttaatcagagaaattgataagattgcttctactcttgtaccagaaaaggactggtcaattcgtattgctgccatgcaaagaattgaaagtcttgttttgggagggcaagaacatttgttattatag

SEQ ID NO: 65828 - DNA, 473 bp, Glycine max
  Peptide Sequence Number=SeqID_182606
atggcggaactgaaaaaatacttccaccgcttcggttacctctccctccccgaaacgacgccgaatttcacagacaccttcgattctcaattcgagtccgctctcgtccgtttccagaaacgcctcggcttgccagtcaccggaaaactcgactccgacacgatttccgcgattgtggcgccgaggtgcggcgtctccgacgccgcaccgcacggattacacgccacgcgtcgcttcgcttacttcaacgggaagccgcggtggacgcgcggaactccgatgactctcacgtatgctttttctccgtataacatgatcgaccgcgtgagcttgccggaaatccgagcggtgttcgagcgtgcgttcgcgcggtgggcgtcggtgattccggtgagtttccaggagacgccggagtacgatagggctgacatcacgatcgggttttacctcggggatcacggcgacggagaacc

SEQ ID NO: 65829 - DNA, 780 bp, Glycine max
  Peptide Sequence Number=SeqID_182607
atggaaaagatgagtgggggagctatggaagatgtagcaataattggaggattgataggagtccaatttatctacgcagggaatgctgtgttgatgagttattctatgtcactgggattcagctctcttaccattatcattttaacttctttggcaacattccttattctattccccattgctttttttgttgaaaggagtaactggcccaagcattgcagtttcagatttattgcacagctattttttctttcatttggaggactaatcttccagtatttattcctcaaaggaatcaatctaacttcgccagcaatgggaactgctatgccaaacattgccccaggtcttatcttcatcatcgcatggatttctgggttagagaaagtcaacttaagcaacaagtatagcaaagtaaaaatattgggaacattgctttgtgtgttgggcgctctcacaatgagcataatgcaaagcatttctgatcctgaaaccgtgaaaaatgccacagtcgaattaacaccgccactaccatctggtcttgcctttgacatacagaagatactcggttgcctctatctcgtggttgcagtcttcattttgtcaagcaacgttgtcctgcaggcttttgctcttggagattttcctgcacccatgtccttgggtgcaataacgtccttgattggggcgttcttgactgcaatttttcagtttctcgaagacaacgaaatgaattggctacttgtgaggtctggagacttggttggcttttttattctg

SEQ ID NO: 65830 - DNA, 315 bp, Glycine max
  Peptide Sequence Number=SeqID_182608
atgggtgttaaaggcataaaaactctaaatgcacaggcaggagctgtgagtggaatatgcctgagcttcaatgggtgggcattgaagaagaaagggccagtgtatgtctccatgtttaacccaattggtacagtttgctctgttgttttctcagcagttaccctagaagacactattagtattggaagtcttgcaggcatgtttctcatgttcactgggctctacttggttctttgggccaaaggaaaagaaggacacgcaggtggagatggcttagagtgtgagtgtgatgcagagacgcctcttttatcttaa

SEQ ID NO: 65831 - DNA, 1758 bp, Glycine max
  Peptide Sequence Number=SeqID_182609
atgcgaaggtttctctttctctataacgaagcacgaaaattccacaaacctcatattcatcttgcatttccatcgcccttagcatatagtaatatcggagacagtcatttcaatttggtggatgtttctgcccaaagtggaaccaatgctgagttggcgctatttgaagcctctcgtcgtggaattaaaccaaattcctttgctcttgttaacctacttggattagccagtaacctgaactgcccctcattcggacaacaactccatagttatgttatacgctctggctatttttcccatattcatgtctccacctctctcatcaaactttacgtcagaacgcactcttttagtgacgcacacaaactgtttgttgaaattgctgaaccgagcgtcgttacttggaacactttgatatccgggtacgtccacaccggccagtttcgaaacgctttgtcattcttcacgctcctagacaggtcccacgtttgtgccgacgcagtctcgttcacgtctgctttgtctgcctgttccctactgagtctcttcaaactgggaagctcaattcattgcaagatagttaaagtgggcatggctgatggcactgtagttgcaaattgcttgattgtcatgtatgggaaatgcggctctcttgaacgtgctgttcggatattctctcagaccattgagaaggatgttatttcttggaattcagtcatagcagcaagtgcaaacaacggagacattgaacttgcttataagtttttgcaccttatgcccaaccctgatactgtgtcctataatgggttgataaatggaattgctaagtttggaaatatggatgatgctgttcaggttttgtcaagcctgccaagtccgaattcgtcttcctggaattctgtaattacgggatttgtgaataggaatcgagctagggaagctttggatatattccgtaaaatgcacttgagaaatgtagagatggatgagttcacattttcaatcattttaactggaattgctggtttgtctgccttaacgtgggggatgttgattcattgctgcacaataaagtgcggtttagatgcttcagtatttgttgggagtgccctaattgacatgtactcaaaatgtgggcaggttaagaatgctgaatcaatcttcgtccatgcactgcctaacaagaatttggtgagctggaatgcaatgttatctggctatgctcgcaatggtgattctgtacgtgttatccacctctttcagtctctgaaaatggaaagagagataaagcctgatggtatcacgtttcttaaccttatatccgtatgttcccatagtgaaataccatttgaggttgctattcgttactttgaatctatgattgatgaatataagattgcaccatccattgagcattgttgttcaatgatacggctcatggggcagaaaggagagctgtggagagcagaaaggatgatacatgaacttggttttgagtcatgtggggtggtttggagggctttgctaggcgcttgtggaacacaggcagatctacaagtagcagagattgcagctgccaaggtgattgaattggagagggatgaagattatgtttatgtgatgatgtctaacatgtatgcatcttgtggaagatgggaagacgtaaatgcaattaggggattcatgagtaggaaaggaattaggaaagaagcgggttctagttggatagaaatagatagctctgtctcgtctctatga

SEQ ID NO: 65832 - DNA, 141 bp, Glycine max
  Peptide Sequence Number=SeqID_182610
atgttggtactgatttgtagacaggctttatactatttgaatgagtttgccgcacttcctcatgggactgccactgacttcccagcacaaattgccattactaaaaacagcaacaaccaagtcaccgactcgcggtcttag

SEQ ID NO: 65833 - DNA, 327 bp, Glycine max
  Peptide Sequence Number=SeqID_182611
atgcacagctttcgtcatggtcagcgttcctccatgcgttgcactcccgttttgctgcgtcaacgtatgaagaccctacggggctgttgtgtaagctccaacaacgttcatcggattgccggcaacatttgttttgagttgcttcatttcgggattgagccccgcgatccgtcgagaagtgcaagttttgcaaccagtctccttagttcagccagtggcgtatgcgcgtttacaggaggagaaactcctcgatgcgcgacggccgcaggcactgcgaaccccaacaaccaccattacacctacaaactcacgaccatctacaggtag

SEQ ID NO: 65834 - DNA, 183 bp, Glycine max
  Peptide Sequence Number=SeqID_182612
atggagagaatgatggggaccagtggcatggttgaggagactttggaaaactcacagaaaggttttgtttgtgttgtgggaatgaagaagagtaagaacaagggaagatgggaacaagaacagcctggaatttgtgttgttgacaaaaggggtaaatacttatccttgatcctaaaattatga

SEQ ID NO: 65835 - DNA, 892 bp, Glycine max
  Peptide Sequence Number=SeqID_182613
atgctcagagttggttcgatgagatacttttacctctatcttgtggttcttacttggtttttgtccatccccagtactcatgaactacaacttgctcagacccaagttctgttacagttaagaaagtatctggagtaccctacctctctgcaaatgtgggaaaattacaatgtagacctttgtagccttcctccatctgcacatgtgagcctcaagtgtgagggtaattcagtaactgagcttaaaattatgggagatagagctgtgaaggttgacaagttcaatggacatgcagttcccaatcagacactgtcactgagcttctctattgattcttttgtcaccacattgacaaggctaacaaacttaagggtccttagattggtgtccttggggatttgggggccacttcctgataaaattcataggctttctttgcttgaagttttggatatgagcttaaacttcttatatggttcagtgccaccaaaaatgtctgcaatggtcaagcttcatactctgacactagatggcaattatttcaacagcacaatgcctgattggtttgattctttgtctaatctaagtgtcttgagtttgaagagtaaccacttaaagggttcattcccttctacactatgcaaaattaggagtcttgttgatatttccttgtcccacaatgagttgtctggtggattgcctgatctcgctgctctctctggcctacatgtacttgatttaagggaaaatcatttagattctgaactgccactcatgcctaaagcagtggtcacaattctgcttagcaaaaattctttttcgggtgagataccaaatcactttagtgaattgagtcatcttcagcatctagatctttcatcaaatcatctca

SEQ ID NO: 65836 - DNA, 903 bp, Glycine max
  Peptide Sequence Number=SeqID_182614
atggtggacttccttcttgcttggccaatacatcggcggcgagggacttattgtaaagtatcaagctcgggaaggaaaaacttctggaaatggaaaatagctgcagcagttgccatgattattgtaattgttcttgtactttctgcttttggagttttcttttatagaaaatatcgttcaaggaagatctataggcatcagatgttgtctaaggctgttcaagataactcaataacaggagtttcttctgaagtccttgccagtgctagattcatttctcaagcagcgaagctagggacacaagctactccaatacgtagacaattttcaattgaagagttgaaagaagtcacaagaaactttgatttgtcaacttatattggtgaaggctccttaggaaagctgtacaaaggtaaactagagaatggaacctatgtggtgataagacgtgtggctctgtcaaagaaatgctcaatacaaaatcttaaagctgggttggatttactctcaaagcttcaccatccaaatttggttagcctttttggtcattgtattgatggtgatggacaagatgattccagtggcctcaaacttcatcttgtatatgagtatgtgccgaatgggaaatatggtacccatttgtcagaattttcatcagacaaggcactgaagtggtctgatagattagcaattttaatcggagttgccaaagctgtgcactttttacataccggagttataccgggttgttttagaaaccaattaaagacaaacaatattttacttgatgagcatcacattcccaaactaagtgactatggtatgtccatcattgctgaggagatcgaataccttgaggcaaagggagaaaatctaaaatcatggtatgtatactggtggtag

SEQ ID NO: 65837 - DNA, 867 bp, Glycine max
  Peptide Sequence Number=SeqID_182615
atggagcggcacaaatgcaagctctgctcccgaacattctccaatggcagagccctcggtggccacatgaaggctcacttagccaccctccctcttccccccaagccaccactttctccctctgctgcttccttctcttctaattcctcttcagaagaagccacacacgatgaaaagtctctgatttatgggttaagagagaatcccaagaaatgcttccgactcgcagatcccgagtttaacatggcctctgtggttcaagacagggaaagcgagacggagtcaaagaacccaactcgccgacgatccgagcggacccgaagaaccgtgaattctgaactaaaaaaggccaaactcagtttcatggagtcgccagagcccgtgagctctgtctccgacacttctcccgaggaagatgtcgccatgtgtctcatgatgttgtcgagagaccgatggagtaaaaacaacaacaacaacatcatcatcattaacaacgttgttagtaatgatgatgttgtcgaagaagaagaagagggtgggagatcagtagagatcaagttgaggagagttcgcgggaagcacaagtgtcagagctgcgggaagacgtttcgatcttcacgcgcattgggcggtcacagaagcatttgcgaaggttcaggtaacgatagtaaaaccttccaatgccctttttgttccaaggtgtttgggtctggtcaagcactcggtggccacaagagatctcacctcatgccttcttcgtcttcgaccgctaacaatgattcttttagattgaaagagagcttcatagatctcaacttgccagctccggccgaagatgacgaccttagtgttgtttctgatgcttaa

SEQ ID NO: 65838 - DNA, 375 bp, Glycine max
  Peptide Sequence Number=SeqID_182616
atggctctccaggtttcaaaaacatcggcttcggcctcaagatcttactttctattttttcggtccaaagggcctccaggttcactacagagctattgctatacccacttctgttttataataagtacagtagcgaagcaacatagaaagataggagttgcgaggtggccaacctattactttcaaaagaaaacttgtggaagaggaatattattgttgatgaggatgatcctgaattggaatcctcaaagcatgggattttcaaatgtggctttgctcatagagtgtggaaagaatgttacaattggattcaagttcaatccgctttgcccatttgtccgatgtgtagatcctagacatgcccaaaatgtttaa

SEQ ID NO: 65839 - DNA, 204 bp, Glycine max
  Peptide Sequence Number=SeqID_182617
atggcgacatcagggttaggtgtagcggcgtgcaatggtgcaagtgttcggaggcagaagggtcacgtgggatcaaatttggcggtggaggcggtgcgcaatgtcgaaggagggtggcgggaatgccatggtaggaagaattcaaccctagctgtggtgaaggtctcaaaaggtgtcatgggtaccaccacatcatcaatgtag

SEQ ID NO: 65840 - DNA, 751 bp, Glycine max
  Peptide Sequence Number=SeqID_182618
atggcttcgaatcctccattccccatggaggatcagacggatgaggatttctttgataaacttgttgaggatgatatggagcctgttaagtctggccatgatgaagggtatgattccgatgaggctaaagcatttgcaaatctgggaatcaatgatgttgatgctgctgcatttgagaattctaatgctgctgagagtggtgttgaagtcaaaggggaattcagtaatgtggaatccgatgtaggacttgaacaggaggggaatttgatgcccgtggtgagttcagttgggtttgatggtaaggtggatccccgtgaggatgggattgggatgggatccgaagtcacgtccgcttcagcttcagctgtaggcacgagcgatacagctggtagttctgggattaaggaggtgggttggaattcttttcatgctgatttgaatggaggcggcggtttgggatcatattctgactttttcagtgacttgggagatcagtctggggattttacggggaatgtgtatgataatttaagtagtgaggtgaagcctgatagtgcagttcaaaatgatggcttaaatgcctcgggtaattatgtgcaatatcacgagggtcaaggttatgatggatctttagaaaaccgctcaaactggcaaggtgatggattaaatgcttcagtttatcatgtacaatatcaagaagatcaagcttatgttgcatcttcagaagaacacacaaatggacaggatctga

SEQ ID NO: 65841 - DNA, 1077 bp, Glycine max
  Peptide Sequence Number=SeqID_182619
atggcttcttcttcactcttggtgtcactgcaagtagcgcttgtggttttcacttgcatattccatgcagcaacagtgacatgtgaccgtagcttcaaaatattctcttctatgaacaactcctccaagagtagccaccattggattggacccatcggccaccgcaaaatcaccgttgatgttaacggtggcgggcactaccggtccgtccaagacgccgtcaatgccgtccccgacaacaacagaaagaatgtccttgttcaaatcaacgccgggtgctacaaagaaaaggtagtggtgcccgtgacgaagccgtacataacatttcagggcgcgggtaaggaagtgacggtgatagaatggcatgatcgagccagtgaccccggtcccagcggacagcaattgcgtacttacagaaccgcttctgttacagtttttgccacctatttttctgccagaaacatcagcttcaagaacacagcacctgcaccaatgccggggatgcagggaaggcaagcggtggcgtttcgaatatccggcgacaaagcatacttctccggctgcggtttctacggtgcacaagacaccctgtgcgacgatgcaggcagacattacttcaaggaatgctacattgagggatcaatcgactttatttttgggaatggcaggtcaatgtacaaggattgcgagctgcactcaatagcgacgaggtttggttccatagcggcccacgataggaaggaggcagaggagaagacagggttcgcattcgtaggatgcaaggtgacaggaacgggtccgttatatgtggggcgagcaatgggacagtattccagaattgtttactcttacacatatttcgatgatatcgttgcacatggcggttgggatgattgggaccatgcagacaataagaacaagactgtgttcttcggagtgtacaagtgctggggaccaggagcagaggctgtacgtggagtctcatgggcccgagacttaaatttcgaatctgctcatccatttatcaggaagagtttcgtcaatgggagacactggatcgcgccatctgatgcttaa

SEQ ID NO: 65842 - DNA, 4539 bp, Glycine max
  Peptide Sequence Number=SeqID_182620
atggcttcgaatcctccatttcacatggaggatcagacggatgaggatttctttaataaacttgttgaggatgatatggagcctcataagtctggccatgatgaaggggatgattccgatgaggctaaagcatttgcaaatctgggaatcaatgatgtcgatgctgctgcatttgataattctgatgctgctgtgagtggtgttgaagtcaaagggggattgggtacagtggaatccgatgcaggatttgaacaagaggggaattcgttgccctcctctagttcagctgggtttgatagtaaggtgggtcccggtgaggatgggattggggtgggatcagaagtcaggtccgcttcagctgtaggcacgagcaataaagtcagtagttctgaggttaaggaggtgggttggaattcttttcatgctgatttgaatggaggcggcgggtttggatcatattctgactttttcagtgaattgggagatcagtctggggattttacggggaatgtgtacgataatttaagtagtgaggtgaagcaaggtaatgaagttcaaaatgatggctcaaatgccttaggtaattatgtgcaatatcacgagggtcaaggttatgatggatctttagaaagccacacaaacaggcaaggtgatgggttaaatgcttcagttaatcatgtacagtatcaagaaggtgaaacttatgttgcatcttcagaagaacacacaaatggacaggatctgagtagtagtcagtattgggaggatctttatcctggctggaagtatgactacaaaaccgggcaatggtatcaaatagatggctatagagcaacagccactactcagcaaagctctgaagccaatatagctgtggattcgagtgccgcttctgatgggaaaacagagatctcttacatgcagcaaactgctcaatctgttgcaggaactttagctgaaactggcactactaaaaatgtgtctagctggagtcaggtttcagaagggaatcatgggtatccagagcatatggtttttgatcctcagtatcctggttggtattatgacacaattgcccaagaatggcgttcattggaaacttataattcaaccatccagtcttctggtcatggacatgaaaatgggaatgcttctgccaatacattctcacccaatgatcatagtttgtatagtgaatacagccaagctgataattatggacaacgggacgttgataatcaggctgtagatggcagctggagtggtttgtatggcactaaccataagcagggttttgagatgtacacaactgggtcagccactatacgaggggataatataacttctggtggcaaccaacagattaatcattcttatggttcaagtatttctgtgaacgaacatcaacaaaatacttctagttcttttggatccgttgcattgtacaatagagtaaaccatgatcgtggttttgctaatggaacttttaaaccacaaagctttggccctactggggacactgttcaacagtttaattattcaaccacaaagtttagtgaacaaaaagttttttcaaatgattttactgaaaatgaaaaacccctcagttattctccacaatcaattcagggtgggcatcagtattcacatgcccctcatgttgggagatcatcagctggacgtccttctcatgctttggtaacttttggatttgggggaaaactcatcataatgaaagatcctaatcttttgagctcatcatacggaagccaggattctgtacaaggttctgtttctgtgttgaacttgattgaagttgtcacgggaaatatggattctttgagcatcagacataacaccagtaactatttccatgctctgagccagcaatcattcccaggtccgttggttggcgggagtgttggaagtaaggaactgtacaaatggttagatgagaggattgcacactgcgaatcacctgacatggattataagaaaggtgaaaggttgagactccttctttccttgcttaaaatcggttgtcaacattatggaaagctacgttctccatttggtacggacaccatactaaaagaaagtgatactcctgagtcagcagttgcaaaactttttgcatctgccaagatgagtggcactcaatatgggatgccaagccactgcttgcaaaatttgccttctgaaggacaaatgagggcaatggctcttgaagttcaaaatcttcttgtctctggcaaaaagaaggaggctttacagtgtgcacaagaaggacaattgtggggacctgcacttgttcttgcttcacaacttggcgaacagttctatgttgatacagtgaagcaaatggcacttcgccagctgattgcagggtcacctttgcgcacattatgccttctaattgctgggcaacctgctgaagttttctctactgatacctcaattagtgagcatcctggtgcttctaatatggctcagcagtcttcacaggttggatccaatggcatgcttgatgattgggaggagaatctggctgtaataactgcaaacagaaccaaagatgatgaacttgtaattattcaccttggtgattgcttgtggaaggaaagaagtgagattactgccgcacacatctgctatttagttgctgaagcaaatttcgagtcatactcagatagcgcaagactctgtctaattggagcagatcactggaaatgtcctcgaacttatgctagtccagaggctatccagaggaccgagttatatgaatattcaaaggtggttggaaactctcagtttactttgcatccatttcagccgtataagcttatatatgcatttttgctagctgaagtggggaaggtttcagactcactgaagtactgccaagcactactgaaatccttgaaaactggccgtgctccagaagtagagtcatggaagcagttagcactatctcttgaggagaggattagaattcaccaacagggtggatatgctgcaaatttagctcctgcaaaattagttggcaaattgctcaacttttttgatagcactgcacatcgagttgttggtggtttaccaccgcctgctccttcgtcatcagcaggaactgttcatggaagtgaaaaacaataccaaaatatggcacctagagtatcctctagccaatcaacaatgtcgttggctccatctgcttcgatggaacccataagtgagtggacagctgacaataatagaatgggaaagcctaataggagtgtttctgagccagattttggtagaaccccaagacaggaaacgacgtcacctgatgcacaagaaaaaccccaggcatcagggggtacatctcgcttttcccgatttggttttggctcacaacttttgcaaaagacagtagggctagtcttgaaacctcgctctggtcgacaggctaaattgggtgacaaaaataagttctattatgatgagaagctgaagagatgggtggaggaaggtgctgaagttccagctgaagaagctgctgctctgacaccgcctccaacaactgctgctttccagaatggttcaactgaatacaacttgagatctgcattgaaaactgaaagttcacctcctattgagggctctagcataagaacttctagccttgaacttagtcccgggatgccgctgataccacccagcgcaaatcaattctcagcccggggtcgtttgggtgttcgatcaagtgtaaccttccccttccctttccctttccctttccatttccctttcacgttctctggactgcactccgaccagcttccccaccttcctattgttcctcagtcctcacctccctctccaggttcaccggtgacccgggctctagctccaaaaggtcatcatggcggctgtgccaccatgctccaccacccaaacgtgagatccgaagcaaaagccaagcctcagatgccaatccaaagcagagacaaaaacgtggatccagagcggagatgcgaacaaagacgcagatctgaagcagagatgtatgttgacaccttcaaccaaggtggtggaacctctgcaaacttgtttcggtccccttctgttccatccgtgaaaccggctgttgctgccaatgcgaagtttttcattccttctgctgcaccatcatcaaatgagcagacaatggaggctatagtggaaagcaagcaagaagatagtgcgacaaatgaagatccttcaacatctgccacaaatgagtggtggtcataccaatcccctaaacaagtatcatcaacaaccatacaaaggtttccaagtttgggtaacatctcaaaccagagagcaacagaaggaagtaactctcatttgcctcattcacgtcgaacatcttcatggagtgggagttttaatgattcatttacccctccaaaaatgggtatgccctcgtcaagatttatgcctgatgaatctttaatgcgtacacatgtgaaaagtagcagctatgcagaagatcttcaagaggttgaactttga

SEQ ID NO: 65843 - DNA, 219 bp, Glycine max
  Peptide Sequence Number=SeqID_182621
atggagcagcaacaacaacgaatagtagcgggtgaagggtcaaagagaaagacgaagctcaacgggagaaagaagaagatgaacgagaggaagaaaaagcttgaacggttgcgggagaaagttgaacggttgcattgtgggaataatgactcccctttcaccccggttgttgggtgccccagcaaaaatgcagggtcccccaagcaacaccctagataa

SEQ ID NO: 65844 - DNA, 2967 bp, Glycine max
  Peptide Sequence Number=SeqID_182622
atgtacacaactgggtctgccacaacacgaggggatagtataacttctggtggcaaccaacagattaatcattcttatggttcaagtatttctgtgaacgaacatcaacaaaatacttctagttcttttggatccgttgcattgtacaatagagtaaaccatgatcgtggtttggctaatggaacttttgaaccacaaagctttggccctactggggacactgttcaacagtttaattattcaaccacaaagtttagtgaacaaaaagttttttcaaatgattttactgaaaatcaaaaaccctttagttattctccacaatcaattcagggtggacatcagtattcacatgcccctcatgttgggagatcatcagctggacgtccttctcatgctttggtaacttttggatttgggggaaaactcatcataatgaaagatcctaatcttttgagctcatcatatggaagccagaattctgtacaaggttctgtttctgtgttgaacttgattgaagttgtcatgggaaatatggattctttgagcatcggagataacaccagtaattatttccatgctctgagccagcaatcattcccaggtccgttggttggcgggagtgttggaagtaaggaactgtacaaatggttagatgagaggattgcacactgcgaatcacctgacatggattataagaaaggtgaaaggttgagactccttctttccttgcttaaaatcggttgtcaacattatggaaagctacgttctccatttggcacggacaccatactaaaagaatatgatactcctgaatcagcagttgcaaaactttttgcatctgccaagacgagtggcactcaatatgggatgccaagccactgcttgcaaaatttgccttctgaaggacaaattagggcaatggctcttgaggttcaaaatcttcttgtctctggcaaaaaaaaggaggctttacagtgtgcacaagaaggacaattgtggggacctgcacttgttcttgcttcacaacttggtgaacagttctatgttgatacagtgaagcaaatggcacttcgccagctagttgcaggatcacctttgcgcacattatgccttctaattgctgggcaacaagctgaaatattctctactgatacctcaattagtgggcatcctggtgcttctgatatgtctcagcagtctccacaggttggatccgatggtatgcttgatgattgggaggagaatctggctgtaataactgcaaacagaaccaaaagtgatgaacttgtaattattcacctaggtgattgcttgtggaaggaaagaagtgagattactgccgcacacatctgctatttagttgctgaagcaaacttcgagtcatactcagatagtgcaagactctgtttaattggagcagatcactggaaatgtcctcgaacttatgctagtccagaggctatccagaggaccgagttatatgaatattcaaaggtggttggaaactctcagtttactttgcatccatttcagccatataagcttatatatgcatttatgctagctgaagtggggaaggttccagactcattgaagtactgccaagcactactgaaatccttgaaaactggccgtgctccagaagtagaatcgtggaagcaattagcactatctcttgaggagaggattagaattcaccaacagggtggatatgctgcaaatttagctcctgcaaaattagttggcaaattgctcaacttttttgatagtactgcacatcgagttgttggtggtttaccaccacctgctcctttgccatcacaaggaactattcatggaagtgaacaacaataccaaaatatggcacccagagtatcctctagccaatcaacaatgtcattggctccatctgcttcgatggaaccaataagtgagtggacagctgacaataatagaatggcaaagcctaatagaagtgtttctgagccagatattggtagaatcccaagacaggaaacaacatcacctgatgcacaaggaaaagcacaggcatcagggggtacatctcgcttttcccgatttggttttggctcacaacttttgcaaaagaccgtagggctagtcttgaaacctcgctctggtcgacaggctaaattgggtgagaaaaacaagttctattatgatgagaagctgaagagatgggtggaggaaggtgctgaagttccagctgaagaagcttctgctctgccaccgcctccaacaactgctgctttccagaatggttcaactgaatacaactcgagatttgcattgaagactgaaagttcacctcctattgagggctctaacataagaactgctagccctgaacttagtccagggatgccaccaataccacccagcgcaaatcaattcttggcccggggtcggttgggtgttaggtcaaggtatgttgacaccttcaaccaaggtggtggaacctctgcaaacttgtttcagtccccttctgttccttctgtgaaaccggctcttgctgccaatgcgaagttttttgttcctactcctgcaccatcgtcaaatgagcaggcaatggatgctatagcagaaggcaagcaagaagacagtgcaacaaatgaatatccttcaacatctgccacaaatgactggtcataccgatccccaaaacatgtatcatcaacagccatacaaaggtttccaagtatgggtaacatctcaaagcagggagcaacagaaggaagtaactctcatttacctcattcacgccgaacagcttcatggagtgggagttttaatgattcatttacccctcaaaaaatgggcaatatgaagcctttaggggaagctttgggcatgcccctgtcaagatattcacctgatgaatcttcaatgcataaacctgtcaaaagtagcagttatggagaagatcttcacgaggttgaactttga

SEQ ID NO: 65845 - DNA, 807 bp, Glycine max
  Peptide Sequence Number=SeqID_182623
atggcctcgatcgcacgactgaggtccgcagttccgccgctgaaggccttcctccgccctgagcgcgggttcggatcggcggccgcggtccagtgccactactacgacgacgacgacgacgacgtggaagaggagtgcgcgccacgtggcatgctggacgcgcagggttgcacgcccgagcgcggagtgcagtgggtgatgataggagagcccggcgccaagaggcacctcttcgctcagagactctcgaagcttctagaagttcctcacatttccatggccacgctcctcagccaggacctcaaccctcgctcctccctctaccagcagatagcacattccttggatcatggaaaacttgtccctgaggatattatttttgggctactatcgaagagattggaggatggatactcgagaggcgaaactgggttcattcttgatggattccctcgaacaaggattcaagctgagattcttgaccacattgctcatgttgatctggtggtgaatttcaaatgttcagaagaggagttaatgaaaaagaatctaggaactcgaaaatttaatgcttaccaagaatatattcttatgactagctccaggtcaacaaaacaattgcaggatgatcatgaccaaagtcatgcagaggagtgcaagctgttggaagattactacaggaagcagaagaagcttcttaactttgaagtagcaggtgggcatggagaaacctggaagggacttctggcagcactacatcttcagcatattaatgctcttagttcttcacagaagttaactgcgtga

SEQ ID NO: 65846 - DNA, 378 bp, Glycine max
  Peptide Sequence Number=SeqID_182624
atgaagattttttttgggttttgcataactggcggtggtaacggaaaatggggttgcacgtggtggctgtggccatgttccacttgcaagctaccagacagtgttggccctgtggtggcttggaccatttgtcctatagcgttggagctcttacttagtctgtgggtgttccaagaagaagccctttactcagcgaggttgttcttcttccgattgcgtcagattgtgttcaacaggaatattaatggtacaaggttggagcgagctttccgtttgatgttgcaaacacttacttccaccaccactgcttcaacaacacagcaagaagaacaactcaaccaggacaccttcaatactcctttaactctcacactatag

SEQ ID NO: 65847 - DNA, 324 bp, Glycine max
  Peptide Sequence Number=SeqID_182625
atggcgggagctactccgtcctgtgttttctgtgcgattgccgccaaatccacctctagcaatactcttctttactccgacgataaggttgttgcttttcaggacattaatccatccgctttcaggcattacttggttgttcctgtggcgcacattcctactgttaaatatcttcagaggaaaactgacgactattctttggtgagtcacatgttagaggtggggaagacgttattaaatagagatgcacctcagtcccagcagtacagaattactggcaccacctatatggacgcgcttttgtatgctgcaatacaatattga

SEQ ID NO: 65848 - DNA, 860 bp, Glycine max
  Peptide Sequence Number=SeqID_182626
atgggtcgcaatgcagcagcagcggcagcttctctgagatggtcaacgacgttgctcttgttgttattgggcctagtagtagggaccaaagcgacgtcgtacaggaggaacgcgtacgcgacgatgatgtacgttgggacgcccagggactacgaattctacgttgccgttcgcgtccttctaaaatctctctccaaacttaacgtcgaagccgatctcgtcgtcattgcttccgtcgacgtccctctccgtgaagaggaagatggtgcaaaagtggtaagggtggaaaacatggacaacccttacaagcgtcaagataattttgacaagagatttaaattatctttgaacaaactctatgcgtggagcttagtggactatgacagggttgtcatgctggatgctgacaatctcttccttcaaaacacagatgagttatttcaatgtggacaattctgtgcggtctttatcaatccctgcgtcttccataccggcctcttcgtcttgcagccatcaatggtcgtgttcaaggacatggttcgtgaattacagaatgggagagaaaatccagatggtgcagaccagggttttatagctagctacttccccgagttgcttgataagccaatgtttcatccaccttcaaatggcaccaaggttgatggaacatataggcttcctttaggttatcaaatggatgcttcttactactatcttaaacttcgctggagcgtaccctgtggaccaaatagtgtgatcacattcccaggggcaccatggttgaagccatggtattggtggtcatggcctgttctgccattaggcctccagtggcatgaacaacgccgtcaaactttagg

SEQ ID NO: 65849 - DNA, 1167 bp, Glycine max
  Peptide Sequence Number=SeqID_182627
atggatgaaccgaacgaagcacaagaccaccgagaactctacgcactcttgaacttgtctccagaagcttccgatgaagaaattcgcagagcgtatcgtcaatgggcgcaagtctatcatcccgataaataccaagctcctcacatgaaggatattgctacggagaactttcagcgaatatgcgaagcgttgacctctggtttggaacttggtccaaagcttaatggagctgaagagatcaaggcagagctcgagagattgaagaggatgaaggaacgggagaaagtggcggcgcattttcaatcctccggtacaattctggccaatatgtctttgccacgctatctaaatggaaatggcctactcagaggaatggctatgacaagtgaaatccagtctcagttatcaaagcacaatgctgttacgattggaggtaatttagcagtgaatggagatgaaggtggtggagctgctactgctgtgtttaggcatcaactttcagaagtttcgtcagtagaggttgtggcctcggctggtctgcgtgcactaatcggggtgcaaacaactcgcaatctatcatcacactcagctgcaacaatgggaatagcaatgtctctgaaagatggttcattgaatctttcaaatttatggacccgccaactgtcagaaacagcaagtggacataaactttttattaaaccttattaccttagaaggaataagcagaaggctctggaggaggaggagaaaacttctgctcaggttaaggaagcaagggctgcagcagagaaagctcagaaattacaacaaactgtggctaataggaaaagaaacaagcaattagaaacaggtggactggttattatgagagcactttatggaaatcagagaattgtgaacaacttaaagtcatcaagtgaaacaagttttgaatcaacgtcagaagtcattgatgttacaatacctttgaattttctagttaatgattctggccaactcaagcttcatgaaggtgtaaaaaaatcaggcatcatgggtttctgtgatccatatcctggaagtcctaaagagttgtatgtagagtacgtttatgctggcaatcaatacaaggtttgggctggggattatgaagaattacagatccctcagggcagccacaggatataa

SEQ ID NO: 65850 - DNA, 594 bp, Glycine max
  Peptide Sequence Number=SeqID_182628
atggcgcaaggattttcgagtagacgtgcttccaaagatatgatgtcttgtaaggaattcaatttcacggagtatgatgaagtgaagaaatgctatcctcatggataccacggagttgatagatacggcagacccgtgtatattgagagaattgggatggtagaccttaacaatctggggcaagtaaccacatttgaaaggtttatcaaacatcatgtgtcagagcaagaaaaaactctcaaagtaagattccctgcatgttcactagctgctaaaaggcacatagcatccactacaagtatcttggatgtcaacggagtaggaatgtctaatttctcaaagcccgcaaggtacctctttatggaaattcagaaaatcgatagttgttactatcctgagactctaaatcagctctttattattaatgccggatctgggtttaggatgctgtggaaagcagtaaaggcattcctagatgtacgcacaatggcaaaaattcatgtgttaggttctaattatctcagcgtcctacttgaggctattgatccaaggttagaaactgtcactttttggaaggaaaatgggtttagttag

SEQ ID NO: 65851 - DNA, 846 bp, Glycine max
  Peptide Sequence Number=SeqID_182629
atgtctcagctttttcttaagaacttcaccttcggctgcgcccacactgcgctcgccgaacccaccggcgtcgcaggtttcggtcggggattactgtccctccctgcgcaacttgcgaccttatctccgaacctcggtaaccgtttctcttattgcttggtctctcactctttcgacaaagaacgagttcgcaaaccgagtccactcattctcggccactacgatgattattccagcgagcgtgttgagtttgtttacacctccatgcttcggaatccgaagcattcttatttctactgcgtcggactcaccggaatctctgtagggaagaggactattctggccccggaaatgctacggagggtggaccgcagaggggacggaggcgtggttgttgacagcggaaccactttcacgatgctgccggcgagtttgtataactcggttgttgctgagttcgaccggcgagtcgggcgagttcacaagcgcgcgagtgaggtggaggaaaaaactggcctcgggccgtgttattttttggaggggttggtggaggtgcccacggtgacgtggcattttctggggaataattccaatgtgatgctgcctaggatgaattatttttacgagttcttggacggtgaggatgaggctaggaggaaggtgggctgtctgatgctaatgaacggtggtgatgacactgaactgagcggtgggcccggggccatacttgggaactatcaacagcaaggatttgaggtcgtgtatgacttggaaaaccagcgcgtgggttttgctaagaggcaatgcgcgtcgctttgggatagtctcaaccgtgacaaaaactag

SEQ ID NO: 65852 - DNA, 360 bp, Glycine max
  Peptide Sequence Number=SeqID_182630
gttgttaatttgagagaagagattaatggtaaatgcgaagatggtgatgtggacatagaagattcctcgatgcccaaaatggttgacatgcaaaacaaagatggcaatattatgaatctacttgaggaagcagcatgtccgggatcagactcggcatgttcttgtagattagtattgcaaaaaattgattgccttgaagctagtcttggagacatcaagaataaaatcaagacactggaagatgcacttcaggacaccaaaatgattaaagttcagcagactctcctatatcaatatcctgaaatggtggttgtacaagactctaccaaagaattgttgtcgtacaaaaagaagaaataa

SEQ ID NO: 65853 - DNA, 156 bp, Glycine max
  Peptide Sequence Number=SeqID_182631
gatgagaggaggcatgcccggtcaatgctgggacctgctgagcacaacgatgaagaaacagtggttacaaagaccagtgacaccgaagaggacatagtcgagatggattatgctcaaccccatcggaaaccacccattcacaatgaaaagccttaa

SEQ ID NO: 65854 - DNA, 531 bp, Glycine max
  Peptide Sequence Number=SeqID_182632
atggcaatgcacaagaggagttcaggttcagcattgggcccaggaggcttggacctaactcaagccttgttcaagtccatcatgaacgctgcaccttcttctcccaccaaggaccacaacaaaatctccgttgttggggcaggcaacgtgggaatggccatagcccaaaccatctcactcaggatctcaccgacgacgatgagattcctgacaaacaccacggtgagatgctggacctccagcacgccgcggccttcctccccggccatctccacactctttgagaaaatcatacctcctttggtccgttactccccagacaccattcttctcatcgtttcaaatcccgtggacgtgctcacttacgtggcatggaagctttcggggttcccttcaaaccacgtcattggctatggcactaacttggactcttcccgttttcgtttcctcattgctgatcatcttgatgtcaacgctcaagatgtccaggcttttatagtgggggaacatggtgacagctcagtggtctag

SEQ ID NO: 65855 - DNA, 558 bp, Glycine max
  Peptide Sequence Number=SeqID_182633
atgcgagtgaaagagatgcacccgctgtgctgtatctccctcgagagtccaggaatcggcaaacattcgccggagcgggagccggcggcgcttttccgaaccagtagcctcccggcggcgggatctcatggcaatgctgctcagggatcggagaccaccgtcgccggcgttctctacaaatggaccaactacggcaaaggctggagatcccgctggttcctcttgcggaatggcgttctctcctacgccaagatccgctgtccggagaatctcaacctcctcattccttccgacgacgttcgcctcatcggagaaatttccaccaaccgtctcgcacgagtggacggcgccgccactgtcacacgacggaagcaccgcaaaacttcttcttcttccggcgttgtccatctcaagagtgggtcacatcaaccggtggccgagggggggtacggtaggctacgtctagacgtaggcggtcacaatcacatcattgctgcgcctgtgttgccattggtcgttggtggatgcatttcttcgtttcagctctactcttattaa

SEQ ID NO: 65856 - DNA, 1761 bp, Glycine max
  Peptide Sequence Number=SeqID_182634
atgagcaacctccctacaactcaagggaaagccatccctgatgcctccgactacaagggccgccccgccgagcgctctaaaaccggtggttggaccgcttccgccatgatattaggaggagaagtgatggagaggttgacaacactaggcatcgcggtgaatttggtaacatatttgactgggaccatgcatttgggtaatgctgcctctgccaacgttgtaaccaacttcttgggaacctccttcatgctctgtctgctcggtggcttcctcgccgatactttcctcggaagataccgcaccatcgccatcttcgctgccgttcaagcaactggtgtgacaatcttgacaatatcaaccataattccgagccttcaccctccaaagtgcaacggagacaccgtgccaccttgcgtgagagcaaatgagaaacaattaacggtgctttatttggcgctttatgtaacggcgctcggcaccggaggtttgaaatcgagtgtgtccgggttcggttcggatcagttcgatgattcggacgacgacgagaagaagcagatgataaagttcttcaactggttctacttcttcgtgagcatagggtctctggccgcaaccacggttcttgtgtacgtacaagacaacataggacgaggttggggttatggtatctgcgcgggtgcgatcgtggtggcacttctcgtgttcttgtcgggtacgaggaagtaccgtttcaagaaacttgtgggaagtccattaactcagtttgcggaagtgttcgtggctgctctgagaaagaggaacatggaattgccctctgattcatcattgctctttaatgactacgaccccaagaagcagactcttcctcatagcaagcagttccgtttcttggacaaagctgcaatcatggattcatcagaatgcggaggtggaatgaagaggaaatggtatctttgcaccctaacagacgtggaagaagtgaaaatgattctaagaatgctacccatatgggccaccaccatcatgttttggacaatccacgctcaaatgaccacattctcggtgtcacaagcgacaaccatggaccgtcacataggaaaaacatttcaaatgcccgcggcatcaatgaccgttttcttaattggaacaattctcctaactgtccccttctacgaccgtttcattgttcccgtggcaaagaaagtgctcaagaatccacatggtttcacccctttgcaacgcattggagtcggtttagtactctcagtggtttccatggtggtaggagcactgatagaaataaagagactaagatatgcccaatcacatggtttggtagataagccagaagcaaagatccctatgaccgtgttttggttgataccacagaacttgtttgtgggggcaggggaggcatttatgtacatggggcagttggactttttccttagagagtgtcccaaagggatgaaaacaatgagcacgggattgttcttgagcacactctctttggggtttttctttagcaccttgttagtgtctatagtgaacaaaatgacagcacatggtaggccatggctcgcagataatcttaaccaagggaggctctatgacttttactggctcttggctatattgagtgctataaatgtggtcttatacttggtttgtgctaagtggtacgtctacaaggagaagaggcttgctgaagagtgcattgaattggaagaagcagatgctgctgctttccatggccattga

SEQ ID NO: 65857 - DNA, 153 bp, Glycine max
  Peptide Sequence Number=SeqID_182635
atgtatttcaatacggttggaaaagctaaaggctgcgaagtaggaactgcgaactgcaccacagcaccagtccccaacctcaacctctattcagaatttaaactaggcgaaaaagttgtcgaatacggaagtggactgttgggaggaaattga

SEQ ID NO: 65858 - DNA, 2010 bp, Glycine max
  Peptide Sequence Number=SeqID_182636
atggcacattggtttggaggtccaaaacctggcgggcctatttcgtcgtttagagagagcaagtcagatgatcggcgtttctatatatttacagcaacgaagacattccatctgagaactgattcgaggaaagatcgggtggcgtggatacaagccttggtttcaacacgtggcctgtatcctcttcaaccactcaatgatcatctcttgcttgcacctaataatatatccttgtcaaccgagaggcttaagatacgcttgcttgaagagggtaccggtgagaaccttgtaaaggagtgtgagcaaattttgctcacagagttctccgaaatgcaaggacaacttgaagttctttgtcaagagcgatctaatttgctcgatacaataaggcagttagagttctgtcaaacgcatgaatacatgtctaaggcagctaatactgaacctgaggccgctgccatacacaatggtgaataccaattaacaaagaatgagttttcaagtcttggacgtggaaaatatagtgaatgtagtacaactgaatcatctgatgatattgagaaacaagagatggaggaagtgtcagatgaagatgaaatctcatattatgataccagagagtgttttacagagcctgattgcaagtgtgagtcagcgggagctatgaatcaagtggacaggtgtagggaacccaacacactatacactgatacagagaacattcatcctgagaaaatggtctgtaattataagcaccctcagatagcaagacgaaaaaagcttccagatcctgttgagaaagagaagggtgttagtctttggtcaatgatcaaggacaatttgggaaaagatctaacgagagtttgtctcccggtatactttaatgagccgatatcatccctacaaaagtgttgtgaggacttggagtactcttatcttctggatcaagcttatgagtacggaaaatcaggaaacggtctccttcgggcattgtatgttgccgcatttgcagtttccggatatgcgtcatctgaaggtcgtaattgtaaaccctttaatcctttattaggagaaacctacgaagctgattaccccgacaaaggaattcgcttcttttccgagaagactcagttgtggtgtggtcttaacaatgacgatgaggaagtcagtcaccatccgactctcattgcctgccactgcgaaggtagaggatggaagttttgggctgacaccaacatccattcaaagttttggggaaggtcaattcagcttgacccagtgggtgttctgaccctagagttcagtgatggggaaatatttcagtggagcaaggtcaccaccacgatctataatcttatccttgggaaaatatactgtgatcatcatgggaacatggatatacgtggtaatcgtacatattcatgcagactcaagttcaaagagcagacgatccttgatcgaaatcctcgccaggtgcatggatttatcgaagatgtaacagggaaaaaagttgccacattatttggcaagtgggatgacagcatgtattatatgaatggcaatgtaaatgtcaagcctaaagatttcacttcatcaaacgcatccttgttgtggaaaaggactatgccatctcctaatctcacccggtataatttgacaccatttgccatcactctgaatgagcttactccgggactgaaggagaagctcccgcccacggattccaggctcagaccagatcaacgggatctagagaatggggaatacgagagggctaatttggagaaacaaaggttggaaaagcggcagagaatgcttgttgcctattactcaaggaaaatacaagaaagtggttggaagcctaggtggttccgaagagaaggtgaaaatggaacatttcgatacgttggtgggtattgggaagcgagagagcatggaagatgggacggatgccctaatacatttggtgaatttaatgaagactctaccgatccgttaggtgcatcttaa

SEQ ID NO: 65859 - DNA, 2463 bp, Glycine max
  Peptide Sequence Number=SeqID_182637
atgccaagatcacctagattgtgcacccctattcggaaggaatggccggaggagagtttgccaaatgacaatgtgattggtttgaatagctatgttacttccttagctggatctggacctcctagttctagtttttgttccacaattgattctgaacacattgttgaagagttgcctgttaggaattatgagaaccagaatataaacttagttaaccatccacataattcaagacaggcaaggaatcaattgactattgagtctaagtataatatcttgagtagagaagttgtacccaaggttgaggaacagatgccactcaggttaagcaaaggacttaagggaattgattctgaattttggggcctgaagtctctggctggcaaaagtgtaaatcgtgactcactgaaagtctcagaagatataagcagtatgggcaaggctatcatctcgaacaatgcacatcttattagcagtataactcagagtacttcatctgcatataattatcctcaattgattgtaaagcaaacaaggaagggaaaaggggttatttgtgaagatttaaacaaaagcttcagtattggaggagcacttaagagtcaagaggatgagaaacttggttttgccgctaagtttcaatccgagacactggtgagatcaaatgttgatgagaataataagcctttattggaaggaactttcatgtctggttgcaatggactcaacttaagagactggctgaagttcaaaggacataaaatgaataaatcaggaaggattcatatatttaagcaagtattggaattggttgattttgaacactctcaaggactcgtcttgctagactttcgaccatcttgtttcactttattgccttcaagtaaaattaagtatattggttcatttggccaacaagagttagattatgaagtcatgacatgtaatgtgactaggaaaaggcctttggaacagaatacctgtgcttgccagagtttgagtacaaagcagaaaaagctctgtgaggagacaggatcttctaggcagcagcatcactgtaccagtattcatggctgccagacgacagtaaatcaaactgactccgacacaaacagacctgtggaatcaaggagtaaagaaagtctatgccaaaataattctacttgtactgaagaaaagcagtttatgtctgtgcttaataagttagaagagaagtggtattgtagtcctgaagtgctcaacgatggagtttgcacattttcatcaaatatttatagccttggagttctcctttttgagttgctgtgcaatattgagtcatgggagacacattcaactgcgatgttggatttgtgtcatagaatcttaccacctaaatttctagcagaaaatccaaaggaagctggtttttgtctttggcttttgcatcctgaaccttcttctcgccccaatgccagaatgattttagactctgaagttattcgtgaatcaaaggaatcaaattctgtagatgatgttggaatatctgatgatgaggctgaaacagagcaattactagattttctaattttattcaaagaagaaaagaaaaaacgggaagcgaagttgaaagaagagctaaatttattgaatgaagatatgaaggaggtagaaagaagttattcatttgtgacagattcagtatttcctttggtgcaaataaacaatcctgaattgagaggagacagtttacattttcaagattcttccggttcagacattagtagatccattcgaaggttgtttggttatgaagaaagatatatgagtaacataaatcagctagagaattcttacttttcctcgagatttcgagtcctgccaaaagaagcttcatctgtttcaatcaatgataaaaatgtgatggaaagtagatggaggttgcctcaagtagagaatgttaataaggagtctagaagaattcagagttctgttggttgtctaggatccttctttgaaggtttatgcaagtttgctcgttacagcaagtttgaagagtgtggcagattaaggaatagagatttgcttagttctgccaatgtaatgtgtgctttaagttttgaccgtgatgaggatcacattgcagcaggaggagtttcaaagaaaatcaagattttcgacctcaatgctatttcaagcgattctgttgacatccagtacccagtagttgagatgtcaaataaatcaaagcttagttgtgtgtgctggaacccttacataaaaaatcatctggcatctactgactatgatggtgtggttcagatgtgggatgcagacactggtcagccattgtctcaatacatggagcaccaaaagagagcttggtctgttcacttttctttgtcagacccaaaaatgtttgctagtggaagtgatgactgctctgtcaaactgtggaatatcagtgaggcatgctttttttaa

SEQ ID NO: 65860 - DNA, 858 bp, Glycine max
  Peptide Sequence Number=SeqID_182638
atggcgagtgggtggatgaagtcattgcaatgcaagtccagagcataccaagacgtataccaccctaactctaaatacctcattcccagttccagctgcagaaagaccatcaaagacgtcgtcgtcgacacaaccaagcccaggcccaagcccaatcccaagcccgaaaagcctctccagaaacaccccagctccagatacccttcatccgccgccaagcccgacttcgaaaccactatcaaccgatcgaggagcgtgaccgccacgcgccacgccgaccctcgcttcccttctctcaccgaactcaccgagggccacccttcgcggaacgtcgtggagattatcttccacaccagctgggggcccaagcccttctcgggcctggtcgagatgatttttaaagtccacaacggcccacgaaccgtctctcgtttcgaggagtatcgcgaggccgtcaaggtccgggccggaacgggcccggcccatgactacgaggagaatgcgcgatgcgttgcggatgggaatgaggtcatgaggtttcactgcttgggtcccacctccggcggcgctccctacggcggagcttgtgccttgtctttccccggcggcaaaggggcggcgatctgcacattctccggcagcggcggtgcacacgaaagctccggcggtggcaggggcagaagggccatgctggtgtgtcgtgtcattgcgggtcggatctcgaagcaaatcgggttcgtggaatcgttgttggatggacgagttgggttcgactcggtcagtggggacaacggcgagttattagtgtttgactcgcgtgctgtattgccctgttttcttatcatttataaattgtaa

SEQ ID NO: 65861 - DNA, 417 bp, Glycine max
  Peptide Sequence Number=SeqID_182639
atggaggggaccagcagccaaagcacgtttgccttcatccctagcacaattgagacaccaagtccaagcatccctgagatatcatcatcatcttcccctggctctcttgcaagaattgcacaaagttaccctcccggctttcccagaaaggtgttagcggagattatagggacatttttgttggtgtttgtgggaagtggttctgctgggctaagcaagattgatgagaggatggtgtcaaagcttggagcatcacttgcaggaggactcatagtgacggtcatgatatactcaattggacacatatcaggggcacacatgaatcccgcggtttctcttgctttcaccgccgtcaggcatcttccttggccacagtctaatggtacttgggttgggtaccaggttaatgagttctaa

SEQ ID NO: 65862 - DNA, 99 bp, Glycine max
  Peptide Sequence Number=SeqID_182640
atgaataattgtctcacacatgaaactggtaatgtaggctatgcagcgtacatgggagacaaggaaatatcagtaccgtggtctgggttgatgttgtga

SEQ ID NO: 65863 - DNA, 836 bp, Glycine max
  Peptide Sequence Number=SeqID_182641
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatcaaagaaaaatcctaaagcaagcattaggagaaacattccaccaaaggctgcaatttgagggtgggcatgatgtaaaatatagccataagttcctgctgtacttggatttccttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 65864 - DNA, 648 bp, Glycine max
  Peptide Sequence Number=SeqID_182642
atgtggtataatgaaagaatttcaaaagataaaaatacaacaagtccaaaattcagcttatgttgtggagatgtcaaagttgaactcccattattacaaactccaccaaaatatcttgaacaacttctctttgatgattatgcaactgatagtaaaaattatcagcataacatacagacatataacatgatgtttgcctttacctctattggtattaagctagataaatctatcaatgaaaccagaggacctcctacagttagaattcagggtcaaccatgcgttcgaataggcagcttattaccaatgcctgaaaaacaaccgaaatttgcacaattatatatctttgatacgcaaaatgaaattgaaaatcgaattaatatcatgagccaacatgctacaattcaaccagacattattttgactttaagtcaaatgttggatgaccacaatgtccatgcaaaaagtttcagaatggccagggacagattggcagatagtcaactagataatgtaaaattgagattgatagctggacgtgaaaaagatggtcgtacatacaatctcccaaatgtttctgaagttgcttccctgattgttggtgattttgatgcagactcaagaagggatattattgttgaaacttaa

SEQ ID NO: 65865 - DNA, 474 bp, Glycine max
  Peptide Sequence Number=SeqID_182643
atgaatagcacaagttttcaaggtgatcgcgctaagcttgaccctttcacgctaagcgcgttcatcttctctgttgatttcaatgttgagctcgctaagtacatctgtgcactaagcgagaaatttgatgagttcaaggctgagctcaaaagaaggaattggcacaagaagctgaccaatttcatggatggaagcattgatgttgcaatcgttaaggagttctatgctaacctctatgatccagaggataactcacctaagcaggtgagggtcagaggtcacttgatcaagtttgatgcagatgctttgaatacttttctgaagacccctgtgatcatagaggaggaggaagagctaccttcatactctagatgggttgcccttgaaaatcctgaggaagaatttgaccactcttgctcagacatggagcgttctttcattctccaacctggcccctacttctcacccttctga

SEQ ID NO: 65866 - DNA, 240 bp, Glycine max
  Peptide Sequence Number=SeqID_182644
atgcaggctcaaggttcaatcaatcaaacattcattcagctcaaactgggtgcaagggagaaatcattcatgcacatggtcagctttttggctaggtggctatttacaatcaaacatggccttcatcatcctcaaattcatgcattaattccatacttcaaagattcatgcaaaaatcattacccaatgttagtcgtttttctcacaattaagatcacactctcaccgggttacagttaa

SEQ ID NO: 65867 - DNA, 450 bp, Glycine max
  Peptide Sequence Number=SeqID_182645
atgacccaagagctggtaacccgcggagacaccttacggttatccgcacctcgtcattcagtcaccccaagtgtgattgacgagcagaggctaatatggtcatttgcgccctttccggagatgtcagcattttccgatggagactttccaagtctcacaaattatctagaactacgtagaggcggcgggcccgatgatacgcggagataccttacggttatccgcacccttgtgtcatccagaggcggcgggcccgatgatacgcggaaataccttacggttacccgcacccttgtgtcatccagaggcagcgggcccgatgatatgcggagataccttacggttatccgcacccttgtgtcatccagaggcggcgggcccgatgatacgcggagataccttacggttatccgcacccttttgtcatccagagggcggcgggcccgatga

SEQ ID NO: 65868 - DNA, 459 bp, Glycine max
  Peptide Sequence Number=SeqID_182646
atggaagacgcacccgtgagccctcgcgtcgccctcctcgcgttgccttcccgccgaaggatgaaggtcgacatggaggccatgaaagagcaaatggccacaatgatggaggccatgatgagcatgaagaagataatggaaaccaatgcggttgcagttgccgctaccagcgctgttgctaaggtgaacccgatgcccccatttgatctcaaccaaatgaatcatccaaccttagatatggtgggcaaagatttaggaagtacggatggccccatgatgtgcaaattcaaaatgagcgcgccttcccgccatatggcttgcctcccaactatacaccacccaatgtggcatacgctcccaattaggatgtcaataacttcactccgatactcattgaaagccaataacctcaatccaatcatgcacatgtgtctcaagccatgggggagacacatgtaa

SEQ ID NO: 65869 - DNA, 387 bp, Glycine max
  Peptide Sequence Number=SeqID_182647
atgagtcatcattcatctagtgttaatggtgagggaaaagagagggtagaaataactcaagatgagaaggaacaaataagggaagaagaaagaaggaaaatactaaaagagttaagaaaagaaaaacatggctcatatagtagtcatgactcttgcaagagcccaagtgaagaacttcatgaatattatgaaggaaggaataggtcacattttagacctcactcccataggagagaaaaggaaagaaagcctcaagaggctaacattaacctaccatacttccatgggaaggacaatgtagaggcttacttagattgggaaataagggtagagcaacaacttaaaaggaagtctacttcaaggcatcttaggggcggcatcttctaa

SEQ ID NO: 65870 - DNA, 372 bp, Glycine max
  Peptide Sequence Number=SeqID_182648
atgcgatctctccctgtggaagtaccagttggtctgtgccgtcataacatagggatcgtgcccacaagacacttggtggactcggaggagcccaacaggaccctggggtttccagctctggttacgggcctcgatcagtcctatcgggtgcccgtccccccagcaaggtcatgccattgtgacatagagtgcccgtcgccccccagcaaggtcatcaggcatcctactaaccaagctttcatcgagaagtactgtgcccctaggcaggcgcagggcgagacaccacagcagcctggggatggccggcagcgggcaacagatgcaccgccaccacctctagagttcacctcagctcatccgcaaaaaggttag

SEQ ID NO: 65871 - DNA, 294 bp, Glycine max
  Peptide Sequence Number=SeqID_182649
atgctagctattatgaacctttggacactgctccccggcaacggtgccaaatttgatcgaggcgtacccgaatcaaataaacatgaaaatgcagcaccacatacaccagttagcccttcgtccattaagcatgaacgcaagttaggctcagagggaaaactgccagggaaccacattacaagcgaaacctcaaagagagttgggcttcgtcctcaaaaggaaacaacaccaaaaaatctagccttccatggattcaaacagaaaacgcaaatgaaacatgaagcagaaacgtaa

SEQ ID NO: 65872 - DNA, 375 bp, Glycine max
  Peptide Sequence Number=SeqID_182650
atgcgtctaccggggaaggagagtctgctgatgaaatctcccataaccataaatgagattttggatgttagcatttcgtttctaaatgaccatttagaggaaacactgggttcgacaaaaatagaagaaattcactcaaagtgtatcaatctcgcacagggtaaggattacggtgagtcaggattttggctcaaagtttgtagaatggctagacatgatacatgtcggggtttggtttggctcaaggataaaagggatgccccacattatttccatgacacaaatgcaaaaatgatgatttggaaactttatgcaaaactggtcatgcatgcatctacgcggacactcaaatgtcaactttttatggtcatgtga

SEQ ID NO: 65873 - DNA, 273 bp, Glycine max
  Peptide Sequence Number=SeqID_182651
atggcttatttagattctttgtctttcaaaagcattttcaggaacagattactcaaagatgatgatggagaccaagtcaacatgtgtctcatgacaaaatcttctgagaataataaagaagattccataaggaagaaatggtacatagatagtggctgttccaaacacatgaccggtgatgtatcaaaattcacaactatttcccctaagaaaagtggacatgttacatacggtgacaacaacaagggaaaattattggagtcgaaggtttga

SEQ ID NO: 65874 - DNA, 233 bp, Glycine max
  Peptide Sequence Number=SeqID_182652
tgcttgtggttggtggtgttgggtgtttgacgcagtgcttgtggttggtggtgttgggtgtttgacgcagtgcttgtggttggtggtgttgggtggcggatctgatgtaggcttggtcgatggtggtggctcggctgatggcggtggttcacggaggaggagggtggcggttctttgtaggcttggctgttctggcgctttgactgtccgtattcactcctctgacacgcaca

SEQ ID NO: 65875 - DNA, 373 bp, Glycine max
  Peptide Sequence Number=SeqID_182653
gtgggaaggacaaggggcttatgatagatcaagaggaaacagaaggaattggatattggtgtgggaagatggtttctgcaattttgctgcctcagcagctcctgaaattaactcaggtgattgttctaccccacctgcttatgggaactgtgaatttcagccctaccaagggcttcaaccggagctcttcttcaagatgtcacatgagatctataactatggagaagggttgataggaaaagtggctgcagatcacagccacaagtggatatacaaagagcctaatgatcaagaaatcaacttcttgacagcatggcacaattcagcagattcggtgagaaagaagaaccccacatatatcttgcagcgttaa

SEQ ID NO: 65876 - DNA, 884 bp, Glycine max
  misc_feature (89)..(89): n is a, c, g, or t
  Peptide Sequence Number=SeqID_182654
gtggcagattggaaaaggcagtgccgtcatcgccccgaattgccgtcgctttcggcggtggcggggcgcggggtattgctcatctccanatcgtcgaagtgctcgatgaactgggcatcaagccggtcgccattgcgggttcttcgataggctcgatcgtcggggcaggaatggcgagtggcatgaccggccacgagatacacaaatatatggcggcgattttcaatcgccgttcggaagtcgcaaagcgcatgtggcaaacccgtccggcccgttgggtcgaattgctcaagggcggcctgcgtgtcagccagttcaatatcgaaaaggtgctggacgtttttctgcctgagagcctgcccgccaatgtggaagagctgaaaattcccatgagcatcacggcggcggattttcacgccgctcaggagattcatatccgcgatggcgatctgcattcagcgatagcggcatcttgtgcaataccgccggttttcgcacccgtgcgccgggaaggtcgaattctggtcgatggcggcttgttcaatcccgtgccttttgatttgttattcgacaaggccgatatcgttatcggtatcgacgttgtcggcacgcctgttggcccggacgattatatgcccactacgttcgaagcagtgatcggagccaaccaattgactatgtgctccatcatcgagaacaagtttcgcatccgtccgccgcacatttttatccgtcccaatgtcgaacggatcgggcttctggatttcctgaagttcgaacagatcctgtcgcaaagtgccagtgttcgcgacgaactgaagcgcgccatagaactgacgatcgaagggaaagcggcgccgatagcttcaactctggcgaattga

SEQ ID NO: 65877 - DNA, 549 bp, Glycine max
  Peptide Sequence Number=SeqID_182655
atgatgagtgagagcatgttggtgaggtttccccttaaggccagcacttggtttaggctgcaggatttcgcctggaccgctgcggggaggcgggtgtggatcatgcgcaccagcatgaccactttgacccagacgtggatgacactgctgctcagcaatgtcttgcctagcgatcataactctgatctccctctacctaagtgccagttggtgtatgccatcctgacacggattagcgtccacgtggcccaggtgattgttgatgccatctatttgtttgcaggtatgccacccaccaggcaccctctggacccggataagtctaacagggccctggggtttccggcactgatcacgggcctctgccagtcattcggggttcctgtcacccccagtaaagtgatccgaccgccgattacccgggccttcatcgagaagtactgcacgcctaggcaggcgcaaagtgatgcacatcaggccgcagacacgccgccaccacctcggcaggccgatcccgctggatcactaggcatggagcgttatctatag

SEQ ID NO: 65878 - DNA, 384 bp, Glycine max
  Peptide Sequence Number=SeqID_182656
atgaacggggccgtggaggaagccaataagaatatcaagaagattatccagaagatgaccgtgtcatacaaagattggcatgagatgctcccattcgtgttacacagttaccgaacctcagcgcgcacgtcaaccggggcaacaccattctcattggtatatggaatggaggtaggtacgcgccggttcagcgaaggggacttggtgttgaagaaagtctccgaagctctgaaagacaatagagggaagtgggccccgaactatgaagggcctttcgttgtaaaaaaggctttctccggaggggccctggtgctcaccaacatggatggcgaggagctaccttcacccgtgaactccgatgttgtcaagcgatactacgcttag

SEQ ID NO: 65879 - DNA, 303 bp, Glycine max
  Peptide Sequence Number=SeqID_182657
atggtggttaccttcttccctcgattgacagcatcggggttcaccctagatgaccatatatttggtgccaccaagatacaatcctattggagcaagagatccaggcttgttaaagtcatccatgatggcagttatatcctcagctataagtatatttctttttttcttcattgggaagaagcagcgggaaacaaacaactaatgaaattttcgactgttggcactagaatgcctacatataaggatcaagaagggttgtggctgggtactatttggagggatagcaggaggcatcaaccttag

SEQ ID NO: 65880 - DNA, 813 bp, Glycine max
  Peptide Sequence Number=SeqID_182658
atggcgatggagacgtcctcaaagccgacaatggaagcagccaacaacggcccaaccactcctcggagcccacttctcaacacccatgtcatcgccgcccactctgacgtcatcttcctcttcgtcctcctccaccccttctccggcaccctctttgtcgttcgcctcggtggtgtcctcatcgacgtgaaaacctcgaagccctccctcacccaaaatcttaggtgccgccgcatcaaaggttgccactccatcaacgcctccatatacaaggacaattgtggcgcaaagaacggaaccctagctatcttcgccagcggggaagaatcaatggttaagcgtctaaaaccgttatttagaagggctaaggtggttgtggaagggctggttggaagcggaggagagtgggcaaaattcctgcatggggttacttttagaaacattttcccgaaatggagcccatgcaaatcgcaggagagaatggcgctttccctgagaacgcgacagctggccatggtgtcgccattcacgatggcgtgttgcaggggttggactcgccagtcaaactggcgagttgagggtgcagatttcgaagcgccatcttcaatggcgttttgcttggccaaaggcgccagcaccagcagcgattcgcgttgcctgagctgcttaaatccccctcttcgtagaccatttcacacgagaaaaagaaaagaaaagagaagatcggtgctgtgtttgaggaagaacgaaggagtgttgctgtgctgtttgtatttgagcaaacctcttcttttgtttttcatcttaagttag

SEQ ID NO: 65881 - DNA, 315 bp, Glycine max
  Peptide Sequence Number=SeqID_182659
gtggaatggtgtggtggttctgaaaccaagaaggaaatcctttcaaggttacatcaaagagaagaagcagcagtcaagagggaaagaaccatggcatatgccttgtctcatcagggccagctctagccaaggcctaggtaattatgaacttggcaaagctagttggagttggagctggaatgatcgttggattgctgcactacctgttgatcatcatgttacagaaatgattgttggtcaggatcttgttgaatggcaaatccttgttgccattggagaagatcttccgttgagtcaatcacatacctttatcag

SEQ ID NO: 65882 - DNA, 285 bp, Glycine max
  Peptide Sequence Number=SeqID_182660
atgccacaccaaaacaactttgtgggttacgcattcactgaaataaatccgaaaaaatttgatattccaaaaggatgtagcatagatcaactgaaggatttgatcaagcaagtagcacctaaagggaatcctcctcatgggattcacgaatcccaagttgtaaggcatttgttttatcgacaacctagtcatttggagtattctgagaaagttttagaatttgaaattattgagctgaaatgtgaccacgacgtgctaaaggtgctcgtagagtccaattactga

SEQ ID NO: 65883 - DNA, 384 bp, Glycine max
  Peptide Sequence Number=SeqID_182661
atggataatccatcaacaagtagggacctctttaatttctcaaatctgtctatgccaccaaggaggttgatatactcatcatactatttggcaaattctttaagcaaatggctgtgcaccaatgaccatgaatctttacctatacctgaaattctgataccaggggacagatgtcgtacaggatgtcacgacatcacgcttcagaacatgcagtttatgtgtgtccgtatgaacagattaaacaaggtaccatcaaggtggctcacaaaagactcaagtcccaaaaactcacaaactaactcttcaatcccggacttggtacagaactcgtgcagcctccatgattatatagccgtgtacgattctgggctgcaagttccttga

SEQ ID NO: 65884 - DNA, 219 bp, Glycine max
  Peptide Sequence Number=SeqID_182662
atgatacctgctagcttttccatacaactaaagagaaacaagtcagatgtggtgctgaacaataacaggagattgttcaacaccgaaaagctaatttttaagaccaatagcaatcaggcctcgaacacacaaaatttatcagagctaagtcttaatggccctgttggacaagtttatgcacttgttgtgaataatgatatgctctttgctggtacatag

SEQ ID NO: 65885 - DNA, 597 bp, Glycine max
  Peptide Sequence Number=SeqID_182663
atggcacgtgctccagataacatcaagtctattaatggatcaaaagagacacttaaacttgtcgtaagaattactgatctttggtttgttgggactttcaacaggtctgaacaagcagaaatggtcataactgattctcatggagatgcaatctatgttgtctgcaaacaagatcagctaaagtcttggaagactaatttgatggaaaattgtacttatgtaatgcataattttaaagtcatgaagaatgatggtcaatttagaatctgtgatcaccagaaatctgatttggaggatcttccctttaagaaatataaatttgctgatttcaccaatatcattgttgggctcttccaacctaagttgttggttgacattattggcgtcgtggatgaggtggtctatcgccatgtgggatcaaagagtacaagggttgttttcaaactcaaggatttgagtggccaaatcctgtcttgcactctttgggatagttattgcttgcagttcttagactacttgaatgagtctgaaaacgatgtccccatcattattatattgacccatgcgcgaatcaaagaaggccagggtacaacatga

SEQ ID NO: 65886 - DNA, 501 bp, Glycine max
  Peptide Sequence Number=SeqID_182664
atgaagttgtgtttgaaattcaagaattcagggagaggcattcaggttcggtcagttttgacacctggtggccaggggagttcgcaagtttcaggttcaagccaattgtcgtcaaaggatgcatttctttcaaaagctgaagcaaagacaatctctgagattagcaacatttctgaggaaattgtttgtgttactactggctccattaatagaattgttatggataaccattcatggtgttattcagcttgcagttactgctacaaaaaaactgatgttgagacaacagcattcacatgtgcatgtggcaaacataatgatcaacctgtgctaaggtatagacttgaggtgatggtcaactacaaggaggaaagcacaaaatttttgctctgggactgtgaatgcactgagttgattggaccatcagctaatgaagttaacaagctgaaaattgaagtacctaaccaaattatcatacgatggtttttaacatttgaatga

SEQ ID NO: 65887 - DNA, 603 bp, Glycine max
  Peptide Sequence Number=SeqID_182665
atggaggtgaaagtaaaggataatggcaatgtttgtcaacgtcatgacagtgctgagaagccactggagattgatcatcccttatatgaatttgggtcagtggagtatcatattcagtctcaagcctctaatccacaagtagcctacttgtcaatatcaatgtcacctctttgccatggagtcctaccaaacgaactttcttattacaccattgaaatggtaaagggtctttgtcctaatgttgtggagattgcagagccagccaaagaaggatatcagcttgctctgaagcttaaccttaatcagattcctcgaaacaaagactatgataaggtcattatggagatttcaacaatacattcagtaattttgagttcacagctaaaagaaatattgtggaacgtgaattctgacgatgcacttcaagggatgtacaaacccatcaaactactctaccatcccaaagaccttttcgttctcatcaggcagccacaaagaatcatagccgtattcccaattcgtttcaaagaaaagtcagatgttatcattgcaacgaatttctttcagatatctcttctcgccgtgttgaaggcaataggctag

SEQ ID NO: 65888 - DNA, 177 bp, Glycine max
  Peptide Sequence Number=SeqID_182666
atggatttcatattggggattcttgcagaacaaaataacaggagagaaagaaaacctaagtatgtagtgcaaaaagaaacgcacaactttgggaatccggatgatgatgagtctgagctcatggttgtcccagttgaagtggaggatgagtctgaactcatgctggcagtcgtttga

SEQ ID NO: 65889 - DNA, 450 bp, Glycine max
  Peptide Sequence Number=SeqID_182667
atggcatgcacaatgaacaaaaaatgcatcaaagcaacacccctcaaaatatcctcattaagatcacactgcacatcaacactctccttccccaaaaaagtgatctttccacaccccttcaacccaaaaacatcagtgtacaaagaaaatcccacctgcaacaaccaagtgcccttaaacaccaacccacaagacaacaaaaactcagcaaaaaacgctaaagaaaaggtcaataccccagaaggccaaaagcgtcattggttggtggaagaaggagaatttgtaagtggggtagtggccagagaaggagaagaagagggaaaacttggcaaaggagaagatggggtgggcgataagcagagcgtagagatcaagggtcttccactttgggtcggagaagtaccaaagtttggagtggaagtgagaggggttgtgaaggtagaggaatga

SEQ ID NO: 65890 - DNA, 126 bp, Glycine max
  Peptide Sequence Number=SeqID_182668
atgacttctaacaccatagtggtgccttcattttaccaccaacaatgggcaccagaataccctgactttgtccatttcagatatgatggaacagcataccaaatcagactaagacagcatcgataa

SEQ ID NO: 65891 - DNA, 285 bp, Glycine max
  Peptide Sequence Number=SeqID_182669
ggtggacactcaagatgttgttagagatatattgtggtcacatctagattccatcaagtttttgaattcattctctatagtgttgatttatgatagtatttacaagatgaacaaatatcgtcgtctttcgttgttggagatcgttgaggtgcaaggattgtttgtggaagatgatgttttacctcaagttattgtcactaatagggatcttgctttgatgaatgcattgaagagtgtttttccttcttcaaccgcttcttatgtcaatcccatattgctaagaag

SEQ ID NO: 65892 - DNA, 327 bp, Glycine max
  Peptide Sequence Number=SeqID_182670
atgagggagatagaggaaaggcttagggccattgaaggaggtggagatcatgcttttgctgacatggcagagttgtacctagtacccgacgtggtcattccttcgaagttcaaggtaccggacttcgataaatacaaggggacaacttgccccaagaatcacctgaaggtgtattacaagaaaatggaagcatatgcgaaagatgaaaaattgttgatgcatttcttccaggaaagtcttactggggcagccgtcacctggtacactaatctggaatcttcccgagtccattcttggaaggacctaatggttgccttcgttaggtag

SEQ ID NO: 65893 - DNA, 342 bp, Glycine max
  Peptide Sequence Number=SeqID_182671
cttttcaagggactggaagcttttgatcgaaaacctcgggataaatctatcattcagaaagtggcaaatgcatatgaggtgttaggcttagttaaagagaaagagagggtactggaaaaatataaccatctcttcacagagacaggaccaaccaagagacataaaaggaactcatttgaggcaaagaaacatgtgcatcctacaaaagagaaaaggcatcagaagcaatctagaaaggcctcatctgaggaaaagtacaagtcagtagaccaaagtgcctccatgttcaagtattctgctaacctatgtgggaagcccatcaaggctagaagtgcagcttga

SEQ ID NO: 65894 - DNA, 982 bp, Glycine max
  Peptide Sequence Number=SeqID_182672
acgcgctgatcaaggccgccctggccaagctgcccaataccggtttcaccgacgtctacacacccatgctcggcaccgatggccagccggatgcgtcgctgttccgcgaggacatgctgcacatgaccccggccggctatgcgatctggaccagggcgctggcgccgaaggtcaactgcaactgagggactgcggacgccgcagaggcgccacgcgcacgccttccggtagatgccaaccttggttggcatctaccgaggcagcaggtgccgcctcagcggaagatcaccgtggcctgggtgccctggcctggctcgctggccaggctgaccttccagccgaagcggtcgcacagccggcgcacgatcgacaggcccaggccggtgccctgcggacggctcggctcggcacggtagaacggctcgaaggcccgcgacagcgcgtcggccgacatgccgataccggtatcgcgcaccaccacccggtcgttgtgcacatgcacgtcgatgcgcccttcgtcggtgtagctgcaggcgttgcgcaccaggttgctgaccaccacctgcagcacccgcggcggcgcatgcagctgcaccgggccatcgctgtgcaggtgcaccgacaccgggcgcgtacccagcagttcgttggcgttgtccacttcatagcggacgatgtcgttgacgtcgaacagctcgacctggggctcgacgtcggcctcgcgtgccaggatcaggaaggcatcgatcaccgcctccatgtcacggcctgcacgctggatgcgctgcaggctgcggcgcaggcgcggctccaggctgtcatcgcccagtgccatgtcgctggccacgcggatgacggtcaacggtgtgcgcagatcatggctggcgtcgcgggtgatattgcgctcgcgcgccacatgcgcgctgacccggttggccagcgaatgcagtgcggccgtcagctgccgggtctcgccctgcat

SEQ ID NO: 65895 - DNA, 390 bp, Glycine max
  Peptide Sequence Number=SeqID_182673
atggagggaaagaaacaaaccttgggaagggaaatggcaagggcccagcacgctgtcaccatgcagggtgtggacatggcagccgaaaattccatgacagcaacgacaacccttcatcaagttgctccgactaagaggcttctcagacacgcagtgcacatagaagaaggagaaaaggaaattctagatctctctctagggaagagatcgaagaaggttgatgagtctgagggagagaacaagttgcataagttgagatggtcgagttttgtgagagggttagtgaatgatcgagatacagggaaaaaggaggtttgggatcatatggagaggcacaggtcaggtgtccactccttaagacgcaagcatcttacacttaggttagattag

SEQ ID NO: 65896 - DNA, 765 bp, Glycine max
  Peptide Sequence Number=SeqID_182674
atggcaacaagcgaagaagtggttgcggcggcgccggaggcagccgcgctggaggcagggctgaagcacaaactggagagaaaatggacgttttggtgcgacaaccaatccaaacccaaacagggcgctgcttggggtacctctcttcgcaaggtctacaccttcgacaccgttgaagagttctggtggtataaattttctcttcctcctccttttttctgttccacaattttcatttttctaatttcagaaaaagggaatctaagcatgcaatctcaaatcttattatgggtattcaagcccagcaagttgcaaatcaatgcggattttcacttgttcaagactgggattgagcctaaatgggaagatcctgagtgtgccaatggaggaaagtggtcagtcaccagcaacagcggcaggaaggctaaccttgataacatgtggcttgaaactatgatggctttgattggggagcaatttgaggatgccgaggacatatgtggtgttgttgcgagtgtgcgccagtggcaggacaaactttcgttgtggacaaagacagcggcaaatgaggctgcccagaggttgaacttgaagggcttgaaagacatcttgactcttatcttaaacaccctgtatggatgctgctgccacttcaatctctctcgcaggttgatcagcaatatgattgagctcaaaaatgaatccctgtccttgatcctgtcatactcccttaacgagcttgatggatgccaaggtttttattaa

SEQ ID NO: 65897 - DNA, 732 bp, Glycine max
  Peptide Sequence Number=SeqID_182675
atggttgggttcaactcagttcctaattggcttctcattcttaaggaagagaagttttttactcgctgtttgattcatcactctgtaaagaagaacgagaagaacattttctgcttagattgctgcacaagcatttgcctccactgcttgccctttcaccgctctcacgtccttttgcagataagaagatacatgtacaatgacgtattacgccttggtgatgctcagacattgttgaattgttcccttgttcaaccgtacacaacaaataaaactaaggttgtatttttgaaacaaaggcctcccaccggctctcacagaggctcgagcaacatttgcatcacatgtgaccgtaacctccaagacccatacatcttctgctctgtctcatgcaaggtgcatcaacatgttctactaattaccaaaagcacaagcataaaggacacttggaacaagcatgaattctctgtgctactagacaaagaaagaagcagcgagaaccaccaagaaatagaagatagccaaatcacaacagattcagtcctagactcacactcacccacgtcgacatcgttatgcaccgtgtctggatcaacaagtactaatagtgggagtgtgacagagaatgagtcactaaaaaagaaacgtggtagtgttgacatggtgccagagatttggtacacaatggtgaaccgccgaaaaggagtccctcatcgatctccattctactga

SEQ ID NO: 65898 - DNA, 390 bp, Glycine max
  Peptide Sequence Number=SeqID_182676
atgcaagtgataaaaagtgagatcgatggatcaaaaataaatttaacattcatgaatcaggacatgcaaggaagctttgagagaaaagagaaagcacttgaaaacctcgttgtgtccaatgaggttaatcttctccttcttgaaaaccacgcgttgaaatcaagcaatgtgggagacttgaagctgatggggattagaacgatgcaagtgtcgaggtcggagccactgatggcgacgcaccagaaaagccttaggaatttgaaggcggcaaagaaggagattgaaaagcaagagttagtgacttggtgccttaacgaagagctggaaaaattagtgacttatggctttaacggcgataaatatttattagccagaaaaacattagattaa

SEQ ID NO: 65899 - DNA, 261 bp, Glycine max
  Peptide Sequence Number=SeqID_182677
atgggtatgcctcggcagtgtcgtttagatattgcaagatattgccgtgaacggttgcaaactgttggatctgtgagttgtgtggatcctctcctgtcctcatacttcccatctctccagcaggaaaaacaagggaggagaggacagaaaatagaagagagagagttgaaagttgaaataaaaaatagaaaggaggagaagatagagagacaggagaaggttgaagagagatgttgctggagaggatgcgaatccgattag

SEQ ID NO: 65900 - DNA, 643 bp, Glycine max
  Peptide Sequence Number=SeqID_182678
atggcagaccagatccaacagtttgcaaccgttcacggcaatatcttgcaatatctaaacgacactgccgaggctacaattaacaaatctctcttccttataagtgcgggaagcaatgacatatttgatttccttttgtataatgtgagtaagaatcccaacttcaatatcacacgtgaggttcaggaattcttcaacctgctaaggactacttaccatacccatctcaagaatctacacaaccttggagccagaaaatttgggatattaagtgttcctcctgtaggttgtgtcccaattgttaccaatggaactggtcactgtgtgaacgacattaatactcttgctgcactctttcacatagaaattggtgatgtgttggaaaatttgagctcagagttcccgggcatgaagtactcacttgggaattcatatgctattacctatgacatgataaacaatcctgacccacttcatttgagtaacgtgacatcagcttgctgcggaaatgaaacggttattgatggagtaccctgtggctccgatacccaagtatgcgaaaatcgcagccaattcttgttctgggaccagtaccatcccactgagcatgcttctcggatagctgctcataaactatatagtg

SEQ ID NO: 65901 - DNA, 447 bp, Glycine max
  Peptide Sequence Number=SeqID_182679
atgggtgaagtagaggagctgcaagagcagatgaaggccgacatggaggccatgaaagagcaaatggccacaatgatggaggccatgatgagcatgaagaagataatggaagccaatgcgattgcagttgccgctaccagggctgttgctaaggtgaacctgatgcccccatctgatctcaaccaaatgaatcatccaacctcatatatggtgggcaaagatttgggaagtacggacgaccccatgatatgcaaatacaaaacgagcacgccttcccgccatatggcttgcctcccaactatacgccacccaatgtggcgtacactcccaatgagaatgtcaataactccactcctatacccattgagagccaacaaccccaaactgatcatgcacatttctcttaaaccgtgggggagacatatgaaattccccaccacaatctag

SEQ ID NO: 65902 - DNA, 546 bp, Glycine max
  Peptide Sequence Number=SeqID_182680
atgggcaatgtatctgtcaaagattattctggaagattaatggatgttgtaaatcaaatgggacttgttggtgaggcatcatttacaaatcataaggtctttgaaaaaatcatggttttggctcctgacaagtttgaagccaagatctctaaaattgaagagtcttgtgatttgcaaactctcacaattgcaaagttaactagcaagcttcatgcacaagagcaaagagtttcaatgggaagtgatgaagataatgaaggtgcctttccagcaaaacacaatggaaggtcttccaataacaacaaagggagagtacacggttcttcaagaaaagattttttttgccttgtcctcattgccaaagaaccaaccatgttgaagaagattcttgagcagcaaccagaacaacaagcaaaattgatagaggaagatagcattgaagatgagcacttatttatgggccctgattcacttgggtccatgaaggtaggaaaggattgggcattgttaacagcacctcctgctttgctaactatacttccttaa

SEQ ID NO: 65903 - DNA, 1491 bp, Glycine max
  Peptide Sequence Number=SeqID_182681
atggagcgacgccacgaggaagagttgacaaagctaaaggctgaccatgaccaggcagaggctcgtgtcagtcgtccccaaggcgacgagcaatccgcccacaccttgcctgaacgcacccaaggggaatcacacccccgacacataggcaacactgcagatgatctgagcctctcccacatgcaccgtctagcagtacggacaatccatcaacatgcttttgtcgaccatattatggaggcagccatacccttggggtggaaaccactcaacctcgagctgtctcactacatgactttgaccgccttggccagtctgcaacaatcagacgatgagtcccttagaaagttcatgcatagatttgggagcatatctgtttggataaaaaatctcaatcccgaggtagcgttgcattccatgctcctcgccttacgccctgacaagttcatagacagtctttgcaaaaaaccacttggtagcatggacgaactatgtgaacgagccaagggctacatccagatggaagaaatgtccagatttcggaatgaagtacgccaagtcggacaaaagcacaacaagcataaagcaaacatcaagaccaactcgcataagtcagacaagtggcacaagctagacaagcaccaacctctctccaaagggcccaacattcaatctggaggtacccatctggctaccccagatgaaacctccgaggacggggttagatgcaaccaagtactacaggtatcaccgctgtattgggccatgaagaacaagatcaaagaactcatacatgctgggaaggagcaagacctgaaggacatcaagaggagtagcacaggagtcgggaagcagacaggagaagagcagaagattgaggcagacagagacaacatccacaatggcgctagcgaccacctccaccagaacaagaacccacccagcacatcagagcaaagtcttcctcctatcacctttatggatagggactttaggggcatcaatcccgtcaaccaggacaaccatgtagttatctcaatcattatagcaaacttaaagagtcaagaccagaggctacatggacttgatgaacaccttcagtcatggaagactctcaacgagcttagagccatactctccacacctcatttggcaatgaaattccttacactggcaagggagattgtaagtgttaaggttgaccaaaagcaagcttgctattgctatgcagaaatcctgaaggtagcaccgtatcctcctatctgggagtcgatcatgcctcacccaacaacagatgaagccactcaagtaatgacagtggaagaagggagcttgtccaactgtaactcggaccaaaattggggcagtgcacgcggcttagcagggacctcaccattcatgagcattgacgcattgccgatgtgctatgcagaaatgcggatctatttacctgacaaacatctgacatgctggggatccatcctggcataa

SEQ ID NO: 65904 - DNA, 174 bp, Glycine max
  Peptide Sequence Number=SeqID_182682
atgtcgcggaacttcacggataacttaacgatgagtgtcaagttcctcgaagaggtcgagcgaaggttgtatgacatcaaacaatggtccccggacgaaattaggagagatcatcatgctaaaatgagacgtcacttgtcagtatcagggttgaagtacaagtacatgaaataa

SEQ ID NO: 65905 - DNA, 384 bp, Glycine max
  Peptide Sequence Number=SeqID_182683
atgctacctgagtcagcagaagacaatcacccacttgtaacacccctcactatactagattccaaatggtccggttccggagacgattgccaactgctcgtgctggttcaatggtccggcctcttgccggaggacacttcgtgggaaccttggcgcatactcaaggatacttacaaccttgaggacaaggttgttttcaatgcgcatgggaatgttataaccagagacatgaagcaacaggaagcagagacagagccaatatcagagctaaaaccaacagcaatgcaagagaaggaaccaaaagcaaccacaggaacaagcaaagaagagacaaaaagggaaattactatgccacagtacctgaaggattttgtggcaaaatga

SEQ ID NO: 65906 - DNA, 1320 bp, Glycine max
  Peptide Sequence Number=SeqID_182684
atgtttttcctatacgaatttggaggcataggaaaaacattcatatggagaacattagcaagttcattgagagcagagaatcaaattgtgattattgttgcttctagcggaataacctctctattagtaccaggaggcagaactgcacattctagatttaaaattcctataccaatttttgaagactcaacatgtaatatccatcaaggcaccgaattagcagaattactgaaccagacaagtctaataatttgggatgaagtagcaatggcccacaaattttgttttgaagcgcttgatcaaagtttaagagatattatcacaaataaatcaaactcaaatcaaatatttggaggcaaagttatagtatttggtggagatttttgtcaaatactaccagtcatcccaagaggaacccgctcagacattgtaaatgcagcaatcaattcatcctatctatgggattcatatgaaatattgaccttgacaaaaaacatgcggttacacagcaatctagaatcagttgatgaacaagaaactgccacatttgctaaatggattctagacattggagatggaattatagatgatgaaaatgatggttatgctacaattcaagttcctgctcatcaactcattactcaatatgatgatccaatcagtgctatagtgaaatcaacattcccagacttagatcagcaccacaataatcctgaattctttaaatccaaggcaatactagcttcaacaaatgaaacagtagaacaaatcaatcattacgtgctatccttcattccaggtgaccacatggaatatctaagctcttattcggttgataaatcagaaaccaatgaagatttgtatttccaatcaattactactgaattccttaattcattgaacacatccggtttgccaactcattctatcaaacttaaaattggaagtcctataatgctgttaaggaacctcgaccaaaatcaaggtctatgtaacggtactagattagtggtaacaaagatggcaaaacatgtaattgcagctgaaattatctcaggtaaaaacattggcctcgctgtttatattccaagaatgtcaatgtccccttcacaatcaccctggccgtttaaactattaagaagacaatttccgattatgctatctcatgcaatgacaattaacaagtcacagggacaatcactatccatggttggactttatttgccgaaaccggtattcactcatggccaattatatgttgcatattcaagggtcaactcagcaaaaggattaaaaattctgattcatgatgatgagtag

SEQ ID NO: 65907 - DNA, 790 bp, Glycine max
  Peptide Sequence Number=SeqID_182685
tcccccaagctctgagacagtttgcgggcaaaagaggttgtctagtgttgtaagagattatcctgtgatgagggagtttgttgaggagggtgacgactttgtcaagcccccaagtttggataagtgttgtccggtgtcgaccatggtagccttaacaaatgtgagagttgcaggtcgatgtggcttctcaagccccccaagcctggacatgtgttgtccaggctgcttttgtcaaattgtccgtgatggtcgtgtttttggcgggtcaggcgcatgtgacatgcgtaataatcttggatatgtgttacacgcggagtgggcacatactggagtaatggtacttctgtctaccacaatgtcatttttctgtctaatttcgccatcggactgggcgacaatgattccaggggcctctaatagcgagtccccttcctcgaagagggtgaagaccttgcgtcgaactggtgggggcacttctcgccctcggggaggggcactgccttttgctgctacaggggagcctgtcctggttactgtgatccttcccccatctatttttcggggtgtgagaagaggtactggcaatggagatgtgagagtgcctccccacgcacaacataccctgagtgttgggtccccgtcgtccaccccagtcgttgctggttgtgagtgggtgagggatgactcaatggcgactagtaagtatttgacggctcttagggcctatgggagtggtcctagtatgttcaatccccacatggcgaagggccaaggggagctcagactgtga

SEQ ID NO: 65908 - DNA, 675 bp, Glycine max
  Peptide Sequence Number=SeqID_182686
atggctgatgagcagaggatccctattagagacgagacttcgtgggggaccgtggagcttaccagagacttccatgaacactctggcaactctgaaggctgtatagtggggaggcctacaatgaagtcgagggatagatcctcccagggtctcgccggcacaggtaacgggcatagcagtctgacaaacagagacgaagagtttgatgtccttcctcatagatggccaaataaagttctctccgacgcgttccgtggtctttgcaacgcccatgtggcccctagtgggtgtattgtgaaattcagtgatgatagtgagtgtcttgaatacgatgacgatagtccagaaaggagtgtggcagcattgggttatgactgccttgataatgcatccatcgcggtgttcgcccagccggccctgtactggatggattacgaattggtgaccaaggagatattggcaccattttttaacgaccgccgtgatggcggcgagctccctgacataaatggaggcgcgaaggagggcggggcagaatggcttgctaaagaaggcgatggggtgatttctctgggagagtaccgcacccatgtcgacaccgaaggcgtctgtttccacgaaaaaggggtcaaaggtgcagcgatggaggagtaccctttgatgaatctcctgtaa

SEQ ID NO: 65909 - DNA, 2061 bp, Glycine max
  Peptide Sequence Number=SeqID_182687
atgccatctctaaactcgcagcctctcaaatccacgttaccgaaaagcttgaagatctactccttcgagtcgccaacctcgaacaaaccagcaccaacacccactcaccctcctcctcttcagccaacccttcacctgcaaacaccattctttgcttcccattctaccccggactcgaagcgcctcaccattgcctccttttacatggaggggccagcgctggcttggttccaatggcttatgtgcaaccatcagctaacgacgtggcagagtttcctcgaggcccttgacgctcgcttctcccactcgccatatgaggaccctactggcctccttttcaagctgactcaaacagggacggtgacagaataccttagccaattcgaggccattgccaatcgaatcgttggggaagaaaagctggtagacacccgccgcccatcacgacaccgcggcaccccaagccctcacccttacctttcccctaaccctcctaccattcctctgtcttcgacccctccgctaaccttaaccctgttaccccctccacccaaacccccatctatacctttgaagcaccttaccccggccgagatggcaagccgccgcgagcggggcctttgttttaactgcgacgagaaatttatgcggggccaccgttgcgcctcacgcttcttcgttctcattgcagacttagagcccccagacgaaacccctcaacccaatttatctaacacaaatccgaaccctgaccctaacccgcaacccgacgacccgacccggcccgaaccgccccaagcccaaattagtttttatgccctctcgggtcattccgcctcgaagaccctacggctattgggccacatcggttgtcagctcgtcgtgatcctcgtcgacgtcggcagcatgcccaacttcatgaaggctcgcctcgtctgccacctgggcctcaccgccatccccacaccgcctctgcgagtcctcgttggcaacgggaatgaacttgaatgccacaaactctgttatgctacttccattcgcatacaaggccataccttcaaaacggacctccatgtcttgccaataagcggtgccgacgtcgttctcgtcatccattggttaaaatccttgggccctatcctgactgattacaacaccttaaccatgaagtttgttcataatgggacaatcatcgagctcagtggtgactcctcccgtgaccatcaagctatctccccacctcagcttcgccgtatgctccagactgacggtgttagcaaattcttccatattcgcattgatacctccatccctgactctccacacacaccacctgaaattcaatccctcatcaacacattcagccttctctttcaaactccccacacattacccccatcgcggcccaccaaccaccgcattcacctccacccttccgccactccttccggcatcattcgaccgagcacgagcctcttctcgtcgccggtattcttggtcaaaaagagacatggctcttggcgtttttgcatggactacagagccttaaacgccttgacaatcaaggaccgttttcccattcccacaatagatgagcttttggacgaattgggaggcgagaaatggttctcaaagctcgacttaatgcaaggctaccaccaaattctcatggcggaatccgacatcgaaaaaattgcattcagaacacaccaaggtcattacgaattcctagtcatgccctttggtctgtgtaacgcgccctcgaccttccaagcaaccatgaattccacctttggtccttgcttacgcaaattcgtcatcatcttcttcgatggcatcctcatctatagccagtcattcccggaacacctcgaacatctgcgaaccactttcgaggtcctccacacccatcaactcttcctgaagctctcgaagtgcatttttgctgtaacagaggtcaaatacctgggtcacattgtctcccaacatggggttgcactggtaccggcgaagatcacgaccatactgtggaagaaaagcttcatgatgaatcaacgatga

SEQ ID NO: 65910 - DNA, 234 bp, Glycine max
  Peptide Sequence Number=SeqID_182688
atgagaagaggtgagaggagacgccattcactagagaataagccatggaaggagaagcttaaccaccaagagagttccttggataagaagcttagcaaggaagcctcattggatgaagagaatgagagagagtgtgagaatattccaagaatatgccaaaggcatcttagcatatttcctttagatgccacaagcatgaaaggtgtgactctagcacatgggaagcttccttga

SEQ ID NO: 65911 - DNA, 231 bp, Glycine max
  Peptide Sequence Number=SeqID_182689
atgtctcctccacctctaggacctcacaatcactcacaaactcatctcaagctctcaggacggcttcctcttcaagctctgccaaattctggttcgctcagccaatcatgcgctcagccagaaaaaggatggctcaaccaatcatgcgctcagccagagaagaatgtctcagccaatcatgtgttcagccaatcatgcgctcagccagagaaggatggctcagccaattag

SEQ ID NO: 65912 - DNA, 198 bp, Glycine max
  Peptide Sequence Number=SeqID_182690
atgactttgggtgggaatttcaaagctgaagccgaagttgaagtggaaacggcgtcgatggcggaagatgcgacggttcgtggaggagcaagaaagatttggtggtgtggtgaggaaggagcatggttaaggaggattcaagggttaaggagaagaacgcgagtgtggtggaggcagaaggtgaggggagaaggttaa

SEQ ID NO: 65913 - DNA, 228 bp, Glycine max
  Peptide Sequence Number=SeqID_182691
atggattctaatttgattgttaatgtgagaatcttattgatgaacaatctctctaagtatctttgccaatgcttagtgagccttgaagcatattcttatcccgcattgctagtagttatgggtatagggttcaaaagatccaaaatgcacatgcagtggcggtgcaataaatggaagaattcttgcttgcaagcctctccggatgcattgcagggccaacttgcctag

SEQ ID NO: 65914 - DNA, 132 bp, Glycine max
  Peptide Sequence Number=SeqID_182692
atgacggcgaggtgcaaagaagatttcgcggtgaaaattgaaggcaaaaacgatgccactgttcactgtgtcaatgttgtcatggcctttatttggcatctctctttgccatccgagaccaagaaggaataa

SEQ ID NO: 65915 - DNA, 477 bp, Glycine max
  Peptide Sequence Number=SeqID_182693
atggctcaaccaatcatgcgctcagccagagaaggatggctcagccaatcatgcgttcagccagagaaggatggctcagccaatcatgcgctcagccagagaaggatggctcagccaattagatggaaaacagaggtagcagaaggagtagcagcttatccaaatgttgactgtgtagagtcttcagagataataataataggtgaagatggggaagctgcttcgagcttggaagaagatggatctgccactagagatggtggatcagctggcactgcttccaccatttctcacaatcgaaggtcgagctccatgccaggccaactgctcaaggaactgctctacattctttgggagctctgggcatctggtcctgctgatgcagacggaggagctggagtggatgatgaagggatgtcatctgctctggccctacaaataaaagctgagattaactatgagcgcttagcggaatag

SEQ ID NO: 65916 - DNA, 267 bp, Glycine max
  Peptide Sequence Number=SeqID_182694
atgcctctagcaagagcaagagcaaaatacacttttatattccaagaaggtggaaattgtcgtttattaaaaaaaaaagagatagatagtaggagaagtagttgtggaagaaagaggtggagtgtgagtgagggagtccttggtcggaagcaatgcaagaagaagaagcatagcagagaagcagcaatgacaagagcaatgctcctggtgttattccctcaagacaacaaagccaagttcaacttcccttctccttctaagtctctg

SEQ ID NO: 65917 - DNA, 546 bp, Glycine max
  Peptide Sequence Number=SeqID_182695
atggttggagttttgataagaatatgtcaaatcacctatgtgcttgacacatctcttaagatcatagtaaccaaaaactatgtcaagttatttaagtatggtgactcgctttaccggtgcaagtgtcttaaggttgctgctcttggccgcttatgcactatgatcaagagggttggcctaagtttggcttatttagaacaggtcagacaatacatggctaggctttcctctattgatccaaatacgaggattattttgatctatggatatcctaatgttggtaagagctcattcattaacaagattacgagagttgatgtggatgtgcaaccctatgctttcaccaccaagtctctctttgtgggtcatactgattataaatacctaaggtaccaagtaattgatacgccagggattctggactggccttttgaagattgtaatattattgagatgtgcagtatcactgctctagcatatttgagagctgcaatcttgtttttcttggacgtctctagatcttgtggttatagtattgctcagtag

SEQ ID NO: 65918 - DNA, 141 bp, Glycine max
  Peptide Sequence Number=SeqID_182696
atggcgaacacttgttgtcccattgagttggagcctaggacactgaatcaagtgaagttcactcaagcaagggaagtagttgtaaaggtggttcaaaagttgcaaccacgtgaagcatcaattgtgtttattgaagtatga

SEQ ID NO: 65919 - DNA, 711 bp, Glycine max
  Peptide Sequence Number=SeqID_182697
atgtatttggaagatgtcggtttatacactggtcattggcatattgaaaagcagaacatggccgaatattttgtcttcgatattgctgaatcactgttaaggaagcttgcttcttctgtttatgaagaagcttctcgagcttatgatctgtatgaggatgtgaaaggcatcaaagacactttgtcaattgtgaaaggtgtgctgttggatgctgaggagaagaaggagcacaagcatgggttgcgcgaatggctcgggcagattcaaaatgtatgcttagatgctgaagatatcttgggtggatttgagtgccaaaaccttagaaagcaagttgtcaaagcattaggcagcacaaggatgaaggtaggccacttcttttcttcgttcaattctcttgttttccgtcttaggattgctcatcaaataaaaaatgttagacgtagattgtataagatagcagctgatgggaacaagtttggtcttgagaggattgatgttgatcacagacttgtgcaaaggacagaaatgacttattcccatgttgatgcttcaggggtgattggaagggataatgataaggatgaaattatcaagcttttgatgcaacctcaccccaattgtgatggcgatggagataaaagtttgtgttattcccatagtgggtattggaggcttagggaagaccacacttgcaaagttggtgttcaatga

SEQ ID NO: 65920 - DNA, 204 bp, Glycine max
  Peptide Sequence Number=SeqID_182698
atggcccctcttgttaagtgttgcattgtaattaaaaagagggaagggactgcaaagcacttggtgatattgggaattggaattggccaattgcaacaaggtgcaatgttacagcgtacttttacacaacacttgagaaggtggtacaattcaggatggcatctcttggaagaagaaacatttactggcacctcctcagtctga

SEQ ID NO: 65921 - DNA, 186 bp, Glycine max
  Peptide Sequence Number=SeqID_182699
atggggtggactaagtcttatggtggtacaaccccaccttcttcaatgaaaaaaatgagcttccctgctctgcaagccaaggaatggaaaaaatccatggacactactgtagcactactaagaatgaagggatgggttagagatgggagaagagagcatgtgaatgagagatggagttgtctttga

SEQ ID NO: 65922 - DNA, 354 bp, Glycine max
  Peptide Sequence Number=SeqID_182700
atggggtttccaagcgttagagaaaaggagaagagattggagccttcatttcagtctcagtgtttgggtgtatgcgagaaaaagagagttccatccaaagaacatttctctcactacaaacattatttagcatatcccagcggtggagatgttcaaaaatgtgttcctaacctggtattcaaattttataacggtccaacggttaacgagtccgggatcgttgttttactgagacatgtttgggtgtatgcgagaaaaagagagggttttgaaagagaaagaaggaaaaacagatttgagagaggagaaaagagagtatgtgaaaaattacctaatatgtctttatctatataa

SEQ ID NO: 65923 - DNA, 375 bp, Glycine max
  Peptide Sequence Number=SeqID_182701
atgggaagaccaacattgctagtgacaacagatgaatggtcactaccattttccggcaagaataattgcgcctattatagatgctttaagttcgtttcactattagttttcacaaaggaaattcttcaaccaaaggatacaacagtgaaattattcatgcaaatcgctagcatgaacagcgccacactcaggcacgcgacacgtggctgtgtcgcctctgccactggcgacagcactgatgtcgccacctgcaatggcgttttggccatgcagggtggagtcgctggtcaaaccagcgcttccccacgcgtatcaggtacagcttttgcaggtgaaccagcttttgcagtgcagctgaaaacgccaggtccttag

SEQ ID NO: 65924 - DNA, 240 bp, Glycine max
  Peptide Sequence Number=SeqID_182702
atgcttgttcaaaaagctagagattggaagctaagagggatgcttttcgctacagcaagctcacgtgccaggtttattcatcttagcattggactatgtgaaggaggttttacaatggataaattcataataggtcttggagccattaataagatactcaaaagcaaaaagctgcaatgtgttaggaagtcccacatcgcctgtcttagttcttggggtgcagcttatatatctgtttga

SEQ ID NO: 65925 - DNA, 432 bp, Glycine max
  Peptide Sequence Number=SeqID_182703
atggtggacatccatgatgcaggcctcaaagttagatatctttggggagttatgggtcggaactcagagatgctatatacgaatctccttcagaatatcactcaagatttgactcctgtgaaaccttgcttggtggaaggaattccagatatgtggatttggaatcatagtgtgtcaggtgtgtacacaaccaagagtgcgtatgcctggttatctaatgtccaggtgggagatggtgttcttagtcatagaggtatgagtgttcaagagaactgtcccattgggatccctcggaatctgattttggaggcctttgcgggaccattgggctttgctgtgatcatggcttcagaaacgtcgtatgctattctgactccaaggcagctgttgacttgggcagaacagcattcagcagtttcattcgtacagtaa

SEQ ID NO: 65926 - DNA, 390 bp, Glycine max
  Peptide Sequence Number=SeqID_182704
atgaatggtgttcgagatacccaattggttcctctccaaggtttcaatgtcaagttcgggtcttttgcaggatttcccggaggggtcgccgacacacgcggtggtgccgtagatgagcacgagagcgcggtggccgcaacgacaaaactaggagaggaggatgaggccaaggaggttgttgaggtggagggactccgtagcggggtcgaagctacagtagaccttgaggggtggcggtgtcaggcacacgctgcggagcgcgtcactggtgatggactagaccagactgcgctcttcgacgtttggaatgaaagggcttgtggcagcgttgctggaagctgtggttgtgttgggggcaataatgggaggtgggaccgacgaggaggttga

SEQ ID NO: 65927 - DNA, 243 bp, Glycine max
  Peptide Sequence Number=SeqID_182705
atggtggtggcgctcgcgattatggcggtcggaggcgttgcggatcagatttggttgcttacggtggtttggtggagggctggcgcgcggtgggcattgattggaggtcgcgcacatggggaagacgtgaaaagtttcgtgggtcaacaacatacgtgtatggcccaaatcatattcgatgtaagagagggacagcagagcaatggtgcatggtgggacactaggactacagaaattaattaa

SEQ ID NO: 65928 - DNA, 402 bp, Glycine max
  Peptide Sequence Number=SeqID_182706
atggcggcgacgcacatagcaagtgagcgttgcgggctcctcacgaggatgcttggtggtgtcgctcctctcaacctctatgagagagataaacactgcaacttcttcacatctgcatacgagaagttcaagaaccatttcttcttgaagtctcttggagaatttgtagttatgaggatcatgtcccttctcatttcaggaattgaacagaagcatcatcaagatggatcttctgagggagagggaatctatgccttcactgccgatgcttttgttttcgtgatcatggttatcaagaattttctttggcaccacattggccatatgcatggaagagataatgagcaacttcaacttgtgtggtttgattcacatcaaactgataatttgtcttcagtgtga

SEQ ID NO: 65929 - DNA, 168 bp, Glycine max
  Peptide Sequence Number=SeqID_182707
atgtcagtgaatatcggacgcctaggagtacatgacaagacagaccacacactgggagaccagttagggtcaagctattttgcgagaatgctccaaccatgtgagattgacacaggcttaaaggagcacttaaaccgtgtgtatttacccccaaggcgtagactctga

SEQ ID NO: 65930 - DNA, 163 bp, Glycine max
  Peptide Sequence Number=SeqID_182708
atggcttttggtaggcctggctgccaagctctgtcaataaaaaatgcttcgaggttgcggttattgttggtgaagtgtggctggcaatggtggactctgaccgaagctggtggtgccagtttccttccctgtcatgctttctctttttgtccgtcacaatcag

SEQ ID NO: 65931 - DNA, 2178 bp, Glycine max
  Peptide Sequence Number=SeqID_182709
atgatgaaatgtgaaaatataatcaaacacaggatgtgggtgggttcacccaacattatgaacttgaaacggtgcgttaagtcttctcctcctccccgaacaaaaaacactgcttataggaggactgggatcgcacttcagaggaagtcaagagtaacattaattagggcacagaacaagcagcattttgagctttgggaaatgggtgaactatgtcattcacgtgctccattagacattaattccagtgggagtgaggaaaacttggtctctatttcaccagaagaaattaagcttgaacccattagctttgatgggaatgatgcttgtcctgtgccacggcctggaatggtatttagttcagaggctgaggccagattgtactacacaaaatatgccaaccaaatgggctttggcatcatgactagaacctcaaaaaagggacgtgatggcaaagttaaatatttaatacttgtatgctctggaataacaagaagtgatgctgcaaggaaacagtattgtgcagctaggatcaatttgactttacgtaaagatggaacctaccgaattaattcagctactcttggtcatagtcatgaattgggttcacatcatctactctcaagtgatattgacacgaggggtaaaaggacattggatcaagaagttgttgacatgggtgttaagaggatatcagacaaaaatgaatgcagatactaccttcagaaagaaagacatttgattggggagaatggagatggtgaagcccttcagaagtatttggtgaggatgcaagaacaagatagaaacttcttctatgtgattgacttggatgatttcttctgtgtgaggaatgttttttgggcagatggaaagagcagagctgcatatgaatcgtttggtgatgtggtgatagttgatactacatgtctttctaatcgctacaaagttccgcttgtaacttttgttggagttaaccatcatgggcaatctgtactgtttggttgtgggctgttatcgtatgaagactcagagtcatttgcttggttgtttcaatcattgttgcattgcatgtctgatgttccccctcaaggaatcataacagatcattgctgcaagaccatgcagaaagcagttgaaactgtatatccctccactcgacatcggtggtgtttatcaaatataatggaaaaacttccccaactaatccatggatatgctaattacaagtccttaagagatcatttgcagaatgttgtatatgacacacctacaataagtgaatttgagcagaaatggaagaagattgtggaggattttgacctcaaggacaataaatggttgaaagagttgttccttgagagacatcgctgggctccttcctttgtaagaggtgagttctgggctggaatgtctattaatccacacaatgaaagcatgcatgcattttttgatggatatgtaagccggctaacaactctgaagcaatttgttgatcagtatgataatgctttgcaatataaggctgagaaagaatatgtagctgacatacattcatcaagtaacagtcaagcttgtgttaccaaatctccaattgagaggcagtttcaagctgcatacactcatgccaagtttctggaggttcaacatgaatttgttggaaaggcagattgtaatgtgtctgttgcctctgatgatggttctatttttcactacaatgtcattgaggatgggataatagatgataagcctaaggaatccgtggttgaagtcatatataacagggttgattgtgatgtaaaatgtagttgtcacttgtttgagttcagaggcatactttgtaggcactcgcttgcagtactatcacaagagagagtgaaggaggtcccctgtaaatatattttggataggtggaggaaaaatattcgaaggaagtatgcttatatcaaaaccagctatggtgttcagcattttgaacctcatgtgcagaggcttgaactattatgcaatcaattcaacagtattgctgctgttgctgcagaatttgaggatacaagttcttttgtaaaggataacctatgtaacttaaaggagaagcttgaagcatggacaaccttattgaggaactcatctcaggtggatgtagagaaatgtaattatatgatggattgggaatga

SEQ ID NO: 65932 - DNA, 1758 bp, Glycine max
  Peptide Sequence Number=SeqID_182710
atggcaagtgcagatgagatgtatcttcgtcactgcctcgaatctgtacacaatagtgcattgaaagcttcccaacacaacaaatctgtgagcttagaagccaacaacttgtggacttcagaaaaaagcttgaatacagataaatttattggtgaagcagaatgtgattctagtgagttagtcttgggacattctgtagcttccataactgagaatctagttgtaagtactaatgcttctgataattggactttaggcacagtaatggggactaagagtatgataaatatattgaatagtcctttgcttcagcaggttggtgtttccgaaagagatgacaatttgaacagcatgaacttcactgatgctaaaaacatgatatgctatgattttatggactctccaagttcgtcatataaactagaaatggaaaaaccaatggtgcaaagtcataagtatggttccatttctgtgtctcaaggaatgctccagtgcacttggaagcaaggtgttcctcattttgttttttctgcagatgatcagaaggaggtctatgtagccaaattgagcaaggcagacacaacacattatgcagatttggactatgtgtacctgtttcatttgaacaagggacgtgagattcctgaccgagatttgcaacttgttggtaagatgaatgtatcaacatgttacaccctctcccctgacaattgtagagtaatggaaacacggtttatattattcggtaatgataaattttatgataaagaaatgtacacttcaaggcattctcacatgaagaacaagggcatggctaagaaagcatcaagatctagtccatcgcctatacacagaacactctcaaagttcagtagatcaaaggccataagagaaagttgtccattggataaacaatcatgtgggctagatgggactaatttaatagaaactaatgttcccacaaattttgagttggctgctattttggtcaaagaccatcttctctctcacagcttggataaagtaggaggctggggtttgaaatttctcaacaaatctggtgtgaatcatactacattgcaatctgaaagttgtaaccaaaataccggggattgctcaagtagcataagcattctcgttccagcaggtcttcatggtggacctagaaccactcacggtggtccatctagtcttgtagatagatggaaatctgggggttgctgtgactgtggtggttgggatgagggatgtcccttaacagtacttcagagaagaactatcaatgaggagattctgtctcatgcagatacacaaggagagtgcaagtcggttgatttagttactcaggatgtcactgggtttgccagtggcagctgtggtgaactgtgcgacaacactggggccaagaatctttacatcatatcggtgaaaggaatcaagggtcgcctcaacagattgccatatgcttgtgttggtgacttggtcatggctactgtgaaaaaggggaagcccaatcttaggaagaaggtattgccagcagttattgtgagacagcgtaacccgtggagaagaaaggatggtgcctacatgtactttgaagcaaaaattactggcagtgttgttaagtgccatggcagattgtttgccaactgccataggcaatttgtgaagggaggttctagggcatgtttatatggtggaattttagccttccgccatgttccaccatacgccattgataacactgattactggtaa

SEQ ID NO: 65933 - DNA, 204 bp, Glycine max
  Peptide Sequence Number=SeqID_182711
atgattgtggtcaactccaagagggccatggtcaacatcatgaacattgtgatcagtttgcaacgtcccaaaatgtcacaacttcctacaatagtcacggacaaccatgagggcccttgtcatttcaaaacatctcaagctttaactcagaatttcaataatggccctggtggatatcaccatgggcgtagtgagaataattaa

SEQ ID NO: 65934 - DNA, 225 bp, Glycine max
  Peptide Sequence Number=SeqID_182712
atgggattcacaaccaagggggctgccctgccagacatccccagaatgcccccctttcgtgcctatctcacttgtttacagctcttatgggtcttttcgctgctttcacatgatgcaatatctgggcctcctagacctgctctctcgcccaagcctcatagcattcatattccaagcactaagtattccctgccagctcagctgcgtcaatccgcctatcggtag

SEQ ID NO: 65935 - DNA, 1011 bp, Glycine max
  Peptide Sequence Number=SeqID_182713
atggaagatgccaatacctgtggaggagaagaagggaaccaaatttcaaagcgcgaaagaagaagcttgttatctaatacacagaagacgaaggaagaagacgaacctttttggaaggagaagaacgaaaccaaggaagaagaagcttgcggggaggttgctgggaagttcattcaattgctgggtgcacctagcaacagtcctacaatcgagggcgttgcactttggctgagggtgatgttggatctagacaggggtggggtgagtgtggtggtgttggaggatggggtgggatcacacaacaatgttagaggatggggatggagtcgagcttggaaggaggtgagtgtctcgagcctagctaggttgaggtctgatcataacccaattctagtcaaatttgacaccaaaatgaggaatgtgagaaggaaagaaagattgtacagatttcaacagatgtggcaaaatgaaagtgaatgtgatgatgtcgtatctcactcatgcaagaaaggaggaaatctgattgctaatattgatcgaattggagccaaccttgagatgaaagcctctcagaggaggaagatcaacactattgattacctaaaggatgatgaaggtgtcctttatgatgatgaggaggagatagcagatgtattgactggttatcttatctctctcttcaaaacctcaaatcctacagagaaagtggtggttgccctcaaacagatgcaccccaccaaaggcccgagcccaaatggaactcctgctcttttctataagcattcctgggagattgtaggtaaggatgtcactgatttagttcttcatatattaaatggagaaggagatccaacatgtattaataaaactcaaactgtctggattccaaaagtgaagaatcctatacatgctggtgaggctcttcgctatgcgaaggtatgggggagggatgttgtacgcagccttacccttgcatatgcaaagagactgtttccggattcgaacccatga

SEQ ID NO: 65936 - DNA, 664 bp, Glycine max
  Peptide Sequence Number=SeqID_182714
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacattactttgaaatgcgagatggggttattcatgtatatccagatagggatgcaaaagaagagctttttcctgttgctgatgcaactacatttttcactgatcttcatcacatacttcgagtcatagcagcagggaatataagaactttatgccatcatagactcaatcttctagaacaagtacatatcgaatttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 65937 - DNA, 192 bp, Glycine max
  Peptide Sequence Number=SeqID_182715
atgggtgatgattgtggatacgttgttattgatttgtacatgcataaattcacaatggatggtgactatggatacaagttgacacgtgtttccccaaatggtcgggtgatggactatgataagggatttgactgtattgatcactcgactagtgaatatctctatggagtcatgtctgcatatagtgcatga

SEQ ID NO: 65938 - DNA, 1521 bp, Glycine max
  Peptide Sequence Number=SeqID_182716
atgttgttcacaatgcttatatgtcaccactcattgcaggatgagatttcaggcccgattagtgctcgaattttcgaactttgcgaccccgatttcttcccacacacactgcaaaattctgaggttacctccagctcaaattgttgccatgaagagaagtcctcatatgccacaaccatatctccacctttagatgtagtagacaacaataagttcaatatcaatagcaatagcagcaacatagtcaccactacctcatctagcactaccacaaccagcaccacaaccaacaacaacaacaacgcaacgaacggcaataatctttctatcttctttgacactcaagatgaaattgacaatgacatctcagcctccatagacttctcatcatctccatcttttgtcgttccaccacttctcccaatctcaactcagcaggatcagtttgatttcccttcagctcagccacaggtgcaactatcaacagcagcaggttcaattttgacgggcctctctcactaccctacagatcctgtgattgcaccccttattggagctccgttaccatctgtttttgatgatgattgcatatcttccatcccttcttatgtgcctctcaacccttcatcaccctcttgctcttatctcagtcctggcataggagtgtacatgccacctcctggttcccttaacactgccttatctgctgacagttctggattgtttggtgggaacattctactggggtctgaactgcaggcacatgaattggactaccagggagaaaatggtggaatgtattgtacagattcaattcaaagggtgtttaactccccagaccttcaggcacttggtaatgagagtcagaaacttgtagctggggctggaagctctgccactttggcaccagaaatctcacacttggaggactctaccttgaaggttggaaaactctctgttgagcagaggaaggaaaagattcatagatacatgaagaagagaaacgaaagaaatttcagcaagaaaatcaagtatgcttgccgcaaaattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatggcgttgttgttgttgttgttgttgtatgcttgccgcaaaactttggcggatagccggccccgggttagaggaaggtttgcaaagaatgatgactttggagagagccataaacaaggaagtagcaatcatgaagatgatgatgaagagataattgtgaaagaagatgatgatatggttgattcctcagatatctttgcacatatcagcggagtgaactctttcaaatgcaactattccatccagtccttgatttga

SEQ ID NO: 65939 - DNA, 225 bp, Glycine max
  Peptide Sequence Number=SeqID_182717
atggcttggagacaagcctatttttcaggaggagacagatcctgcagatacctaagaagctgcccaaggagatggaggaagaagttaaaaaggataggaagtgatcattcatgttttgatagttatttgttagatccagaaacaaaatcaaaaggaatggcaaaatggtccttttcccaagatttcagacatccattcgcccaggctagcaatcagctcgcttag

SEQ ID NO: 65940 - DNA, 417 bp, Glycine max
  Peptide Sequence Number=SeqID_182718
atggattggccactaaggctaactccaacaccaccaccacctccgttccaccattgttgtgccctaacccctctccctcaaacctcactgtattgcctcaaacctcgctctccctcaaacctcactgtattgcctcaaacctcgctctccctcaaacctcactgtattgcctcaaacctcgctctccctcaaacctcggtctcccttaatcgctctccctcaaacctccctcaattgctctccctcaaacagcactccctaaaggtccctcgaaacgtcactctctggccaacatttttgtgcagtggagcttacaatcgcaccgtcggtacgcatagtgaggtcgcccctgccgtgacctgtctgccatctcgaagaagtgtatctgctgtgcgccgtaggtcattgtaccagtaa

SEQ ID NO: 65941 - DNA, 222 bp, Glycine max
  Peptide Sequence Number=SeqID_182719
atggctaatagaggaaggatgtttgtggaaagttggaaatgggaggacaataaaagttttcaaggacaaacggattccaaatgtcccaagaaattgtattctgccaatttgaaagtgatcatgaccgtgaggaagtattcgtccaatggtatctacaatgtcaaatctggataccacttggccagaatgaactttgaacctattgaatcatcttctaattaa

SEQ ID NO: 65942 - DNA, 429 bp, Glycine max
  Peptide Sequence Number=SeqID_182720
atgtggatggaagctctctcggaaatcctggtgcgtcgggcttcggtggagtgctgcgcgattctattggtcagtggattattggtttctcgggacattgtggatttacttctaacctttatgctaagctcttggcaatcttgcatggtcttcaaattgcctggagtagaggtctcaagaaaattatctgagtctgatgctttgaacgccttggatcttgtttttgatgataatctcatgtctcacatccttatcaatctatcatcaacaatattcttcagttcaatcactttgattgggaggttgtacatgtctttaagcatacttatagagaaggcaataaagttacatattgacttgctaaaaatggagcttcaaccagccagcatttgctcctttggtcatcttgccctcatcctctcactctga

SEQ ID NO: 65943 - DNA, 468 bp, Glycine max
  Peptide Sequence Number=SeqID_182721
atgattctggtttttaaatacaatggttggaggggtttgggtcaggggcctagaaagctatacttctctacatggtgggctgacttaaggagacagaccattgaacaatggattttcgtcattaacatacaacagagacataccttcgatggcttccttgggagtcttaaagccaagcacaatggacttccaaaatcgagtcccacccttttcgggactcgattttttcctagttttcttcgacctgcgaaagtgagcaaatattcaaacgaggaacgcctaatgttaaaaccaaaggtagtacctcaaaagataagtgccagacacgaactccacaaacacgaactcgacaatgtggttgcagtcacggaagcgcaatccagtttgcgacaaacaccaactcaggcagaaggagaaacaacaagaacgccctgggagtaccctttccgggactcttttctttcctag

SEQ ID NO: 65944 - DNA, 802 bp, Glycine max
  Peptide Sequence Number=SeqID_182722
atggacgttgttcgttcacaaagaggcagtagtagaaacacgagcccagaccgcgccaaaatatgcaggatgaataaaaaagtgaagccctttagaaaagttcaagtcgtttactatctctcccgaaacggccttttggagcacccccatttcatggagctcacccttttgtccaatcaacctctccgcttgaaagatgtcttcgatcgactcatggctcttcgtgggagtggcatgcctttgcaatattcatggtctagtaaaaggaactataagagcggttatgtgtggtacgacttgggtctgaaggatataatacatccagcagaaggaggcgaatatgttctcaaaggttctgaactcgtcgaaggatgctctgagagatttaatgtgagcaacaagcagcagggaattcatcagcaggcagaggcagaggcagaggcaaattacaattacaattacgattcaaggagtaaggctttgggtgtgtgcaacaagcagcagcagcagcagaaagagcgtgaagagttggaggaatacgaggagcaagagaaagagtacgaggagggagagaaaacaagctacacgagctccaccaccaccccacactctcgttgctcaagaggggtatcaacggaagaactggtttatgatgaagaagaaaacaagaacgcaacaaaggtaaatgctgaaggcacaaataagaataagaagaacaagggtgagaaagtgaagagaagggatggtgaagggtcggtgtcaagtcgttactcagcactgttgcagctgatagcgtgtgggg

SEQ ID NO: 65945 - DNA, 186 bp, Glycine max
  Peptide Sequence Number=SeqID_182723
atggatcacccgggaagaagccaagtgaacatagaagacaacaccggaagcatagttcatctcgtaatccttaacacctctgatttggtgagcattgagacctcaggaattgcttctcttgaggaactgcataagagtttggtctcaagtgggaagcagcaattgccaatcctcgttggcaagtga

SEQ ID NO: 65946 - DNA, 224 bp, Glycine max
  Peptide Sequence Number=SeqID_182724
atggctagaagcaagagaattcaagaagattttaaggaaagggaaggtttttccacaaaagctatagataatgctcttactaagaaggaccaaacacttgagaaagatgaagttcatattgatgggaactcgatgctaaagaagaaggagaaaaccactccaccacaagaaaaaaggctcttactgaagagagccaaaagacaaacaaggaggatgagaaggag

SEQ ID NO: 65947 - DNA, 384 bp, Glycine max
  Peptide Sequence Number=SeqID_182725
atggcttctaggaaacacaaaagtattggttcaagacccacaacacaatatgatacaaggagattttcctctttagatgcttggaaccggtacacagataatgtcttggggagaaacatcttgcctaagaggaaggtagagctctatcatactgagctagatgattttaagactgaattagagaggcgtaatttccataaacgcctcaccaatttcattgatgcgagcatagacttggcattggagaaagagttctatgcaaacttatacagctctaagggcccttcaccaaagcaatccagaagggtgagactatacccacatactccagatactacaggttgcccacagattaccaagagattgaggctgccttacgcataa

SEQ ID NO: 65948 - DNA, 309 bp, Glycine max
  Peptide Sequence Number=SeqID_182726
atgatatcttcagtggggaatgagaagaacatgctcaatgaaactaatcataatttaaagaaagaacttccgtctctgatatttgactttgaagagaagctgaaggaacaacagaaaattgaaggttccttgagatctgaggttgagactctcaaagttgaggttgttgagaaatctgtattgcaaagtcagctggaggaaattgaagggaaactggcacaagctgaatctagactaaacgaagaggttggaagtgttcaagttgctgcttctacaatggaatcccagccttttcaagttggcagataa

SEQ ID NO: 65949 - DNA, 456 bp, Glycine max
  Peptide Sequence Number=SeqID_182727
atgggttcgaatccggaaacagcctctttgcatatgcaagggatcgagaacgagagagaaagagagtattccttcttcgagggaaggtgcctcctgaaagctaagataggacctcgaaatgtcgagctttacaagactgcggtggttgaacggagtgttggaacttgttgggttgtgattggcgtcgcggagacgaagtctgtccgtcgtcgtcttcctggtcgtatggtcaaccatggcgatggcaacaagcaggtcggaccagtgttagatggtgggatcgagaacgagagagaaagagagtattccttcttcgagggaaggaaggcaaagacaacatatgatatttcttcttctctcaacctcaactctaggaagacgaagcttccagtttcagattcttggtctccttcagcagataatgcagtcaagttaaacgtggatggaagctcctaa

SEQ ID NO: 65950 - DNA, 255 bp, Glycine max
  misc_feature (41)..(41): n is a, c, g, or t
  Peptide Sequence Number=SeqID_182728
atgctgacaatagctgaggagtctgtggatctcctcggggncggagtaggtgtccgccattgcaagatgagggttcactgttatcaagcaagttggagacccagcatgaccacagattcacctccactccttatgttcccatggacccggcgacaaggttacatgttgattttatgctttcgaaagtccacgttaaccaataaaaagcaaagaggcctgtttaaggcgttggaccttaaaacaatttttaagtga

SEQ ID NO: 65951 - DNA, 846 bp, Glycine max
  Peptide Sequence Number=SeqID_182729
atgacgaaattgaagacgaccttgtctcctgaaactaaggcagttgcacctaagtggattgaagtaaagcaacaatttagtgcagctatagtaccaccaagcttggcactgcagcagttaactgaacaaatgaagtgtccacagtcattggatggttgcctggtagaggctcctgattttcaatttcctcagacttgtgttgtcatgtgcgataagcaacatgctccctgctatgacatttgtcatggctggtattttcaggatggagaagttaacgtgacaaaagtaagatgccaaccaaaggtgattggaactgtagtaacagttgctggggccatgttgatgacattgtacaaagggcaagtaatcagtttcttcgtgtctaagtacatgcatcacccaacaaactatgaacctgaaaacaacactgattctggtgaaaaggattggttcaagggttctgttcttctcgtacttgccaccctttcatgggcttcttcatccttcaggcaagcactaacattaagtaaataccctggtcagctctccctcacagcacttgtgtgtggcttagggaataatataatcaggtatcacctactatgttcaagggattgtcatgcagaaaaaagggcctgttttcgttactgctttcagccctttgatgatgattatcgtagccatcatgggtgccttcatccttgcagaaaaaatatatcttggagggcaaaatacttcaacgacggtcgtaaactaaatccgtctttatatagttatttaccaacaacgacgggtgctagggacaccgacgttgatatactggcaaacaacgtcgggcctttctaa

SEQ ID NO: 65952 - DNA, 603 bp, Glycine max
  Peptide Sequence Number=SeqID_182730
atggatatgagaatgcatgccaacaactactctagaaagggtaaatctatgtcttcatattggtcttatatttttccttcagttggcttcaagggatccaagatcagtaatcatcaatcagtttctgttagaagtaattgtgaaaattttgataaggatggtgatcgctcagataaatatgttgattctagtcccatgagtaatggcaaggatttattgaaaggtaaaagtaatgataaagatcaggccactagaaatagcagtaggagttctgaagtttttgaagaagtaaatgagcagcattctccaaatattcccaagaggcctctacccaatttcactgatggttctactgttatttatcttgagttgaatgaattttttgaatcatgcctccctaatatagtaaaagggtgtcagagggtcctactttacagtacgttgaaacatggcatatcgcttcgtacacttcttcgcaacagtgataaactttctggtcctggtttgctgattgttggagatatgcacctggctgagtttggtgggctgctagattaccccttgcaacctactgcaaagagaaaacatcaagggacaaactaa

SEQ ID NO: 65953 - DNA, 447 bp, Glycine max
  Peptide Sequence Number=SeqID_182731
atgaatcagcagcagtgtttgggtagacagtggtatggggtggaggcagcgcttgcttgggagagccgttgtgaacgccgttggtcggcaccaccattgatggttgcgacaatgcgctggtgcctcaattttcgatgctttctcctcaacggcttgcttgcgctacacaatgcagcaccgcacatgcgttcagggatgacgtgtaataatgctatcacatataaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgttttgatagagaaaaagagccagaatggaatgagtttgagacaaatgaaagtattttttaa

SEQ ID NO: 65954 - DNA, 564 bp, Glycine max
  Peptide Sequence Number=SeqID_182732
atgataattatgaaaggcaccaacagacagataggttgggattctatatctggagaagatcattctatttcactcttgagaggagaagtttttcaagccttggctacctttgatcatgataaaacacagcaaaaagcattacgccgctttcagattttgttagatggcagaaatacttctctgcctccagccaacattagaaggattccagatcaagatattatttatgtactagcaggaataagcaatgaaggcagtgaaactgcttggagatggttgaagttatctaagttgcttgaagaagcaacagcaagaaaccagactgagggaaataaggatcttaaccacaatgagaaggactatttgcttcctaaagtagttgaattctctgaagagaatagacatgggggaaaagatacatctaaggtagagctttcagccaatgaaggactcaactcaaacaaagcttacaggaataaatcattgatgacagagaagtggaaccttggaaccagaggaataattcctccttgtcttttaccccttgtctgcaatccatggtag

SEQ ID NO: 65955 - DNA, 3690 bp, Glycine max
  Peptide Sequence Number=SeqID_182733
atggctattggcactgctaaagttcttgtttctgctcaagaccaaattatgtgcattcagactgagagggaagcactcctccaattcaaggctgcccttgtggatgactatggcatgctctcttcttggaccacttctgattgctgccaatggcaagggattcgctgcagcaacctcaccggccatgtcctaatgctcgaccttcatagagatgttaatgaagaacaagtacgttatattagcggagagatccacaagtcgttgatggagttgcaacaattaaactatttaaacctcagttgcaattcttttcaacgcaaaggaatcccagagtttcttggttctctcagcaacttgagataccttgatctgtcatattctcaatttggcggaaaaattcccactcagtttggctctctttctcatttgaaatacttaaatcttgctgggaattctctggagggttcaatcccacgtcaacttggaaatctctcccagttgcagcatcttgatctctggggcaatcaacttgaaggaaatataccctctcaaattgtaaatctctcccagttgcagcatcttgatctcagtgtcaatcgatttgaaggaaatataccctctcaaattggaaatccctcccagttgcagcatcttgatctcagctacaattcttttgaaggaagtataccgtcccaacttgggaacctttcaaatttgcagaagctttatcttggaggatcacattatgatgatgatggtggtgctctcaaaattgacgatggagatcattggctgtctaatctcatttctttaacccatctttccttgctctccatatctaatctcaacacttctcatagctacccccaaatgattgccaagctaccaaaacttagagaactgagtttaattgattgtagcctttccgatcagtttatcctttcagtgaggctctctaaattcaatttttctagttccctttccattcttgatctttcctcgaacaacttcacgtcatcaatgattctccagtggctgtccaacgtcactttcaaccttgttgagcttgaccttagttataacctcttggagggttccacattaaaccattttggccgtgtaatgaattctcttgagcacctcgacctctcatataatatattcaagggtgaggatttgaaatccttggcgaatatatgcaccttacattctttatacatgccagcaaacaatttgactgaagaccttccatcaatccttcataatttgtctagtggttgtgttagacactcattacaagatttggatttgacatataaccaaatcaccggctctttacctgacatttcagtattctcatctctaaaaacattggctcttgatatgaatcaattaagtggaaatatacctgaaggcctccgcttaccacttcatttgaaatctctgtcaatccaatcaaactctttagaaggtggaattcccaaatcattagggaatgcatgtgctttgcgctcattggacatgtctgataatagcttgagtgaagagtttccaatgataatccatcacttgtctggatgtgccagattctcgctgcaagaattgaacttagaaggaaatcaaatcaatggtacgtttcctgacctttcagtattttctgccttgaaaagattggatctttcagaaaatcaattaaacggaaaaattccagagaggaacaaattgccgtctctgttggagtctttgtcaatcgaatcaaactctttagaaggtggaattcccaaatcatttgggaatgcatgtgctttgcgctcattgtatatgtctaataatagcttgagtgaagagtttccaatgataatccatcacttatctggatgtgctagatattcattggaacaattatatctaggcatgaatcaaatcaacggcacactacccgacctctcaatattctcatctttaagagaattatatctttatggaaacaagctaaaaggagagatttctaaagatattaaatttccacctcaactgaagagactagatatgcaatcaaattccttaaagggtgtgctcactgactatcatttcgctaatatgtctaacttagacttattggagttatctgacaactctttattggccttggcatttagccaaaattgggtcccaccatttcagttgagccacataggattgcgatcttgcaagctaggtccagtatttcccaaatggttggagacacaaaatcaaatttgggatattgacatttcaaatgctggaatagcaggtatggttccaaagtggttttgggctaacttagcattccgagaatggatttcaatgaatatttcatacaataatctccatggtataattccaaattttccaataaagaatctttacacctccataattcttggatcaaatcaatttgatgaccctattccaccatttctgcgaggttccgtgtttcttgatttatccaaaaacaaattctcagattctctttcatttttatgtgtgaatgatacagttgaaaatttataccaattagatctttcaaataatcatttctctggaaaaattccggattgttggatccatttcaagtcattatcttatttggacttaagtcacaataatttttctggaaggatacctacatccatgggatctcttcttcatcttcaagcattgctattgagaaacaacaacttaacagatgagatacctttctccttgaggagttgcacaaatctagtaatgctagatattgcagaaaatagattatcaggacttatccctgcttggattgggagcgaattacaggagttgcaatttttaagtttgggaagaaataatttccatggaagtttacctttgaaaatttgctacctaagtaagattcaactcttggatctctcactaaacagcatgtctgggcaaattcctaaatgcataaaaaattttacttcaatgactcaaaagacatcttcaagagattatcaaggtcattcatattttgtcaaactcaattactcttcaagtcctcaaccatatgatttgaatgcactcttgatgtggaaaggttcagaacaaatattcaaaaataatgggttactacttctaaaaattattgatctctcaagcaatcacttttctggagaaattccactggaaatagagaatttatttggattggtttcattgaatttatcaagaaacaatttgatagggataattccctcaaaaatcggaaagctaacatcacttgaatctcttgatttgtcaagaaaccaattggttggttcaattgctccaagtcttactcaaatttatggactcggtgtgttagatttgtcacataactatctaactggaaaaattccaaccagcacgcagttacagagttttaatgcctcgagttatgaagataatcttgatctttgtggaccgcctcttgagaaattgtgtattgataaggggctagcacaagaaccaaatgttgaagttccagaggatgaatattcacttttcagtcgtgaattttacatgagtatgacatttggatttgttataagcttttgggtggtgtttggctcaatcttattcaagcgttcttggagacatgcctatttcaagttcttgaaaaatctatcagacaatatttatgtcaaggtcgca

SEQ ID NO: 65956 - DNA, 375 bp, Glycine max
  Peptide Sequence Number=SeqID_182734
atgccacggagagggacgctgctgagagggaaagagagagagagtggtgtgctgagagggagagagctcgtgcgtgcgatgagggagagagctcgtgcgttcgatgagagagagagcgcacgcgctcatggtgccgatgctggtaaagataatcctgaagatctccaaccacgcgacggagtatgccgctggtgcgctgctctcgctgtgctcggagtcggagtggtgctagcacgaggcggtggcgacgggcgtgctgacttagcttctgcttctcatgcagagcgattgcacggagagagcgaagaggaaggcgcagatgctgctaaagcttcttcgggatttgtggccgcaagattccgtcgaaaactctga

SEQ ID NO: 65957 - DNA, 264 bp, Glycine max
  Peptide Sequence Number=SeqID_182735
atggcaatagacatagatcattttccaaaattggatatcaatatggtgtcccatgagcaaccaactgccaaaagaaagatgaaacaagtttctaacatgtctttggacgaggaagacttatggcagtggaggtgtgatccctctcaatccttctcggtggcttcagcgtataaactcatatcgacttcaaatagggtggagtgggataattccctgcttgatggtgtcttcaagaactttgggcaatcaatcgttcccccatag

SEQ ID NO: 65958 - DNA, 276 bp, Glycine max
  Peptide Sequence Number=SeqID_182736
atggaggtggatgaccatgttgcatcatcaagaaaaactggaggagggaggctcaaaagtattgtatggaaccattttgataagattaaaattattgatgggaagacaaggcctaatgcaaatactacaaaaaatttctcgagggagcatcaaagaatggaacaaagcatttgcatgcctatatggaaaaatgcattcaaaaaaggtcacatgacaaagggaaggaagggtggaaattacatcagatatgtggactacaagcaaccaaaagaaaag

SEQ ID NO: 65959 - DNA, 288 bp, Glycine max
  Peptide Sequence Number=SeqID_182737
atgaataggggcaaacaacaagtcctacccccaaccctaaccctaaccctaacttcagaccttggctcttcctcttcttcttccttcagattcatccataccgttagttatattactggattcggggcagattactactaccgtgtttctccgctttcacgtataagttcaaatgtatttgtagcaactaacaatcgaggaacaatagttgactctggcacaacattggcataccttgttcaagaagcttacaatccttttatcaaagctcactatagtttgctgtga

SEQ ID NO: 65960 - DNA, 300 bp, Glycine max
  Peptide Sequence Number=SeqID_182738
atgggaggtgaggttgctgcagcgaattccttcccattggcagcaatcagcagtggtccaagaagagagcatgccatagcgatccagaagggaagccttgaattggaggagttcttccctctccctctcaatgcacattatttcctcttcagcacaaacaacctgcaactgagtgggggagggaaagatgtttctgcgtgcggtggcacaaccgttgatggcaaaggtgaagtcgtcgacggggattgtggggctggaggtggtgcctcacgcaagggaggtgctgattgggctgtatag

SEQ ID NO: 65961 - DNA, 210 bp, Glycine max
  Peptide Sequence Number=SeqID_182739
atgcagaaagaggctgaagtacagaaacttatggaagagaatgtgaggttgagtgctctgcttgacaagaaagaggctcaacttctagcattgaatgaacaatgtaaaatgatggccttgagcgcttcaaacatctcttccttgctgacagctggagtcttcatagtgaagctttactggattaagaagcatccatggagggctccataa

SEQ ID NO: 65962 - DNA, 204 bp, Glycine max
  Peptide Sequence Number=SeqID_182740
atgatgcacgaccatgatgtttttggaaaaaccgtcgtggtttgcacttcatttagtcacgtaaccagcctcgtgacctcagttagtgtatacacttaccttcaccccctacgcgctaccctcactccaatcaccctctttgtcactcacactttcacgccagcccgccgttcaattgcggtcgtcattgtccaagctagctag

SEQ ID NO: 65963 - DNA, 309 bp, Glycine max
  Peptide Sequence Number=SeqID_182741
atgcggaggaactcgcctgcctcctctagcgatacttctttcttgccacaaccatcctttttctccggaagacctttcactggaatatcctcgttcggagtgaggttcgttttgtcattttgctcttccaccatctttgccttcctgtcataccctaatttcgttcaggggggccatctgtttgttgggatacgaccctcgtttgaccacttcgaggaagttccaccagaaggtggtgccttctggaggaagcaacctaactcaccagggcgagttgggtggcaagctcctccctcttttcccctataa

SEQ ID NO: 65964 - DNA, 1131 bp, Glycine max
  Peptide Sequence Number=SeqID_182742
atggcacttatcgggaacctgtcaagtgagttaaccaataagaaatttgattggtctcgaccaattcgtgatcatgtgacagaaatggctaatctggtagcaaagttgaattccatgggaatgcaaatgagtgagtcctttctagtacaatttattttgaactctcttcctactgaatttggccagtttcaagtgaactataacgctcttaaggaaaaatggaattttcaagaaattaaggccatgttaaatcaagagaaatggagattaaagaaaatgaaggagaactcaattcatctcatgactcatgatggagccagtaccagtaagagtaaatcgggtaaaaaggacaaggaaataaagggattcattttgatccaaaccataagaggaactaaaaagtttcgctgcattggaaacaaaatgaaggcaagaataaagggcattgggacttacagattaatcgtggacactaggtgtcatgtagttttggaaggatgcctctatgtacttggatatgccaggaatttagtttctgttgcaaagatggatgaattaggttttagttttaagattggaaacaatattaggtcatatatcaaaagaaaggataatgagattagtgacaatgaaattttgcctcaattggatttcagtgactgggatatatgtttggatagcattaaaggaaagaaaaccaaacaaatatcaaagaattttgctacaagaagtaatgaacttctaagattgatacacattgatatttgtggatcttttgacattccatcttgggacagtgaaaagtattttaatacctttattgatgaattttctcattattgttatctgtatcttctgcatgaaaaatctcaattagtggatgccttaaaagtgttcattgatgaggtagaaaggcagatggacaaaaaagtgacagttgtaaggtttgatataggtggtgaattttatggaaaatacaatgaaagtgaacaatgtccaggtcaatttacaaagttccttgaaagtagaggcatatatgcacaatatactatgcctaacaaactgcaacaaaatggtgtggctgaaaggtggaatcgtactctaatgaatatggttagtgtaacgccctga

SEQ ID NO: 65965 - DNA, 243 bp, Glycine max
  Peptide Sequence Number=SeqID_182743
atggctccgaagaagcattccacaaagaggtccaggagggatgcccagggggaaagctccagcgtctccgtggagttcgacacccacggaggagggagttcgagatatgcgctcgtgagtaaggggtcagtggattccctttggcatagatgccctcagccagttcctgggccacccactgatcttggaggaggaccatcggtgcgaattcagccagaggagggactaggcctccggctttga

SEQ ID NO: 65966 - DNA, 306 bp, Glycine max
  Peptide Sequence Number=SeqID_182744
atggaatcacaagtgcggcgaccttggtcgtgtagctccgccctctcccaggtgaccgagcaggtcggtcatatcctcattcatgtgggcttccttcgcttcgcctggggatcttgcgggtccggttccctcctcagtgggccaatctccaggccacacgacctcagccctgaactgctctggggaagggcatacaaaaggaggggagccctgcccctactggctgaggctggaacggtagaagcactcatgcaattgcacctgcccgcggtggttggccgtctgctggcgaaccatatgccgtag

SEQ ID NO: 65967 - DNA, 378 bp, Glycine max
  Peptide Sequence Number=SeqID_182745
atgaatgaatcatctgagtggcgcaggatcgtagacgagagcacgaaggaagccgcggcggtggacccggtcgaaccggagaaggttcttgaagttgccagctcgcacggcctcactctcaaattcgtcctcaccacccaccatcactgggatcatgctggtggaaacgacaagataaagcagctggtgccaggaatcaaagtctatggtggttccattgaaaacgtcaagggttgcactgacaaagttgaaaacggtgataaggtctctcttggagctgaaatcactatattggcccttcacactccttggtactctatgccctatccctatgctattgtcaattgtttccaattagtgtacactaattttggataa

SEQ ID NO: 65968 - DNA, 798 bp, Glycine max
  Peptide Sequence Number=SeqID_182746
atggcggtggagagtgacaaagtgggttctgatgggaaagtttggagcttttgcagcatgccattttggcaaacaactcatgcttcttcatcttcttcttcaacaacaacaacaataccaacaacttcttctatgcatcatagtgttcaccatcagagccagattcttcagtctcttgatagatccactcatcaaccttccaccactgtctcttctgtggctaaatctcttctccccacaaggagaaggctccgtcttgatcctcccaacaagctctactttccttgtatgtctctcattattaatctttttgctttttttttagcatcaatgaacctgtttcaaacaactgcacccaagagttgttatatgcgccctccgggtggtattcttgctcctggtgaaagtataattgcaactgtgtttaagtttgtggagccaccagagaacaatgagaaaccaattgatcagaaaagcagggttaagtttaaaatcatgagcttaaaagtgaaaggcgaaatggactatgtaccagaactgtttgatgagcaaagggatcatgtagcagacgagcaaattttgcgtgtcatttttctggaccctgaacgccctagccctgctttggataagcttaaacggcagctagctgaggctgaggctgcattggaagcaagaaagaagcccccggaggagacaggtcctcgagttgctggtgaaggacttgttatagatgaatggaaagaaagaagagaaagatacctggccaggcagcaggttgaagtggtagattcagtgtaa

SEQ ID NO: 65969 - DNA, 267 bp, Glycine max
  Peptide Sequence Number=SeqID_182747
atgggaaacaacttgaggtttttgagtctttgcctcttggcatggattgcatcaactcatgctcaacttcagcttggtttttatgctaataattgcccaaaagcagagcaaattgttttgaaatttgttcatgaccatatccataatgcttcatcactaccaactgcattaataagaatgcactttcatgactgttttgtaaggattaaggttaaggagctaactaagatgaagcatttcagggatgagatgcatcagtccttctga

SEQ ID NO: 65970 - DNA, 852 bp, Glycine max
  Peptide Sequence Number=SeqID_182748
atggttggtgtgcaattaaaaattggtaccttgattcaactgtttctagtacacgaaaagcgtataaattcaaaaaagactgttccgggctacgatgtagcgggtgtggtggtgaaggttggtagtcaagtgaaggactttaaagtgggtgatgaagtgtatggagatgtaaatgagaaagcactagaaggacctaagcaattcgggtctttggctgagtacacagctgttgaggagaaattgttggcatcaaaaccgaagaatttggactttgctcaagctgctgctcttcctctagcaattgagactgcttatgagggtttggagaggactggattttctcctggtaaatctattcttgttctaaatggttctggaggagttggtagcctagtgattcagttttacaacagagatgcagggattctagctaagcaagtttttggagcttcaagagttgctgccacttcgagtactagaaatttggacctattgaaaagcttgggagctgatttggctattgactacacaaaagagaactttgaagatttgccagaaaaatttgatgtagtttatgatgccattgggcaatgtgacagggcagtgaaggctgtgaaagaaggcggcagtgtcgtggcactcacaggtgctgttacaccacctggcttcagatttgtagttacttccaatggagctgttctgaggaaactaaacccttacttagaaagtgggaaggtgaagccaattgtagaccccaaaggtccattctcctttgataagcttgctgaagccttctcttaccttgaaacaaaccgagccactggaaaggttgttatacatccaatcccttga

SEQ ID NO: 65971 - DNA, 435 bp, Glycine max
  Peptide Sequence Number=SeqID_182749
atggaaccactcgctatgcgatcttccaaccatcaaggtgttgttcaagcaggcattagcactacatcgacaactcccacatctgcagccgttaatacccttgtggtatccaagacaaccactaccaatcagctagattttatcttagaagattgtgaagataatgagggagaagttccaaataacatggtgccaatactagagatggctcaagaggagaatgctgtcacaattaatgagaggcacgcaatgacttattctatacccaaaattcaacctttggtcattgggcctatgacaggcgttgaagcatttggacctcctccagtgcaatttggtacggtgcaaatggttgggtgttcgcccaatgtctcaagcactattggatttgatggaaacttgcttgtggagcttctatggaggctggatctttga

SEQ ID NO: 65972 - DNA, 1504 bp, Glycine max
  Peptide Sequence Number=SeqID_182750
ctgccagagttctgctccgccgcccacctcctctgcttcccggaggtccagctcagcctcgagaaacacaccgaagaacgtcgatttccaaacctacgataactctcagaacttctccaactacggaacgagtcgacccggcggaaccgactcgttcagaagctacgccaccaccttctccagccgtcccgacaacagtttccgccgctacagccgccgatccgccggccacgtggacagcttcgtccgctacggaggctccatcggcgacatctaccagaccttcaacacctatggcacttcctccgccggcggcgccggcgagttcaaacagtacgccaccgaatcaaacttccccgagcttgatttcaccacctactccgacagctccggcgggaggaggcagtcgttctcgagctacggcgagaacggcaactccggcggccagaatttcacgagctacggcaagaactccgccggcgccgggaacgagttctccagctacgggactagctccaacgttgaggcgtctaatttcacgaactacggcgcgagagggacaagtcccaacgacacgttcacaaactacggcgtgctgcagaacattcctgaagtgaacttccagagctacgcagagggaaccgttggtggcacggaaagtttttcaaactacagagtacaagctaacgtcggtgacgactcgtttcaatcctatgccaagaacaccaaagaagggaccaaagtggattttagaaactacgctatttccgcaaaccctagttctgatactttcaaaggctacgctaaaggagcagaaggagatcacaaggttggtttcacaagctacggcaacgacactaatactacgtttaaagattacgtcaaacagggcgtttcctttgctagttacaacgtaccttccagttccgcttctaaaactgtcagtgacagttttgtaaaaacgggtaagttttttcgcgagagcatgatcaaggaagggactgttatgccaatgccagatataagagataaaatgcctccaaggtcgtttttgccccgctatattttgtcgaaattgcctttctcgtcttccaagatttacgagttgaagcgcgtgttcaaggtgtctgataactcatccatggacaagatgatcatggactcgttcggggagtgcgagagggcacccagcgtgggtgagaccaaacgctgcgtagggatgaagggtgggaaggtgaccaaatcggtgtcgtgccatcagagcttgttcccttacttgctttactactgccactccgttcctaaggttcgggtctacgaagcggatctattgaacccggaatctaaggccaagattaaccatggagttgctatttgtcatttggacaccactgcgtggagccccacccacggtgcatttgtggcgcttgggtcgggtccgggtcggattgaagtgtgccattggatctttgagaatgacatgacttggacaattgctgattga

SEQ ID NO: 65973 - DNA, 278 bp, Glycine max
  Peptide Sequence Number=SeqID_182751
tgctgttcgtctatcctccaccctcaaatcttatccggagccccatgaattgcttgtcattcatgcatcctccaccatcgagtctggagccccacgaattgattgcctagccgctgttcgtctatcctccaccatcaaaggcgaagacggacgaaatcagtgttttatctttgctttccctcttatctccggtaaaaggtacttgacaccctttgttgcacaatacgtgaagttccgagacatgccagaaatcaaaaggaagcattgttacgcaatcc

SEQ ID NO: 65974 - DNA, 531 bp, Glycine max
  Peptide Sequence Number=SeqID_182752
atggcccagtctaactcctccaggctcggcttccctgccctcatcactaccctatgcattgccagaggagttgttccagactcattgaccttcgaatcccttagccctgccattaatttggcttatattagaaagaactgctggaacccagatgatcccacgatcactttttcagggaccctgcctccagcaccaccagttccagtaccctctgacacctccgctcagagcttagacgctatggtgccgatactgcagagccttcaccagggcttatgtctggtgatgcagagcattcataacttggctcagcaccagcccatcatcattaaggaggagtttattgcccaggtggcctggccaggagtccaaccttctcctgtggaggaaggtgaggctcctacagcccaggggctgcagccaaagccgaaggcaacacccgaggccacatcggaggagactccagagatcacacctgctgccacgcctgctgaggacacaaattatgcagtagatatggcagtagcatag

SEQ ID NO: 65975 - DNA, 336 bp, Glycine max
  Peptide Sequence Number=SeqID_182753
atgtcatcatatagtgaattcatagagcactgggtccaaatttgcactccagcaaagtctaaggttaaaacagaagcaagcacattagaattttctgagcagtgtaccaactgcgaaaaggcaattatgccatctcgtattgaagttttcttcctcactgctatgcaggaagctgtgaatgtatcacttgggaacctattgacttatccctttgtgagggatgcggttgtgaagaagaaaacacttgccttgaaaggtgcacattacaatttcgttaagggcacatttgagctttgggatctggacttcaaaatctctaactctgtatccgtttaa

SEQ ID NO: 65976 - DNA, 579 bp, Glycine max
  Peptide Sequence Number=SeqID_182754
atggatttgataggaaaaatccaccctagttcttctaaatgccatagttatattattgtggcaacaaattacttcacgaagtgggtggaggcacaactgatggtctctgttactcaaaatgacatcatcaaattcatccaaaaccaaatagcctatagatttgggataccagaggctataatggatgaccagggactagtcataggagactggaagtactcagacaaaacttcatttggaatggaaggtttcttaagtataggggtagagtcagctaatccagcagtgatagccaagggtggaagatggtggttcaccatcaaagagacatcaattatcctgacaaggaaatcggccactaatccaggaaataagaattttagggatctcattcggctgagaagaggtgtgcaaactgaccgagagatggatggggcagctaagaatcttggggatggattggaccaaaccaaattgcctcgcaaaatagtgaggaaaccaaattggaccaaaattggtgttgtactcagtgtggccatcttcaaggttgttgagaatatggacaatgcacctgtatag

SEQ ID NO: 65977 - DNA, 588 bp, Glycine max
  Peptide Sequence Number=SeqID_182755
atgattgcacacttcgaatccatacatattaatccatgggatgttgtggagaatgcaaatcgcattccatatgatgttgagcttaacgaggtccctcaaagtcaatggatgaaagagcaaaaacaaagatttctgctcaactccaaagctcgtaacgctctgttatgtgttctctttaaggacgaatacaccaaagtccagagctttagaagtgccaaaatagatgtgggacacactgcctataacatatggatggacaacataggtaaagaggaacgagctaagtctcctcacacgaaaacttatgataattatgatcacattgacaaaattttgagaagtttgtctagaaaattgagaccacagtccatgaataagaacttcaacaagatgaaggagtcaataagagaaaatctctttctcttaacactcaaagtaaggcaagcaccaacatccaaggaatccacatccaggtcatcgtccaaaagtgtgtccaaagcattgagtgtggacaactcttctgatgatgaatttgaagaagaatccaatgagaataatgagttggctttcatcgccagaaagatgtga

SEQ ID NO: 65978 - DNA, 294 bp, Glycine max
  Peptide Sequence Number=SeqID_182756
atgttgcatttcccacacttgcagtttatggtgtttgcttgctcagactctcgagtttgcccatcccacattctggatttcaatccgggtgaagcctttgtggtccgaaatatcgccaacatggttccaccatatgacaagaccaagtattcaggaacaggggcggccattgaatatgctgtcgtacatttaaaggtggagaatattgtggtcattggacacagctgctgtggaggtataaagggcctcatgtctatcccagatgatgggaccactgcaagaatctccaactaa

SEQ ID NO: 65979 - DNA, 162 bp, Glycine max
  Peptide Sequence Number=SeqID_182757
atgcctagacacggactgccagtttcaaactatttatggccttatggaaagtcaactgaccctactgatagccaaatgggcaactatggaaacaaagttactgctgagtcaaataatgtggctgacctttggactctggcctttggcaagttcgccatataa

SEQ ID NO: 65980 - DNA, 276 bp, Glycine max
  Peptide Sequence Number=SeqID_182758
atggcgaggacatgtagtcctctcaaggcgaggacgtgtagtcctctaaagattgactgtccttttgaaagaggtgataactcatgcaacctcatcctatcttttgcaaatctctccgggaactccctcagagagggaacctattgggtgagaacttctaatctgcccctaggttcacttgaggctcatgcacggtgcccctcattgccccagtgtaaggcttttgaggtaccaatcattgtcttgttttcacgacctcgtagtgaggaagaatga

SEQ ID NO: 65981 - DNA, 483 bp, Glycine max
  Peptide Sequence Number=SeqID_182759
atggagaggagtatgattgatgctgccagtcatggagctcttggtgatatgactcctgttgaggctaggaatctgattgagaagatggcgtccaactcccaacaattcagtgcaagaaatgatgttattgtccttagaggagtccatgatgtggccacagattcatctacatctgctgaaaataagaagcttgagggaaaacttgatgccttggttaacctactatctggagtcaatgagcaacttgaagcccatgttgcaaacatttataatagactccctcagcaacaaaaccaacaacaacagaataattatgatctttcaaacaatagatacaatccaggttggaggaatcatccaaatctgagatgggaaaatcctccacaacaacaacagcagcaacaacaacagtttgtccctcccttccagaatgttgttggtccaagcaggccatatgttcctcctccaatgcagcaacaatag

SEQ ID NO: 65982 - DNA, 411 bp, Glycine max
  Peptide Sequence Number=SeqID_182760
atgagctcgcttagcgcacgcggtgcgcttagcgagttcacacttgctcaacgcctctatacagctcatccttcttccagattcttctgcgcgcttagccggaggatggtgcacttagcggatggctcgcccagcacgtggcgtggctcagtgctgctagcggaagcttcaaattttttacttgcatccaaaaaatatatccatgtgcaacagagtcatggtagacgttacctatggaagatgaccatgcataacggcctcccatctgttgttcagccatggtgcgaatacttaacggacaatgatttgatgcccgaagataaggttgtgttctactacaacttcaagcaacatgtatgggaggtcatctttaggaagcagctgatatgggatgacgtcgactccagttga

SEQ ID NO: 65983 - DNA, 240 bp, Glycine max
  Peptide Sequence Number=SeqID_182761
atgagcttgacaaggaagccatcttgcggagctttggatgagattttgagagattgtgagcgagtgtccgctaagcgcaacactcctgggctaagcgcgaggaagactctgaaagaagatgagttgtacaagtgctcaatactcgattcttaccattttatactacttgtacaattcggtgcacttgccgaaagccaaacacatgcttatagggtcactcaacattgggaaatggtttga

SEQ ID NO: 65984 - DNA, 561 bp, Glycine max
  Peptide Sequence Number=SeqID_182762
atggaggaagatatttgcttacaatgctttgccaagctaacatacttcattttactgactgcgggtaagaatgaggaagaggagttcaacaccgaaccgctatttgtactcatgatgagtgttaaaaataatactcaggtactgataaattgtcagaacaacaaaaagcttctgggtcgtgtaagggcttttgacaggaactgcaacatggttcttgaaaatgtcagggagatatggactgaggtatggtgccaaagactggtaaaggaaagaaaaacgcctagccagtcaacaaggatagattcatcagcaaaatgtttctccgtggagattctgtcaccattgttcttaggaaccccaaatgagattctcttatcaacttctacaagttgtaacaggaaccctcccctttcccctttcgtgaaagcttaccctagcagaggtgttgatttagcgattgaagcagagcctgtggctgcaattacagtgacggagatctcacaagctatgattgaagagttatctctgaatttactggtagtcggcggcgtgactgcatag

SEQ ID NO: 65985 - DNA, 468 bp, Glycine max
  Peptide Sequence Number=SeqID_182763
atgcaagatctaacactgaagattgagacagtcatgagagctcaagctcaagctcaagtccccataattacacctccattcccaacctatgatagatgcaggattgtgcatgggatggcagaatgcactgttgatgatgagttagttgcaaacatcgatgagaacaattttgttgggggaagaaacaacacttttaaccagtaccccaacaatttcaatcaaggacttggcttcaggaagaatcaaggaatgcaatcaagcaacctcccttcgcaacctaaacgaaatcctaaaaaggaggatgccaatgctttgatgactagaagcaagagattcaagagaactctgagaagaatgaagatttttccccaaaagttgcagatagtgtccctactgagaaggaccaagtacctaagaaagttgaggttggggcgaagaaggaaatggatgaaaagaaggagatactaa

SEQ ID NO: 65986 - DNA, 189 bp, Glycine max
  Peptide Sequence Number=SeqID_182764
atgtatacatacattcacagtattagcttcccccaaggtaggggtaaggaagtcgataattatctagtacccgacaacgatgctagaaacttgatacataaagtatgtaaggcttgcagaagggcaagtgtaccctacacagtagtaacaatggactcaaaagttcgaatatcaaatccaaaagactag

SEQ ID NO: 65987 - DNA, 173 bp, Glycine max
  Peptide Sequence Number=SeqID_182765
atggaggctagtctatgcattccgggcaagggctttattctaaacacagagggccaaccatggaatctcctcagaaaaggtcttactaccctggctcagacatggagcgtcttctcttactcaaacctagttcctacctcccgcacttcaaatttgaacacagacagagctag

SEQ ID NO: 65988 - DNA, 630 bp, Glycine max
  Peptide Sequence Number=SeqID_182766
atgagttcccttcgtctggctttatgctgtgtggtggtagtgcttggagcactaccacacttctcatatgcacagctagatccttcattttacgatagcacatgttcaaatgtgacttcaatcgtacgtgaggtgctctcaaatgtctcccagtctgatccccgcatacttgcaagtctcatcaggctccattttcacgactgttttgttcaggggtgtgacgcatcaattctgctgaacgacacggacacgatcgtgagcgagcaaagtgcagtgccaaacaacaactcaataagaggtttggatgttgtgaaccagatcaagactgcagtggaaaatgcttgtcccggcatagtttcttgtgctgatattcttgctcttgcagctcaaatatcttctgatctggctaatggtcctgtttggcaagttccattgggaagaagggatagtttgacagcaaatcaaacccttgctaaccaaaatcttccggctcctacttttaccattgatcaacttatcgaatcatttggtaatcaaagcctcaacattactgatctagttgcactttcaggatattttctcttaatcactataagacttgagctagttagggatccaaacttagtttga

SEQ ID NO: 65989 - DNA, 319 bp, Glycine max
  Peptide Sequence Number=SeqID_182767
gttgttgtttgcgacaaatgaatactacgttcgagtgatcaacggtttcagtgacaattcctctgtgccgttggtgatttggtgtgcctcggaggagatggatcttggagggcgtgctctgcaagaacacgatgatttcagctgggtgatgaggccgaatttctggagcagcaaccgcatgaagtgcaccatgaaatggggcaatacgaggaagagcttcgaggcgtttaaggcttctagggacactgatcggtgtggccttcataggatgtgttcttggatggtaactcaaaatgggttttatttcagcaatgatgag

SEQ ID NO: 65990 - DNA, 219 bp, Glycine max
  Peptide Sequence Number=SeqID_182768
atgaagtgcaaaagcctgacagagaagaacataataaagcctgaagagaaaaatgctaagttacaagcgacaaagcaagcacgtttagagcagcaaacaatggatgacaccactaggattaataagatgaagtacctaaagtgtccctctactgcatccaatgctataaaggctgatgaagttattccaactggttcatctaaacctacgtctaagtag

SEQ ID NO: 65991 - DNA, 270 bp, Glycine max
  Peptide Sequence Number=SeqID_182769
atgttgcgttgtggtgagtacagggcagagcagaaagatgaaatgaaaggagagtgtttatctgtgctccgcgtggagacccctcgctttccacttttgtttatagcagatatcatatataagattctgaataagcgtgcctttgggcactgtttggttcctccacaacatgttaaagtgcaaagatcttcagcttttcaaaatccaaggaaagtgagaggcctaggtgttggtgtttgttgggttgttatgtcacataggatatgctag

SEQ ID NO: 65992 - DNA, 240 bp, Glycine max
  Peptide Sequence Number=SeqID_182770
atgaagaacaatgtagaagtcgattatggtcgcaattcggtagcgcctcgaccttatttttctcttctttcttctttttctctaaatttctctcaatgcaagaccttggaacccatcactcagcctcctgcacgcctatttatagcaaaagatggcattaggggtcatggccgctcgcccaggcgagttggttacttcacccctaagctatttgggggcccaggcgagccagggttctga

SEQ ID NO: 65993 - DNA, 522 bp, Glycine max
  Peptide Sequence Number=SeqID_182771
atgggatcgagtcaggcgccttcgcttaaaaagaggttctatcaagtcaaggcagcgatcaacgcttttcttgcctttcatgaccgcaaggaaagcccagttgtcgctatcttagccgatctatatgacaccttcgaccgaagatgtgaaaagagcagtgcaaggattgtttgctgtactccggccctctatatatggttggtttcgcaccttttctgccaagaggtgagacatgcttgcccgctagaatgccaccgctcatgcacagaggaaaaagaggcaagttgggaccaactcttagcaagcaaagaaggagcgtctgtcaactggttgccccgatggaaagaagtgaaaaaccgggattcttattttgtgcggaggatttctaaatgttcccttgatggggacaaggggttgcatcaattaccatcccgtcctcgctataagataacttggctaccctttgagaagggcaccactagaggaagacctcacacctattattgcacgaggtttcaatag

SEQ ID NO: 65994 - DNA, 247 bp, Glycine max
  Peptide Sequence Number=SeqID_182772
atggcatttttaggagaaactagcagtcagacgattgtcaactcaaggttggctttcatttttccaaatggatcaattattcacaatgatattggcgtttacttccaaacttcaactccggtgcccattcgagtaccaaacagctgtgattttgcaagcctaaaaaccataatacacaatacccttaagctatctgacaaacaatttttggatgaaattcattaccagaagccattcaccgatacag

SEQ ID NO: 65995 - DNA, 141 bp, Glycine max
  Peptide Sequence Number=SeqID_182773
atggtggctgcgcagcgtgactggagtagtaagccttctggtaatcgattacaggctattgtaatcgattacaggctgtctgttcttgtgaaatcgattacactgaatggtaatcaattaccagagcataaactaggctag

SEQ ID NO: 65996 - DNA, 412 bp, Glycine max
  Peptide Sequence Number=SeqID_182774
atgacggaagggtgtggtgaagggttttgccttgcaaaccttcccggtgatgcttttagtctatgggggaacttctttgaggcaaagaaacaaatgatggctgatgccaaccgttggttgaaattttgcccccggtcaacttcgtggtttttgcccgttgttggcttggctagggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 65997 - DNA, 798 bp, Glycine max
  Peptide Sequence Number=SeqID_182775
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagaaaggtggaatctccccagagaatctgttattatccaattccaattgcttcaagctggtgaagttgccaatataagaaggaagttcacctaccaaagaattcatagaaaaatctatgactctaaggcctgtacagtttcccatactttctggaatggctccagtgaaattattctgccacagaagtacctttctgaggcttgtcatggaacccaattcagaaggaatgtttccagaaagctggttttcatagagaaacaactcctccaaggctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 65998 - DNA, 123 bp, Glycine max
  Peptide Sequence Number=SeqID_182776
atggctcatttggccctgtctcagatggctgtaactgttcctgttggcagcgatttgtctctcagaagatctgcggttaagatccaactgtccggagaatctgtagttatgctagatgtttag

SEQ ID NO: 65999 - DNA, 243 bp, Glycine max
  Peptide Sequence Number=SeqID_182777
atggggactcaaagaggagtcaatgggttgtttttttgtctccctttgctatgtgtgatgatcatggagtccccctctatgcctatagctttccttctggaagaggaagagatttgggacagtgagaccccgccattgggacagggtccatgcatgataagaggtgtaaaggtgcctggctgcttggataaagaaaatgaacatgataggatgctcatgaatgcaattagcgctccttactag

SEQ ID NO: 66000 - DNA, 1578 bp, Glycine max
  Peptide Sequence Number=SeqID_182778
atggcactttctatgcacaaggactcagccaacaaccagatggactcgagcaagtatgtgaggtacacaccagagcaggttgaggctttggagagggtatatgctgaatgccctaagccgagttccttaagaagacaacaactcatcagagagtgccccatcctctccaacattgaaccgaaacagatcaaagtttggtttcagaacagaaggtgtcgtgagaagcagaggaaggaagcttctcggctgcagacagtgaacagaaagctgactgcaatgaacaagcttttaatggaggaaaatgaccgtttgcagaagcaggtttctcatctggtttatgagaatggttacatgaagcaacagatacacactgcttctgcaggtactaccacagacaatagctgtgagtctgtggttatgagtggtcaaaaccaacagcaaaacccaacacctcagcatcccaatagggatgctaacaacccagctggtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgttgatcatattgatttagatgtctggagtgtacctgaagtactgaggcccttgtatgaatcatcaaaattcttggctcagaaattgacaattgctacattcttaactatgccaaaaatcaagagtgagtacagtgggggacgccagcctgctgtattgagaacatttagccagagactttgcaggggctttaatgatgctgtgaatggatttgttgatgatggctggtcactgatgggtactgatggggtggaagatgtgacaatagccataaactcatctccaaacaaattcttgggctccaattacaatgcatcaatgttcccagcatttggaggtggcgttttgtgtgctaaggcatcaatgctcttgcagaatgttccccctgctttgcttgttcgatttttgagggagcatcgatcagagtgggctgattatggagttgatgcatactctgctgcatgccttaaagctagtccctatgcagttccttgtgcaagacctggtggcttccccagcacccagtcattttaccccttgctcatactattgagcacgaggaggtattaa

SEQ ID NO: 66001 - DNA, 359 bp, Glycine max
  Peptide Sequence Number=SeqID_182779
tgcacatcctcaccttcagagggatacacgtcctcgacttcagagggctacacgtcctcaccatcagagggttgtacgtcctcgccttcagagggcttcacgtcctcacctccatagggctgctcgcctccagagggctgtacatcctcgccttcagagggctacatgtccttgacttcagagggttgcacgtcctcacctttagagggctacacgtcctcgcctacggagggctgcacgtccttgcctctatagggttattaattaggcaagtttgtgaagtgctaatttttaccttatcgctaagccaatctactggcttagcgagtcatccgctgagcgcaaccctcctcgactga

SEQ ID NO: 66002 - DNA, 129 bp, Glycine max
  Peptide Sequence Number=SeqID_182780
atggcagagtttgaaatccacagacagaagacgaacgatgcgaggaagaaggtggtgactgacataatattcctttcattccgactatccaacgtatctcactggtctcggttcaaatttataaaataa

SEQ ID NO: 66003 - DNA, 261 bp, Glycine max
  Peptide Sequence Number=SeqID_182781
atggagaaaaactgggttttgagatggagttttgtggtggggttgatgtgtttgagcgtggaagggattggtatgaattggggaactcaagcaacccacaagtggccacaacacacagtggttcagatgttgaaggataatgggattaagaaagtgaagctttttgattcagatgactccaccatgagtgctttggctgggactgggattgaagtcatgaagtcatggtggctatccctaataatcagcttgccgagatga

SEQ ID NO: 66004 - DNA, 834 bp, Glycine max
  Peptide Sequence Number=SeqID_182782
atggtggaaatgttccctactgggaaggacagagttatggtgttattccaccgttttcatcagaatttaagcaggttctgcctcccctccccgccttccatctcaaaactaatgggtgaaaatccaaagaaacctggggctcctcataatgttcgactatattcaattgcttctacaaggtatggagacttttttgatggaaaaactgccagcttgtgtgtgcgtcgtgctgtttattatgatcctgagacaggaaaggaagatccttccaagaatggcatatgtagcaattttttgtgtaattcaaagcctggagacaaaattcagatcacaggcccttcagggaagataatgcttttacccgaggatgacccaaatgctacccatataatgattgccaccggtacaggtgttgctccattcagaggctatctacgccgaatgttcctggaatcagtccctacatacaagtttggtggactagcatggcttttccttggagttgccaacactgacagtcttctctatgatgaagaattcagcaaatacctcaatgactattcggacaatttccgctatgatcgagccctcagcagagaacaaaagaacaaaaatgggggcaaaatgtatgttcaggataagatagaggagtacagtgatgaaatcttcaaactcctggataatggggcccacatttatttctgtggtctgaaagggatgatgcctgggatccaagatacactgaagaaggttgctgagcaaagaggagaaagttgggaagagaagctttcacaacttaagaagaacaaacaatggcatgttgaagtctattga

SEQ ID NO: 66005 - DNA, 894 bp, Glycine max
  Peptide Sequence Number=SeqID_182783
atgatcgacacattctcaactggttcgttcttctgctccttgttcctaaatttcctcatggtgagttttcaaaacgaaataaccttaaagtttggcatgaaagtgttgtctgtgacattggatgattggtcagaggatgaaatagatgcaatgatcgaagttgggggaaatgtttctgctaattcaatttatgaagcttatattcctgaaggatatacgaaacctggaccagatgctggtcatgagcagcgttcaaagttcatacggtcaaaatatgaattacaagaatttctgaaaccgagtttgcgcattgtgtctggaaaaagcagtctacaatcaagttctgccaaaagtagttttatggacagttttaaaagtactagtagttcacagagaatggaaggtatggtggaatttattggaatgttgaaggtgaaagtgattaaaggcacaaatttagctatcagagatataaagtcaagtgatccatatgttgttttgagccttggccagcagactgtccagacaactataataaggagcaacttgaatccagtctggaatgaggaatacatgctgtctgttcctgagcattatggacagataaaattgaaagtatttgaccatgacacattttctgctgatgatataatgggagaagcagacattgatcttcagtctctgataacatctgctatggcatttggagatgctggaatgtttggtgatatgcagataggaaaatggttaaaatcggatgacaatgcccttattgaggatagcacagtcaatattgttgatggtaaggttaaacaaatgatgtcactcaagctccaggatgttgaatctggagaattagatcttgaactcgagtggattcctcttgagcaatag

SEQ ID NO: 66006 - DNA, 471 bp, Glycine max
  Peptide Sequence Number=SeqID_182784
atgccgtcgctctcgggactcgccaccgcgatcctcatcgcgatcgcgctacttctcgccggaacctcctcttccggccgtgatctccgtccgtcggagcacggcctcgtgttccaggcatcgccgccggccaattcctcgccagagatgaagtccttcttcagcaccagcaagggctcttcttcctcgtcctccgacgccgacacgtcgccccgcaacacgacggagtctctgccgccgccgtggtggggagtcaacggcggcggcggcggcggcggaggaagccacgtgggacgagcgctgatgatagcgagtctggtttgcggaatcacaggtggcgtcttattggtggcttcggcgttgctttatctgtttaaacaccgaagaaaaccccaccaaaacgaaccgtttcgtgcatgtaataataatgcaaacaagcttcaattagtgccagttgtgcgtaatcgttga

SEQ ID NO: 66007 - DNA, 1596 bp, Glycine max
  Peptide Sequence Number=SeqID_182785
atggctaactattcccactctcatatctgccaatgtctgagtggcttgctgaacttccggcgacatttttcagtcataattgccgaaaagcgccacaagaccggccaagagttggcggaggaagtgttgtccttggcacaaggcctactccaccttgggctcacacctggtcaagtggttgccatctctgcttacaatagtgaaaggtatctggagtggttattagccattgcatttgttggaggaatagctgctcctctgaactatcgctggagttttgaagaggcaagattagcaatcaatgcagtgaacccattgatgttagtgactgatgagagcagttacgcaaggtactcaaaactccagcaaaatgatgttccatctctgaagtggcatattttgttggattccccttcctcggattttactaagtggaatgtgttaactgctgaaatgcttaagaggcatcctgtaaaacttctaccatttgactactcctgggcgcctgaaggcgctgtcataatatgctttacttcaggaactacgggaaagcctaagggagtcacccttagtcatggagctttgatcatacaatccctagccaagattgccatagttggctacaatgaggatgatgtctatctgcatactgctccattattccatattggtggcttgtcatctgccatgaccatgcttatggttggaggttgccatgtcttgatgccaaagtttgatgcagaatccgctgttgatgccatagagcaatatgcggtgacatcttttatcacagttcctgcaataatggctagtctgatttctataattaggcacaaagagacctggcaagggggagacactgtcaagaaaattcttaatgggggtggaagcctctcacatgagctcatcaaggacactagcatattcttccacaaagctaaacttatttcagcttatgggatgacagagacatgttcttcattgacattcctgacactctatgagccaatgcatgaaacaacaagccagtcccttcaagcatttggtgtggcaggatcaaagctcattcaccagcaacaaggtgtttgtgttggcaaggctgcaccacatatagaactaaagataagtgcagatgcttctggtcacattgggagaattctaactagaggaccacatataatgctaaggtattgggaccaaactctcacaaatccattaaatccgaataatgaagcctggcttgacacaggtgacattggatcaattgatcattatggtaatttgtggctccttggtcgaacaaatggtcgaatcaagagtggtggggagaacatttaccctgaagaggttgaggcaattctacaacaacatccagggattgcaagtgttgttgttgtgggaatcccagatgctcacctgacagagatggtagcagcatgtatccaactaagggaaaattggcaatggtttaagataccaaaaacgtttattgtatggaggaagccatttcaactcaccacgacagggaaaataagaagagaccaagtcagaaaagaagttatgtctcagctgcaatctttgcatagtaatctttga

SEQ ID NO: 66008 - DNA, 207 bp, Glycine max
  Peptide Sequence Number=SeqID_182786
atgtcttttttttttttgttttttgtgcaactttttttttctggctctgtatggtggtgtagggaaaaagtggcaatggagagctctgctgctatggagggtggtgacaggatttacgataatggtaaagacgatgcgagtgtgggcgatcactttgacatacttaaggatatgactcctttctggaggacctcgatgagcggttga

SEQ ID NO: 66009 - DNA, 303 bp, Glycine max
  Peptide Sequence Number=SeqID_182787
atgttcgcaacacaattccgagcattctcaccgttgggaatttcgatatcagcctttttctttcccgcagaaacccagagctgtcttggtaaaactacgatcccggtttcgttaaccgttggattattgttaaatttggatatgttgttcgaaattcaattccgcacgcttccaccgttgggatttgcgagacaatattcgtgtagggagaaaaaggaatcgtatgaagacagtacaagtggaggtttcaatctcttctccgtctctctgacgtttgggaattctatcggagcagtcggatga

SEQ ID NO: 66010 - DNA, 1419 bp, Glycine max
  Peptide Sequence Number=SeqID_182788
atgagaaatttaaaggatagattggacttcttacaatcggagaatcatcaactgaaggacacactatcagataagaagaaggaatttaagagtctatcttcccagctttctgcttctgtggaaaaattgtcacagcaacaactgacacagaaaaatttgttacaaaccattcagaagcttaaggatgatatagaggatgcacatactcaagtttcaataattcaggatgtatataaatgtttctttgaagatattgtgagtgagtttagatgcagcactgaagaattacatatggagaatagtttcatgcaagaaatatatgaagtaatattcaaagaagcttcccacagtgctcaagcttctagtgggttgggaattgaggaagctgaaatggagtcaactattttgcaagggcaattagatattaatcatattatatttaaagaaacattggtgaatgcaggtgaagcattaaaattggaaagtgctgagaaagagaaactaaaatatgaaatgcttatgatgaaatcagtagtggaggaaaaggaaaagttaatccaaggaatagtagatgctttggttctagaaaaacaaaaaacggagtctgcctctgaacagcgtaacagtttaagagctgagatagttcagcaacataaattaattgctgagaaaagtaaagaattggatgtcactaagggtaacctggtggcagctttgaaggaaattgaacaagacaaggagcaagtgcaagagctacgtcaaaatcttgaacaaagaatgatcaagcttaaagaaactgatgaagaaaaaagagtgctttgtgctcttacacaaaagcaacaagaagcactaaaactgattgaggcaaaagaaagggaaagcaggaagcaaatggaatcaaccattaatctcatccataaattgttggcaatgattactgattttgaagctagagtaaataaagatatttcaagaaattgtttgaggcttgaaaacatgagatctgagttccattggatcaagaacaaagccaatgtacttaaaaccatgggtatggtgtacaagcaaaagctagaaacaaaatcctctgatctctcaaaggctgaagcagagggaagcaaaaagctattggagaggtcatgtaaccctcgtgccctcatgggcaaaaaaaagtctcatgggtggttcaaatgggttgtacttgttgatcttttgggggatgaggtagatactcttcttagcctccttgaaaaaatatacattgcgcttgatcattattcacctatactgcagcattaccctggggtgagaatctgtccctttctgcatatttgttctttgtacataattgagcttggacttggaatgggagtttttttgtttataacatacatgggaatccctcattccatgaaatga

SEQ ID NO: 66011 - DNA, 2316 bp, Glycine max
  Peptide Sequence Number=SeqID_182789
atggggagtgttcttggggagggacactttgttgtgctgcttttggtgatggtgtctttgacagtgagcactgtaaatggtcaaccaaagtctattctcttgaattgtggttcagattcttctgtgaatgtggatggtaggagatgggtgggggacatggccactgataacaatgtcaccctaagttcccctagtgttgttgtttccacttctacatcaagtggcagttcaatctatgattctctctataaaactgccaggattttcaactctcctttgaattacacattcaaagatgttcagggaaactactttgttaggttccatttctgcccctttgagactgatgactacaatgtgaatgagtcctcatttggtgttgtggtcaatagtctgaaactgttgtcagagtttgatgttccaggcaagatatcccacaagaatatgaacttgctgaattctggaaggaatgctagttcattgttcttggtcaaggaatatattgtggctgtcaatggggatatgcttttgattgagtttgttccaaccagaagctcctttggcttcatcaatgccattgaaattgtcccagttgcgggtgagctttttgctggctcagttagtagagttggtggaagtggtggaaacatgaatttgccgggacgagggatggagactatgtataggttaaatgttggtggtcctgagattcagtccaatcaggatcatgatctttggagaacttgggaagtggattctggctatatgatcacagaaaatgctggttctggaattaagaacagttctaacattacatatgcttctgtgaatgatactgcggtggctcctctccttgtctatgaaactgcaagggcaatgtccaacactgaagtcttggacaaaaggttcaacatgtcatggaaatttgaagtggatcccgactttgattatctggtccgtttacatttctgtgagctggtttatgacaaggccaacgagaggatatttaggatctacataaacaataagacagctgcagataatgttgatgtgtttgtgcgcgcgggagggatgaataaagcgtatcaccaggactattttgatcctgtgtcgccgaggattgacactgtttgggttcaacttggtcctgacacggctgctggtgctgcaggaactgatgctctcctgaatggtctggaggttttcaagcttagtcgaaacgggaatcttgcctatgtggagaggtttgacttaggtggcaattcaggaaacaaatcaaaagcaagagctatttgggtgggagttggagcaggtgtagcttctgtagctatagttgcacttatagttggtcttgttttctgtttctgtaacggcaggaagaaacaatcaagtgataccaagaacaaccctcagggttggagaccattgttcctctatggaggggctgctgtgaacagcacggttggtgcgaagggatcagcaggtactcaaaagccttatggatctgtgggctcaacaagagttggcaagaagtttacattggcagaaatcaatgctgcgactaacaacttcgatgacagtttggtaattggagttggaggctttggtaaggtgtataagggggaggttgaagatggtgttcctgtggctattaagcgcgccaacccccagtctgagcaaggcctggctgaatttgagacagaaatcgagatgctgtccaaactcagacacaggcatttggtgtccttaattggtttctgtgaagagaagaatgaaatgatcttggtttatgagtacatggcaaatggaacacttagaagccacctctttgggagtgatcttcctcctctatcttggaagcagcgtctagaagtgtgcatcggtgctgcaaggggacttcactaccttcacacaggagccgaccgaggaatcattcacagggatgtcaagacaaccaatatactgctagatgagaactttgtagccaaaatggctgattttgggttgtcaaaagacggaccagcctttgaacacacccacgttagcacggctgtgaaaggaagttttggttatctagaccccgagtacttcagaaggcagcaattgactgagaagtctgatgtatactcctttggtgttgtgttgtttgaagttgtttgtgctagagctgtgataaaccccaccttacctaaggatcagatcaaccttgcagaatgggcaatgagatggcaaaggcaaagatcacttgagacaatcattgactctcttcttagaggaactattgtccggaatcattggcaaagtatggagagatag

SEQ ID NO: 66012 - DNA, 168 bp, Glycine max
  Peptide Sequence Number=SeqID_182790
atgggcaacattggagtgctaacgggatcacaaggagaaatccgatcgcaatgtaattctgtgaatggaaattcttccggacttactactactgccaccaaagaatcatcacaagatagcatgcattacatagtggaaacagtagaaaatattttcataggaatataa

SEQ ID NO: 66013 - DNA, 938 bp, Glycine max
  Peptide Sequence Number=SeqID_182791
cccatgggctcaaaatcaaccctaaggctaatgagaaccctaaggccttcccttggatctttggcccaatctacttggagtcttctatccaatgcccttgcagggtaaaagtgggtatgggcatggccacctttatccatgataagttggtgactttactgcgagactaccaagatatctttgcttggtcgtaccaagacatgcttggcttgaacgctgacattgtgcagcataagttacccttgaatcttggatgctccccggtgaaacaaaagctaagaaggataaggcccgagatgtccttaaagattaaggaggaagtaaagaagcagttcaatgttggcttcttggctgtggcccgataccccaagtgggtggccaacatagtgcctgtcccaaagaaagacgaaaaggtacggatgtgcatggacaatcaggaccttaaccgagcaagtcccaaggataactttcctttatcgcacatagatgtcctcgtagacaacaaggccaggacgttctgttataaggtgatgtcctttggactcaagaacgccgggccaacctatcaacaggcgatggtagctttgttccacaatatgatgcatcgagaaatcgaagtctacgtggacgacatgatcgccaagtccaaaactgaagaggaacacctcatcaacttacggaagttgttcgagagactacggaagtaccagttaaggttgaaccccgtcaagtgtactttcagggtcaagtcagggaaattgttgggcttcgtcgtgagtcaaaaagggatagaggttggccccgagaaagtaaaagccatccttgagatctcacagctacctacgagccgttcttcaagctctttcacaaggatcagtccattcgctggaacgatgactgtcaagaggcagttggaagaatcaaatagtgcctcatga

SEQ ID NO: 66014 - DNA, 456 bp, Glycine max
  Peptide Sequence Number=SeqID_182792
atggcttccaacaaaacttcttttcatccggctcttgccgtttcaaacatcaggaatcatgtttccattgttcttgaaatggaaaacgttcaatattcgacgtggacggaactcttcaagattcatgcacgctcaaccaaggtgcttgatcatatcatacctccggccaacggcacggggatgattccttctaccgaggaagagagggagctatggtcaactttggatgccacagttttttcgtggatttatgctaccatttctagtgacttattgcacaccattattgagctcgactctacggctatggaggcttgggatagattgcgtgatatattccaagataatcaacattctcgtgccattaccttggagcaagaattctccgctacttctatggagaattttccaaatgttttctcttattgtcttcgtctcaaatctctagcagattaa

SEQ ID NO: 66015 - DNA, 795 bp, Glycine max
  Peptide Sequence Number=SeqID_182793
atgatgacaaaggtgatgaacaaaaagctcaaaagatcaaagaacaactcaagtgaatcaaagaacatctcaagtgaatcaagaacaagtcaagagttcaagaatcaagaagaattcaagactcaagaagaaagcctatcaaagaacaactcaaggtacatctacttgggtttgactgagaacaagagagggtacatctcttgtggatcagttctagtggagggtacatgcactagggtttcaaagagaacaagggagggtaggcacgggttgttgcagaaccagtataaaaactcttgtgtgtttgtttccttcttccctactcttttactttccactgccactcgatccaacacttcggtgtctgatagtcgactggtattgcaattggttgggggtcttacacaactgtaccgtggagtgggtgcgttgatccgtcaaagcaacccccttcctcccttttacaaggctcgttccatgctcactcttgaggaggccgggatggcaaaggaagcagccactgagtctgctatgatcgcctcttcgattaatgatgggtccccacaacttacaaaattaggacattcgaagggaaaaaatggtgcgcaacattctggtggcggacaacgcaacaacgggggaggtcggaagaatgtaggttctggtggtggccagaactcgaccggcggtaaaggcggtggtcgggggcagtcctctggtggccacgatgaaaccactcctccgcaatggcagcaacgacaaccattttcatggggatggtataatcctacctag

SEQ ID NO: 66016 - DNA, 1479 bp, Glycine max
  Peptide Sequence Number=SeqID_182794
atgcacaccatgtcccttaaccaacccgacccgtcatggtacatggacaccggtgctacatctcacatgacttcctctaccggtaatctcttgtcttattttaatttaaacaatcatcctaatactaatattattgttggtaatggtcacacgattccaattcttggctatggtcatactaatttgtcttccccgtgtcaatccctctcccttaacaatgttctttatgctcctaaactgattaaaaatctcgtttctgttagaaagtttacaaaagataattcagtgtctgttgagtttgatccctttgggttttctgtgaaggattatcggacagggatgtcaataatgagatgtgatagccgcagagacctgtatccaatttcctattccctcaacaatcaagcttcctcttctacatttgccgccatctctcctaagctttggcatgatcgtttgggtcacccagtgtctcctatcttcgatgtgctttggaagaataaaagcattgattgtaataaactttctagttctagtatttgtggttcatgtgttcttggtcagaaatctgatgtgtatgacatatttttgacttttaaagcccatatttctactcaatttgagtgtaatataaaaaatgtccaatgtgataatggtagagagtttgctaataattctttttggcatttttgtcaaactgatggcatgtcattacgtctttcttgccctcacacttcttctcaaaacgggaaagccgaatgcaaaattcagactataaacaatatgtctcatactcttcttgctcatgcatctcttcctccatcattttggcatcatgctctccaaatggtaacctatcttcttaatgtgcttccaagtaaattgttgggaaataagtcttcgcttgaggttctttacacaagggtcccttcttatgatcatatccgggtttttgggtgtttgtgttaccctctcattccgtctacaactattaataagttgcaaccaaggtctactccttgtgtcttcctcgggtatccaacccaccatcgtggttacaagtgttatgatttgtcgtctcataaaattattatttgtcgccatgtcttgtttgatgagcatacttttccgtttgctagtttgcattccccaaaatcccatacatatgatttcattgacgaaggattatccccttatgtcattcaccatcttcaccaacttactccaactccttcttctcagcccaacgtgccaagtgagcccaactcatcccctcctgacccaatttcctcacaaatcactcctgcccaaacacaaatcgatccctttcctactaattctcctatccaacagtctagggtcgtgacccatagccagcatgggatatataaacccaataaaaaatattccatgcatactacggttgagaggtctccattgcctcgaaatccaatcacggctcttcgtgatcctaattag

SEQ ID NO: 66017 - DNA, 360 bp, Glycine max
  Peptide Sequence Number=SeqID_182795
atgaagaagatcctcatctggatgtccatgggggaatcgttgttcgctctgcacaatttgttgaaacaactcaagtgggtgaccggagactcgctcgacgtgccacgaaagacgggtaatgaagcaatctcccataggaagaagaatttggtgaacggttgcgaagatcagaagtggagattgaaggggtggtttagggaacccgtaatgaacctgccacctgacaatactcatggaagggctgagtcagcagaagagagaggaaaggagaagttaggtacaaatgatccaagaaatgtgggtgtgaggaaaggtagcagagtgctcctagccaatagcaggctgagggattttgggtga

SEQ ID NO: 66018 - DNA, 1488 bp, Glycine max
  Peptide Sequence Number=SeqID_182796
atgcaccatatgcaactggcaaaggagtccaagttcaatcgcatcacagaagcattgacaactttgttgcaacgccaaacgccccctccagattcttcccatgttggttcgaactcaccgaaaccatcattccaagtgcgctctgttaagcttgattttccgcgttttgatggaaaaaatgtaagggattgggtttttagagtagaacaattctttgattattatgaaacgcctgattatgatcgtttaaccattgctttggttcatcttgaccaagatgtgattccatggttcaaaatgatgcaaagagctaatccttttcccttttggcgagttttcacaagggccctcaagatggattttggtccttctgttcatgagtgtcctaaatccactttgtttaagttgatgcaaactggtactgtgaatagtatatggaatttacagcccttactaacagagtggacgtttaaagtgaacatatgcagcgatgtccgagccatgtcccctactactttgcccaaagcagcagcactagccaaattgtttgaggaatggtatgaaccaaattccaaaccaaaattctccaatagccaagccagaacctcaaacaccaaccagccttacccgaaatactcttacaaccccatcaaggccgatgttccaaacaccaaccccaaagctaaccaatcacccttattacgtaccccaaattccaaaccattgaaccaaacccaaaacaaaccaaagattaaatacatctcccaagccgaaatgcaagttaggagggataaagggttgtcttattggtgtgacgacaaattttccttctccctcaaatgtcccaacaagcagctcatgatgttgcaacttacagatgatagtgatcttaacgaagagattaaaccacctgacatagacattgctactgctgaaatgccacgtggggcacaccacctatctcttaatgccatgaagggattccatggtgttggcactattcgatttactggtaatattggaaacattcgagtgcagattttggttgatggtgataattctgaatcgttcctacagcctagaattgcaatgttcctcaagttaccaattgaacccgagcctcattttagggtcttggtgggaaatggccaaataatggaaactgaaggatgggttaagcagttggcagtagacattcagggacaaaaattattggttcctgtatatttgctacctgtttcgggagctgaccttattctgggatcaccttggctagccacactaggtccccatgttgctgattatgcagccttgacactcaaatttttctaccatgggaactttcttacattgcagggagaagtttccagtactcctactcaagctcaccttcaccaactcaaaaggttgcatgatactagtgccatttctaatagttttgctatccacatgatgcaacatgataatcctgatgacattcttacttag

SEQ ID NO: 66019 - DNA, 387 bp, Glycine max
  Peptide Sequence Number=SeqID_182797
atgaaagaagtgatttatgatgaagaacaaaacaacaacgcaacaaaggtaaatgttgcaggcacaaataacaataacaagaacaatggtgagaaagtgaagcgaagggatgttgatagtgtgtgggggtgggagcatgggcgcgcaacagcaggggagtacttgaaagggttgcgtctcagtgatgtggggaccaaagaaagagaaagggagaagaaggctttgttttgggaggaggctatgagtgaggtgcttgtaggcctaggatcttcttcatcaatggattttgcttcttggaagatgaatggcagcggaatggagaaggaagagagagaggagacgccacttcaaggagaagatgagtatagaagaagctcaccaccatag

SEQ ID NO: 66020 - DNA, 300 bp, Glycine max
  Peptide Sequence Number=SeqID_182798
atggatttggcttcattcagtcatatggtttggactttaatcttagttaatgtccttagcatcattttcttaaataagaagactgcaatgtgcaaatactttagcaccatttctggttacctttcttctccagctccagggacttcagttttttggccattgaatgatattttggtcttatataacagtaacattaacttttatgttagaggtgatagaaagccaataggtgtggaaggaccagtgatagtgggtgctggtccatcaaggcttgctgcagcagcatgtgttaaacagtag

SEQ ID NO: 66021 - DNA, 615 bp, Glycine max
  Peptide Sequence Number=SeqID_182799
atgataatgatacatttaactgaattttccaacttcttgaacccgtttggcgcatccagctcgccgtcggcccggattcgggctacccaatgccaatgctctgacttgcaaaagcggcttgagtcaagtcgtgacaaggcgcgagccaagcttcaattagttgctaggttaaaatgtggctcggcttgcctttttgtggtaattacagcttcatttgttgtgattcttgtgactcatggctttgcaatgattgtggctgtgtcgggattggcttccatgaatttggcttcagaaaggaagttggctaaagtgacatctcaacttgatgcagccacgaaaggaacttatatagttaataaggacttggagacaacaagtcgacttgtggctagactaaatgacgagttagagtacatgaaaacaacaatgagattttggcttgagagaaaaaaggataagtttcaagccgatggtgaagtgatgcgcttgttgaagaagaaccaatgtagttttagcgatcaattggatgagttggaagaacatttgtttttatgttttatgactattaatagggctagagaccttgtgttgaaccagatcactaactcaacttga

SEQ ID NO: 66022 - DNA, 447 bp, Glycine max
  Peptide Sequence Number=SeqID_182800
atgggtgaagtaaaagaggcgcaagagcagatggaggccgacatggaggccatgaaagaacaaatgacaacaatgatggaggccatgatgagcatgaagaagataatggaagccgatgcggttgcagtttccgctaccagcgctgttgctagggtgaacccgatgcccccatatgatctcaaccaaatgaatcatccaaccttagatatggtgggcaaagatttgggaagtacggacgatcccatgatgtgcaaattcaaaatgagcatgccttcctgccatatgacttacctcccaactatacgccacccaatgtggcgtacactcccaatgagaatgtcaataactccactcctatacccattgagagccaacaaccccaaactgatcatgcacatgtctcttaaaccatgggggagacgcatgaaattccctaccacaatctag

SEQ ID NO: 66023 - DNA, 375 bp, Glycine max
  Peptide Sequence Number=SeqID_182801
atggagaaacattccacactaaacgaaggaaaaccagaggcatcaggtagcaagaaaagaaaaaccagaggcaacaagaaaagaaaaaccagagaagaaataggaagcaaagcctacttgccggggaaggaaacgaatgcggcaatggaggcgcttgcgggaacaagaaggagaagacacagaacggcagaagaggtatttttttggctcttaatgggctgcgacgcgcgtgtctacgtggtgggccgcgtccaaccagaggtgtcttcttattcaaccgcgtctggtgacggcggaggcgacggacaccgtgtcgcaccggagtcgtacgcgcatgcgtgtccggtgcgagtccgacgcgggacacgccggtga

SEQ ID NO: 66024 - DNA, 234 bp, Glycine max
  Peptide Sequence Number=SeqID_182802
atgattttaccctttccgtgggtcccacgctgttcccgctctaaagtgagggcacacttgttgaagatgacaggaaagggagttagagtttgtcaaaaggtaacagttgccaaacttatagatttgaagaagatagacaatgaggctacattgagggtggagaggtcaaaacaatgtgtcattgcctccggtttctactcaacaccaaatggatacaaacactcttggtgttga

SEQ ID NO: 66025 - DNA, 183 bp, Glycine max
  Peptide Sequence Number=SeqID_182803
atggcttggcttcagtggattgttagccagttgcttttctcccttgaccttgctactttcatagccatagcaggaagcctggcaactttctttcgagacatggttgaagaaaaggctaatgccctgactccaacggcgcctactccttcccctaaagcgggtgttgtttcggggcactcttag

SEQ ID NO: 66026 - DNA, 354 bp, Glycine max
  Peptide Sequence Number=SeqID_182804
atggaatctggtactccaaaaacctttgactggaccagcagacttgggatagcaactacaattgctgaggctttatctttcttgcatcaagagctatgccatcatggtattgttcgtggtaacctgaaatcctccaacattttgctaaacaagaatatggagccatgtataagtgaatatggtgttatgggtatggatgatcaaagaggttccctttttgccagtcctattgattctggtgcattagatatctttaaggaagatgtttatggctttggtgtgattctacttgaattgcttactggtaagttagtgaagggcaatgggattgacttgactgattgggttcaataa

SEQ ID NO: 66027 - DNA, 303 bp, Glycine max
  Peptide Sequence Number=SeqID_182805
atggggagagtgggccaacgccgcaacaagttattagtgaaggacccaaggcaggaccatcaaggcaaacacacagcctcgtgtatgacacccaaattcaggaatagggaagctcttgaggaatttggatctagtagaggaaacagacaaggagacccaatttctccttatttgtttgtcttatgtatggaaagattgagtcatattatctcggtggcggtggataataacatgtggaagcctattcagttgggaagaaatggtcctaagttgtctcacctagcttttgtgtggttcacctaa

SEQ ID NO: 66028 - DNA, 609 bp, Glycine max
  Peptide Sequence Number=SeqID_182806
atggaattatatcatgagacattcctccggcgtgcaggtgctatgataggcattgttctgaaaattgataagctaacgttaattcactctcgagggaagttcgcacgtatatgcgtcgaggggttacacttctgtttcaagtttggtcagtatggacacaaggctgcgcaatgtgttgatggtatggcggctgaaggcaaaaaggaaccagaagtgcaagctgctaaggaaggtgagtcagttagggctgatgtcataagcaataatggggtaattaatgtggaggtgccaaatatggtaactggtgaagtaaatatggtaatgacatccaatcccaatgatttcgagccatggatgattgctatggcacgtgtgggtctgcgcattgctggtttagtagtgcctggtgctggaggaatgggcttgatattgctatcaataccctccccacaaaaacagaccttgtcctcaaggtcatacgcagcttgtaactcaggtcagcgttccaaagtggcatcttctggaggagtgcctggccctcggatggatctgccccgtggtgtgggggcagttgaagacgataggcaattgcaccgaggtgctctatga

SEQ ID NO: 66029 - DNA, 1266 bp, Glycine max
  Peptide Sequence Number=SeqID_182807
atgttaggttgcgctacattaggggttatgatagtaatatcgggcccattcctccagcatcgtccaattgcctttttcagcaaacaattatgcccgagactacaaaaagcttctacctacgtccgcgaacatcatgcgataaccaccgccgtgtgcaagtggtgccattacttgctagggcaccattttgtcatcttaacggaccatcgcagtttgaaggagcttatgactcaatataagccgagaccctccaatgtcgttgatgatgccttgtccaggatttcggcctccacttcttcacttatgatcctatccgtaccgcacaacctcttcttggatcaactgaagcaaatgtttgtgcaggatcagacttaccaaactctcctgcaacaggtcctcacttccccacaggatcaccctggtttcaccagcaaatcacacttgctttacttcaacaacaaaatttggttacccgccggccatgatctcactaaggtactcatggacgagtttcaccaaacacctcttggcgggcatatgggtgtcaccaagacactcgatagcattcaacaacatttttcatggccacatatgtgtgccgatgtcagccattatgttgctcagtgcaccacctgcccccagattaaatccgaaactcgcaagcctgccggtctcctgcagcccctaccacaaccctcgtcactttgggctgacctttccatggacttcattacaggcctccctccgtctcacgggtacacaacaatcatggttgttgtcgatagattctccaaaggtacccactttggtcctttaccgacacactatacagcccacaaggttgttctgttattcttcaacttggtctgcaaaatccatggtttcccacgcagcatcatctccgatcgagacctcattttcctcagtgcattctggcgtgaattattcagggtcagtggtaccaagctccgctttagtacggcttaccatcctcagtcggatggtcagatagaggccattaatagggtgctggaacaatatttgagggctttcgtccatgatcgaccccgacaatggttcaactacttatctctagcagagtggtcttataattcctctgttcacagtggcactggtttttccccgttcgaagtcatgtttggtaaacctcccccaacattacccttatatgcagcaggcgactccccagtggaagctgttgacacattgctcaccttgcggcacgatattcatctcacactctag

SEQ ID NO: 66030 - DNA, 297 bp, Glycine max
  Peptide Sequence Number=SeqID_182808
atgtctgtggagggagaaagatgcattacaaataggaccatggaatggaggcttcaatcctttctccttctctctaacatttggaaaccctatcagagcagtcagagggacttgaggaatctcaggaaaccgctagagatgccgctattgttgtcacaatacacacgtgagccgcttagagttgtgagctatgaactactcaatcacacaattgtaagatcttttaagagcgacgagtattgttatgggatccattgtaggaacccggcgagtttaatcacaagcacaacgagttaa

SEQ ID NO: 66031 - DNA, 216 bp, Glycine max
  Peptide Sequence Number=SeqID_182809
atggcaccgaaggacatggagaagacgaacttcgtcaccctatggagaactttctactacaaagtgatgtcctttgggctcaagaacgttggggcaacttaccaacgggctatggtagtactattccacgacatgatgcacaaagagattgaggtctacgtggatgacatgatcgctaagtcaaaaaccgaggaggaacaccttgtcaatttatga

SEQ ID NO: 66032 - DNA, 382 bp, Glycine max
  Peptide Sequence Number=SeqID_182810
atgtcaacgtcttacagccgagatttttttttgtctcacacttttgttaccctgacccgtgaagtcaagtggcaggcggagatacccgagtggttatccgtacaaagacaacttctgttaatcctgacccgtgaagtcaggtggcaggcagagatacccaagtggttatcagtacaaagacaacttctgttaatcccgacccgtgaagttaggtggaaggcggaaataccccaagtggttatccgtacaaacacacttctgttaatcctgacccgtggagtcaggtggcagacggaaataccccaagtggttatccgtacacacacagttctgctaccccgacctgtgagaagtcaggtagcacgcggagacgccctatatg

SEQ ID NO: 66033 - DNA, 278 bp, Glycine max
  Peptide Sequence Number=SeqID_182811
atggcatctaagaagaggaaagctccatctacacctatccagaccagatttgataggtccagattcacatccctagaggcttgggagagatacactaacattgtggtgcttagaaagctactaccagagaggaatgtggtagtctattacacagagtttgatgagttcaaggaggaactcgagagacgccattgggatgagaagctgactggtttctctgatagtagcatagacatcgatattgtgaaggagttttatgccaacctctatgaccccga

SEQ ID NO: 66034 - DNA, 117 bp, Glycine max
  Peptide Sequence Number=SeqID_182812
atgttctgtttgttccagcatatcacaagaagtttctactctactggtgttggaggattgagatgctatgagaatccaaagaataagattactgcagtacctgccgaggaagagtaa

SEQ ID NO: 66035 - DNA, 615 bp, Glycine max
  Peptide Sequence Number=SeqID_182813
atggagggcagtgacatatccagagttgatagtgcaagagccagtggttataacatatggaggaacaacagcatggatgttttctcaacatctgaacgcgaagatgacgaagaggctctcaaatgggcagccatagagagactcccgacgtatcttcgcattcggagaagcatactcaacaatgaagatgggaaagggagagaagttgacatcaagcaactaggcctgacagagagaaagtttcttatggagaggcttgtgaagatagcagaagaagataatgaaaggttcttgttgaaactcagggaaagaatggacagaagtgcatacgaggcgattgtggtagaacggcataagcctctgtccaaaaataacattgcttccatacagtatcaatgcttttacaaaaaaacagaacatgcgacaattttccccccttcactattacaaaaagggcagagtattgtgtcccgacgtctccttaaagcaattcacctagtcatctgctcccccgaacacaaagttcaagatcatcacaggattcaaacacaaacaacacacaggaagtgggttatcacattcctaactaatggagagaaacaagataacatgtag

SEQ ID NO: 66036 - DNA, 195 bp, Glycine max
  Peptide Sequence Number=SeqID_182814
atggctggacttttgggatataggagccttccacctaaggcaaagaatttggtagttgttgggggtttgacaacttttgtctttggtgcctacttctacaccatgagggttgttggaggcactgatgaactgcagacattgcctcttgttgatggagttgatagcaccaagcagaaacatgatgaaaaagaatga

SEQ ID NO: 66037 - DNA, 444 bp, Glycine max
  Peptide Sequence Number=SeqID_182815
atggcggagctctatggtctgaacatgatggcggatggaatccaagacgatccaagcaacgtcacgcggttcgtgatgctggtgagagagcctatcattccgcgcacggaccgtcctttcaagacgagcattgttttcgcacacgacaagggaactgatggaagcttgcttcccaatctacttggagtcttctacccaatgcccttgcgggataggattgcatcaggaacttccgtgctcttcaaagtgctttctgtgttcacattccgcaactttagtctaacgaagaccgagtcgcggccgcatcagaaccgtccaattaggctcgtggatgacgcaaacgcctccgtggctaaggttaagacagtggaaaagtgtgagatgaagagagtggtgggaagggaagaagggaagacacttggaggggagctcgagaggctttag

SEQ ID NO: 66038 - DNA, 1653 bp, Glycine max
  Peptide Sequence Number=SeqID_182816
atgggtgtaactaaggatggtctttcaaaccctgttggtgatatagtatcaaatgttggatcacctcttcaagcaggtggccccgcttttccacgcagtgatacagatatgctaatgaagttgaaactggcgcaattacaacatcagcaacagcagaatgccaatccaccacagcagcaactgcaacagcatactctttcgaatcagcaatctcagacatcaaatcatagcatgcatcagcaagataaaatgggaggaggtggtggtagtagtgtcaatgtggatggtagcatgtcaaattcctttagaggaaatgatcaggtttccaaaaatcagactgggagaaagagaaagcaacctgcatcttctggtcctgccaatagttctggaacagctaatacagctggcccatctccaagttcagcaccctcaactccctcaacacatacacctggtgatgtgatgtcaatgcctgttttacctcatagtggtagctcttcaaagccattaatgatgtttagtgctgatggcgctggaactctgacatcaccttcaaaccaattgtgggatgataaggatcttgaattgcaggctgatgtggaccgttttgtggaggatggatctcttgatgataatgtggagtcttttttatcccctgatgatacagaccttagagatactgttggtcgttgtatggatttctccatcatccggttggcctgctccaaaaagctcagcattgttgagtttcagagtttcacattttctgaaataaattctgtacgtgcaagcactaccaaagttggctgttgccatttttcatctgatgggaaattgcttgctagtggtggccatgacaaaaaggctgttttgtggttcacagattctctaaaacagaaagctactcttgaagagcatgcatctttaatcactgatgtccgtttcagtccaagcatgcctcgtcttgcaacatcttcacatgacaaaactgtcagagtttgggatgttgaaaatcctggatattcgcttcgtacctttacgggacattcttcacctgttatgtcactagattttcaccctaataaagatgatcttatctgctcttgtgatgctgatggtgagatacgatattggagcattaacaatggcaattgtgctagagtctcgaagggtggcgctgttcagatgagatttcaacctcgcctagggaggtacctagctgcagctgcagagaatgttgtttctatacttgatgtggaaacacaagcatctcgatattcactaaagggacatacaaaatcaatacgttctgtgtgttgggatccttctggggagtttctggcatctgtcagtgaggactctgtcagagtttggactcttggatcagggagtgaaggggagtgtgttcacgagcttagctatgacagtagggaagggctgaggatgtccttggtggagggagagaatcgtaggggtgcttcagtcattaataactcaattttgtttgtgtcattggagctctggaacatgactgagaacaagacgatgacactatctgctcatgaaggtcttattgcggcattggcggtttctactgtaaatggtttggttgcttcagccagtcatgacaagtttgtcaagctctggaagtga

SEQ ID NO: 66039 - DNA, 180 bp, Glycine max
  Peptide Sequence Number=SeqID_182817
caagatcgtggcctgagtcagtgctggcatgtcccgccaaaacgaatagcggaatgggggaggggtgtatcgccagcacgaatggcgggcttggatgaggctgtatcgccaatcctgaaggcgagtcctacgtggcctgtgtcaccaatgcaaaaggcgacactctcctctcctacatga

SEQ ID NO: 66040 - DNA, 390 bp, Glycine max
  Peptide Sequence Number=SeqID_182818
atgtctcagactaactgggaagctgataagatgttagatgtttacatccacgattacttagtgaagagggatttgaaggcttcagctcaggcttttcaagctgaaggcaaagtgtcctcggaccctgttgctattgatgcacctggaggatttctgttcgagtggtggtcggttttctgggacatatttattgctaggacaaatgagaagcactcagaggttgctgcatcttatatcgagggtgctggctgggtgactggcaagtgttgtggctatgggctgattggtgggagccctgtcacactgcagtttgctgttgcttctggagtagcgttaatcgcggctgctatcgtggccatcatgaccgctactgaccctattttcatctaa

SEQ ID NO: 66041 - DNA, 780 bp, Glycine max
  Peptide Sequence Number=SeqID_182819
atgaagggattgcctagggaaaaaaaactgaggcactgcttgaagtttatggcgagagagcaacagcagcagcaacagcaacagcaacagcaacagcaacaagggcagcagcagccacaacctcagaagttgcaacatcaacaacagcagcagcaacaacaacacatgcagatgcaacaaatcctattacaaagggctcagcagcagcagcagcagcaacaacaacagcagcagcagcagcagcaaccacaacaacagcagcagcagcagcaaccacaacagcagcatcagcagcagcagcaaccacaacagcagggtagggatagggctcatctcttaaatggtggtacgaatgggttagttggaaaccctagcacagcaaatgcactagcaacaaagatgtatgaggaaaggttaaaattgccccttcaaagggactctttggaagatgcagcaatgaagcaaagatttggagaccaaatcttagacccaaatcatgcctcaatattgaagtcatctgcagctaccggccagccttcagggcaagttttgcatggtgctgctggtgcaatgtctccacaagttcaagctcgtagtcagcaattaccaggatctactccggatataaagagtgagatcaatcctgttttaaatcccagagctgccggccctgaaggatcattgatagcaatgcctggttcgaatcaaggtagcaacaatttgactctgaaaggatggccactcacaccattatcaagtggcagaaatagccttccttaa

SEQ ID NO: 66042 - DNA, 585 bp, Glycine max
  Peptide Sequence Number=SeqID_182820
atgcagttcatctttataattaggcaaccagaatatctcccaaccttcattgctgcatcttccaaagaagatgagccctatccctaccctgctgttgtggttgctgctgctgctgatgctgctgttgtggttgctgctgctgctgctgttgttgtggttgctgctgctgctgctgctgttgttgttgctgctgctgctgctgctgagccctttgtaataggatttgttgcatctgcatgtgttgttgttgctgctgctgttgttgatgttgcaacttctgaggttgtggctgctgctgcccttgttgctgttgctgttgctgttgctgttgctgctgctgatgtgaacagagagacaccagacaacaatgttccagagtgtgggttggacagaaaccccactgcagtgccatgggttaaccggaaactccaccagagtatcatgggttggtcagaaactccactggagtgccatgggttggccagatgcgcagctgggagctgtaggccagacggttgcatcgaagagagaagagaagaaactgccgtcattaagcctttgaaaggagtgagaatgggaaaatag

SEQ ID NO: 66043 - DNA, 186 bp, Glycine max
  Peptide Sequence Number=SeqID_182821
atgtcggaactaatgaacggtacagggtctgtttttttatgggtaccgccattgaagatggcaagaaagtttggtaccgccaatgaagatggagacatagcagcttacgtggagggtgtcgcccatggtcctggcgagacacctccacgttggatccgccaatggagttggcgttacggggcctga

SEQ ID NO: 66044 - DNA, 450 bp, Glycine max
  Peptide Sequence Number=SeqID_182822
atggaagagagcatgatgatgaggcatggttgttcatcgaagtggtacactagagaagagaaagaggttgctaaaatccttctggggttgcagcagcaagaacattcgaaacctccctcattgaattggggccgcaagaggaagagatctgcaattcaagacgtttttctgcatcataataaaacgcagaacaacccttcaagtcctgacacacctctctccttccttccttccactgaatctcaccagaaccctaaaaaacgatctccccaaaagaagaaactcaaggaagaattttttcttggaagtatagaagacttgaagaaacaaaaagttttgctcgaagaagagttgtacaatgtgaagcttttttacaacaaggcaaaggcttacaatctgaagttaaaagcaaaagaacagataattgatgaatttcttcttctattatga

SEQ ID NO: 66045 - DNA, 906 bp, Glycine max
  Peptide Sequence Number=SeqID_182823
atgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcatagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacatcaaataactatgaaccagcatatcaacctccatcaccaagccaaccaagtccatcatcccaccccccctcccctttagattcagaggttcccatagaaaaacaaaactgtcacaagcgaaggagatctgagtatggagggagttcaagcgctgttgggatcaacaatcaaggcaacgttctggaaaatctttctgttggcattgggactattgctgtgaattttgaaaaaatatccaacatgatggagaaaagagaaaaagatagagatagagatagagagctcgagggtattatttgggatgttataaaagaaattccaaatttggatgacataacgcgtttcaagacaactgaattgttaaatactaaagcaaaaaaggattttttcttgaagatgtcaccggaagaacgctcatcttggataaactttaagttagggaataattaa

SEQ ID NO: 66046 - DNA, 702 bp, Glycine max
  Peptide Sequence Number=SeqID_182824
atgggtgaacacatgaataaagctatgcaggaaaagccaatcttaataggtcttgaagatttgtaccaaggaatccctgatgaatccgttaacctcacttttcaacacctggctgaagtgaaaacatcggataagagaaaactcacaacaacaccttcacgctcaatagcaaaactacctagtcttgatttcaccaaaggcttgcaagcttctaatcaacaacaccatctacaagactttggccatggtgaatcgccattgggtcattctggtcattttattagcgatgcaagtggtggtgcacaaagacaaagtcctcgactcaagcctagcggagatgatgatcatttggggcatggcatgagctttgatggtgtgagtgttgcttcaggaagaggtagtcgacggcgccgacccgggattcctcactctaagatttgcgcaatttgtaatacctatgtttatatcttccggactagatgcctggtatgtggcagggtttattgcaggcaatgtgcagaaagaggaatgggggagatgatagaaggaagaaagtgtattgagtgtcttggattgagattcagccaaagatgtaatagtttctcatacaatgaaaggacgtacgtagtcacactgattcaaatatcagagctaaatcagataacaaccacagtgaaagcacataagcttccctacacgtag

SEQ ID NO: 66047 - DNA, 477 bp, Glycine max
  Peptide Sequence Number=SeqID_182825
atgtatcacgtagcacccttgcacctgacacaacatctaaacaacaaaatctctgtctgtttccaattccagctaattgaatctcaacgtggtgcccttgataaatttgttattattcataaaaatgacgcagaagcaagttcaataggtgaaaatgtgatagaacaaccattgataaatcatactgacaacgaggaaaatgttatagaacaaccacctatagataatactgacaatggtgtagaacaaccacctagagatgatactgacaatggtgaaaacgtgatagaacaaccacctataaataatactgacaacacaaatagtcataatttcaatcaagaactagaagaaaatattttagaaataggagtagaagggaatgttgagcataataacacttctagtgaagtacctacaaatatttatgacccagaactatggaaaaatattgatggaaaatttatagagatttaa

SEQ ID NO: 66048 - DNA, 648 bp, Glycine max
  Peptide Sequence Number=SeqID_182826
atggatccaaacgcggtgaagtccactctctccaatctggcgtttggaaacgtaatggcggcagctgcccgtgattatcagaaggaattgcatgctcaagagaagacacatgcatcaagttcagtacatcaggaggttgaccttgacgagttaatggataaagaagcagagaaacgggaggaatggaagaagaaaggtcatggagaatttagggaagtaaccgagggtgatttcttaggcgaagtcacaggaagtgaaaaagtgatttgtcacttctaccataaggagttctatagatgcaagataatggataagcatttaaagtctcttgcaccaaagcatatcgatacaaagttcatcaagcttgatgcagagaatgcaccattctttgttacaaaactggctatcaagactttaccctgcgtcatactgttcagacaaggagtagcagtagatagattggtaggatttcaagatgtgggaggtaaagatgattttaccacaagaacgctggaggctctgctgataaagaaaggtataattgaggtgaagaaagctgaggatgatgaagatgatgaatatcaagacagtacacgtagagttgtaagatcctccatgattgctggttctgattctgattctgattaa

SEQ ID NO: 66049 - DNA, 441 bp, Glycine max
  Peptide Sequence Number=SeqID_182827
atgttgatttatcgccaaaagagtgaagactacaaaaaacccactttagcaatgcaatcagttcatgtgaatggttcagtcaggtcttccgattccagcaaggctcaaaatgcaacaaagcagagacaacctcaaaaggaaatgatgaatctgatgataccttttgggaatggaccaacccaaagtgagagatttattgtgtctgcccatccaacgacgtcgttgcaggtgccatcatcatcttcatctaatggattgggccacgaggcccaagcggtgcttcctgatctaaacatgagcccaaaagagttttcccagttgaactcatctcaaccgttgaatgtggcctcggcaatcagggacttgaaaagattcaatgcagctgaagcaaggaggaggaggattatgcttatgaggcaaccgcaaaaaaccacgttatga

SEQ ID NO: 66050 - DNA, 283 bp, Glycine max
  Peptide Sequence Number=SeqID_182828
ggaagaattcaatgtcttctcccgggaagtagttagatttggaaatttatgtaaggaccctcagtggcatagcctagaacaatatttctcaagattacatttggatatctgggacaacatgcaaccaacggtagaggcagaaatgacaatgcaagaattgaccactatagctcagaatactgctgaactatatcacgagctaacttcgttagaacattttgaacaagattatcagcacaagcttaaggaaatggaatccttaaatcttcctctcaacggttag

SEQ ID NO: 66051 - DNA, 794 bp, Glycine max
  Peptide Sequence Number=SeqID_182829
gtgcaaccgctgtcaagcattgtaatggttctgaaagacttggtgaagctggtctctcactgcactatgctaacattatcaatcagataagcatgattgcatctcgcccaaccgttcttcccccaaatttaagagacacattgtatcatggattgccaaattatatcaagagtgctcttccttcacggttacaaaacattgatgctatgaaagagctctccatcactcaggtcaaagctgaaatggacaagactctgcagtggctcactccatttgccacaaatacaatcaaagcacatcaaggttttggatgggttggtgaatgggcaaatacaagtaacgagtttggcgaaaacacaaccaaagaaagtaacctgattcgcctccaaacactttactatgctgagaagcataaaatagatttttacatcatcgaattgttgactcagattcactatttggttacctttgtaagatacagacataataccatgaagccaatgcccaaaagaacttctcctaggcgacttgattttcaatcaaagtttatatctatagacagtattaacaagcctttgggatctaaactttctcaagaggataaaagattattagaagaggtaactatgaggagaagaagcccaggagttagcaaaagcgaggatcttgcagtgaccaagaaaagaagtgccaaagtttggcatcatagcaatagtgtaggaagttcacctgtcacacgagaagggttggaccaccaaagatctaatgttttggatattatagatgggctataa

SEQ ID NO: 66052 - DNA, 603 bp, Glycine max
  Peptide Sequence Number=SeqID_182830
atgttggtatctgaggcgattaaggttggggatttatgggttgatgaatttccatgtttacttgaaagctattgtgggaggtctttgagctctgcatcagaggaaatgagttcgagggagttggaaaatattcttgtaaccagcaaagatactaaaaagcgaagaattatggaaaaacctgagtcaatccaagaacacgagtctgttggcttagatgatcatattgaccctactgattcatcagctggtgccacaaccaagcatccaaggcaccgttctggatgcacttgtattgtgtgcattcagcccccaagtggaaaagggaggcataggccaacatgcacttgccttgcctgcatgaccgtgaggcgccggttcaagacccttatgatgcgtaagaagcaacgcgaatcagatgctacccaaaaggatcagattcatcacagtgatgagggagacaccaatggtggtgcatcaagagatggtgcaattgcaagtaacttggagaatgagggaagcctcaacagaatggatgaacttggtgcaggacaaatagacctgaatagtcatcccgatcatgaagacatgcaagtggctatgtga

SEQ ID NO: 66053 - DNA, 405 bp, Glycine max
  Peptide Sequence Number=SeqID_182831
atgtttagtcggatagatcccggaggcaaatttgttatgggttccagaagggcatcagattctatagatacacaggttgaggcctctactttttctcactccaatgattttgcaacaaaggaagcaaccttttctggtgcaactgcaaatctgcactcaggaaacagttatcctgatcttctccgcacaacgaaagggaatggcgaaccttacttaaacagatattcagaacatttgcgtttcagtaccgaaactgctaattgtctacaaactgaaaatgatatggagttgagagttacgtgggaagaagcacaagacttgcttcatccaccaccttgtgtcaagccaagtgttgaaacaattgaggacaaagaatttgaggaatttgaggagaatatggactga

SEQ ID NO: 66054 - DNA, 666 bp, Glycine max
  Peptide Sequence Number=SeqID_182832
atggttagaactagaggtcttggtcgctctttagggcacgcaataggaaaagtgttggggaggagagacgagagtgacgatgatgccccgcgacgacgaagaagacctactgcatcagcctgtagacaacgacaacaacaggttgttttggaggacccttctacggccgaggaggaattggttgacatccaggcagaagcacctattgatgaaggtgatgctgatgttgagggttttccatgcagactccatgacacatctgttctaagtgattttgaaaatcacattgctttgagagtgtggaatggagagttgaagctatcttaccatggaaggaagatgactaagcttgggaggcctgccccagagattgaaggccttgtgcataaggaaaccagcagtttccatttgcctatcggagaggtgactatcaccttggatgacgttgcggcattgttacttttccttgttgtcggagctttccacagcttcgagcagcttaatgtcgacgacgttgtggacttattgatggagttactcgaggtcagtgctggagatgccagagttgagaccattcggtgtaatgggtcttatgtgcgactttcgtggctgcgcgacatgtatgagttgaagattgaggcatgtgcgtggattatagcagcgtga

SEQ ID NO: 66055 - DNA, 363 bp, Glycine max
  Peptide Sequence Number=SeqID_182833
atgacaggaagaagcgagaggatcactaacctcgaagcaacaggaagaccaacaaccaaatggagacaagaagaaaaaccaccaacaccaacgctcactatcacagaggaagacgaacgctcaccggaagacgaagaaccaagggccggtgaagggcctttatgtcttttcaccatgtctgctgggtgccccagcaaaaaattctgggtgcaccaagaattgagatattttaaacaaaagaaagtgcaggaaaccacattcaagcaacatcctttcttcttgcgatctaagaagaaagttcatcatagatcttgccaaaggagacatcttcaccacatcttaaccaaaaatctcaatgtttag

SEQ ID NO: 66056 - DNA, 177 bp, Glycine max
  Peptide Sequence Number=SeqID_182834
atgatggaaggagatttcatcaagctcgcccaggcgagaaagaacattgcggattacataatcatcccctttttgacttatggaatgttacggaatctcacgaattgtgcaacgatgcttccttttgagttccggcatgtcacggaacttcacgaattgtctaatgaagggtgtcaa

SEQ ID NO: 66057 - DNA, 442 bp, Glycine max
  Peptide Sequence Number=SeqID_182835
cacccctgcgccaattgcggtgccgtacaggcccagcatccacaccgtatcactcttgcgccagccggttgctgccgcctccaccgtaccgagggtaccggtttgtgagttatccatctgtctctccaaaattgtctcaaatgcagccggaacgacggctaaaaattcgcggcggcctgcagcgtgcggtcgctttacaaaacgcgcctatgctacccgtttttgcccggcgtggattgccgcaacgcaagacatgcatcacaaaggcggagtgcaagacacagcgcgaagtggacgtgagcgggagaatgaagtgcggggatgttgccagcagcagagcgctgtgaaggaaactcccccggcagctagcctcgggcaatgcagcacgtcgccagaggataacgccgggagaattgaaaatcagaacgcccgcattctgtag

SEQ ID NO: 66058 - DNA, 1271 bp, Glycine max
  Peptide Sequence Number=SeqID_182836
cgattgccgttgcgctctatacccgcgtgaatcaaatcagcgtctcttattttctcggcgtgaaagaggcgggcattttttccgtggcgctgacgttgtcaaccgcctgggtatttttacccagcgcgctgctggcgtcgttttatccggcgttttttgctgagcgtaatgaccagcaggcgatcgtcaaagcgcagaaactgcatctgctggtaattggcgtttccgctgcggtaattgtggcgatctggctgctgtcgggctggtttattcgtgacttctacggtgagcaatatcttgatgcggtcgcgccgacgttattactcagcctcggtgcgatgtgcgcggtgctgagcagcgttatggatcgtttcatcattaaatataacggctaccgctatctggtgaagaaaaccttcgcggtattagtgatttgcctgctgtcgtcgctgctgctggtgccgcatttcggcttaaccggtgccgccatgagcgtggttacggtgcttaatcaaattaacgcaggcgtcagtgcggcacgcaatagcgggctgcagcaggccagcggggaatatgtcctgtttctcgatgcggatgactgggttgacgataacttcctgatgagtttcaaactcaatctcaatgcctggccggccgaagcggtggacttaatggttggcaatctcaacgacaaccgtatcggcaaagtctcgcaggcgggattcttcagccagcaggatattccttacgtgctgggcgagctggagatgagcgacaacattggctatctgcataataaatgttatcgccgccagattattgacgatcttcatctgcgcttcatggaaggcgtctcgatgagtgaagatctgctgtttaacctgaagtttttcagctgcgtcagtaattttttgatcactccaggcgcggcttatcactatgaggatgtggcgggatcgctgtcgaaacgtaaagtgcagtacagcgaactgaaagtgcgtaaacagtcgcttaccgatttgtacgattcgattgtggaaaagtacgcgtcgggtaatctcgaccattttttaaaagcaatctcgaaacgcgtgctggcactggatatgcagattgtcaccgctatgtatcacgcctcgttttcacctgccgatattgcgcaggaaattaatcaaatcaagcgcggaaaatattctaaagaatgcgggcgttctgattttcaattctcccggcgttatcctctggcgacgtgctgcattgcccgaggctag

SEQ ID NO: 66059 - DNA, 1059 bp, Glycine max
  Peptide Sequence Number=SeqID_182837
atgagtacaacacaagggaatagggaatatgaaataagtatcctggatttagagaaaaaaactactttacactgcggatgtattgcatcgagctctatgtttgagtaccttgattatggaggcataggttgtgttacctgtgtaaagacttcgcaacttaatttgatacgggatactgaaaacactatcgggtctgttagatcaataaaaaacaatgcaagtgatcgtcatactgaacatatggattctagattattggtggatggtgctggcaaaggaaaccttatgcagttgcgtaggcatgttgaagctagtgaatccagccgttggcaacgagctgagagagatggcatagattcatgtattggtccaaacaggcaagatgatagaagattttcaaatgtgatgaaactgtctggtcactcattaacatttacaacattagataataacagaccaacatgggagacacaaactatgcacaaatcaagttcacagaatatgtctctgggaacctcatcaggaaattctgtcctgccttctgctttagacattgcagaaaggagacttgagggtaaaacatcgttttgtccctttcatcaagggcaaagacttttctccatatctaaaccattgatggatgggatagccattaatctggaagctagtaaaggtgtgatttctcaggaacgcgttgcccggccacctgctaatgggaaaaccaagaatctgttactttctcgatactggcctaggattactgatcaagagctggagaaattgtccggagatttgaagtctactatagtgccattgttcgagaaggtattgagtgccagcgatgcaggtcgaattggtcgacttgttctcccaaaatcttgcgctgaggcttactttcctcctatttcacagtcagaaggtcttcctttgcagttcaaagatgtgaagggaaatgactggacatttcagttcagattttggcctaataacaatagtagaatgtatgtattggagggagtaaccccttgcatgcaggccatgcaattaaatgctgggtga

SEQ ID NO: 66060 - DNA, 1077 bp, Glycine max
  Peptide Sequence Number=SeqID_182838
atgtgcagcatggctgatcaaaatgtggttttaggtagtggagcattttgtcgccaggatacatgcagtggtggaatgaatggttacatatccttatgtggtggagaaccttgccctcctatttttaggtctcctattgcaagcatggaagatatcatggacaatcatgttatatgtgcaatatatagactcccagatgcacataaacatattacccgaccaccacaaggagttaaatttccaaaaaagattgttgaaattggggatctaaaacctgaacctgttttgtggcatgaagattcaggcaggagacaccattctgaaaatgggagcatctggtcgtctagttacctaaaactgacaggggctccctttttctatatcaggaaaaaccctccaggatctatttctggtcgggagcttggggatgcagcacacagactcattgtcaattccttacaggcaaaggttgatactaatggataccgccatccgcataatggacctcctatatcttatcctgcacccatgggtcattatcgacaaccagtgccttcgtatggttatgaatccagcccaggatatgttgcaatgccgccacctatttcagctccctcactccaaggcagaccacagtttgcaccttacaatgctgcccctactgctcagcagtatggttgcaatcaaccatacccgccaccaccagtggtgtacaatcatcctcgtcagcaatcaaattcttacgaaagaaatgactatcagcacgccagatcaaatcattatgaaagaaatcaccatcaaggtagtgggggtagttcaaggcatggatatcaatcatcaggaaataatcacaatgccaggtttaataattcacatggttcatatggtagtcaccatcatgaagttagtcaccacaaccaaaacttccaaccttctagagctcatcagaattggactccaccaaacaacccgagtgggcacagggattatggtcatcattcatccaatcaatattctttattagatagaagaggaaacaggaatccaatgcccccacctggttacagtcgcaaataa

SEQ ID NO: 66061 - DNA, 939 bp, Glycine max
  Peptide Sequence Number=SeqID_182839
atggagtcctacgcttcacacttcaacattcaccctatcttcaaccaaaccgtggaaagtgctgactttgataaagggtcgaaggtttgggtggttaaaactcaagaggttgattattcttctcgctggcttgtggtggctactggtgaaaatgctgaacctgttgtgcctaggattcatgggatggagctttttaatggtgatgttgctcacactagcgtgtataagtctggctctgagtataggaacaagaaggttttggtcattgggtgtggtaattcgggaatggaagtttgcttggacctttgtagacacaatgccaaaccttacatggttgctagaaatacagtacatgtgcttcctagagagatgtttggcttctcaacatttggggttgctatggcgctctataagtggtttcccattaagttagtagacaagatcatcttgcttgcaacaaacttcattttgggcaacaccaatcactatggcatcaagaggcccaaaaccggcccaatagagctcaaactcgccacagggaaaaccccagtccttgatgttggtcaagttgcacaaataaaatgtggtaacataaaggtgatggagggtgtgaaggagataacaagaaatggtgccaaatttatggatggacaagaaaaggaattcgatgctataatcttggcaacaggatacaagagcaacgtgcctacttggctcaagggatgtgattttttcacggaagatggaatgcccaaaacaccctttcctcatgggtggaaaggagagcagggattgtatacggtggggttcacaagaagaggtcttcaaggaacgtcgtgtgatgcaatcaagatcgctgaagacatagctgaacagtggagaaccgtagaggacaagagtcactgcgattcacatatcatcctactcaataattcatag

SEQ ID NO: 66062 - DNA, 3183 bp, Glycine max
  Peptide Sequence Number=SeqID_182840
atgactcttgaagatttctttacgttgactgaaatgaaagatggcctcacagccccttctcgagtgcaagagttggtctctgtaatgaagaaggagcaagattgtgttgttaagaatgctggtgatgcaacaaggcagtgggctgctgttgcaagcactattgctgctacagagaataaagattgtcttgatctttttattcaattagatggacttgggttcatcaacaaatggttaaaggatgcccaaaatttgggtgctgataatactaatgatggcttcattgaagagtcaattactgcaatgttacgagcagttgaaaaactgtatctagacagcgagaagtcaatttcatcaggaatttcggtaactgtcagtaaccttcttggccatcatagctctaaggtgcaggataaagcaagagtattatttgaccgctggaaaggaggtggagatggagatgctgaaccaactgataattcggatcttggtagaatcaacaatgtgagtgatgagattgtttgggagaaaggccagccatcttctgtgaatgaagctggcaatgaagatgatcatgcatctcaacctgctggaggtgagaagtctctattgggaggctcagatagtcagctacaagaaaaagtttctagcatacagatacagaatgctgacaatgcactccagtcctctgtaagtttggattgtgaagatgccaaagagagatcaaaccatgttgatattgtcttggcttctgttcaagaagttgccaacataagtgaaggtgggacctgtaacttatctgttaataaacaaggcagtttcaaaggtcaacaagatgatttgaagttaaatgacttgtccaaaaacgagaagcaagatcaaaatgttaatggttctccagaagaattaagagcatcagatatctcttcagcatctggagagccagatcttgaacctgtctccattggtgatagtgaagcaaaagcactggagtctgtggaagaagaacctgctttagaacataatgttgaaagcaatgaaaatatcatttgtcctaaaataaatgtttctggtagcatgagaacacctgcatcagatgggatgagtgtgggggatgatgtcagagctataaattccagcaatccccaacttcccaaatcatcagaaaatgatgattgttgttctcaagcattgcaggacttatcagtcactggcagtcacttggaaaagcctgagatgtcttacctcaaaacagaatatgtaggagcagtaaaggaaagcaagggccaagatgatgataccccaaatggttctgactcttctaatcagggcaaaggtcccacaagccctaacattattgacaagaattctgacatggaacttgagtatggtattgttgatgctttagaagttgctcgactagttgcccaggaagttgagagggaatgtgtaagccctataaaggaagggaatgaccaagtttctaatgaagtcaacagtaccacaaatggttctgattcttttaaatggggaaatggccccaaaagccctaatgttattgacaagagttctgatattgaacttgagtatggtattgttgatgctttagaagttgcccggcaagttgctcaggaggttgagaaagaagtttgcagctcttcttcagataaaatctcagaaggtggaatcaggcaggcagccagccttgatttagggagaaaggatgaagtcactcatgccctacctgaggaggtatcatccaggcaaagcaactctgctgaggtgtgttctgaacaggcggaacatatgagtgtttcagataatattgaggctgggcaagatgacttggagtcctcgcaggtgactgaagcagctcgagacccaggaggtaattcagagaaaagtctctgtacctttgatctcaatgaagaagttggttctgatgatatggatgtttctgtaaatgctatgtctactatgccaatacctgttgtttctgcttcaaaacctgcacagacttctcggttgccaatggcccctttgcagtttgaggggacccttggatggaaagggtcagctgccaccagtgcctttcgccccgcatcacctcgtaaaaattctgataacgagaagaatgtttctgttggtggaaactcagagatttccaagcagaagcatgattgctttgattttgatctgaatgtggctgaggatgaagaaggattggtaaaacaaattggtgaatcttcaggccttccttctggccaatcatcagttgaacttggtcctaaaagatcaagcaggtttgagttggatttaaacagtattggtgctgatgatgatgcccaaccttcagatcagaggatggagggggcactcttttcaggaagaaatggttattggagcccatcacctgcttcatcgtcgtcatcaatgcaacctttagtacgaaacatcgatttgaatgacagaccattctttcaaaccgatttagtggaccaagggcatagtaagtcttcttcgattattgaagcgtataaacggtccaagtcggatgctcccgtgatatctatattgggtgccaaggtagaagttggtagaagagaatatattcctcaaactttatctttgccaaatggcaaggcaattgagcctgcaatggatcttccattgtcaggagcaggtagcattttaggaatgggccctacactaccctacaatcattcaactgcttttgggtataacagactgacatcagtgcctgctttgtctttttcatcagccatgtatggatcatctggtggcccaattccatacatggtagactcaagaggaactcctgttgtgcctcaggttgagggatcttcctcaactgtcctgtcatcttattctcaacctccatttatcgtgagcatgaccggtacacaacttggtttaaatggggttggatcttcacgtcccaactttgatttgaactctggcttcacaattgatggagggaacagagacatgttgactgcaagacaatttttctttcctgctcaaggcagagccatggaggagcacgtgagaacccttccacaatcctcaagttccggagttagtgtgaaaagaaaggaaccagatggtggctgggatagggatacctatgcatttagctacaaacatcagcaacctccatag

SEQ ID NO: 66063 - DNA, 279 bp, Glycine max
  Peptide Sequence Number=SeqID_182841
atggacaacaacacaaacattaagatcttgaaggggtggcacggatctcgacagggaggacaatgttggtgtggcacaacatttctggatctatgctggtggcgtgatgcaacgggactaggtgcgggttgcgaagtcgtaggggaaggtgggtatgatggttttggatctggtttggggggggttgggttgggggtcgcgtggcagtgttggaggatagagatggggtggcatgggattttgatgaacggaagtttgaagggtgcaaggatatggtga

SEQ ID NO: 66064 - DNA, 267 bp, Glycine max
  Peptide Sequence Number=SeqID_182842
atggagaagtttgcaatgtcgtgcaatatttatatgactgtttccaaaaagttgcagggtgagaaggaggatgttggaagcattgtaggttccaaaatggcacatggggtcgaagtggaagttcacagatatatagagaaagaagatcgaagaggtgtcaaagatgatcagtatttcataactcactcgatcagaaaagtaatttcacccacaatgcatgcggttgttgctgatccaaatttttttgcacattatgagaattattga

SEQ ID NO: 66065 - DNA, 1284 bp, Glycine max
  Peptide Sequence Number=SeqID_182843
atggcaggaatgaaagtctatgtgactgacgaaaaggagttgattatggaaccatcagtgaagtgggctgggaatcctaacattatagttgcagttaaagcatttgggcttcgagccacagtccaggttgttgatttgcaagtatttgctgctccacgtataactctgaagcctttggttccaagttttccatgctttgccaatatttacgtgtctctcatggagaagccacatgttgattttggactaaaactgcttggagctgatgcaatgtctattcctggtctttataggattgtccaggaaatcattaaagaccaagttgcaaaaatgtatctgtggcccaaggccttagaggttcaaataatggatccaacaaaagccatgaaagtgccagttggaatccttcatgtgaaagttgtaagggcagagaagcttaaaaagaaagatctactgggggcatcagacccttatgtgaaactcaaactcacagaagagaaacttccttcaaagaaaacaactgtgaaatacaagaatttgaatccagaatggaatgaggaatttaatatagtcgtcaaagatccagaatctcaagtcttagagcttactgtttatgactgggagcagattggcaagcatgacaagatgggtatgaatgtcattccattgaaagagattacacctgatgaaccaaaagcggtgactcttaatttactcaagaccatggaccctaatgatcctgagaatgcgaagtcacgtgggcagctaactgttgaagttctgtacaaaccttttaaggaggatgagttacctcagagtgcagaggattccaatgcaatagaaaaggctcctgaaggaacacctgctagtggtggtctgcttgtaattattgttcatgaagctgaagatgtggaaggaaaacaccacacaaatccatatgtgcgactgctatttaagggagaggagagaaaaaccaagaggataaatttgacattagacagtgaagtgctaacaagagcaaagaataagggtagcagaaacgaaaatgttgagttagatgagtggatattaaagaaagcttatatttctgtgaaatttgactatggctcaccgcaaccatacagcatgtcaagaaaaatagagatccaagatggggaaagtctgggttatgtggatataaaattgtctgatgttgttaccaacaaaagaatcaacgagaaatatcatctcattgactcaagaaatggacgaattcaaatcgagcttcagtggagaactccttga

SEQ ID NO: 66066 - DNA, 612 bp, Glycine max
  Peptide Sequence Number=SeqID_182844
atggcaaactgctttcttctttgtagtgctaacacttttttccttaatgaggatcgggcaaatgagatatataagagggttgaagatcaaaagtctagtagaggaagaaatcaagatgctttattggctgcttgtctctacatcgcttgccgacaagaagacaaacctcgtactgtaaaggaaatttgctctgttgccaatggggccacaaagaaggaaattggccgagctaaagaatacatagtaaaacaactgggtttggagaacggtaatgctgtggagatgggtacaatacatgcaggggacttcatgaggcgattctgttctaatctttgtatgaataatcaagctgttaaagctgctcaggaagctgtgcataaatcagaagaatttgatataaggaggagtcccatttcaattgctgcagcagttatatacatcataactcagctttctgatgataagaaacctctcaaagatatatcacttgccacaggcgttgcagaaggaacgattaggaactcctacaaggatctttatccccatgtttccaaaataataccaaattggtatgctaaggaggaggatttaaagaatctttgcagcccttga

SEQ ID NO: 66067 - DNA, 408 bp, Glycine max
  Peptide Sequence Number=SeqID_182845
atggctcataacacaacttcagcaagccttgcacgcaaggtgagaaacggacctgtcggacatggtggcgatggtcttgaaggcgatgatgagggcgcgatcagggttggagccgcggttctgccagcgaccgagggaggaggagaggaactcgccgccacctccgccgccgttgggcttggcgatgacggtggagaggccgccgtcggtgaggagggggttggagggcccgccgacacgattgggatcgttgtcaccggactcgttggcgaaggtacgccactcagaggtctcgtcgatagagtgggactccagtacgaggccgcactccgagcacaccgtgtcgccggcagagtggtcaaacaccacctccgtctgcctcttgcagtcgctgcagaacgcgtctga

SEQ ID NO: 66068 - DNA, 3299 bp, Glycine max
  Peptide Sequence Number=SeqID_182846
ttcaagtggagggtacatccacttggttgttcaaagagaacaagggagggtacatcccttgtggatctttgcttgtaaaggtttttacaaggttgaaagaaatctcaagaaccggtggttgcttggggactggatgtaggcacggaggaggaggaaaaccagcggcagaatcagctttggacgcgagggtggaaaatgtgaaaggtgatttgaagataatgaaattgatgatggaggcgatacaagcagaagaaaaagaagcaaaggagaaccaatcaaagttcctagaattggtgacgaagagcttgatgatgaatgtcaacaatgaagaagagggagaaggatcacatggcagaggtcgcaaggccaaaacaaacagagagcatgatggaaaaaggctaaatctgactagtgctggttggatttggaagagcttagagggagaagcactagacgaattccaacaatcgattaagaaggtggagctcccttctttcaccagcaaagatcccgccgactggatttcaagggccaaaatctatttccagaacgagaatctgatgtgggaagaattaaagtatgaactaatgcagaggtatgcagggaagggaacaatgtatgagcaattgtcggcgttgcagcagactgggagtgttgatgactacattcaacgcttgcacgctgccaatttgttgacgagaagccatttgatgaatacaacgagggtcattgaaatagagatggcaagcaaaaataaagcatgggtgggacgtggagacacacctattgaatccagatctgggaccggatcaggtcagagaaaccacctggtggcaacgggtcgaaccgggtcaagaaattctggaggaaatggaactgatgggctaggcccaaacacaaggggagatggtggcatgtgtttcaaatgtggtggaccttatggtccattacatcagtgtctcatgaaacaacttcgtctcatcttagctgatgatgagttatgggtcgaatgcgaagaagaagatgcattcgaggatgcccaggaggaagggatggatgatggaaaaacaaggagtcatagcaccatgaagctacaagggaagataagtggaattctcattcttcttcttgttgacagtggggcgacccataatttcatttcaaggaaattggttgaagctttaggttggacatgggaggagacaaaatcaatgaatattttgatgggggatggtcacacaactgaaactagtgatattgatgttattctgggtatgtcttggctgaaaactctaggggtaatgacggtggattggaatagtcaaataatgaagtttgaaacagaactggggacgagaaccttgagaggagtaaatcaagaggagcctttgtttgccactctgtgtgggggattacctcctgttcgtgaggagcatgcaattaacctgaaaccaggacatgatccaatgaatgtaaggccatatagatatccctaccatcaaaagaatgagatagaaagacaagtgaaagagttgctggagattggtcatgtaaggccaagtcaaagtgaatattcaagtccgataattctagttaaaaagaaaaacaacaagtggaagatgtgtgtggattatagatctctaagcaaggccacaattctagataaattcccaattccgatgattgaagaactattagatgagttacatggttctacctatttctccaacatagagtgcttaggacatgtcatttcaaagcaaggggtaaaggtgggcccaaacaaagtgaagagcgtgctggattggccagtcctcactaatgtcaagggagtacgtgagttccttggtatcacgggctattatagaaaattcatcaaagactatggaaagataggtagacctttgaccgagttgacaaaaaaggatggctttggatggaatgaccatgctcaaaaggcttttgaagaactaaagaagaagatcacttcagccctgaaaccagtggcgtactttagcaaggccttaagtagcaaaaatgtcaccaaatctgcttatgaaaaagagttaatggtagtggcgttggctatacaacattggtgtccctacttaataggaaggaaattcactgtctattctgatcaaaagagtttgaagcaacttctccaacaaagaatcaccacgggaagccaacaaaattggctagctaagttgttgggcatgggggagatggagcttaaatccttagcatacataccggtgtggttagactgccaaaatttaataactgaagttcacgaaagttccacttggaggaaggttattgaagacttgaagcaaggtcaagggaagcatctcagttttgagtataaacaaggtgtgttattcttcaaagacaggcatcttgcttcgaatctattttggaaaggaatgaaaggagatattatgaggtttgtgcagaactatgatgtttgtcaacaccagaaatacttaacaacaacccctaaagggtttgagaccattctagtcgtggtagacagggtgtctaaatatagtcattttattccattaagacaccttcatagagcacgtgccatagctaaaatatttgtgaaaaaggtgattaggcttcatgggatacccaattctgttgtgagtgatcgtgatccgttgtttatgagtttgttttggaaagaattcttcaaactacaagggaattgcaagatagggatgaagctgagacaattgaagaatcacttggcaagagcacaagaaaggatgaagacacaagcagataagtatagaaaagagagaaattttgagatagctgacttggtgttcctcaaattgaagcaacataggcagcattctgttgctgcaagaatcagtctgaaattaagtactagatactatgggcctttggaggtgattgagaggattgaggaagtagcttacaagttgaaattgcctacaagttccaagatacacccgattttccatgtctcattgctcaaaaaagcacatggagattacaaagttgaaatcacacttcctagtggattggaggatgaccgtgaaggagaaattgaaccggaattggtgttggcaactcgtagtataatgcaaagaggagaaaaagtcaaccaatggctagacaagactttacttcaaggagagggtgttgataggaaccaaactctcaatgggcctttggagcctctagcttatgagatgaagaaaggctcaagggaattcttagtgtatttccgtagaaagaaaagaagggtagaaaaggaataa

SEQ ID NO: 66069 - DNA, 489 bp, Glycine max
  Peptide Sequence Number=SeqID_182847
atggatggtgttttgaaaccataccaagcgggggaacaaaggggttcttcctacaagcaaaataaaatgaaaaactcgagaaataatgtagcaacctatgcatcaggtctcatgaatccgcttgcactgcgttcttctttttactatcatcaacaaaaccagctaccaccactacttcctttgcccagtgtttctctttctccaagtactactgtcaagagtcgaaaaaacagaaccagaaaatcaaaacaaatgcaagaggaagaagcttataagaagaaaccaacagcggggcttcttacttctcctggggtttgtacgtcgtcgtttaggtcaacggcaataggaggtaatggatttggatttggcactgaaaatgtggattttgcaagttgggtgttcgatctgtcaccgccaccaagcagtttgccggtgccaaagttttgtatgagaagatcaaagctaagttgcaatgcagaaactaattaa

SEQ ID NO: 66070 - DNA, 411 bp, Glycine max
  Peptide Sequence Number=SeqID_182848
atgaagcacaagcgtcaaatatgtgtcgacaccacattgaagcaattatggcccttcagcaggagaatgcgcaactatgagaaggccaccaatgttaatgctcaacaagacacacaccccggtgatgaatacattggggaggcagttgcaacaattcaagaacccttttgtccaaggcatttggaggttatcgtcgccttcaactggaagagtttaaccattgaaaaatttatgtgtccagtattttcgggcaagatgtcaggacatcgtatccgacatcgtggatcctgcagcttcaatgcttcacttgacttttatcttgcattgtacagcaattccagtattctcgggcaggatgtcaggacattgtatccgacatcgtggatccttcaacttcaattcttcacttga

SEQ ID NO: 66071 - DNA, 3582 bp, Glycine max
  Peptide Sequence Number=SeqID_182849
atggcagaagtggaactagccccagattcacttatagaacaaaatgtaacatctaaaacggtccaacaatccaaaaccgatagtgtttcgtttttcggcttgtttgctgcggctgatgcaactgactgtgtcttgatgttcctcggaagtgtcggtgttgcattctggatgcaaacaggggagaggcaaacggcacgtttgcgcttgaaatatttgcaggcagtgctaaagaaggatattaatttctttgacaatgaagccagggatgctaatatcattttccacatctcgagtgacgcaatattggtacaagatgcaattggagacaagacaggccatgccattcgttacctttcccaattcattgttggattcgccattggatttacctcagtgtggcagctcacactactcaccttggctgtggttccgttgatagctgtagctgggggagcttatacaataattatgtctactttatcagaaaagggtgaagcagcttatgctgaagctggaaaggttgcagaagaggtgatttctcaggtgcgtactgtttactcatttgtaggagaagagaaagcagctggctcatactcaaagtctcttgataatgctctgaagttgggcaagaagggtggttttgcaaaaggagttggagtaggcttcacatatgggctattattttgtgcttgggcattgcttttatggtatgctagcatacttgtgaggcatcataagacaaatggaggcaaagcgttcacaacaattatcaatgtcatctttagtggatttgctcttggtcaagctgctccaaaccttggttccattgccaaagggcgcgttgctgcagccaatatcatgaacatgattgcgtccgcttcaagaaattctaaaaagttggatgatggcaatattgtcccacaagtagcaggggaaattgaattttgtgaggtctgctttgcttacccctcaagatccaatatgatctttgaaaaattgagcttctcagtgagtgctgggaagactatagcagttgtaggtccaagtggttccggaaagagcacgatcgtttcactaattcaacggttctatgaccccacttcaggtaagatcctgttggatggatatgacctaaagaatcttcaattgaaatggttgagagaacagatgggcttggttagtcaagaaccagcactatttgccacaacaatcgctggaaatattttattcggaaaggaagacgcagacatggataaagtcatacaagctgccatggctgcaaatgctcattctttcattcaaggattacctgatggttatcaaactcaggttggagaaggtggcacccaactttcagggggccaaaagcaaagaattgccatagcaagagcagtgctaagaaacccaaaagtattgcttttagatgaggccacaagtgctctagatgctgaatcggagctcattgtccaacaggcattggaaaaaataatgtcaaacagaacaacaatagttgttgctcatagattatccaccatacgcgatgtagatacaattgttgtgttgaagaacggccaggtggttgaaagtgggactcatttggaattaatgtccaacaatggagagtatgtgaatctggtgagtttgcaagcatcacaaagcctcacaaactctagatcaatatcttgctccgaaagttcaagaaattctagttttagagaaccttcagacaacctgaccttagaggagccgttgaagttggatacagcagcagaactgcaatcaagagatcaacacttgccatcaaagactacttccactccatcaattttggatttactgaaactgaatgctccagagtggccctatgcaatacttgggtcagtaggtgcaatattggctggcatggaagcccctctctttgcacttggaatcactcacattttgactgcattttattctcctcagggttctaaaatcaagcaagaagttgattgggttgcttttatatttcttggagtagctgttattactatacctatttatctattactacactacttctatacattgatgggagagcgtctcactgcccgtgtgcgtttattaatgttctcagctattctcaacaatgaagttgcatggtttgatatggatgagcacaacacaggctcactaacggccatgctagctgcggatgcaacattagtaagaagtgctctagctgacagactctcaaccattgttcaaaatgtagctctcactgtaacagcttttgttattggcttcacattgagttggaaactaacagcagtggttgtagcctgccttccccttctcataggagcttctattactgagcaactatttctcaaggggtttggaggagactatggccatgcttactctagagcaacttctttggctcgtgaagctattgccaacatacgtaccgttgctgcttttggcgcagaagatcgaatctcaatccagtttgcatctgaactgaacaaacccaacaaacaagctcttctacgtggccacatatcaggttttggctatggcataacacagctattggctttctgttcctatgcacttggcctttggtatgcatcagtattaatcaagaagaatgagtcaaattttggagacatcatgaagtccttcatggtcttaatcatcacttctctggcaatagcagaaacactagctcttaccccagacattgtgaagggatcacaagcattgggatcagtttttggcattatccaaaggagaacagccatcaccccaaatgaccccaactcaaagatgataactgatgtcaaaggagagatagagtttagaaatgttagcttcaagtaccctatgagacctgatatcaccatatttcagaacttaaacctcatagtcccagcaggtaagagtctggcagtagtggggcaaagtggttcagggaaaagcacagtgatttctttggtaatgagattttacgaccccgatttggggtcagtcctaatagatgaatgtgatatcaaaagcctaaaccttagatccttaaggctgagaataggattggttcagcaagaacctgctttgttctcaaccacagtttatgaaaacatcaagtatggaaaagaggaggcatcagaaatagaggtaatgaaggcagccaaagcagcaaatgctcatgaattcattagcagaatgccagaagggtacaaaactgaggttggtgagagaggggcgcagttgtcaggaggacaaaaacaaagagtggcaattgctagagctattctgaaagatccatccattcttttgttggatgaagcaacaagtgcactagacacagtatcagagaggctggtccaagaggctcttgataagcttatggaaggtagaacaactattttagtagctcacaggctatcaactgttcgcgatgccgacagcattgcagtgcttcaaaatggcagggttgctgaaatgggaagccatgagaggctgatggccaaacctgcaagcatctacaagcaattggttagtctacagcatgaaacacgtgaccaacaagaccattga

SEQ ID NO: 66072 - DNA, 1662 bp, Glycine max
  Peptide Sequence Number=SeqID_182850
atgctagcacagggattcgaggacgaagagaaatggctcgccgaggggatcgccggcattcagcacaacgcattcttcatgcatcgcgcactggacgataacaatctcagagacgctctcaaatactccgcgcagatgctatccgagcttcgaacttccaggctctcacctcacaaatactaccaactttatatgagagccttcgatgagctcaggaggttggagattttcttcaaagacgaaagcagacacggggtttccatagttgatctctacgagcttgttcagcacgctggaaatatattgcctagactgtatctcctttgcacggtaggatctgtttatctcagatgcaaggatgctccagtaaaggatgttcttaaagatctagtggagatgtgtcgtgctgttcaacatcccattcgtggtctatttttgaggagttacctttctcaagtcagtaaagataagttgcctgatattggctatgaatatgaagagggggaatctaatagtgtgatggacgcagttgaatttgttctacagaatttcacagaaatgaataagctttgggttcggttgcagttgcagcatcagggacctgctcagataagggagaagagggaaaaagaaaggaacgagcttcgtgatcttgtggggaaaaatctacatgttctgagtcaaatagagggcgtggaccttgagatgtacaaagacaccgtccttcctagtgtcttagagcaggttgtcaattgtaaagatgagcttgcccaattttatcttatggagtgcataatccaggtttttccagatgagtaccatttgcagacacttgagactttgttaggtgcttgccctcaattgcagcccacagtagacatcaagacagtgttatctcagttaatggacaggttgtcaaattatgctgcctctagtactgaagtattgcccgaatttctgcaagtggaagcatttaccaaattaagcacagcaattggcagggtgatagaagcacaagttgacatgcctattgtgggagcaatagctttgcatgtttctcttcttacatttactctccgtgttcatccagatcgacttgattatgtggaccaagtactgggatcatgtgtcaagaagctttatggaaaaccaaagcttgatgacaatagagcaacaaagcaagttgttgcacttttaagtgctccacttgataaatacaatgatattgtgactgccctgacactttccaattatcctcgtgtaatggatcatcttgatcatgaaacaaataaagttatggccatggttattatccaaagcattatgaagaataacacttgcatctgtactgccgataaggttgaagttttatttgaactaatcaaagggcttataatggacttggatggaacaactgtggatgaggttgatgaagaagatttcaatgaggagcaaaactctgttgctcgcctcatacacatgtttcataatgatgaatcagaggaaatgtttaagataatatgtaccgtaacgaagcatattatgagcggaggaccaaggcgcttaccttttacagttccctccttgatattttctgcactaagggtatctttcttccttgacgatgatattctttcaatgttttatctccagtatctttaa

SEQ ID NO: 66073 - DNA, 222 bp, Glycine max
  Peptide Sequence Number=SeqID_182851
atgggggcatacgcaaaagatgagaaattactgatacattccttccaagaaagtcttactgggaccaaatggttgccttcgttaggtagtgtcagtataatggcttcagataggatgcaactacagaacatgtgcaaaaagggggcacagatctttcaaagaatatgcccaaaggtggagggatctggcagcccaagtgtttccctcaatgacgaagaatga

SEQ ID NO: 66074 - DNA, 207 bp, Glycine max
  Peptide Sequence Number=SeqID_182852
atgcaaggcatgagcaactatgtgtcaggatcatgcatgagtgagcataacatgcaaacgatgaaagtactatcagtgacaatgcatcaccaaaagaggaaaactttagatgacacttcactgttatcaagcgagtcagagacccagcatgaccacagatcgacctccactccctatggttcacacaaactcgagtatagggcctag

SEQ ID NO: 66075 - DNA, 444 bp, Glycine max
  Peptide Sequence Number=SeqID_182853
atggaaattgaacagcaagccatgaaaatgatgaagtcgtctaggttcagacgaatctgtgtgttctgtgacaccagccatggcaagaaccccagctaccaacacgctgcaatccaactcgccaaacaacttgtggagaggaacatcgacttggtttatggaggagggagtattgggttgatgggtttaatctcacaagttgtgtttgatggtggacgccacgtgttaggggtcattccaactactcttatgccaatagagataacgggggagagtgtaggagaagtgagggcagtgtcgggtatgcaccaacgcaaggcagaaatggcgagagaagccgatgcatttattgcactgccagacataaaacgtaacttaaaggaaattaagttgaacgtcgcactggtgacaagtgctgagtttgaactgtttatgtacaactaa

SEQ ID NO: 66076 - DNA, 522 bp, Glycine max
  Peptide Sequence Number=SeqID_182854
atgtcatttttgggagaaacaagcagtcagaccattactaactccagattatctttcatttttccaaatggatcaatcagttacaaccaaactggtgtttattttcaaagtctcattccaacaccaatgcgagttcctaacaactgttcttttgatacactcaagcgtagaatgcacaacacccttcaactaaccaacgatcaattactggatgaaatctactaccgacagccattcatagatgcagaattattatgtaccattattagaacaccggatgctatactcaacctgcttcaatcaaccatcactcctactcatgatgcaattatgtattacaacgggaagtggaacataccacgtcaaggtgagtttttgggttactcctttactggaactaatccaataagatttagcattccttcgggatgtggcatggagaaactcaaggatttaatcaaacaagttacacctacaggggttccccctaatggaattcacggatcacaattggttagttga

SEQ ID NO: 66077 - DNA, 390 bp, Glycine max
  Peptide Sequence Number=SeqID_182855
aattggacatctccatcggccttacacttcatccgcatctcccttcacctatccccaacctcttactccttcaatccttcaattcgaccctctcaccaacaccaactgcaacatctccaatcctacgacgatggcgccgaaatcatcttccactcgatgattacgggagggcagtcggtggtggtgatgctgctcctcccctgcgacgacggcgacgagcaaggttgtgaaagcggagtgcagaagtttcgggtgaagatgttggcggaaagtggtggtcagagcactgtggatgttctctgtcaggtactaggcatttattctgctgctagttttcgcttaaattgcacttgcatgttggttgacagtaaattaggcaacgctggataa

SEQ ID NO: 66078 - DNA, 201 bp, Glycine max
  Peptide Sequence Number=SeqID_182856
atgacaatcaaaggacatctgagagttgattacccgagtttcaagaaaagaatggaaagatctgagaggaaaactttcaatgataagaaagcaaataaagattacatcacttgggaagataacaatatggattcatccgaagactcagaaaatgaagtcatgaatctaagtcttatggcaaaaaattatgaaagcgaataa

SEQ ID NO: 66079 - DNA, 168 bp, Glycine max
  Peptide Sequence Number=SeqID_182857
atgtggaagtggaggatgtaccgttggtggggagaaagttcacttgcattcagtcgaatggacaagaggttcgagaaagttatgcaagatggatggtcctttttgaacattcaagggagtggagcttatgtcttaaaggagaaacttaaggggctcaaagtttgctaa

SEQ ID NO: 66080 - DNA, 513 bp, Glycine max
  Peptide Sequence Number=SeqID_182858
atgacgagctcccctcctcccaagctagctacttcacaatctacggtaaagaggactaaacaatccacacaactcagaagattgactattaggcgcttagatgaagaggaacactttgaaatttcaaatgctaggaggaagatcattttattggtgagaatgagatggaggtcattcaagtcaaaactgaccacgcataaggcatttgcaaaaggcaaagtgatgacgagactccttgtaaaaagtatgtattttattgaaattgtgtctaatgtctcacaagatatcagaaaagatggctcagacaatcctgaaaaagaacatcaacaccatatatttttcgtgggagttataactttcttgaggaaaaaaacatggatgagaagcaaaagagacaataggagcaagcatcccagtctaggagtgaagcaattgttgaccctccattcctccttcacaaaatctggagtgaaagttggtttgtacaaaaccatctgggtagatgacatctaa

SEQ ID NO: 66081 - DNA, 1044 bp, Glycine max
  Peptide Sequence Number=SeqID_182859
atgtctcctattatgcatggagaaggtagcagagtcaaaaacactgcagagtacaaaatgatgccaggcaatggacagttaacagttcctccgggcttcaggttccaccctactgatgaggagcttctctactattacctgaggaagaaagtttcttatgaagccattgatcttgatgtcataagagaagtagatctcaacaaacttgagccttgggacctcaatgataagtgtaggattgggtcagggcctcagaatgagtggtatttcttcagccacaaggacaagaagtacccaacaggaaccagaacaaaccgagcaactacagctgggttttggaaagcaactgggagggacaaggccatataccacactaattccaagaggattggcatgaggaaaaccctagttttctacactggtcgtgctcctcatggccaaaagactgattggatcatgcatgagtatcgccttgatgaagatgatgctgatattcaagaagatgggtgggtggtatgcagggtgttcaaaaagaaaagccaaaaccgaggtttccagcaagaaattgaagaagaagagcacttaaccacccatatgagagcaagtggtcattgccaggtcctagagccaaagcatcatcacatgcaacaaggactctatgatcactacaacttcgatgggacaatgcatctcccacagttgttcagtcaagaatcagcagttgcaccacccacaaattcttccttggcctcatctatgaatgccatggacatccttcagtgctctcaaaacctcctgaggctcacaaccactactggctgtggacttaatctcatgcagcagcaacaacaacaaggagagaggttcagtggtgactggtctttcttggacaagctactagcatcacaccatggcatggatcaaagcaaatgtaaccctcctactcatcatcaaggtgcaagtgtgggaacttcagctcagaaattcccatttcattaccttggctgtgacaccacccatgatatcatgaaattttccaagtag

SEQ ID NO: 66082 - DNA, 1780 bp, Glycine max
  Peptide Sequence Number=SeqID_182860
cctcaaggatcagatagcaaatctagaatcagagaatgaatccctacggaggcagacagcggctgttgctttcgagcagaaagttcatccagaaaaaatagaatcagaccattcagcagcttctttggagcagaaagttcaaccagaaaaaatagaaccaggccattcagcaactgctttagagcagaaagttaatccagaaaaaatagaaccagtccattcagcaactgctttggagcagaaagttcatccagaaaaaatagaaccagatcattcagcagctgctctagagcagaaagttcatccagaaaaaatagaaccagaccatgaagttgctgttgcagagaaaatgcaagtgcaaccaagagttattgcagataatatgacttcacaaatcaagaatttggataatggaagttcaaccgaggaagaatggcaagcaagaaaagaaccgagagcaccagtcttcttgcttactaaacaaagatcactcacagataggcaacaggaaagtcatgatgcactgctcaagtgtcttacggaagataagcgatttgagaaaaacagaccagctgttgcttgtattgtatataaatcacttcttcattggagatcccttgaagcagaaaagactcatatttttgataaaattacacatgctatccgatcatctatagagagtcaagaaggaatccatgatctagcctactggctttcaacaacatcaacacttctgttttatctacaatgtacaatgaaggccagcaatacaactaaggcagtgtcacgtaatcgaaactcgcccgcctctttgtttggcaaaatggcacaaggtttacgttcatcttcaatgggcttggggatttcaagtggctacagtggaatggtggacaagacaaatggtcaatctaaagtagaagccaagtacccggcaattctgtttaagcaacatttaactgcatatgttgagaagatatatggaatgatccgtgatagtttaaagaaagagattagccccttcttaaatctgtgtatacaggcaccaagatccataaggactagatcaataagagggtcatccagaaacatccattcaaatattgttgcaaaacaacaggcattgcatatgtactggaaaggcattgtggacaagctagatactgccttgcgtatattgtctgataactatgttcctcccatcataacaaggaagatatttagtcaggttttctcattcatgaatgtccagctctttaatagtttgttgcttcgccgtgagtgttgttcctttagcaatggagaatatttgaaggcaggtttgcatgagttggaactatggtgtcttaaagcaacagaccagtttgctggatcatcttgggatgagctcaaacacatacgccaggctgtgggctttctggttttgcatcaaaagacccaaaaatctttggaggagatcacaaatgagctctgcccggtgttaagtattccacaaatatatcgtataggaactatgttctgggatgacaagtatggagcacatggattatctgcagaagtcattagcagaatgagagtgattatgacagaagactcaataaacatacacaacagctcattccttctagaggtggattccagcataccattcttaatggaggagatgttccggtcaatgagtgacatccgcctatcagacatggatgtggatccaccaccaatcctcaggcaaagatctgacttccaattcttgttgcaacaaatggatagtgactctcagtga

SEQ ID NO: 66083 - DNA, 204 bp, Glycine max
  Peptide Sequence Number=SeqID_182861
atgaatgagcatcgacatcataatcgttaccaccatcgcagtgatgatcatgttggtggtaatgatagtgatcatggtgttggtggcgacggcgacagtaacaacaacaataattatgttagtgattgcagtcatgacacctgtgatgaaaatgatcatgataatgatgatgattatagtgatgatatatttgagatattttag

SEQ ID NO: 66084 - DNA, 3111 bp, Glycine max
  Peptide Sequence Number=SeqID_182862
atgggaacacctgtgaacatcatcgttggatcacaggtttgggttgaggatcctgaggatgcatggattgatggtgaggtgacacaaatcaaaggcaaaaatgccaccatcattgccacaaatgggaaaactgtggtggcagaaatttcaagcatataccccaaagatacagaggcaccacctgcaggagttgatgacatgaccaagctagcataccttcatgagccaggagtcctgcataaccttgcaactcgtttttctctcaatgagatatatacatatacagggaatatcttaattgcagtgaatccttttcgaagactgccgcatttgtatgacatccatatgatggagcagtacaaaggagcagcatttggagagcttagtcctcacctttttgctgtagctgacacatgttacagggcaatgataaatgaaaatggaagccaatccattttggtaagtggagagagtggagctggtaaaactgagacaacgaaaatgctcatgagatatctagcattcatggggggtagatctgctacagaaggaagaactgtagaacaacaggttttggaggtatatgcagtgacattttcacttctgcagtcaaatccagtgttggaagcatttggaaatgccaaaactgtcaaaaacaacaactcaagtcgttttggtaaatttgttgaaattcaatttgacaagaatgggaagatttctggagctgcaatccgtacatatctcctcgaaagatcacgagtttgccaggtctctgatccagagagaaactaccattgcttttacatgctttgtgcagcaccaccagaggatgtcaagaagtacaagttaggggatccaaggcaattccactatcttaatcaatcaaactgttatcaagtatcgaatgtggatgatgcaaaagaatacttggagaccagaaatgcaatggatattgtaggcattagccaagaagagcaggatgcgatcttccgtgtggtagccgcaatcctccatcttggaaatgttgactttgtcaaagggaaagaagttgattcttccaaattgaaagatgataaatcactcttccacctccaaacagccgcagatttattcatgtgtgatgcgaaagcactggaagactcactttgcgagcgtgtcattgtaactcctgatggtaacattaccaaacctcttgacccagatgcagctgctttgagccgagatgccttggcaaagactgtctactccaaattgtttgattggattgtggacaagattaacagttcaattggtcaagattccaatgcacatgtattcaagatggagcaagaagagtacacaaaggaggaaatcaattggagctatgtagaatttgtggataatcaggatgttctcgatcttattgagaagaaaccagggggaattattgctcttcttgatgaagcctgcatgttccctaaatcaactcatgagacttttgcacaaaagatgtaccagacatataaaggacacaagcgcttcagcaagccaaaactttctcgaacaaatttcacaattaaccattatgctggagatgtcacatatcaagcagattattttcttgataaaaacaaagattatgttgtagcagagcatcaagctcttttatgtgcttccaagtgttcatttgttgctaatatcttccctcctttaccagaggagacatcaaagcaatcaaaattctcttccattggttcacaatttaagcaacaactgcaatctctcatggagacactgaacacaacagagccgcattacataagatgtgtgaaaccaaatacagttctgcagccaggaatctttgagaacttcaatgtcttgaaccaactaagatgtgggggagtacttgaggcaataaggattagttgtgctggatatccaacaaaaaggacatttgaagaatttcttgatcgctttggaatgctagttcctgatgtccttgatggctctgatgagaaaaaggcatctatggccatctgtgataagatgggtttaaaaggctatcaaatggggaaaacaaaggtatttctcagagctggtcagatggctgaattagatgcacgacgagccgaagtcttagctaaagcggccaaactcatacagagacaaatccgaacacatttaacgagaaaggagtttatcaccttgagaaaggccactattcatatccaaaagatttggagagctaaacttgcacgtaaactctatgagaatatgaggagggaagcagcttctatcaggatacagaaacacgtgcgtgcacacagagcaagaatgaattatacaacgttacaagcatcagctatagttattcaatcaggtttgagagcattagcagcaagaaatgaatataggtacagaagaagaacaaaggcttcaacaaaaattcagacacaatggagaagagcccaagctctttctggttacaaacagcagaagaaagcaactgttgcacttcaatgtctatggagagctaaagtagcaaggaaagagctcagaaagcttcggatggctgcaagagaaactggggcacttaaggaagcaaaggacaagttggagaagcgtgttgaggagcttacatggcgactggatattgaaaagcacatgaggacagatcttgaagaagctaaagggcaagagattgcaaaattgcaaaatgctttacaagaaatgcaaggtcagttagatgaagcccatgctgcaattatacatgagagagaagcagcaaaaatagcaattgaacaagcaccaccagtaattaaagaggtacctgttgtggacaacacaaagctagatttactgacaaataaaaatgaggagttggagactgaagtagaagagctgaaaaacaagattaaagactttgaagaaaggttctcagaagtcgagaacgagaaccaagaaaggctgaaagaggcagaagaagcacagcttaaagcaacacaacttcaggagactattgaaagattagaattgagtttgtcaaaccttgagtctgagaaccaggttctatgccagaaggctttggaagaatcaaaaaatgaagaactctttgaagagatcaaaatgtaa

SEQ ID NO: 66085 - DNA, 1101 bp, Glycine max
  Peptide Sequence Number=SeqID_182863
atggaggaaagtggctcctataggaatgacatgtgtactggattgcggtgccacactactaataataacacatttcacgacgtgcatttaagggcagttgtgaaacttccgccaaatgtttcagttccagcagtgttggtgtttggagattcaatcgtggacactggcaacaacaacaacaacttaggaacaacagctcggtgcaattacccaccatatggtaaagattttgagggaggcaaaccaactggtcgatttagcaacggaaaggttccatctgactttatagctgaagaattgggcattaaagagtatgtaccagcatacttggatccacatctccaacctggtgaattggccactggtgtgtgctttgcatctggtggtgcaggatacgatcctttgacatcgcaatcagcgtcggctatatctttatcgggtcaactagacttgttcaaagaatacctaggcaaattacgaggagtggttggagaagacagaacaaacttcatcttagccaacagtctttatgttgtggtatttggcagcaatgacatttccaatacttactttttgtcccgtgttagacaactgcaatatgattttcctacatacgctgattttctgctcagctcagcttctaatttcttcaaggaattatatggattaggggcacggaggattgcagtgttcagtgcaccgccacttgggtgtttgccatctcagagaacgctggcaggaggattagaaagaaaaattgtagtcaatattaacgacgcagccaagttatttaacaacaaattgtcaaaggagctggattctctcaatcacaactttcaagatagcaggatagtttacattgatgtttacaaccctctctttgacatcattataaactacaaaaaatatggctataaagtcggagacaagggttgctgtggcacgggaacaatagaggttgtgttattatgcaaccgtttcactcccttgtgtcccaacgatttagagtatgtgttttgggacagttttcatcctactgaaagcgtttatagaaggctcatagcttctcttcttggaaaatatttggataaattcttgtga

SEQ ID NO: 66086 - DNA, 225 bp, Glycine max
  Peptide Sequence Number=SeqID_182864
atggaccaaatggtgtccggggccgaagttccacttccaatgattattcactatcacaatgggcttgtgagcaaggaattgttgccaaacgacctttcacatgttgacggtgtacacgtagcagttgaggaaattgtcgtggcgataatgaaagctcaattttttggtgttggtatgattgtacaagaggaaatttccaggcatgatcatattgtttcgctctga

SEQ ID NO: 66087 - DNA, 1356 bp, Glycine max
  Peptide Sequence Number=SeqID_182865
atggaacgtattaagcgggatcgtacacaaatgagcagatcactttccatcgccctggcccagctgaacctgctggtcggcgacattgaaggcaacaccgaacgcatgttgcaaatcgtgcaggagcagcagaaggcgggagccgatctggtcatgttcagcgaactggcgctgtccggctacccgccggaagatctgctgtatcgcaatgatttctatcagcgctgcgacgcgcagctgctgcgcctgcagcaggcctccgccgagaccgcgatcctggtcggccacccgtggcgcgaaggcgacaagctgtataacgcgctgtcgctgtttgccgaaggccgcctgctgacccgctactttaaacagcagctgccgaactacggcgtgttcgatgagaagcgctatttccacgccggcaacgacacctgcgtggtggaactgaaaggctaccgtctggggctgctgatttgcgaagatctgtggttccctgagccgattgacgccgccaaggcggccggcgcggaaattatcctgtcgatcaacgcctcgccgtataaccgtgaaaagccgtatatccgcaaaaccctgatggccggccactgccagcgcacccagctgccgctggtgtacctcaaccaggtcggcggccaggatgagctgattttcgacggctgttccaaggtcttcgacgccgccggcaccatgactcaccgtctggcggccttcgacgagcaggtgacccgcctggaattcaacgagctggccgtggtgccgatggccgatccggccgccgagctgccgcagctggcgcaggtgtaccaggcgctggtgttggcggtgcgcgactacgtgaccaaaaatggcttcaaaggcgcggtgctcggcctgtccggcggcatcgactcggcgctgacgctggcgatcgccgtggatgcgctgggcaaagacaaggtgcaggcgctgatgatgccgttccgctataccgcggacatcagcatcgccgacgccaaggaagaggcggaaatcctcggcgtggagttcgatatcgtctccatcgaaccgatgttcgacgcctttatgggccagctgtcgccgatgttcgccggcaccgagcgcgacaccaccgaagaaaacctgcaggcgcgttgccgcggggtggtgctgatggcgctgtccaacaaacgccgcagcatcgtgctgaccaccggcaacaagagcgaaatggcggtgggatacgccacgctgtacggcgatatggccggcggtttcgacgtgctgaaggacgtgccgaaaacgctggtgttcaagctgtccgaataccgcaacaccgtctcctacgtgatcccgcagcgg

SEQ ID NO: 66088 - DNA, 252 bp, Glycine max
  Peptide Sequence Number=SeqID_182866
atggctaagttcgggaggcatgctccagagattgaaggccttgtggcttccagcagactaaactttgtaaaaggcattttacaagagagtggaaatctcaagcgggttgcttggggactggacgtaggcacaggacgtggccgaaccagtataaaaactgagtttgcattctctcttcccttaaaacttcttttttcattgctatttatcttttgctttaaagaagtttattttgaattgtcttttgagtaa

SEQ ID NO: 66089 - DNA, 204 bp, Glycine max
  Peptide Sequence Number=SeqID_182867
atggaagttggaagtggaagttacaggaagttggaagttggaagtggaagttattgtaagttgaaagttaaaaatggaaattggaagtggaagttactagaagttgaagttggaagtggaagttgtgtaatcgattacaagacattactctttagaagtaactgtgtaatcggttacatcattatggtaatcaattacaagtaa

SEQ ID NO: 66090 - DNA, 354 bp, Glycine max
  Peptide Sequence Number=SeqID_182868
atgagtgaaatagaggaggtgcaagagcagatgaaggtcgacatgaaggccatgaaagagaaaatgactacaatgatggaagccatgataagtatgagaaaaatgatggaggtcaacacaactacagttgttgccacaagtaccgccacagaagtggacctgactcacccacctggcttcaatcaaggaggcaaagcattgggaagtgcgagcggcccccattttgtgcaggttcagaataagcattccttcccaccatatggcttgcctcccaactatacaccacccaatgttgcacacactcccgatgagaatgtcaacaactccccacccatacccattgagagccaataa

SEQ ID NO: 66091 - DNA, 905 bp, Glycine max
  Peptide Sequence Number=SeqID_182869
gtcatttgctcaagattgatgctgataatctcaacgcattccttgagacagctgtggtattagcagagggggagacattacccgcatactctagatactgcaggttacctacagattacagagagatagagggccatcctgggaagattctcaagaaagatctgactacactagctcaggtgtggagtgttctctcatactccaacttggcccccacatcacatacttctgatttgatagtggagagagctaggctgatctttggcctagtctctcacatggatatgaacataggagcgcttatctctggccagatgacttctacagcccagtctaacacttctagacttgggtttccagctctgatcaccgcattatgtagatccagaggggttgtctctgatagcctcacttttgagcgcctgagcccggtcattaacttggcctacatcaggaaaaactgttggaaccccaaggctctaacaatttctatccgaggggttaggagggtgagggctaggccagctgagctcccttccacttttgcggctcctactccagcatccatgtcagtggtggcgcctctaggatctattccctcagtcgagcagttcaaagagatggtagtctggtctaggaatcaaccttctcttcacaaggaagataaaggtcccacagctcaggtaccacagaatatggaggatgagttctctgaggccaccattccagagccatttactgcaggggaggaggcaggtgacacacagatgacacaagtagctactgccacttctgagagatctcttgaggccacttcagagcctcctgcatcagcagtggacctaccttcacctcagcacgcaacagacccttctactcctgtcctagagatacctaaagactag

SEQ ID NO: 66092 - DNA, 222 bp, Glycine max
  Peptide Sequence Number=SeqID_182870
atgtggatatggcatggtgaattgacagacatgcagagtgggtcccaatctgaaccatttgatgtagaaatcggagatcgcttggaggatatgatttgtgatcttgaacaagagtcttttcagcaagcacatgcctttatatatgatacattgcaaactgattcaaagaagtctttgtatccggggtgcaagaattccttgacgttgttatcagcggtgtga

SEQ ID NO: 66093 - DNA, 870 bp, Glycine max
  Peptide Sequence Number=SeqID_182871
atggtgagacaacgagtgacatatgtcatttggagagctgaacaattgggtattaaggagtatttgcctgcatatttggatccgaatctcaaatctagtgatcttgttaccggcgtctgctttgcctccggtgcttcaggatacgatcctttgacacccaaaataacgtcagttctatcgttatctactcaactagacatgttcagggaatacataggaaagctgaaaggcattgttggagagagcagaacaaactacatcctatccaatagtctttatcttgtggtggcaggtagtgacgacattgccaacacctattttgttgctcacgccagaatattacagtatgacattccttcttacaccgaccttatggtcaactcagcctctaattttgtaaaggaactgtataatctgggagctcgtagagttgcagtactgggtgcaccaccgattggatgcgtgccatcacagagaactctggctggagggctaacaagaaagtgctcagaaaagtacaattacgcagccaggttgttcaattccaaactttcaaaggaacttgattccctcggtcacaacttgtccgataccaggatagtttacattgatgtttacacccctctgctcgatatcattgaaaactaccaaaaatatggctataaagttatggacagaggttgctgtggcacaggcaaactagaggttgcagtgttatgcaaccctttggatgccacttgttccaatgcttcggaatatgtcttttgggatagttatcatccaacagaaggagtttacagaaagctcgtaaattatgttcttgaaaagtgtttaaatatgatttttgatgattttactggttggaaatag

SEQ ID NO: 66094 - DNA, 192 bp, Glycine max
  Peptide Sequence Number=SeqID_182872
atggctgttaacggaacaattccagcattgttttcatttggagactcaatccttgatacaggaaataataacaaccttcagacattaaccaagtgcaattttcctccatatggaattgatttccaaggaggaatacctacaggaagatgctgcaatggaaaaactcccacagatttgatagtggagatataa

SEQ ID NO: 66095 - DNA, 569 bp, Glycine max
  Peptide Sequence Number=SeqID_182873
atggcgctgaccctactctccttcactttcatgggctacctgatgatcggcgtgccggtggcgttcgccatcgggctgtcttcgatcaccgcgatcatgtacgaggacctgccgctggcggtggccttccagcagatgacctcgggcatgaacgcgttttcgttcctggccatcccgttcttcatcttcaccggcgaactgatgctgtacggcggcatcgccgaccgcatcgtggcattcgccaaatcgctggtgggccacgtgcgcggcggcctgggcatgtccaacgtggtggcctgcacgctgttcggcggcgtgtcgggttcgccggtggcggacgtgtcggcaatgggttcggtgatgatcccgatgatgaagcgcgagggctaccacgccgactacgcggtcaacgtcaccacccacgcggcgctggtgggcgcgctgatgccgaccagccacaacatcatcatctacacgctggcggcgggcggcaaggtgtcgatcgccgcgctgatcgcggccggcgtggtgccggcgctgatcctgacgctgtgcaatctggcggcggc

SEQ ID NO: 66096 - DNA, 684 bp, Glycine max
  Peptide Sequence Number=SeqID_182874
atgtttcgagaatacataggaaagctgacagcacttgttggacaacaacgagccgctaacatcatatccaacagtgtgtatcttgtttctgccggcaacaatgacattgccattacctattctcagatattagccacaacacagcctttccccttatatgccacacgtttaattgacaccacttcaaatttcctcaagagtctatatgaacttggagcaagacgagtgtgggtactaagtacattgccacttggatgcttgcctggaggtagaactgtggcagggggaccattaaggatttgtgcaccctttgcgaatctatttgcgcagacattcaatggccaattatcatcagcagttaattctatcagaaccacccttcccaattatgacattaggttcatcgatgtctatactcctctctttaatctcataaataatcctcagccagaagggtttgtagatgtctcagaagggtgttgtgggactgcgccatttggagtttcaggaatatgtagccttttcagcttgtgcccaaatccttcctcatacgttttctgggattctgcccatccaactgagagagcttataagtttgttgtgtctactatactacaatcacatactaataatgtttcgagctcttttgcttttgctccatttaattcttcactctcaaattaa

SEQ ID NO: 66097 - DNA, 1077 bp, Glycine max
  Peptide Sequence Number=SeqID_182875
atgacttcacaatctcctcagaaacaagcgactactattgcaaaacctagttctgcaccaaattataatgtgcctagtagacaaagatcgatgaagcgggtaggtggcagcagcactggatctggtccttcacagagcaacttctccaaccctcccccaacgccgcccccgcccccgccttttcctgtataccagctcccaccagttagctatggtaatatggtaccaggtgtccctgaccatgctccaagagatcattaccggaacaataactgggatgcaagaccattggttgggggttttgtgcctgcaatgaatgaatatcggggttcctctcgtaggggttattttgggcctcatccacgaggagatggttcctatcataatagttatggtagcaggcgtgatcatcaagatcgtggaaattatgtgaatgctagagatgcttttctacctcaaccaaggatgcctccaagaggattactgaggcacccaccacctaataccgctgcatttgtgggccctcagcctattggaccatttgctaaccccatcagttttcctgagttctattactatcaaccagtaacagtggaacagtttacgggtatgccattcttcactcacagccctcctcctacaccgttcttctctgccgcagaatctcctctctctaatatgatagtctaccaaattgaatattactttagtgatgctaatttagtgaaagacgcatttttaaggtctaaaatggacgaacagggttgggttcctgttactttgatagcagactttcctcgagttaaaaatttgacaaccaacattcagttgatacttgactctctcagaacttctactgttgtggaagtgcaaggtgacaagttaaggagacttaacgagtggatgagatggctgccctctgctcagcgacgatctaattctggttcaatatctcctagtgggtcaacacacaataatcttacagctaattttcaaactatcatcttggaagaaaccactgcagatgaaagtccaacacagccaaacggtggtgatgctactaagagcagcatttaa

SEQ ID NO: 66098 - DNA, 501 bp, Glycine max
  Peptide Sequence Number=SeqID_182876
atgcctaaaggtactgtggtgatgggaaataatgcatcatgcaagatagctagtattgggacaatccaaattaagatgtttgatggagttattcatatacatggtgatgttatgcatgttcttgatctgaaaaggaatcttatctctttatgcactctggattcaaaagggtacaagtacactagtgaaggtggagtcatgaagtgctctggttgtgatgaaaggtatgcaaaacaaaaacggttcaaattcaagaagggcactcacaatcctaaagaaacaccttattaccttcattctgatctttggggactagcgaaagttccctctttagaggccaattatatgctgacgataattgatggtacatcaggagttaaagatgcaaggtataaggaaagacttgttgctaaaggttatagacaaatcccagagcttaaggagttggatgtgaagattgcattcttacacggagagttacatgaggatatctacatgtag

SEQ ID NO: 66099 - DNA, 537 bp, Glycine max
  Peptide Sequence Number=SeqID_182877
atgaaagagttgggagcaacaaagaagatacttgggatggagattttgagagatagagctactggcagattatacctaagccaaaaggggtacattgagaaagttctttgcagatttaacatgcaaaaagccaagccagttactactccattagcggttcaatttaggcttccatcccctttacgtccacagatagttgatgatattgatttcatgtcacaagtttcatactctagtacagtggattcttttatgtatgccatgatttttagggagaccttgataaaagaagatctcttacacggtacgtcttctcaattaggggttgtgctatcagttgaaaggttgagtacaaaggcttctaaggaagttatttggttgaagggactatttggtgaacttagtggagacctacagtttagctctttggagcttttgtgtggaaaaggtggagatggttcatttgttgctagagagttggagtttgtggtttcttcattgcattatggaattcatgtcaaggtggagatatgttga

SEQ ID NO: 66100 - DNA, 434 bp, Glycine max
  Peptide Sequence Number=SeqID_182878
atgactcaaaagctggtaacttgcggagacaccttacggttatccgcacctcgtcattcagtgaccccaagtgtgattgatgagcagaggccaatatggtcatctgcgccctttccggagatgtcagcatcttccggtggagactttttcaagtctcacaagttatctagaactacgagcaagagcattgcttttatcggccaccccacaagatctgtcatactgaccctgaggtcatgtgacatgcggagacaaaatttggtcattccgcacccctttgccattcagacacagtcgtgtccgatggcgcgcagagacaaaaattggtcattctgcaccctttgtcatccagaggcggcgggcccgatgacatgcggagacaaaatttggtcattccgcaccccttttccattcagacacagtcgtgtccgatg

SEQ ID NO: 66101 - DNA, 576 bp, Glycine max
  Peptide Sequence Number=SeqID_182879
atggcgaaaagtctcaccaacaagttgcactcaaaacataggttgtattctcaccgtatggctgaagccatgtctatagagggccacttgactatgtttaaggatattattgttgatttagaggtgatggaggttaaatacgatgaaggagatttggggttaattttattgtgctcactgccttcatcatatgccacgtttagagatacaattctatatagttgtgatacgttaaccctagatgaggtttttgatgctttgttttctaaggaaaagatgaagcaacttgtgagtggatatgaggctcagggagagggtttgtttgttcatggtagaccacaagaacaagggtttggtaatccgcaaatggctggttcaaagttcaggaatgctgagaagacttgtaattactgcaagcaaaagggtcacatcaagactaattgttataagctaaaaaataagaaaaagagaatggtgagcaaacagggaaaaccacaaaagaatatggtgaagctagtattgtggacacaaatcacattgatggagaattattggttgcttctcatggtgacttga

SEQ ID NO: 66102 - DNA, 510 bp, Glycine max
  Peptide Sequence Number=SeqID_182880
atgtaccctgctgggtttcatgtcctcgggaatcacgaagagtggcgcggagaacatcaggcccgtccacgtgtccggttccgatttgaagtacatgaggagcgtggcgagtcctcccatggactcgccgaagaggaatgccgggaggtttttgtaggggtggctattgcggacgtggaggaagaaggagagggaggtggcggcgattttgtccatgtcgccgagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgacccctgccgcttacccggatacctgtccggctttctcccttcgggaagcgtggcgctttctcatag

SEQ ID NO: 66103 - DNA, 1113 bp, Glycine max
  Peptide Sequence Number=SeqID_182881
cgccacgcttcccgaagggagaaagccggacaggtatccgggtaagcggcaggggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccccgctccgacggtctccagtgctacctcggcgacatggacaaaatcgccgccacctccctctccttcttcctccacgtccgcaatagccacccctacaaaaacctcccggcattcctcttcggcgagtccatgggaggactcgccacgctcctcatgtacttcaaatcggaaccggacacgtggacgggcctgatgttctccgcgccactcttcgtgattcccgaggacatgaaacccagcagggtacatttgttcatgtacggtctcttgttcggtctcgccgacacgtgggcggccatgccggataacaaaatggtcggaaaggccatcagggatcccgagaagttgaaggtcatagcgtcgaacccgaggcgctacacgggcccacccagggtggggaccatgcgggagctgcttagggtgacacagtatgtacaggataatttctccaaggtaacgacgccgtttttcactgctcacggaacttctgacggcgttacctgcccttcctcgtccaagctgctgtatgagaagggttccagtgaggataagacgttgaagctctacgatggaatgtatcactctttgattcagggagagcccgatgagtctgcgaatctcgtgttgggggacatgagagagtggattgatgagagggttcgacg

SEQ ID NO: 66104 - DNA, 3027 bp, Glycine max
  Peptide Sequence Number=SeqID_182882
atgcgctcaggagtttgtgcattacagcagaccctcacagctgaggctgcttcagtgttgaagcactctctggggttggctcggaggaggggccatgcacagctcactcctctgcatgtggctgccactttgctaagccttagaggcagttccttgagaagggcttgcctcaagtctcagcctcaccaaacttctcatcatcctcttcaatgcagggcccttgagttgtgcttcaatgttgccctcaacaggctccaaacaacaccttctcctttgatccacactcagccttctctctccaatgctctcattgctgcattgaagagagctcaggctcaccagagaaggggctgcattgagcaccagcagcaacagcctctgctcaccatcaaggttgagctggaacacctcatcatatcaatccttgatgaccctagtgttagcagggttatgagagaggctggcttctccagcactgctgttaagaacaacatagaggactcttcacctcattctgttttccagtgttacaatagttctggtggtgtgttctcttctccttgttcaccttctgccagtgagaacaacaaccatagggaaacagccaccaaccctaccaatttcagacaccctcatcattacttaacttcttatgcatcttctgagttccacccttcacttctgttttctccaccaaagaataattcaccagtgtgttccatcactggtgcagcttcttctagtaaggatgatgtcaggcttgttctggatatcctcttgaggaagaagaaaaagaacaccgtgattgttggtgactcactgtcattaactgaaggccttgtggcagagctaatggggaggctagaaaggtcagaagtgcctgatgagttaaagtcaacccattttatcaaattccaaatttcacatgattcattgagttgcatgaagagagatgaagttgaaatgaaactcttggaactcaaaaggaaggtggaatccattgcttcaggaggaggagggggtggcattttttatattggagacctgaagtggacagtgaaggaggcaagtttcagtgagaaagaggaaggatccccaaatggagaagtttctggttataaccctgttgatcatcttgtttcagaaatagggaagttattctctgattgtggaacctcaaataatgctaaggtgtggctcatggccactgctagctatcaaacatacatgaggtgtcaaatgaggcaaccccctcttgagaagcaatgggctcttcaggctgttcctattccatcaggtggacttggcttgagtcttcatgctcccagtgtccttcattcaaagatgattgtctcgcataaccaatctcatgtgccggaaacaaatccctttggtaacatggagcaggagaataagctcaattgttgtgaggaatgtgcctccaattatgaaaaagaagcccaatttctcaggcccgaccaaaagaaaatgttgcctctctggcttcagtctcatagcacagaagactctaagaaggatgaattagtccaattgaaaagaaaatggaatagactatgccactgtctccaccaaagcaaacagcctcagaaccaatggagctggaaccacaacagttataattcaccaagctctatatcctttgccaacaatgccacacatggctccacttccaaacttgtccctcgattccagcgccaacaattatgcatcattgagttcaatttcggcaacaaaagggaagcaacagagccagtcttggattcccttgagagcatggacggtaaaaaagtaaagactattcttgctcttggcaatggtggttcaggtgagtcgacggtgggggatataactgatacaacactgcaacaagctcatatttgtaaactattgcaggagaatgtaccatggcagtctgagactgttccttcaatagcagaagccttgattgattccaaatcagcaaagcaaaataacaatattacttggttacttgtgcaaggcaatgacaccattgggaaaagaaggttggcacttgcaattgcagaatcagtttttggctcaactgatgtactccttcactttgacatgctaaagagagagacttcaatagccccattttctgaaatgctggaaggagcactgaagacacaccaccagcttgtgattctaatagaaaatgttgactttgctgatgcccagttcaagaaattcctctcagatggatttgaaaagggaaagtttggaaatttcacagaagagaactcaagccaagtaatattcatattgacaaatggtggatgtggatccactagcaatgaagagcagaatgataacttggttatgaggttgttgtggcaggtcagtgaaaccaagcctaactcagagacgccatctgtggcaaccaggatcgcggagccttgtttaggccacaagagaagagctgaacttgatttgttttctaacaccaacagttctcaagggagcaagaagaaacagttttcaagacaaacaagctttaacactcttgatctgaacatgaaagctgatgaagaggataaagcaggagagagtagccccatttcaagtgatttgactggagaaactatagctgatccgttgaaccaaaatgggtttcttgactcaaatgtgaaccggtttgagtttaacacaaatccagttaaggacagagagatggcagagttgtttctgtgtaagttcaaagggtcttttgaggaggtttgtgggaagcaatgttgggagaatttaagtgtagatgagagggtgattgaggatgtgagtgttgggtgtggttattttaccaacagcttgtttgagaaatggctgaaagacgtttttcaaagcagtttagaaacagttaactttggagggaaggagggtatacttttaagactttcttgggagggtaaaggagatagaaaatcggatagtgggttcatgagttcttctctgcccaagagtatccaagttaattacttcatagagtga

SEQ ID NO: 66105 - DNA, 111 bp, Glycine max
  Peptide Sequence Number=SeqID_182883
atgggggcacctgtgttctctgagcagtctatatatcttgttccgattaaagacaaagcaccactaagtagattttcaacaaagcctgaaagtaaaccaagggttcattaa

SEQ ID NO: 66106 - DNA, 462 bp, Glycine max
  Peptide Sequence Number=SeqID_182884
atgggattgaaccaagcaccctcttttaagaaaaggttctatcatgtcaaaattaagagtctagaagtagccaacttgcaagagctagggcagtggatggatcaacttcaacgtcaagccttccgtaaggcatatgggaaaatctgggacttggctatgatagaagtttccgtagaagccatcgcatccctcactcagtattatgaccagtcgctaagatgcttcacgtttggggattttcagttggcaccaaccgtagaagagtttgaagggatcttgggatgcccgctaggaggaaggaagccatatctgttttctgggttatacccctccatggcaagagtagcaaaggtggtcaagatctcggtgcaagaattggaccaagtgaaacaaaatagaaatggggtggttgggataccaaggaagcacttggaagagaaagcaaaagctttggctggttaa

SEQ ID NO: 66107 - DNA, 261 bp, Glycine max
  Peptide Sequence Number=SeqID_182885
cagacggccaaccaccgggtgcacgtgcagacccatgactctctatatcagcttagcctcagcctgcagagccagggttttgcttcttttccatgccctactccggatcagttcagggcagaggtcgcatggccaggagattggcttgaggcccaggcaggggaggcatccgcagaggctcccgacgaggcagatgaggcccacgaggacgaggagatgaccgatttgcttgatttcttgggagggagcggagccacatga

SEQ ID NO: 66108 - DNA, 393 bp, Glycine max
  Peptide Sequence Number=SeqID_182886
atgaatggcagaaatggaaccactccaacaatggtgtcaccaccttcacaacatagctcatgtgggtccactgagcccaaccaagaggacaacaataacaacaacaatgacaacaacaacgatgacaacaaccacaacaacaatgacgatgacaacaacaacaacaacaacaataacaataatggcaacaacaacaacaacaacaacaacaatggcgacaacaacaacaacaacaacaacaacaatggtgacaaccaccttgaagctccttccttggtgctagtggggttccctcgctgtcttatgtatcagatgatctctgaggataacctcaagagagttataagcaattgggcttggatccggaattgggatgaaccggcttggacttga

SEQ ID NO: 66109 - DNA, 426 bp, Glycine max
  Peptide Sequence Number=SeqID_182887
atgccacaatctaggaatggtgttgacagttttggcggtatgggggcaactttagtagattcactcgacacattatttataatgggtcttgatgtccaattcaaaagggctacagaagttctaggtggccttctcaatgcttatgatctctgtggaatcccctataacagaattaacttggcatatggaaatacaaataaccctacatgggcgcgggaaaacagtattcttgtggattctggttcagagcaacttgaatttattgctctctctcaacggacaaatgaccccaagtacaaggaaaaggctgaaaaggtcatcaagggtctttatgaaacttttccagaggatgttgcttcctataaacatcaatccacttactggaacaaaatcaagtggagcagctacatttggtgccatggatga

SEQ ID NO: 66110 - DNA, 1137 bp, Glycine max
  Peptide Sequence Number=SeqID_182888
atgacatgtactgggtggatttgttctctacgaagaacaggtagatcacggaaggaatgtaacgaagatagatggtataagaagcaaagcgtgaatgaggaatatttggaagcattcagaacaaagtcttacatcgaaatatgcaacaaagcacaagaggggattgaaaagacaagcaccaaaatgctaacttcctcttcttcttcaattcctttgtgcatgcagctcacggagtatttgcttgagccgcggcaagagatgatagcaaacatagcacagagattgaagctgcatcatcttcttgtggactacttcgaagcaagcttagaagcgtgtcgttgttgtgacacaatccttgaagccatccattcaatgcgacttgcttatcgacgaatcacaagggttgttaagctaagcaaaacggtccttgacgatgaagatgatgacaatgacgacaaaatccacaacaagtatgtaatctatagagagttagcttcctttgctatgcaaaaaaaccctttgtccgttgttattagcaccgtgaagttccgtgacatccacgacagacacgtggaactcttgcaaagactgaaatcaacgagaagggaaattcgaaggaggttgacattaaagagggtttgcaagaaggttttggggattgctcttattactgctcatagcgtggttcttgttgctttgttagtgtttgcttttcacagcattgttgggttggtggctgcgcctagtatcgtgtgtgggttggttggtttgttcgtgaagaggggccgtgaaaggtttaggtcaagctattgtgatgatgagaagctgtgtgaacaacttgatgtggctgcaaaaggggtttatgttctgagcaatgatttggacacaatgagtaggatggtgaagaggctgcacgatgaagtggagcataggaaagtggttgctgaggtttgtgtgaggaatgagaagagtgagatactactgaagcaggttatgagggattttcatgagcatgagtctagctttctggagcagttggaagagcttgaggggcatatctacttgtgctttctcaccacaaacagatcaaggaggcttgttgtgcaagaaattacggacaaaaaagtaaaacattga

SEQ ID NO: 66111 - DNA, 603 bp, Glycine max
  Peptide Sequence Number=SeqID_182889
atgtgggagaaatcaatgaaaggtcttcaaagcttgatttggaggtcaacaccatcttttacatgcctagtcaaaggcttggaaatgcagcctttgactaggtgctattttgaaaaggaagtctattttagccttagccgaatggatgaattagcatgttttgttcctggaatgctggctctgggatcttctaactatggccttggagaagctgaaaaatttatggcacttgcagaggagcttgcatggacttgctacaatttctatcagctaacaccaactaaattggcaggagagagctattactttagcaatggacaggtgaatactggtgcaaaagacaatatgatgcagagctacttcctttcagaaacactcaagtacctctatctcttgttttctcctccatcagtcatttctcttaatgaatgggtgttcaacactgaggcacacatcttaagaattatgactagaagtgcgcatgaagagagtggtgaacaagaagaggggactacttgttttgctttaccaacagagttaggttgtctgtctatggtgaacaatacttggaagctcggtttattggtgtacttagtaggataa

SEQ ID NO: 66112 - DNA, 912 bp, Glycine max
  Peptide Sequence Number=SeqID_182890
atgaggttcagtgcttctgctctttctgttgcgaaattcccaaacaaggggacactctatcttccctttccttctgtctttagcattctctgggggcattgggaaaaagtggatgttatgagtcccacattcgtgtcacgaggatctctcacctgtttgagtgtgcttactgactgcttagtcataacattggagcagcagaaagagaaaggttctaatgaaattgttttcaaagcaatggggagagctatcaacaaaaccgtgacaattgtggagttgatcaagaggagaattgtgggcctccaccagaatacagcaattggatccactgatatcactgatacttgggagcccctagaggaaggcctccttcctttggagacgacaaggcacgtgtcaatgataacaataaccctttcaaagaaggaactcgatacatcgtctgtgggggaatttaacagattgcttttttttaggtatcagcctccactaccagctgaccaggtgaaggctgctacagattttgattatgaaggaggtaggtacacatgcaggagggttcacctaatggtcgtgttcgtggtcgtggtggccgaggcaggggaaggggcagaggtaatggctttatttcagctgattatgaggatggaggttgggatcgcaataggggaaatgctaggggcaggggtagaggaagaggacgtggctttcgtggtcgtggaaggggagggtacaatgggccccatgttgacatgcaagatggaggatacaaccaagatgtacctcaaggccgtggtcgtggccgtggcagggggggatatcgtggaaggggtcgtggcttccgatcgaatgggccaatccaagcagctgcctgaggcaaccagtaggccgccattagtgcagtgcagatga

SEQ ID NO: 66113 - DNA, 405 bp, Glycine max
  Peptide Sequence Number=SeqID_182891
atggaatgggatgagatggcttcccttcaggaagaattgaagggagttaaagataagatttatgaaaatcaaaaggttgaagaagcacttacaacaaccacaacagaactctctaccctccaagaggagatactctcaaaatccaagctattggaattagcaaaaagattgcattcaagggactcttttaaccaaggaattaaacctgataaagactttagaagcacaactaaaggaagacatctactttcaaatgcagagcttgagcaaaagatgaagtcttttgaagatctccatattgaatatggatctgctaaaggagtcttgaacttgagggacatgttcagactaataacagtcgcagaagaggaaaaagcacaattgagggaattggaagtatattag

SEQ ID NO: 66114 - DNA, 372 bp, Glycine max
  Peptide Sequence Number=SeqID_182892
atggcgcctatactcggtcaatggagtccactgctgggactggcattggattcggccgccagttgttttgctattggtggcacatggtccctgtatatggaactggtcagagaacgaatagacgcgggatcgataggctccgaatatccagttttggatctctctaacgggactggaacgggcgaagccattggattgattgggcgagttagcccaacaggaatgtggtcgtctagatcgggcttagccgcttcgtctgcggattctctagtagctgctctagcgtctgcttcgtcgggtgctgaatcggatgctttatctgcgcggtttgaaactctttggaaaagaaaatgctttgcccaggaattctag

SEQ ID NO: 66115 - DNA, 273 bp, Glycine max
  Peptide Sequence Number=SeqID_182893
atgaatcagtccatctccccaaaactagctaatatccggattagtcctcaggtgtggaaactgaccggggttgaagttgctaccgactcttatcctcgctcactaaactcccccaacctagtctcatgtcaagagagaagagcggaacttctttttccaggccacctacatctgatccatctggcgaagaggggcgcatcgtctgaagctaccgtccattccaatagagactcatcatcggagaaagatccgtcaggcacaggtcttcgttaa

SEQ ID NO: 66116 - DNA, 422 bp, Glycine max
  Peptide Sequence Number=SeqID_182894
tccggatatttggttgctttgtactcgacccatgtggttcggcttgttgggccacctcacttaaccaaacatctccgagaagaagttctaccagatctacagcacttgctgcttcatgcccggttgcatcttactctgctggttcaccttcgaaacaggtctccgcacctgagacacatccttctcctcgagctggagctcctactgttcccgcgccagcttccactctagctcccttcggcctcgaagatcatcaggaggtcgtacatttcaccagactgtgggacagacacgtcccaaaatccgttctccccccttctggtctggaaagtacctttgccctgcctgatgctgtagcagcttatactgatgcgttgtatccttactcggctcgggctcttttgattgattccaaagcctag

SEQ ID NO: 66117 - DNA, 577 bp, Glycine max
  Peptide Sequence Number=SeqID_182895
gagttttagcgggctatccacaagcattagttctccccctgacctgcctcccaacctcaagatcatcagcggacgacgccttcttccgaaagtcctccctctttgctttgccccagcgaaagagactgaaaaagatccggtggaagttcaaagcatcgaagatgagtacatggaagcaccaatgaagaaagaagaagcatacataagcggcctctttttctcaccggtgacatcggcgaaagaaagaaggctaccgcgggtagagatcgaccctggggcctccatcaacgtgatgccactgcgggccctagccgatcttggaatgaattcctacgagccggctaagtcagaccaaggttactattccgggaacgagaagtaccagatgggggagacccgctacttcaacgaaatatactacctcactaagatggctgtcagcccgagtgcctctgggttgggtgtcacagcttatacctcgagtggctctttatccgtagcggatctccttcctgggagattggcttggcgcactggaaaggagattaaagatgggatggaatatgccaagggctga

SEQ ID NO: 66118 - DNA, 207 bp, Glycine max
  Peptide Sequence Number=SeqID_182896
atgaaaacggcgctcatgccgaggcacggcaagaaaagcgccagaagcacagaatcgagcatgtccagtttaagggtggagagggagcaaatgatgaagatttttaaaacatcagaggtaagaataatggtgaagaatgacaatgaaaaagaagaggggagagtgtggggaatggtttgtgtttggttgtttgcattgagaagatag

SEQ ID NO: 66119 - DNA, 221 bp, Glycine max
  Peptide Sequence Number=SeqID_182897
gctttctccggaggggcccttgtgctcaccagcatggatgacgaggaactaccttcacccggattcctgtcctctgtaattttctcgtcgcaatcttttaaagaacgtgggattgggggttcattgtttcgatcctcgctttgtgccttaaaagatgcggacatgattgctttaagtgatggtcaaataccgcgccaaatccaagacagagatgaatcgag

SEQ ID NO: 66120 - DNA, 1051 bp, Glycine max
  Peptide Sequence Number=SeqID_182898
atgccggatttacgcaattccgccaatgaacccgtgggggcgattcaaggcgtactgaacatgctgcgccgcctgcacaaagactacccatctgattacagtgcctgcgtattcgatgccaaaggcaaaacattccgcgatgatttgtatcccgaatacaaagccaatcgcgccagcatgccggatgatttgcgcgcgcagattgaaccgctttatgaaaccatacgcgccatgggttggccactcattattgaagaaggcgtagaagctgacgacgtcattggcgctttagccaaacaggcggaaaaagaaggcatcaggaccattatttctacgggtgacaaagacatcacgcaactggtgaatgagcatatcactgtggtgaataccatgcgcgatgctttccgcaaaaccgatgatgtgctggatatcgctggcgtggaaaacaagtttggtatcccccctgaaagaattattgattacctgattctggtcggtgataccgctgacaacgtgccaggcgtggaaaaagtcggcccaaaaacagcggttaaatggctaaccgaatacggcacactggataacattatcgccaacgctgacaatattaaaggcgtggtcggtgaaaatctacgcaaagctttgccctggctgccaactgcgcgtgaattgattaccatacgctgtgatattggcgtctgtgaaagctttgacgacctgattcaacaagcgcctgataaagagaaactgctaggcttattcgaccattttgaattccgtacctggaagcgtgaactggacaaactgggtgatggcgcaccctccacttcgccaaacacaacatcagaaaccgttgcggccccagtcagtcagcgcacagaatatacgcctgacacacgtcgccaataccaggcgattttcacagaaattgagctagacaactggttgccacgattacagcaggctgagctcctgtgtttcgatacagaaaccacttcactcgacccgatgcaggcaaaaatcgttggcgtgtcattcagcgtcacgcctg

SEQ ID NO: 66121 - DNA, 363 bp, Glycine max
  Peptide Sequence Number=SeqID_182899
atgaaaggcgcgatacaggaccgttgtatgaccagcccaaagctaccaagcatggtgcagccagagttacttgatggcgatgatgtcacccatgaatcgtggcgtgcgtttgaaatcatggccgagtttgtcggcgcaaccgaaagcctcaaggcaattatgccggcggtgtcgatttttggcagtgcacgtaccaagcccgaccatccgtattacatgctcaccgaagaaattgcacgtttgttatcagactctggatttagtgtgttgtccggtggcggtccgggcattatggaggctgcgaataaaggggcttttcccggacgtggtgccagtgtggggttgatatcaactcccgtttga

SEQ ID NO: 66122 - DNA, 336 bp, Glycine max
  Peptide Sequence Number=SeqID_182900
atgagtgaaatagaggaggtgcaagagcagatgaaggccaacatagaggccatgaaagagcagatgaccacaatgatggaagccatgacgagtatgagaaaaatgatggaggttaacacgactacagtcgttgccacaagtacccccactaaggtggacccgactcacccatctggcctcaatcaagaaaattgtccagtcttgaatatggtccagagcaagcatttcttcccaccatatgacttgcctcctaactatacaccacccaatgatacacacgctccctatgagaatgtcgataatgtagaagcaaagactttgactttggtgttttga

SEQ ID NO: 66123 - DNA, 273 bp, Glycine max
  Peptide Sequence Number=SeqID_182901
atgttggaaaccaaaaagagttatgactacaccacgtctctatgtattgagctttgtggtatcttaaatggccttaagcttgtgtgggaatcaggatatcgctacctcatctatgaatcagactcccaatgcgtcatggacatgataaaccagggagtgaacagttctcaaactcatgctcctcttattcaagctatcaaaggtcttgttgtcgaagctttgatcgtctcgattcgacacacctttcacgaaggaaacttctgtgttgactag

SEQ ID NO: 66124 - DNA, 225 bp, Glycine max
  Peptide Sequence Number=SeqID_182902
atgaattggtcaacttcagaaaccgaaaaaggcatgtttgatgctattttggaaggaatgttagatatggacaacgagccatggccctctatttcagaatctgcaaaagatttggaaggtggtgaagcatcagacaagcatccagacagtgctgttttaattaggatgaaatggtttagagcaatgaaccagatgaagaagcttgctttgaaggtggaaagttaa

SEQ ID NO: 66125 - DNA, 753 bp, Glycine max
  Peptide Sequence Number=SeqID_182903
atgggactggggatgtttaaggcattgttttgctgcagcaagccccatgaaattgacattgcagactcctgggactcatctcctgatcatacccccaaacaacattctaaaccaaagccaaagccaaatgctgcacctactcattccaataataaacaaaccaccacatctacacaaataggagcaattctagggaaaccatacgtgaacatacaccaaatgtacgagatgaagaaggaactgggaagcgggcagtctggtgtaacatatctgtgtgtggagaagacgacgaagcgagagtatgcatgcaaatccatctctcggtcgaagctgctgagcacgcaggagattgaggatgtgagaagagaggttatgattctgcagcatctttcggggcagcccaacatagtggagttcagaggggcttatgaggacaagcagaacgtgcatctggtgatggagctgtgcagtgggggcgaactcttcgaccgcatcattgccaaagggaactactccgagcgtgaagctgccactgtcatgaggcagattgtcaatgtggttcacgtctgccatttcatgggcgtcatgcatcgagacctcaagcccgagaatttcttgttggccaccaaccaccccgatgcagccgtaaaagccactgattttggactctccatttttattgaggaagaattaaagagcttgaataataaagtgcaaagtggcgaaaacacggagtgcagaggaccatcctaa

SEQ ID NO: 66126 - DNA, 1374 bp, Glycine max
  Peptide Sequence Number=SeqID_182904
atggggcactgcttcagcaaacccagcacaaacgaaataccaatcaactatgattattcaccaccccctcatcattatcagccacgcccgcactcacactcagactcaaggagaacacaacaacctcaacttcaacctcaacctggttaccccaatcgaactccaaaatcagacccatctccatcatcatcatcatttggtgatcaagtagcagcacgaatattagacaaaccatactttgacatcaaatctctttacaacctcgagagggaactcgggaggggtcaattcgggatcactcgtctttgcaccgagaagaccacgggaaggaaatacgcttgcaagtccattccaaagcggaagctaagtaaaaaaaagcatactgatgatgtcaagagggaagttctcatccttcagcacctctcgggacagcccaacatcgttgagttcaagggtgcttatgaggattggcaacacgtgcatttggtgatggagttgtgtttgggtggtgagctcttcgaccgcatcactgcaaagggtagttactccgagagtgaagctgcttctatattcagacaaattgttaatgtggttcatgcttgtcattttatgggggtcatgcatagggaccttaagcctgaaaatttcttgcttgctaataaggatcctaaggcacctctcaaagccaccgattttggattgtccgtcttcattgaagaaggtatagtgtatagagaaattgttggaagtgcatactatgtagctccggaggtgttaaagcgaaattatggaaaggagatagatgtgtggagcgcaggaatcattttatacatccttctaagtggggtgcctccattttggggcgaaaaattaattcaaaacatcatttggaattcagtagccactcgtgcacctttgctctggttaaaaaacgagagaagcatatttgaagctattttgggaggcaagcttgatctggagagcgcaccatggccttcaatttcagctgctgcaaaagatttgatcaggaaaatgttgaataatgaccctaagaaacgcattacagctgccgaagcccttgaacacccgtggatgaaggaaggtggtgaagcatctgacaagcctttagacaatgctgttttgactagaatgaaacagttcagagcaatgaacaagatgaagaaacttgctttaaaggttatagcagaaaacctttcagaggaagaaataaagggtttgaaacaaatgttcaacaatatggatactgatcgcagtggcacaatcacattcgaggaactcaaatctggattgaccaaattgggatccaagcttagtgaatcagaaataaagcagctaatggacgctgtgagttga

SEQ ID NO: 66127 - DNA, 981 bp, Glycine max
  Peptide Sequence Number=SeqID_182905
atgaactataacaccttacgcatgcaattctttcatgatgggcgtctggttgaacttgtcgacgacgatgcatccaccttcaacctgttgactcctaaattttgccgcctatctcgtacacaaaggactagcctatattgccatatatccatcatccctgaggaaatagaaaccactcagaaccttccttccaccatcctcgacctcctctctaagttccatttcttgttcaacccacatgacaccttgccacctgagcgaaccacagaccaccatatccacctgctccctcaatccacccccgtcaatgtccacccgtaccgttatctacactttcagaagtgtgaaattgagcttcaagtagaaatgatgttgcaaaagggcttaatccaaccaagcactagcccctttcccatccctacgatagatgagctccttgatgagctaggaggtgcaacatgttttttaaaacttgaccttctgcaaggctaccaccagatacgcatgcattcgactgatatgcccaaaacagcttttcacactcaccatggtcattacaaattcagagtaatgccatttgggttgtgcaacacgccatcctccttccaagctacaatgaacaaaatttttcagccttatctacatcaatttgtcatctttttctttgatgacatactgatttacagtgcctcattcacagatcaccttcatttggaactaacctttcaagtgttgtctaccaatcaattttttttgaaaatgaccaaatgtttctttgctcaaagtcaggttaagtatcttggtcatctcgtatcacacaagggagtggaacctctaacttcaaaaattgatgccatacaacagtggccaactccaccaacaaccagggttgagcgcagtttcttgggacttacgggattttaccacagattcattcgcggctacgcatcaatggcggcaccgctggtccaccctcaataa

SEQ ID NO: 66128 - DNA, 927 bp, Glycine max
  Peptide Sequence Number=SeqID_182906
atgaaaaaaggaactagcgttggggcaccttgtctgcttgaaaataccttagctgaaatggtcatctctgcagttcccagcatagaaatgatccggtctgttaattcaggcacagaagcatgcatgggggcgctccgtctggcacgtgcttttacagggaagcagaagatcatcaagtttgaggggtgttcccatgccatgctgatccttttcttgttaagacagcttacatccaacaccctcactgccctcttcaacgatattttagccattgagaagctttttgaaaatcacaagggagagattgcagcactcatccttgaacctgctgtaggaaactcaggtttcattgttcctaaacttgagtttcttgataccatacgtaaaatcatcaaggagaacaatgcacttctcatctttgatgaagttatgaccggattccagttgtcatatggaggagctcaagagtattttggcattgttcctgacttgaaaacattaggaaatataattgttagcggtcttccggtaggtgcatatggggaaatatcagtagagggattcaaacccgtgacctctcccccctcccttctcccttctcccttctcccttcacccttattcaaccactgagtcaaccttatatcttcatcaggctgacactttgagtgggaaccccttggctatggctgcaggaatagaggctcagaagcttattaaggaagcaggaacttatgagtacttagatgaagtcacaggagaacttgttcaagggattcttcaaagtgacttggccaagtttgctagtttctaccggggaatgttggagcaaggtgtatattttgcatcttcacaatttgaggctgggttcaccagtttggcacatactactgaagacatcaaaatgacaatagcagctgctgagagg

SEQ ID NO: 66129 - DNA, 540 bp, Glycine max
  Peptide Sequence Number=SeqID_182907
atgtacgagatgaaggaagagctgggaagaggcaaatttggggtgactaatctgtgtgtagagaaagccacaggacgagcgtatgcatgcaaatccatagcaaagaagaagccgcaaaaagtggaggatgttagaagagaggtcatgattctgcagcatctttcagagcagcataacatagtggaattcaagggagcttatgaggacgggaagaacatgcaccttgtcatggagctatgcagtggggagggaactactcggagcctgaagccaccacaatcatcagacagattcccaaggtggagtaattcagcacagagcaatccaacaccgaagaagaaacagcagcaaacaaggtggagacagcctgttatgattaggaacaaggaacaacaacaaaatgcagcaggtagtggagtgagcaagggctgtccttctgcggctgtgcagtacaattccgttgggattgctttttcactttggaatcttccttttgcttttcctccaaggcaatatgccacaacaccattagctaagtga

SEQ ID NO: 66130 - DNA, 1152 bp, Glycine max
  Peptide Sequence Number=SeqID_182908
atgggaaggtgtatactaatagactggacatccctgtgccataaagggccaggctcaaccgcgttggacttcaaggagaacaaaaaattggactattgtatgcaccctcctcttatgtatatacctgacagtatttctgcaagtatagagcaacagattatttgcatggggaataaaaaagttaagagtactgaattagctgggctgaatgggcaaaaacatccactgcttaagaaggcgttgagttggtcttttgatgatataatacatgggtgtgcaaaacaaaagaatcatatgcttgcaaggaagcttatgttacagatacctctcctctttgtctcaacgtcgaacatgtttctgacttggacaccaaaaccttccttacacttgccagacatgtgtgagacattagttgtattccttgtctatatgaaaaatcttggtttgcagccatccagacatacatataatggcattattaaagttgtttctcatagaagctatggggatgccgtaagagtgttgaaaaagatgcagcagaagaatttgaagccatatgattcaactctagcgtcactttcaatcacttgcagcaaagcactacaactagatttagctgaggcttttctgaatcaaatttctgaatgtgtatatccaaatccttataatgctttgctagcgtcatgcaatcaactgagtcaacctgaacgtgctattcgattgtttgccaagatagtgcagaaaaaagttttacctaatatcaggacatgcgaacttctgttttcgttatttggagttgtaaatgcccattacgaagacagtgatgcatggtcacaggtggatgctgctaaaagaataaatgctatagaaaagcatatggccaacaatggcattcagcatagtcacctttcaatgaataaattaaaatggaagagtcatgcagggagaacgcgacgcttacctcgacgtcgatggagcagagcagcacaacaggccagtcgaggagaacgcgcaaggaagaagcagagcagagtagtacaacagcaccaccaccatgccgccaacaatggtgaagaagcaacccacgccgtcggaatcgcgcagaaggagaagaagaagaagtcaggtctcggtggaaggaagaagaaataa

SEQ ID NO: 66131 - DNA, 306 bp, Glycine max
  Peptide Sequence Number=SeqID_182909
atgaagatttttatgtttggagacgcagtcggtcgtgcgtctctagttcgcgtgctaccagcagtcatcccgtgcctgagttcgcgcgcttccagcagtcatccctctctagttcgacgtggtgtggctgggttttttggtggcctgagttcgcgcgctaccaggagtcatcccttgcctccgtattcacacagctcaatacttagcgaggacaaaatagctgtagaaagtgcttactttaagtcctatgtcaacacttgcggcttaattgacagcatggaagcaacacttggtgcttttagttga

SEQ ID NO: 66132 - DNA, 1398 bp, Glycine max
  Peptide Sequence Number=SeqID_182910
atgtgtgaaagtggtagtagagtcacatgggaaggttgcagcgtcttgctcgatatcaacgatggtgaccgtctcgttttcgctcgtctctccccctctgcgaaattgaagattgggaataagaactgctctctgcaaccgttaatcggtcgtcccttcggtactgcttttcaagtcgatggaccttatctctctcccgcacaaggcacgcacgcatggtgcctctctatttgcgatttagttaatggtaataatgctgaagaattaagagatgttcaagtaagtgtcaagtcgagggacaaagttgaggataattatcctgaagaagagagagatgttcaagcaaatgttgattcgagggacaatcgagagttggttgacaataatacggcacaaagactgactggtgaagatatagaagccatgcgaaggcagggtgcgggaggtaatgaaataattgaagctctcattgccaatagcgtgacatttgaaaagaaaacatcattctcacaggagaaatatagacttaagaaacagaagaaatatgcgccaaaagtacttatgaggcgccctgttgctcgaagtatatgtgaggcctattttaagaagtatccatctaaaattggattcttgcgggtggacacgttgtcccttctgctttccatgggtaatgtttcttcaaattctgacattctcgtagttgatatgattggcggccttcttactggtgctgtggcagaacgtttaggaggtaccggttttgtatgcaactcatattctgggcaggcaccatattccatggatattgtgaggatatttaacttaagtgatgaaatctgcaagagaattgtgcggtctcccatctctgacttgttatcacaaaaagaattacccgaacaaactctgcaacatgatgatgcatgcaatgtggaaagccggtcaactgatcaaatgtctgcatcgaccagcatggaggataactctcattcattggaaaatggaatttctgatcttggggctgagaatactgaacctgctaaagttcggaaagctccaaaggctggagaaagggcacacaaagaaatcattgacttgtggaaggaaaatggtttctctagtctaatcattgctgctccggagttggatacttgggcattggttagagatgtcttgccccttttagcaaactctgctccatttgctatttatcaccaatatcttcagcctcttgcaacttgcatgcacaatttacagcttgagaaaatggctattggattgcaaataacagagccttggctgcgtgaataccaggtacttccatctagaactcacccatgcatgcaaatgagctcatttgggggctacattctcagtggaactaagatatgcagcacctaa

SEQ ID NO: 66133 - DNA, 1401 bp, Glycine max
  Peptide Sequence Number=SeqID_182911
atggattttgaggtttacttgaagaaatatttcaaaacttcaaattttacttttttgggtgccgggggtttcagtacattctttggtgagagtaacactgttgaacttagtttaccagaaaacttgcaacagattgtcatcaaccagttttcaagagtggcacatcatgaacgatgctcatttttggggaatgtgacccttggatccagcatttctctctctgaattacgcgatctgtatcacgtggtgaggctctctggttctggattttatgtgttaatggttgtccttgcatatggtgctgaaagtgatagaagtcttggtattccaggggagaacttgaaagggatacattcagctagagagtttgtttggtggtataatgggcacccagatggacgaaatcttgagccagacctaaagagcactgatacagctgtaatccttggccagggaaatgttgctttagatgttgcaaggattcttttacgacctactacagagttagcaacaactgatattgccagtcatgcattggctactttagaggagagctctatcagggtggtttatttggttggaagacgtggtccagcccaagcagcttgtactgcaaaagaactacgtgaaattcttggtattcataatgttgatattttcattcaggaatctgatctacttttaaccccagttgatgaggaagaacttaagagtaaccgaatacagagaagagttcatgagttgctctctaaggctgctacctcaaaacctaaacatgcttgtttgaaccaacgtgagctccattttgtcttcttccgtaagccaaatagttttcaagagtcgaaagacagagctggccatgtttctggcatgcattttgagaagacagttcttcaaggtgttagccctggcaaacagattgctgttggtgctggagaatttgaagatataaaatgcgggatggcacttaagagcattggttacagatcagtaccagttgatggcttaccttttgatcataagaaaggtgtagttccaaatgatagaggacgagtgttgagtgacccttcagatccttcagttcttgaaaagggcttgtatgtatgtggatggctgaggagaggaccgactggaattatcgccacaaacctctattgtgcagaagaaactgtttcgagcatatcagcagaccttgaaaacggagggttgatttcgtcatcaaccttgcccaaacctggcagggacggacttctccagcttctgcatgatagaaatgtcagagtagtttcattaagtgattgggaaaagatagactctgaagaaaggaggcttggaagttcaaggaacaaacctagggaaaaactagccagctgggatgaactatacaaaactacctcataa

SEQ ID NO: 66134 - DNA, 237 bp, Glycine max
  Peptide Sequence Number=SeqID_182912
atgaagagtcgtgatgtggaaagttgcgatgaagacgtacacggaggcgcgacactcagagaggaacaccttaattttcacgtgacctcgtgcttagtgtgggctttcgcgctaagcatgcctttgggcttcctcgtgggccttcttcacactaagcctgagttttcccacttagtgagggtgcacgttaagcctggattgcgtgctaagcgagctgtccaattcttcttcttttaa

SEQ ID NO: 66135 - DNA, 426 bp, Glycine max
  Peptide Sequence Number=SeqID_182913
atggagaagcatgctattttgatccaagagaaagtccaaggtgacctttggcaacttgttcaagtttctcatggtggtctaaaggtgcaattggtgaaacaagtccttgactcctttgttaatgcctctggcctccatgtaaatctccacaattctcggctttttacctctaaacatattcgtcgtgccaaggtgaacaagtttagagatatcttaggtttcactcccacaaccaatattggcaaatatcttggcttccctatcttaatttggagagtgaagaaatcaaactttggctttattctagatagaatgaacttgcacttgatgggttgtaagtcaaatttactgggaagggtagggagagtggtcctgacatccttagtgcttaatactatacctaattatgtgatgcagaacctgtga

SEQ ID NO: 66136 - DNA, 768 bp, Glycine max
  Peptide Sequence Number=SeqID_182914
acgactaacacaaaccttgttgctaagaaggctactgaaaatgttgttaaagaaggtgaagcattaaaaggtaaagtccttcaagtacaagttgaagttgttgcaataatagcaaaggttgtcaacaacgccattgttaatgaggtcctcaatgatctcactaacacaaaggttatggaagaagagccaacattttccaatggagataaagttgatgagtcgcgcgctaagccaagcgtacctgagctaagtgcatgtcattgtggcaactgtggggctaagcgagcctcgctcgctaagctcccatactttgtgcttagcgggcagtttccagctaagccgattatgcagaagctatggcttctaggaaacgcaagagtagtggttctatgccacaggcttaagaggaatgttgagatttatcatactgagtacgacgagtttaaaacaaagttggagaggcataaccttcacgaaaacctcgccaacattcacgaagggagcatagatgtgtcggtggttaaagaattttatgtcaatttgtatagtccagaaaccaagctcccaagtgtgccagtgtctgattccagagaggtggaggctagcctatgcattccgggaaagggttttattctgaacgttgagggccaaccatggaagctcctcataaaggatcttactaccctagcccagacatggagtgccttctcttactctaacctagctcctagctcctacctcccacacctcagatttgaacacagatag

SEQ ID NO: 66137 - DNA, 429 bp, Glycine max
  Peptide Sequence Number=SeqID_182915
atgtctaccagtttgtggtggggacatcacaaaatcgtctgcagaatccttggaagcagcatctttgtacgagcaggcagcaattatttccttgtttattgtgccatgcacaatgtcaacaactttaacataaaagagatgaagaggtgccctcttacgaacaaagaggataggcttataggcataagtgtccctcacctgagaagtgcttcacaggcaaatgctcttccagtcattggagtcaatcttgtagaaagcataatactcctcctttgtgatctcctaaggctctgtcatccaaatggccttatccttctttttgtagttgtgaaaacaaagtcctctaaaggtttccccctcacgaaggatttttcctttcacagcaaactaatgttcaatttacgaatggtaaccggcagatctgaatga

SEQ ID NO: 66138 - DNA, 298 bp, Glycine max
  Peptide Sequence Number=SeqID_182916
ccctgaggttcttgatctgactcaagatgacctcattcacaactttgctgttggtgtctacatgctgacttacaacgatatagcaaacaacactgagcatgaacctacaacccccgaaactacaacatatcagaagggcagtagcaaagatttaattgaactgccaggcctaggatcttcttcatcaatggattcctttgcttcttggaagatgaatggcagtggaatggagaaggaagagagagaggagacgccacttcaaggagaagatgagtctagaagaagctcaccaccatag

SEQ ID NO: 66139 - DNA, 348 bp, Glycine max
  Peptide Sequence Number=SeqID_182917
atgaaagattgcaaaaatacaagtagtgaggatgtctccttcacctctaggatctcacaatcactcccaaactcatctcaagctcttaaaccagctcctgcttcaagctctggtctctgcatatcttcacacagcttaaataggtggccttgttcgtgctcgtgcgctagcgcaattatggaccgcttagcgcacattggtgaatttcggcttagcgcgtgcctttctcacttagcgatgaaccgaagtggtgcgcttagtgagatgaagcggtgtgctttgcgaacctatacagctcatcttcttctagagtcttccttgcgcttagcccatgagagttgcgcttag

SEQ ID NO: 66140 - DNA, 279 bp, Glycine max
  Peptide Sequence Number=SeqID_182918
atgactgaagacattgtcatctttgaaaaagtggcagatgaccttaattgtctctgcaggccaatagacttgataatcttggaggcaaaagagaatgtgatagtctcggtcaaaagacatcaaagtcttcgaaaagaggcatatgaccttgattgtctctacatgccaatggacttggtagtctcggaggcgaagaagactgtgatagtctttgaaatgataattgcgaggactttgagtcccctgaaagatgaaagacgaggactttgggttctatga

SEQ ID NO: 66141 - DNA, 258 bp, Glycine max
  Peptide Sequence Number=SeqID_182919
atgaagtgctctcagttttgtatcaccaaacctacttctctattcagaaaaatacatcatctattcaaagccggagatgttcgtgcatgtgacgtcgtaccactagcatggcgtggcgtcgtcgtcgttccagttggagaaagtgacgacgctggaggcatccacgacggacttcagagtgaaaagcacgatgccgtcgaaggagatagaaacagagggacggaaatagatgagcagagtaacgatcatttagaataa

SEQ ID NO: 66142 - DNA, 603 bp, Glycine max
  Peptide Sequence Number=SeqID_182920
ggctgttcgtctatcctgtcctctcaaatcttatccggagccttatgaattgtttgtcattcatgcatcctccgcaatcgagtctggagccccacgaattgattgcctagcgctgttcatctatcttgcaccctcaactcttagtcgtagccccatgaattgcttgtcattcatgcatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 66143 - DNA, 285 bp, Glycine max
  Peptide Sequence Number=SeqID_182921
gctggagaggaaagaaagttgcaactatgtgagctagatgaaatccgtttagaaggctatgagaactcccatttctacaaggagaagaccaagaagttccatgatagtttgatagataagaaggacttcgtggtgggacagccaattgagatcaaaagtgaatccacagataaaggcttcaaggtcaatggacaccgactgaaaccattcctcacaaatccctccttagtggatgtagtggtggaggagacctccttacttcaccctacttctcttcctccatga

SEQ ID NO: 66144 - DNA, 156 bp, Glycine max
  Peptide Sequence Number=SeqID_182922
atgagtgaaaatgcacaaagaaagtatgaatgcacgagtttgggtgtaagagagaagatgcaggcaatgttcagaaaatttttggcagagggggccaggcgcctagcgaatgatagactacttagcactgctatggccacaatgaattggccttag

SEQ ID NO: 66145 - DNA, 165 bp, Glycine max
  Peptide Sequence Number=SeqID_182923
atggagaattggcgaacagcgctaggaaataatttcgcggggctccaggctccgctaggcaatgtattcatggggctccggataaaagtggagaatggagaattggcgaacagcgctaggcaacaaattcgcggggctccaaactcgttggtggaggatgcatga

SEQ ID NO: 66146 - DNA, 803 bp, Glycine max
  Peptide Sequence Number=SeqID_182924
atgacatcggctccttacgagaaaaaaataagcctgggcataaaagtaaattctcctgtaggagcacagcagaactgtttaaaaattataaggttggagatgaactattgtgagttcagaacgatagtcggttttgctgcaggaatcgggataacccccgtgttaagccattttaaaaatattcttcataatgagcccagaacgcgactgtttttgtttttcggaaataaaaattctgacgaattaatctaccgggatcttttggataatctggccagaacttatggggacagattacagatattttatttcttttcgcaggaaaaaacaccggatcagcttttttatggaaggctagatgcgaaaaagttaaacctgattatcaatcagattttgcaccttgatgatacagacgaagaatccaccatctgggatgcagtagatgaagttctgatctgtggaaaaggggacatgataaaaacactggccaatgcatgctaccatcatggaatcccgaaaaaaaatattcattttgaactttttgaagagtttaatgatgatatttaccctatagaaaaagagtttccgttgattgaaaatgtggaaatcgattttaaaatactgggaaaagactacagtacccatcttccggataacaaggataaaattctgcagcaattgctggttcagaaatttcctgttccttattcctgtaaatccggaatttgcggaagttgtgaatgttatttggaagaaggagaagttgaattgctagagaatgaatatttaacggaaaaagaaga

SEQ ID NO: 66147 - DNA, 189 bp, Glycine max
  Peptide Sequence Number=SeqID_182925
atgggtgtcgttacgaatcagcaaaaaaacacaaaagggggtgtaattagtaaaaagggggtgcgaatagcaaccaggccaacttgtgccttccaggggattccaacagaaggcggtgccttctggtggaagcaaccctactcgcctaggcgagctgggcgacaaccacctccatcttttctcctataa

SEQ ID NO: 66148 - DNA, 618 bp, Glycine max
  Peptide Sequence Number=SeqID_182926
atgactacatgtcttcgccttccaaaagggtggacccttggctacacaccctcaccttcagaggactacacgactacacgtccttgccttcagagaactgcacgtcctcgccttcagaggactgcaggtcctcgtgttcagaggactacacgactacacgccctcaccttcaaaggactacacgttcttgccttcagagggctgtgcatcctcgccttcaaagggctacacgccctcaccttcagagggcgacacaacctcaccttcagaggactacatgtcctttccttaagaggactgcacgtcctcggcttcagaggactgcatgtcctcgccttcaaagggctacatgccctcacttttagaggattacacgtcctcaccttcaaagggctacacgccttcaccttcagtggactacacgtcctcggcttcagaggactgcatgtcctcgccttcagagggctacacaccttcacttttagaggaccacacatcctcgcatttagaggattgcatgtcctcacctttagagggctacacaccctcatcttcataggactacacgtcctcaccttcagaggactgcacgtcctcacctttagaggactacacatc

SEQ ID NO: 66149 - DNA, 321 bp, Glycine max
  Peptide Sequence Number=SeqID_182927
atgaagatgaaagccaataaaacaagaaatgaattgaaagtctcggattcgaaaacttacaggttgaagagcaaagaacgcacgaagaacggtggaaaatcttcacgaaattgctcacggaaacgtctcaaaagcgttacccaagcaccttggcttggattttcttcacagaaacgtgttttttcactcaaaatccctgaaatgcatagggtaaaaggtcatgaccctttgggacagcccccttcccctatttataggagaaaaggggaggaggttgccacccagcttgatgcaatcctaccccgcaagggtattggatag

SEQ ID NO: 66150 - DNA, 525 bp, Glycine max
  Peptide Sequence Number=SeqID_182928
atggctacaaagaaacttgcaactacgagggccaagaaaaccaatgcaggagaaggatcttacacatcttcacttgcaaattttgtttgtgatggacacaaagatcgcagtgaggagtaccaatgccgttttgagttgatcaaagactgctctttcctgaaggaaagaagagtccaactactagagggcgattatcctgagttcatggaggagatcactaggaggaattggagacaacttgcagaaccaatgcccaaatattaccttgaagttgtcttagagttctatgctaatgcttggcctactaatgagggagttctagataagcattccaatgtgtggggccaatggatcccttatgacagagatgcgatcaaccagttttcagggaatacattgatattggaagaagtgaaaaagatgatggaactcacaaatcaagaggggggtgaattgagaaagagactaaggtacccaaccctaaagtcctttgtcaataagagcctaagagaaacatgcccttag

SEQ ID NO: 66151 - DNA, 336 bp, Glycine max
  Peptide Sequence Number=SeqID_182929
atggtggatccattgtgtctgagatgcagtcttgaggaggaatttatgatgcacaccctggtgtcctacataaaggtgcaaaccttttggttttcttctcctttggggttgtgtattgatgttgaaagatttactgattttcaagagtggttggcaagttgtattagaagcgctaaggaggaggagaaggaggaagcgtcccgtgggagtatcgatgtatttgagactccagttatttggaaggccccccgtgcaggcatgtacaaagccaattttgatgcttctgttagaaagggtgttggtgttggaatgagattgatattaagggatgactga

SEQ ID NO: 66152 - DNA, 156 bp, Glycine max
  Peptide Sequence Number=SeqID_182930
atggatgttgctattgatgctcctcaaccatgtctacatcctgttgatccttttgtggttgttattgttgtggttactattgctcaccatgtggttgttgttgccgtagtgggttgtgctcattatacacataaccagtcgcctgatatcgaatag

SEQ ID NO: 66153 - DNA, 279 bp, Glycine max
  Peptide Sequence Number=SeqID_182931
atgaccaaaatacaaggcccaaaagaaggaaaaagctattccaatatttacaaagaagagtggacccaaccttggcccatgggctcagaaatctatcttgaagttcatgagaaccttagggccttctttagcagctctagcccaatcctcttggagtcttctatccaatacccttgggggggaatgagatgggaaggtttggggcacataagggtcagagaaggagaaggtgggcgaagaagatcgggtgtgtgggaaagaggcaaggaggagaggtag

SEQ ID NO: 66154 - DNA, 192 bp, Glycine max
  Peptide Sequence Number=SeqID_182932
atggaagtagtccttcatcaaggagcaatcccttgcgggaggagaaagcaccacatgatagtaatggaagtagtccttcatcaaggagcaatcccttgcgggaggagaaactgggaggattcctcaattcaaagaacactttggctgcttaaaccatctctattagagaatgatatgcaaattaacaagtga

SEQ ID NO: 66155 - DNA, 375 bp, Glycine max
  Peptide Sequence Number=SeqID_182933
atgacccaaggatacaaaatgccaacgacattagagatcctgtcctccaaattgttcacagatggatcgcaagtgttatccgtgcacattggtagagtgatggcttatgattttttaggacatgcaaggatgtcaaaaagagaacatccaggatgtagagtttcaagccaaaagataagcattgattatccaacacaggaagcacaagggggcacatctgtggaagcaatgtcttccaagattattttgatgatgccaaagaataaagagtcaagcaagttccaaagaatcaagagtcaagcaagtttcaagaatcaagatcaagattcaactaaagaatcaagaatcaagaatcaagattcaagattcaagtaa

SEQ ID NO: 66156 - DNA, 468 bp, Glycine max
  Peptide Sequence Number=SeqID_182934
atgcccttacctaagattgtgacacatgttcatttccttgctttctctctcccaaagcagcaaggtcctccaccaccaccacctccaatctccctctttcacacaaagagagatattgtgtgtttgaacaagttttgggcttttggtggtaatgtggtggctatgaataaggactcgtgtggagtggggttcgtggcagaactgtccggcgaaagtagccgcaaaacggtgaatgcgacgactttggtgtttgcatgtgagtgtgagtatgagtatggtgcgtgtggtgtgactgatgctttggaaatgctggtgcgcatgatgcacagaggtgcttgcagtgtgaagccaacactggagatggagcacggatcatggtgggtctaccttaccagttttacaaggagggtagcagaagctcttaatgctaatgctaaaaggtggtcaagtctgaaaaaggaaacttga

SEQ ID NO: 66157 - DNA, 378 bp, Glycine max
  Peptide Sequence Number=SeqID_182935
atggttgaagcattctcgcaaaacaacatgtccctaactggtctccctataattttacctagtgaaagtgacttgacttaccactgtgtgggggataaggaggaggatatggttgaagtgttaataaagtatttccaggctctcttcccaaggtctaatcttattggtgtacaaaaggtggcggggggtgtaggaagaagacttaccgaggaaatgcttgaagttttaaatgggagcttcactgaggatgagagtctggtgagtatttttgataatgccatcattgcctctaaatgttttcattccatgaagaaggggaagaagggttttatggggctaaagcttgatatgtctaaagcctatgacagcgtggaatag

SEQ ID NO: 66158 - DNA, 327 bp, Glycine max
  Peptide Sequence Number=SeqID_182936
atgatggacaatgatgctctccatcaacttcgagcacacattatagagatggaacaccgtcacaaagaagaacttagaaaattgaaggctgaccacgacaagttggactcttgtgtgagacgcccctatggggacgaacactccgctcatacgatcaacgagtgcacccaggtatgcgacgagccggtcgcaccgcctgacatccgcaaccttggcaagtttatgctagtggctttacactccatgttgttggccctacgacctggcaagttcattgatagcctatgcaagaaacctcctagtagcatggacaagctacataaatga

SEQ ID NO: 66159 - DNA, 861 bp, Glycine max
  Peptide Sequence Number=SeqID_182937
atggcagccaaatctcctcatgactcttcattctccttctcaaggaggtacttccattggaagaagaaggccttggatgaatctgatgacgaggaagaaatcctcaacttctcatcttcatcctcacatttccctgaagaagtcgatgacaaccaagaggaacactaccacccccaccacctcacactccaaatgccacaacatggtgccatcagcaccaagaaaaaaccctacttctccaagaagtccaagttcaagtccgccctcacggtctttaccacgcgtgtgccgaggctgggactacaccacaacaagaacagttccagtctcggcacgcgcgtggtagggacactcttcggccaccgccgtggccacgtgcacttcgccttccaggaggacccaaagctgggcccagctttcctcatagaactcgcgacccccaccagcgtcctcgtccgggaaatggcttcggggctggtgagaatcgcgctagaatgcgagaagaagaaaaagggtgacattaactacaacgccagcagcagcaaagtgaggctgcttgaggagccactctggagaacgtactgcaacgggaggaagtgcggatacgcgaacaggcgcgagtgtgggcctgaggtgtggaagatactgaaggcggtggagcccatatcgatgggggctggggtgttgccggtgtgcgtgaatggagctgcagggtccgaggaagaagctgctggggaggttatgtatatgagagctaagtatgagagggttgtggggtccagagactctgaggcgttttacatgatgaaccctgatgggagtggaggtcctgaactcagcatttacttgatcagagtttga

SEQ ID NO: 66160 - DNA, 189 bp, Glycine max
  Peptide Sequence Number=SeqID_182938
atgttgatatttgtgggtagtgtctttggatgggtggatttattcttcgattgtgtcagggtttgtgataccaaaggacaggcaaaggaatctgacaaaaggaaggtaagcagccccaacctacctgttgggaacaaggaattggagattttgagggaaatttcagagttgaaatcggcagcaaattaa

SEQ ID NO: 66161 - DNA, 516 bp, Glycine max
  Peptide Sequence Number=SeqID_182939
atggctaagtttgatcctgaaatagtcatggagttttatgctaatgcctggcctacggaagaaagggtccaagacatgcgctcttgggactttgcccagaccgcagtggggagacgggttcggatcatgcacaccagcatgaccactctcacgcaaatctggatgacttcgctctttagcaacattctccttagcgaccataactcggacctccccctgtcgaagtgtcagctggtctacgccataatgacacaggtgagtgtacatgtggctcagttgatctctgatgctatttaccagcctctgccagttctatggagtgctggtcaccccaacaagcttatccagcctcctattaacaaggctttcattgagaaatactgtatgcccaggcaggtgcagggccaggcaccacaacagccagaggagggccaacaacaggcatttgtagacgcaccaccgccacctccagagtccacctctgctcacttgcagaggttggaacgctgtatatga

SEQ ID NO: 66162 - DNA, 411 bp, Glycine max
  Peptide Sequence Number=SeqID_182940
atgtatagacaacaaaaaagtctgtatcaccctatctacttctctctctcgacaacggagtggaacgcgggggaaaggaacagacgtgaggggatgacatggagagaagggaaggaaggggtttgggttgagcttgcttgtggagcttctatggaggctggatctttgagcttcaatgaggaagaaggagcttcaccaccaagaattgccttggataagaagcttgaagaggatgctttaatggaggaaaagaaagagagaaggggggagcacaaaattgaaggaataaaagagggaaagaagtggaactttgaagtgtatctcataagactttcattcatcaaagttacaacaagtgttacacatgcttctatttatagactaggtagcttccttgagaagctttcttaa

SEQ ID NO: 66163 - DNA, 345 bp, Glycine max
  Peptide Sequence Number=SeqID_182941
atggaggacggcgtaggaagaggtttggaatgcccgaagactatggatgggaaggcgagtaataggaatgggttagagaaggatattccttcttgttgtctgaaggctagggctccaatccatgagtctgaggtgaagtgccattccactgttgtttctgggtggttctcagcttctcaaacttgccctgagaaatttaggaaatctgtttacttcaacaacctaatgtggccaggattaagaccaatttgtaagcacatgtgttatgttctagccattggaaatgttatatgccttagttattatattactatacaatcggtgcaattccttctatgctcctaa

SEQ ID NO: 66164 - DNA, 487 bp, Glycine max
  Peptide Sequence Number=SeqID_182942
atggagaaaaatgaagaaacaacaatggaggagaagcttgcttatgaatcttctatggaggatggatctttgagcttcaatgagcccaatcctcttgaagtcaacaaggaccaatgtccaaacaatgagattgagcaagcaaagatgaatgacaaactttttgggagtgctccgggcaacctcatgtatgttcaggtgatgaggtacttgcagaagactaaggattatatacttgtgtatagaagagttgacaacttggaggataggaaatcgacttctggatacatctttatgatggctaagggatctaagcacttggaattgaagtacttgactgttagagatcttgtgaaagatggttccatagtggtaaagcatgtggacactaattccatgttggttgatcccttgatcaagggactcaggcctattgttttcaaaagacatgttgaaaacatgggcattgtgagttcttttgatatacttg

SEQ ID NO: 66165 - DNA, 2406 bp, Glycine max
  Peptide Sequence Number=SeqID_182943
atggccaacaactggattgtcacttggtttgtgaagccattcccatttacattcagtctacacactttcacgttgacttatatgtcttacctatttccaggtgatcgcgatacctctattagttctctttccgcgattcgtaggcttggccaaacacatcgagatgtcctctactatcacatcacgtttcttgctgatgatgctccttcctcaccagagctcctaatagcaacccgcaaattattaaacaagtttaccaccctgttccagcccctaagtactctgccaccggttcgtgacactgatcatcgtattcatctccttcctctagcagctcctgtcaatgtcagaccatatcgatacccgcattaccagaaacaagaaatcgaagctcagcgtttctatgttgactatcgtgctctgaatgctttgacggtgcgtgatagatttcccatccccacaattgatgaacttcttgatgagttaggtgatgccatttgggctatgcaatgctccctcctctttccaggccactatgaatatgctcttccaaccataccttcgaaggtggaatatttggggcatttggtctcacctcgtggggtggaacctctgaaatcgaagattgaggcaatcctccaatggcatgttcctcgaaccactaaggcagtaaggagtttcttgggccttgcggggttctatcgcaggtttattcagaagtatgccaccattgcagctcctctggccctatcaactgctccagtgttgactttgccaaacttcaatctgccatttacactagaaatggatgcatcaggagtaggcatgggtgttgacccttcacttaccatgctcctttcggttccctacctcacgttcatggaggaacttcgtcatcaattggaagctcatacaggatatgtccagcaacgcacatcaatcactgagaatcccacacaccaccctgatttcagcattgccaataatatgattcttcatcgcggacgactctggcttcccagggatatccctatgatttccactctattaaaggaatatcgcgtgactccgacaggcagacacaccggcattaccaaaacagttgcaagaatctctgaaaacttctactggcctggtcttagagatgatgtcactcagtttattgccacgtgcctcgattgtcagttcaaaaaatatgaaacgaaaaagcttgctggattactctaccccttgccggttccacatcgactgtgggaagatctttccctagatttcatcaccggccttccaccatatcgtggttattccgttattcttgttgttgtagaccgattttccaaaggaatacatcttggcatgttacccatggcgtataccgcctataatgtggcctcattattgtcagaacttgtagtgaagttacatggcgtccccaggagtttggtctctgatagagatccattatttcttagcaagttctggcaagagctgttccgtttgagtggtactcaattgaagatgagttcggcttaccacccacaaagtgatggccaaacagaggttttaaactgcattgttgagcaacatttgtggtctttcgtgcatcacaggccctcccattggggaaaatttctggcatgggcagagtattcgcacaatacttcttggaattcggccacgggtgttacaccgtatgaagttacttatggtcgtaaaccaccatcgtttccggcataccttgttggaacttcgaatatcgatgctgttgataccatgataactgacaaggaggaagcatttcaattcattcaaaagaagttgcttaaggctcaagcttcgatgaaagaccaggcagacgttcaccgttgtgatgtatcctaccagccgggggactgggttctgctaaagcttcgaccctacagacagataacgacgaagggatctcagtcattttcaggaaaattagcaaaaaggttcaatggaccatttaaggtccttgcacgcattgacaaagtggcctatcgcctggagttgcccattgaagctaaaattcatctcatatttcattattcaatgttgaaactgtttcacggaaatccagatagcaaggccaatgaattgcctgggcaattcgtgaatcatcaacccgtcatcattccaatgacaatcttggactaccgccggagcaatgatgcctgggaagtgctggtgcagtggcaaggattgtcaccagatgacacctcttgggaggactggaaccaactacaacatgattaccaccttggggacaaggtgactttccaagggccgtggagtgatagagaagaaggtaagactcggactgagacaaagacacatgcagaagccattgaagtcacaaagggagcaacaacatccacagcagag

SEQ ID NO: 66166 - DNA, 480 bp, Glycine max
  Peptide Sequence Number=SeqID_182944
atgcctgattcagcgccatcctcgtcctcggataagctcgagcagcttcttatttgcctcaccaaccaacagctctcccttacccagaaaattgacgacctcatcaaccatgtttccccttctatggttaaccccaccatgacttcctccatcccacgcccccttcctaatcatgcacagacacatagactgaaattagatgtacctcggtttgacagaacagatcctttgggctggatcttcaaaatcaatcagttcttcgagtaccatggtactcttgaacatgatcgattaacaattgtctccttctacatggaggggcgcgccctatcctggttccagtggatgaccggaaacggtcaattcactttgcggccagtatttcttcaggcgctacagaccatgtttgcaccatcgcaatatgaagaccccacaggggccctcttcaagctcacacataagggatcagtggccacttag

SEQ ID NO: 66167 - DNA, 459 bp, Glycine max
  Peptide Sequence Number=SeqID_182945
atggataattttgaatgggctttaagcaagctgaaaggattgtttgtgaaagataacgtgttgcctcaggttattgttagtgatagggatcttgcttttatgaatgcattggagaccgtgtttccttcttcaaccaacttgttatgttcgctacacattacaaagaatgtcacttctccagatgaagtatcatataatgaacactttaagaactttacaacccggtgcgcacgttataaaacatttgttgactatgtccaacaaacatggttggtgcctttcaaggagaagtttgtacaagcatgggctaatcgggtcatacatcttggaaacacaacaacaaataggcactataatgtagctccatgtagagcttgtaggccttggatcttcttcatcaatggagtcctttacttcttgaagatcaatggaagcagaatggagaaggaggaacagtga

SEQ ID NO: 66168 - DNA, 177 bp, Glycine max
  Peptide Sequence Number=SeqID_182946
atggatcatattctaatcgtggagggaagcagctctgcaggggaatttggaggctgtttgagtcccaacttcggtgcctgtgcgtgtagcatacgaacttcttctagctggtcatcaatatttggatgtaaggactccagaagagttcaatgctggacacgctcctggcgcaattaa

SEQ ID NO: 66169 - DNA, 261 bp, Glycine max
  Peptide Sequence Number=SeqID_182947
atgccggaggcggcagaggtagacggtttcgatgtcgccggcgccgatgcggcggaggaggtggaagttgcggaaggagagggcagccttgcggaggaaggtggtagagcggatggcggagtaggcgaagtcggaggagcggtgaggcttgatggagagactctccgggtaggggcgggtgttggtgtttgtgaggatgatgacgaattgaggagcggaggaattgtcacgcggcataggtttctttggagcattgcttaa

SEQ ID NO: 66170 - DNA, 882 bp, Glycine max
  Peptide Sequence Number=SeqID_182948
atgacttatggcaatatagccgcaacttcacctgccacggtgagagcttcacctgccatggtgagagcttcaccaactatagtgaggacaccaacgtcaccaatgagagcttccacacttatggcaccaatgctggcagcgactctgcatgacaactctgacgtccagactttccaatcctacagaaaaaactttgttggctctgggaatgagttcaccggctatgggacaaactccaacgttgctacattaggtttcacgaactacggcaagggagacgcaagtcccaataacacgttcacaaactacgacatggagatgaacgttcctgaagtgatgttcaagagctacacagatggaactcatggtggcactaagagttttgttaactacagagaccaagctaatgtaggcgatgactcatttcaatcctatgctaagaacaccaaagaagggacacaagtggatttcaaaaactatgggaattcttttaaccctggttcgaatactttcaaaggctacgctaaaggagaagaatgggatcacaagcatgtgttgcatgtgtctgataactcctccatggacaagatcattatggactcattaagggagtgcgagagggcacccagcatgggtgagaccaaacgttgcataggtgaccaaatcggtgtcataccatcagaccttgttcccttacttgctttgctattgaacccagaatctaagaccaagattaaccatgaagttgctatttatcacttggacaccactgtgtggagccccacccacagtgcatttgtggcgcttgtgttgggtccgggtcagattgaaatgtgccattggatctttgagaatgacttgacttggacaattgttgattga

SEQ ID NO: 66171 - DNA, 576 bp, Glycine max
  Peptide Sequence Number=SeqID_182949
atggcgacactggattccgacgtgaccgtgtttccggtcggcaaagcctctagcagcggcggtccttctttgtccaacaagaagctgaagcggttcaagatcaagaagtggaatgtggtttctctctgggcttggaatattgttgtggataattgtgctatttgtcggaaccatatcatggatctctataagcgtgttaattcaacttattgtctgtgtgttgccaacgaagctagcgccattagcgaggaatgcactgtagcttgggtgaaaacaggacctagttttgttgatgctgccgtagggaggattgctcagggaactagggttcttgcagaaggggggtatgaaaagatctttaggcaaacatttgagatagttccagaggagcagcttctcaaaacttatgcatgctacttgtctacctcagctagacctgtgatgggagtcttatatttgtcaacagctaagctggcattttgtagtgataacccactttcttaccaagtgggtgaccaaactcaatggagctattataaggacaccatagtcctacctaaactggccactgtgtaa

SEQ ID NO: 66172 - DNA, 447 bp, Glycine max
  Peptide Sequence Number=SeqID_182950
atggcaacaaacgacaacgataccaacaccgtcaaccaaggaaaaggaccacacaagcatgaatccaccatgttgaggatgcttgccacgggttcctctgaaatagggaacccaacaaacgttgcaagtccttcacgtcaggatgttgatgatcactcaatcatcattgccctgcaaagagagatggataccttgccacctaacctgtctcagaaaaatgacgatctcggactcatgtaccgttggatcgtcgtgaaatttaaacaccaagttcaaaatccaattccgagcattctcaccgttgggaatttcaaaatcatggagaaaaaggaattgcatgaagacagtataagtggaggtttcaatctcttctccgtctctctgacatttaggaattctatcggagcagtcggaggaataactgaaggaatatcagggaaccgctag

SEQ ID NO: 66173 - DNA, 183 bp, Glycine max
  Peptide Sequence Number=SeqID_182951
atggttgtgaatgtcattgatcgtgaaagtgggtttaatgtcgttggtggcggagcccggtggttcggcgtgggcggagctgttttcgggccgaggtttcttgctgaggaggcatcatcggagaaggagatgaagagaggtggaggagtggaagaaggaaatcacatgagagggaaggggtga

SEQ ID NO: 66174 - DNA, 1596 bp, Glycine max
  Peptide Sequence Number=SeqID_182952
atggcaatgttgggtccctcagggagcggcaagaccaccttactcaccgccctcgccggccgtcttgacggaaaactctccggcgccatcacgtacaacggccaccctttctccagctccatgaagaggaacatagggtttgtgtcccaagatgacgtgttatatcctcacctcactgtgcttgagagtctaacctatgctgccatgttgaaacttcccaagagtttgactagagaagagaaaatggaacaagttgaaatgatcattgtggacctagggctgtcccggtgccggaacagccctgttggtggtggagccgccttgtttcgggggatttcgggtggggagcgaaagcgggtcagcatcgggcaagagatgttggtgaacccgagtttattgttgctggatgagccaacatctgggttggactccaccacggctcaacgcatcatggcgatgctccaaagcctcgccggagcttaccggaccgtggtgactaccattcaccagccctcaagccggttgtattggatgtttgataaggtggtggtgttgtcggatgggtacccgatttttaccgggcaaacggatcaagtcatggattatcttgagtccattgggtttgtacccgttttcaatttcgtgaaccccgctgattttctgcttgaccttgctaatggcatagttgctgatgccaaacaagaagagcagatagatcaccatgaggatcaagcttcaatcaaacagttcctagtttcatcatataagaagaacttataccctcttctcaaacaagagattcaacagaatcatagagaactagcatttttaacttcaggagcacctagaagttctgagaaccaatggaccactagctggtgggagcaattcatggttcttcttaagaggggtttaatggaaaggaggcatgaatcttattcgagattaaggattttccaagtcttgtctgtctcaattctctcaggacttctgtggtggcattctgatccctcacatatacacgatcaggtaggcctgctattcttcttctccatcttctgggggttcttccctctcttcaatgccgtcttcgcttttccattggaacgaccaatgctgatgaaagaaagatcatcaggcatgtaccatctctcctcctactatgtagccaggatggtaggggacttaccaatggaatttgtgcttcccaccatctttgtaaccatctcttattggatgggtggactcaagccatcgttggttacatttgtgttaaccctcttgatcatgctttttaatgtgctggtctctcaaggaataggccttgcacttggtgccattctaatggatgtgaaacaagccacaaccttagcttcagtgactatgttggtgtttcttttggctggaggagtgcagtactcagtaaatgaggtctatcagtgtagacagggattgcattataggataagagattttcctgccattaagtgtctagggcttgatagtttgtggggagatgtggctgttttggctgtaatgttgattggatacagagttgtggcttatttagctttgaggatggggctgcatcattga

SEQ ID NO: 66175 - DNA, 238 bp, Glycine max
  Peptide Sequence Number=SeqID_182953
atggctaaagtagacgaggtgcaagagcggataaaggctgacttggaggccatgaaagagcaaatggccacaatgatggaggccatgatgagcatgaagaagataatgaaggtcaatgtggctgcagttgtcgctaccaatgttgttgctgagatggactcaactcccccatcaggcctcaaccaaataaatcatgccatctcggatatggtagggcaaagagacaaagaattgggaa

SEQ ID NO: 66176 - DNA, 407 bp, Glycine max
  Peptide Sequence Number=SeqID_182954
atggaatattccaatgttggtcaatttcatccatgcatccaagattctattgaaaacattattgatgccaaagtggatagtaactgtggttatcgtgcaatagttgccttattgggtatgggtgaagaatcatggtcattggtgcgtaaccatctgcatgtagaacttacaagctggtcagaaaagtatatcaacctgcttgggggtatagagaaatttgaggatgtcgcaacctacccttcggcgggagggcgacgcgagactcgcgggatgcgtgttccacgaaaggaatacgtgcggagtcgccaccaacgtttatttgaggaaaacgtcggaaaaaccggaaaagacgcgatctacgaactttttagtgaaaggttcgggagttgtatttacgcacggggaag

SEQ ID NO: 66177 - DNA, 204 bp, Glycine max
  Peptide Sequence Number=SeqID_182955
atgtacagaattgtcacgagcaagaaagaacagaaaagaaaccatgacttgggacacatgaagcagtccccttctttgttaccaaccgaatctttgtgctcgtgtctttgttgcgtcgtgcctaaaggaaagcagaaaaggaaaaggccgaaacactcaaagccagattccctacctttccaaaaaggtcttattgatccatga

SEQ ID NO: 66178 - DNA, 243 bp, Glycine max
  Peptide Sequence Number=SeqID_182956
atgctacaatgcgaggggtatttctctttgctcgggcatataatcgaatttcccaacggtgggaatgctcggaattgggttgcaaacgtgatgcttaaatttcatgacgatccaacggtgaatgagtcagagatcgccatttttctaagacaggttaggtggcttgcgggaaaaagagagggttttgggagaagagagaaaaaacaaaattgtgaggcagaggaggctgaggaatcagtctga

SEQ ID NO: 66179 - DNA, 165 bp, Glycine max
  Peptide Sequence Number=SeqID_182957
atggtacctgtcatatggagaatcagaggcagcactagtggtaacaacattagcctaaggtttagggaaagacaaaaagaaggttttctgccaaatttatttttgttaaacccatgctttttgaaggacttaaagaaaggtttgctagagctctcaacaagatag

SEQ ID NO: 66180 - DNA, 663 bp, Glycine max
  Peptide Sequence Number=SeqID_182958
atggaattgcttgaacagtacatgcaattcaaacaagaggcagaaaaagatggaaagaagaacaacttgtggaagaatgcatcgaaaaatacctctcttcagatggctgctttagagcaaatgaaagctgatgaaaatgttatgaaactggctgaagatcaaaagaggcaaaaagaacaactccatgctaaaatcattcagcttcaaaaacaagttgatatgaaacaagagctggagttggagattcagcaattaaaaggttcattaactgtgctgaagcacatggaagatgacaaagatgcagaaattctgaataaggtagatacactacaaaagaatttaagggacaaggagcagtcacttcaagacttagatgcattgaaccaaacactaatcattaaaaagcgtgagagtaatgatgagttgcaggaagctcgacaagcattggttgatgccattaaagagttacaatctcatggaaatattcgtttcaagagaatgggggaacttgatactagaccattccttgaagcaatgaagcaaagatataatgaggaggatgctgaagagagagcttcagaactgtgttcattgtggaaagaatatctaaaggacccagattggcatccattcaaagttatcatggttgaaggaaaagaaaag

SEQ ID NO: 66181 - DNA, 2328 bp, Glycine max
  Peptide Sequence Number=SeqID_182959
atgcgtcgacgcctccctctcttggcccactccctcctcttcaaacccaccatcaacaacaatcccctacgcttcctccccatcctaaaccatcctccctccgcccctcgccgcttctcctccgccaccccctccaaagacgacggcgtctccctctgctgccagatgtggatcgacaacttccgccaccccgaccgcgccgtcacaaacctctcctccttcctccgtcgcttcgacctctgggtcctcgcctaccagaaggtcgccaccgacgacaccggctcctacacctcccgctcctccctccacgcctccaccctccaagacctcctcgccctccgcaacgccgtcctcgacgcgaaattcaagtggggctccaggctcaagttcttcatcaaatcccccaaagacaaaaccgactacgactccctctccaagcgcaaaatcaaaaccatcctcaccaccacacaacccgcgccgttccaggacagaatcgttcatgaagttctccttatgatcctcgaaccgatctacgagccgaggttttcgccaaagtcgtatgcttttcgacccgggagaacaccccacactgttttgagggttattaggagaagctttgctgggtacttgtggtatataaagggtgattttagtgttttgttggatgggatgaaggtggggttggtgattaattctgttatgagagatgttagggataagttggttgttgatttgattaaggacgcattggttacgccggttgttgttactactgtggagaagaaggagaagaagaagaagaggaagtatcagaagaagagggttttggccgaggatgagcctaagcccgatccttattggctggatacgttttttgggtttgcacccgaggaggcggagagggtacccaattgggggcattgtggggtgcttagtccgcttttggccaatgtttgcttggatgagttggatacgtggatggaggggaagattaaggagttttatgttccttccaagagtgatgttatatggaatagtcccgaggaggagcaggggaacacgtcgtggccggagttcgtgcccacgagtgggccggataagacgaggaagatggattttgtgaggtatggagggcatgtcttgattggtgttcgagggcctagggcagatgcggctgcgttgaggaagcagttgattgagttttgtgatcagaggtttatgctcaagcttgataatgagagcctccctatagagcatataaccaaagggatcatgtttttggaccatgtgttgtgtaggagggttgtgtatccaactcttaggtacactgccactggtggtaagatcataagtgagaagggcgtggggacgctgttgtcggtcacggcgagcttgaaacaatgtattaagcagtttaggaagttgagttttctcaagggggatagggatccggatccccagccttgttttaggatgtttcatgccacgcaggcacacaccaatgctcaaatgaacaagtttttgtcaaccatggttgagtggtatagatatgcagacaataggaagaagattgtgaacttctgttcttatatcataagaggctcccttgctaagctgtatgctgcaaaatacaagcttcggtcgcgtgcaaaagtgtacaagattggtgctcgtaacctgagccgtccattgaaggagaaaaaagggcagtctcctgagtaccataatttgctgaggatgggtcttgccgagtcaatagacgggctacaatatacgaggatgtctcttgtgcctgagaccgattactccctgttccctagtaattggaggcctgaccatgaaaagttgttactagaatacataaaactggaagatccaaaaactttggaggaacaacgggattgcatcagagaacaaggtcttgtttcacctcaagactatatttcaatgctcgtgtggaattataaaaggaactctcttcctatggaccagctctccttagtaaggagcaatgaaagtgttgtaggaaatcagcatttgctagttggctcaaaccaggatgaccaggaccacacaaaccaagaagaagaaaatgatggaaggatgaatgcagcacaaatgactaccagtaatgattgtttgcactgtatttcagattcagacgatgccacaactttcgttgatattatgtttcacctttccaccatggatgcttgccagagaaaggatacaataactgaagaatggagagctctgacgtgctggcatccactcaggcaaaatattaacactgccactctgctagtgggaacactgactgggctataa

SEQ ID NO: 66182 - DNA, 1338 bp, Glycine max
  Peptide Sequence Number=SeqID_182960
atgtctagggcattgtttcatttgttgggtgttttgtggctgtgttggtgcttgacatcaattggagaagctcaaatagagtacctaagatacaaagatccaaagcaatcggttcaaactcgggttagggacttgatgagtcgaatgactttagacgagaagattggtcaaatggttcaaattgataggagtgttgccaatgctaatgttatgaaaaccagcttcattgggagtgtattgagtggtggcggtagtgaaccccttccaagggctactgctgaagattgggttaatatgataaatgattttcagaaaggagctcttgagagtagattgggcataccaatgatctatggtattgatgctgttcatggacacaataatgtctacaatgctaccatatttccccataatgttgggcttggatttgcatttatccacttgtttggttctaataatctttggatcggtgctgcaactgctcttgaagttagagctacggggattccttatgtttttgctccatgcatagcggtttgtagagatccaagatggggtcggtgttatgaaagctatagtgaggatcctaaaattgtgcaagaaatgacagaaatcatacctggtctacaaggaagtatccctgccaattccaggaagggatttccatatgttggtggcaagacaaaggtagcagcttgtgctaaacactttgttggagatggtggtacaacgaagggaataaatgagaacaacacagtgattgattggcatggattgttgagcattcacatgcctgcatattctgattctattattaagggggtctctacagttatggtttcatactccagttggaatggtgtgaggatgcatgcaaatcgtgatctagtcactggcttcctcaagaatacccttaaatttaagcctttctttttgccattgtcagatcctgatttaagcaacatggttcatattgtggatgctaacaacaaattttgttcacttatttatcaggggtttgtcatctcagattggcagggtattgatagactcacatcaccacccagttcaaattacacatactctgtgcaggcttccattgaagcaggtgttgatatggtgatggtcccattcgaatatgacaagttcattcaggatcttactctcttggtcaagagcaatatcattccaatggagcgcattgatgatgcagtggagagaattttgcttgtaaagttcaccatgggtctttttgagaatcctctagctgataccagcttagtcaatgagcttggaagccaggtgagtcatccaaaccgtttagttcaatcagaataa

SEQ ID NO: 66183 - DNA, 258 bp, Glycine max
  Peptide Sequence Number=SeqID_182961
atgaatgacgaagaacggttgaaaatcttcgcgaaatcactcacggaaacgttacgaaaacattacggaagcgcctcggcttggatttgcttcacggaaacaatttctctcagcaatttcaaccaaatagaggaggagcttgccacccagctcgcccaggcgagccaggttgcttcctctagaagcaaccgccttctgggggaagaatctggaaggcccaagtgggtctggttgctatttgcacccctattttactaa

SEQ ID NO: 66184 - DNA, 327 bp, Glycine max
  Peptide Sequence Number=SeqID_182962
atgtcttccaaggttattttgatgatgccaaagaatcaagagttaagcaaagtttcaagccaagattcaagaatcaagtttcaagattcaagattcaagaataatcaagatcaagattcaagactcaagattcaagaatcaagagaagactcaatcaagataagtactaaattttttttcaaaacattgagtagcacaagaagttttcacaaaatcattaccaaagagttttactctctggtgatcgattaccagaaggtagtaatcgattaccagtgttttaaaacattaagatttcacatttcaagagttacaacttgtgtttaa

SEQ ID NO: 66185 - DNA, 216 bp, Glycine max
  Peptide Sequence Number=SeqID_182963
atgaaaaaacagtggattgcggccctggcagcggcaggccttcttttagtcgttagcgcccaggcagaggcaaaagggtgcctgaaaggcgccgtcgctggcggcgtggcaggtcatctggttcatcatggcgttgccggagcggcagcgggctgcgcggtgggccaccacatggccgccaaaaaacagaaagaggcggaacaaaagcaacagtaa

SEQ ID NO: 66186 - DNA, 783 bp, Glycine max
  Peptide Sequence Number=SeqID_182964
atggataaaccggagatcgatcgcggcgagttgaaaaacatgctgctgagcgccctgttaccgcagaccatgcagtggaatcacaaactgcattacgttgactatggccagcaaaaagcgcacgggctggtattcagaaacggcaggcgctacgaagccgatatcgtgattggtgcagacggtgcctggtcgagggtccgccggtacctgacaccggtacgtccggtttataccggcattacctttttcgaaggctggatagatcacccgtccgaccaaatcaacagcattgccggcaacgggaccgcgttcagctttagcggtgcgcaggcgctggtcacgcaacgcaacggcggcgggaggatttgcgtctatgcggcgatgaagcgcgcccctgatgtcatcgatcaacgcatagcctcctccggcctcaccgcctgggtgcgcgacagctaccgcgactgggctgcttccctgcagtcggtggtgaacgccaccggtgactatatcaggcgtccgatttacagcctgcccgccgattttggctgggtaccgcgtccgggcatcaccctgattggcgatgccgctcacctgatgccgccggttggcgtaggggtcaacctggcgatgcttgatgctgccgatctggctcaggcactgtgcgaagccccgcacccgcagaacggactacgctctgcggagaccctgataatggaacgcgcccgcgaaatgatgcctgatgcaatagcggggtttcagaactggttcgatgagaaagcctga

SEQ ID NO: 66187 - DNA, 395 bp, Glycine max
  Peptide Sequence Number=SeqID_182965
ctttcgaagaagttacgaaaactcacggattgcgaaaaacacctcctttcgatttccgtcacattacggaattttcacggatcgcggtgccaagtatctcgaagcggccaatcaaaggttgtatatcatcaaataataatccccggacgaaattagggtatgacaccaaagaatcaagatttaagcaagttccaaagaatcaggagtcaaaaagcttcaagaatcaagtttcaaagaatcaagattcaagaataatcaagtctcaagattcaatcaagtttcaagaatcaagattcaagaacaatcaagatcaagattcaagactcaagattcaagaatcaagagaagacttaatcaagataagtactaaaaaagtttttcaaaacattgagtag

SEQ ID NO: 66188 - DNA, 521 bp, Glycine max
  Peptide Sequence Number=SeqID_182966
ccgacaaggatggtgtggacgacactgtctgtgaaaaatacgacattaacaaggagaaatgggcccagttttgtcagacccgcagagacccctcgtgggaggatatgcggaaaaaagcacaggccatccagaagcaaaacactgctccccacataatcactgagggcgtcattgaccctccatctcccaccagacgccacgtgaagtggaagatggcccgcacaaagaaaactgggcaggtgacgtctaaggcagcaaaggaaatagctcaaaagattgtgtcacagggatcgttcgtcccacatggatgtcaggatgtcctgactgctgccattgggcgaccagagcatcctggccatgtccgttctgctagagtcggtttcaccataaaacaatatttcggatcgactccacaaacatcccgtagttcttcctccatgcctcctgaagacctacaacaactaacccaacaaatcagggaccaactggaggagtcgataacagaaaaagtgactcggtag

SEQ ID NO: 66189 - DNA, 731 bp, Glycine max
  Peptide Sequence Number=SeqID_182967
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgcttgcaaaaccccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 66190 - DNA, 657 bp, Glycine max
  Peptide Sequence Number=SeqID_182968
atggttgatgcaaatagatcacggctcaacattcaagaggtggaacaaacccttacccgaatgatcaatgactccaacactgagatgcagctgaaacttgatcaggtcactgcatccttagttgagctcaagagtttgttcactcaacagccactcaaccaacctgggagctctatgatcaacaacatagagaggacccaatatggtagcagactcaatacccaagtgtttgttggaattcctcagacacaatcgttcccatcacaaacccattactctacgaggttttctaaggttgagttccttaggtttgatggaatgaaagttaaggagtggctttataaatgcaaacaattttttgcactagacaacaccccacctaaatcgaagactaggcgagtacaagagtacttgaatgagtttgagctgatgttaatccagaaaaaccccccaggacctgtaatgcagcagaaaaggcagagaggagagctaaaggactctatcattctctttacacctggtcatcaattgaaacataagagatcccaactcctagtgatagaaatagaggatgatgagctagtagatgagggaatagaggtgatcaaagagaatggggtggtcactatgacatctaatcaaggggatagaccttag

SEQ ID NO: 66191 - DNA, 928 bp, Glycine max
  Peptide Sequence Number=SeqID_182969
aggactacacatcctcaccttcaaaggactacaggccctttccttcagaggacttgacgacctcacctttagagggctacacgccctcgccttcaaagggctacatgccctcgcctttagaggactacacatcctcacctttagagggctacatgccctcgccttcagaggactacacgtcctcagcatcagagggctgcatgtcctcacctttggaggactacacaccctcgcctttagaggactacacgtcctcacctttagagggctacacgccctcgcgttcagaagactacacgtcgtcaccttcagagggctacacgccctcgcctttagtaggactacacatcctcaccttcagagggctacacgccctcaccttcagaggactacacgtcctcgtcttcagaggactacacgtgctcaccttcagaggactacacgtcctcaccttcagagggttgcacaccctcgccttcagaaggttgctcgtcctcaacttcagagggatacacgtcctcaccttttgagggctatgcgtcctcactttaatttccttttatcagttccttttcctgggccaccccctgatattggagggcgacaaaatatgcaagcacaaccaaagagggaggctatcatgcagctactatgcatactggggcaagatttcacccgtgccgctgcaaagagacgagtgcggcaacattctgcccagcaaccgcaatgccgatctccccctgcggaagtatcagttggtctgtgccgtcccgacatagggatcacgcccgcaagacacccagtggactcgaagaaatccaacaaggtcctggggtttccagctttggttatgggcctctggatcgcgttcgcaagacacccagcggacccagagaagtccaacagggtcctggggttccaactctga

SEQ ID NO: 66192 - DNA, 255 bp, Glycine max
  Peptide Sequence Number=SeqID_182970
atggcagcagaatggagaaggaagagagagaggagacgctacttcaaggagaagatgagtctagaagaagcttaccaccataggaggccatggataagagcttggaggaagaagaagatgaatgaagggagagaaagagaagatcacgaaattttatgctctaaaagagctctgaaatctgaactatggctcagcccacaaatccaagattctccactaagtgtgcttaggtgtcatgaggcatgtaaagcatga

SEQ ID NO: 66193 - DNA, 826 bp, Glycine max
  Peptide Sequence Number=SeqID_182971
atggccaatcgtaacaatgtgatttccgccttggaaaaagcggaactggtcattgcccaagacgcctttttagacactgaaaccaaccgctatgccgatattctgctgccaggagcgttatgggccgaagccgaaggcgtcatgatcaactcagaacgcaatatgaccctgatgcagcaggcagctcatccaccaggtaaagccatggctgactggcagattattgccaaagtcgcttgtgaaatgggttttagtgaaggctttagttaccaatcagccgctgaagtgtttgcggaaatcacacagacgtccaacctgaaaaccggttacgacatccgcggagtgagtcatgacaagttgcgcgaaacgcccttgcaatggccatgtcccccagagagtgaagcggaccggcatccgattcgttacctcaatgacgggatcagccagacattaaaagtcaacgaagatggtcaagcgccaagactcgcctttgctactgccagtggtaaagcgatgttttttgcccggccacatatggatccgcaggaattacctgacgaaggctttccatttgtactcaacactggccgcttgcaacatcaatggcatacgctgaccaaaaccggcaagattgccaccttgaacaaactgaatccgggaccgttcatcgagctgcaccctgaagatgctgctgtactcggcattcaggataaagaccaggttgaaatcagctcccgccgtggcagcgctgtgctacccgccatcgtcacggacagagtccgtgcaggcaactgttttgcgccctttcactggaatgatgtctatg

SEQ ID NO: 66194 - DNA, 189 bp, Glycine max
  Peptide Sequence Number=SeqID_182972
atggttcctcctggtgaatatcgcttgtcagccattgctgctactcttgagaatggtgttggactcaggggggaatcaaaattagaatcctttatcgacatagttgagcatgacatgattatcttatatggaataagggctacgcccaaatcagttcttgaactaatggatgtcaaggatgccctctag

SEQ ID NO: 66195 - DNA, 228 bp, Glycine max
  Peptide Sequence Number=SeqID_182973
atggcgagggcgtgtagccctctgaaggtgaggacatgcagtcctctgaaagtgaggacacacagtcctcttaaggtgagggcgtgcagccctctgttggcgaggacgtgtagtcctctgaagaccaggattgactgcccttttgaaaaaggtgataattcatgctacctcatcctatctttttgcaaatctctccgggaactccctcagagtgtatgttctttttga

SEQ ID NO: 66196 - DNA, 175 bp, Glycine max
  Peptide Sequence Number=SeqID_182974
gcgtgctagggaggctgaggggaggttacaaggttcagaagttgagggaattgagagaagagagaaagaagaagaagaaagaagaggaaacgaagctgaggcactgccgaatcacgactgtgataaatctctacgccgttccttgttcggtgttcttcgtgcgattgtcgattag

SEQ ID NO: 66197 - DNA, 447 bp, Glycine max
  Peptide Sequence Number=SeqID_182975
atggaagaggcagagaaggagatcttggaaacatttagaaaagtagaggtaaacatacctctgctggatgcaataaagcaaattccaagatatgctaaattcttgaaggaactgtgcactaataagaggaagcttaaaggaagtgaaagaattagtatgggcagaaatgtctccacattgattggtaaatctgttccccaaatccctgaaaaatgtaaagatccagctggagttgctgcacatgatgtccaacgttatgtcaaggaatcagatcgggctgcacaatgcacaaggcaagataaaatgtcaaaagaagaattgaagctgcaggatccacgatgtcggatacaatgtccaggacatcctgcccgaaaatactggacacataaatctgttatatctttaacagattgtgcaggatccacgatgtcggatacgatgtcctga

SEQ ID NO: 66198 - DNA, 1164 bp, Glycine max
  Peptide Sequence Number=SeqID_182976
atggcttcggcggtgtcggtactggagcgcggcggccccagctcgctcgacgatatgatggccgactgggagccgaacgatcgccagtttttctcggtgattcagcacgcgagaccggccactacgccggacaatgcgccgccggagacctttaatcagccgtttcacggcccgtttccgcaggtgattgtgcgctgggtgaagggcgctgacggtaaagagtacgaactgcgctatgacgtcaaagggctgcgcgaagacagttcaatgggcggcggaggcccgcgtcgtattctgaatatccccgagccgatgtttacctttgccggcgcgctggggctgctgttcagtctgctgctggcgtggaacctgacgcgaccaatgcgtcagctgcgggaggggtttgcccgcgtgtcgcgcggtgatttgtcggtgcggctttatccggtgatgcgtcgacgccatgatgagctgtcgattgtggcccaggattttgatgcgatggtggagcggctggatacgctggtgaaagcgcgcgaggagctgctgcacgatatctcccacgagctgcgctccccgctggcgcgcctgcagttagccaccggtctggcgcgtcagacgccggagtcggtagcctcctcactgaatcgcatcgacgaggaggcgcgccgtctggataagatgatcggcgaactgctgacgctgtcgcgcgctgaacatgagagcatgcctggcgagcagtactttgacctgaccggcctgctacatgcggtggtaaccgatgtgcgctacgaagcgcagatccccggtgtgcacgtagattttctggtggatgagaacgcggattacaccgtgcgcggtaatgctgagctaatccgccgcggcgtggagaatgtgctgcgcaacgcgctgcgtttctcgcatcaggggcagcatatcagcgtgcagttgcaggcggagaatcagtggctggcgattcgcgtgcgcgatcaggggccgggcgtggatgatgagaagctgtcgagtatcttcgatccgttcgttcgggtgaattcaccgctgatgggcaaaggctacgggctggggctgtcgatcgtgcgcaaagtggttctggcccatcacggcgaagttcaggcggtgaatcgtccggaaggcgggctggaa

SEQ ID NO: 66199 - DNA, 249 bp, Glycine max
  Peptide Sequence Number=SeqID_182977
atgtgcagtcctctgatggcgaggacatacagtcctctaaaggtgataggtactagtacccaagggtccacctttatgagaaagcatgagatcgactcatcgagagggccggtcatccaaaaagattggacacgagatattgactgtccttttgaaaaaggtgataattcatgcaaccttatcctatctcttgcaaatttctccgagaactccctcagagtgtatgttctatttgatttagtcacttga

SEQ ID NO: 66200 - DNA, 447 bp, Glycine max
  Peptide Sequence Number=SeqID_182978
atgggggagacacatgaaattccccaccacaatctagccgacttcgagccttgcctcggatatgccactgaagggcaagcagttgttgatatacccctgcaaaacacattggagggccctcagtatcacccacaaccacacccctcacattccacagcgaaagagttgttcctagtacccaatatcatcacccctcccaagttcaaggtgctggactttgacaagtacaaggggactacttgccccaagaaccatctaaagatgtattgtcggaagatgggggcatacgcaaaagatgaggaattgctgatacattccttccaagaaagtcttactggggtagcttttacctggtacactaacttggaaccttctcgagtccattcatggaaggacttaatggttgccttcgttaggcagtgtcagttaattctgatatggctctag

SEQ ID NO: 66201 - DNA, 296 bp, Glycine max
  Peptide Sequence Number=SeqID_182979
gtacaagagtagatgaagaccaacatggaggccatgagagagcaaatggcctcagtgatggaggccatgatgagaatgaagaagataatacggttgcagttgctgctaccagtgctgttacaaaagtgaacccgatgcccccatctggcttcaaccaaatgaatcatccaacctcagctatgatttgggaagtatgggtggcccctattatgtgcaaattcaaaatgagcacgccttcccgccatatggctggcctcccaacttacaccacccaatgtggcgcacactcccaatga

SEQ ID NO: 66202 - DNA, 747 bp, Glycine max
  Peptide Sequence Number=SeqID_182980
atggcccgcagccgtgccggtgccgaactggaccgccgcatcggcgatgccaccctgccgccggccatcgccgagttcctgcgccagccgtggcagcaccacctgaccctggcgctgctgcgcgagggcgaggagggcgcgtcggtggccgaggcactgagcctggctgacggcctgctggaggaagtggccgaggcccgccgccagatcgtcggcaagccgtggctgcaggcctggcagccggtgctggccaaggtatttgccagtgtcggcgtgcacggcgatgccgccaccggtgccatcgacgccttgcatgacaccctgcagggcattgctgaatcgcgcccggaactgcagcgcgcgctgccggaactgccgcaggttgccttgccggcgccgccggtggctgaatcgccggcggtcgagctgggcgggcagatcgacgccgacgatttcgacaacgccgacgccgaccgcttccgccgcatggaaatcggcaactggctggacttcgtcgacaaggatggcaaggtgcaggcgggcaagctgtcctgggtcagcccgatctcctcgcgcctgctgttcgtcaaccgtcgcggcgtgcgcttctgcgtggcctcgccggaagaactggcggtgatggtgcggctgggccgcctgcgtgcccacgtcgatgatggcgccttcgacagcgccatgcagggcgtgatcgatcgcctcgacccgggcagcgccacgctgcactga

SEQ ID NO: 66203 - DNA, 390 bp, Glycine max
  Peptide Sequence Number=SeqID_182981
atggccgtggcgttgctggggatcaaggagaccgcgccgggcgaacggcgcgtggcactgacgccggagaccgcgcgcaggctcggggccttgggcattgccgtctggtatgaggcgggcgcgggtttggcggctggtttcaccgacgccgcctatgacgatgccggtgcacgcgtcttcgacgcgggccgctgggccgagatcgatatcctgctgtgcgtgcagcccccccctgcggcggtgctggaacagctcaagcccggcgccagcgtggtcggcctgctggccccggccagcgatccggcgctggccgcgctggcggccgatggtcgcctgcagctgttcccgctgcagcagctgccgcgcaccacccgtgcgcaggcgatggat

SEQ ID NO: 66204 - DNA, 381 bp, Glycine max
  Peptide Sequence Number=SeqID_182982
atgaagcattttcttgagcaagtagcctggcctgaagctcaacttccattggtgagacccaatgaggctgctccgcctgagcccacacctgtgcatgttgatccaaagccagctaacccacaatctccagtggtgaatccactgtcttctcctgagtgtgaagtagttcccccatctccacctctgattatcatcttcgatgcatcatcagatgaagtggctgccccccctgattcaccagcaggagaaatagctgaccttcctacttccccagttggaggaatttccgatctttctgattcgtcatctggagaagttgttgctctcacaatgtctgcttacagtaattcctttttgctagttttatttatgggtagttag

SEQ ID NO: 66205 - DNA, 201 bp, Glycine max
  Peptide Sequence Number=SeqID_182983
atggatcgagttacatcgctgcttcgtctactgccaaacatatttaggactgtcgatgtccctcttacttccggtttcaccttgacgaagataaaagaacaagctttacggtgcccttaccaaacccgtgctagagctagagtaatgggtgaagtagaggaggtgcaagagcaaatgaaggccgacatggaggccatgtaa

SEQ ID NO: 66206 - DNA, 369 bp, Glycine max
  Peptide Sequence Number=SeqID_182984
atgcaagtacaaccagaggaggaggctatcatgcagctactatgcataccggggcaagatttcacctgtgccactgcaaagaaatgtgtgcggatcatgcgtaccaacatgaccactattacacagatatggatgacgttgctacttagatacattcttctcaacgaccgcaatgccgatctccccctacgaaagtatcggttgggatcgcgcccgcaggacacccagtggacccaaagaagtccaacaggagtgcccatcacccccaacaaggtcattaggccccgcattaatcgggctttcatcaagaagtactgcgcccccaggcaggcagagggcgagacaccacaacagcctggggatggctag

SEQ ID NO: 66207 - DNA, 645 bp, Glycine max
  Peptide Sequence Number=SeqID_182985
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacaatgcacagagagttttcaaagatatgccccaaaaaaatgaagcttcttggaatgcaatgatatcagcacttgctgctcatggaaaagccaaggaggcactatcactatttcagcacatgtcagatgagggtggaggcctcgttgatgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 66208 - DNA, 192 bp, Glycine max
  Peptide Sequence Number=SeqID_182986
atgcagtctcagggacttgcattgcctccagagcctatggctggtccctcaggtcctcgtgtcatcacaaaggagagaagattttacgagggatcaacagttcacaatattcctttgttgcctggccaagtgaaggttggtgttgaggaggttaaagatgcactggctcccgttcctgtacccactgatgag

SEQ ID NO: 66209 - DNA, 963 bp, Glycine max
  Peptide Sequence Number=SeqID_182987
cttgtccccacacttgaagagtactcctacctagtgggtttacctgtgccagacaagatacctttccatggttttgagcctacccctaaaccctctgacatcgcagccgccctccatcttaaaacctccatcatccaagcaaaccttacctctaaaggaggcctccaaggtcttcccacccacttcctctaccaacaagcctccatatttgctgaagcagctagtatgcttgccttccattctatcctagccctccttatacatggccttttactcttcccaaatattgacaacttcatcgatatcaatgccattaaaatctttcttacaaagaaccccgtacccactctactcgccgatacctaccattctatccatgaccgtacccaggctggccggggaaccatttcttgttgtgcacctttactctatcagtggtttaccttccacttacctcaatcccgtgccttcaagaccaatgatgacaagctttcctggcctcgccgaatcatgacccttgacccatctgacattgtttggtaccaagcagctagtgatgttggagagattattgtgagttgtggtgaatatcccaacgtacctcttttgggtatgcgtggcggaattagctacaacccactcctcgctcgacgacaatttgggtacccgataaagacaaaaccaaacaaccttgccttgactaatgaattctatcttaaccatggagatcactcgaacaaaagggaaagattcgcacaagctggagcgctatccgcagcatcaacagaagtcagttgggaaagaaatcagactatgtgcacgaatcttatacccagtgggttattgataggaccaagagctttggcctaccctgccgcttacctagatacctatcgtccaccatcccaccatcatccttgcctatcccatttgacactaaggaagagaatcaagaacagttaa

SEQ ID NO: 66210 - DNA, 822 bp, Glycine max
  Peptide Sequence Number=SeqID_182988
atgggtgaagtagaggaggtgcaagagcagatgaaagtcgacacagaggccttgaaagagcaaatggccacaatgatggaggccatgatgagcataaaggagataatggaggtcaatatggctgcagttgccactgtctgcacggtttctaggatggacccgactcccccatctggcctcaacctaataaatcgtccaacctcagatacgagcggccctcattttgtgcaagtcctgaacaagcatgttttcctgccatatggtttgcctccgaactatactccacccaatgagaatgtcaataactctactcctatactcgttgagagccaacaaccccaaactgatcatgcacatgtctctcaacccatgcgggagacacatgaaatatcccatcgcaatctagtcgactttgagcctcgccttggatatgccactgaagggcaagcagttggcgatatacccctgcaaaacactttggagggccctcagtatcacctacaaccacaccccttgcattccacagcgggtaaaaaccctcctgctatgacagaaatgggaaagttggatcatctagaggaaaggctcagggccattgaaggaggtagagattatgcctttgttaaagagttgttcctagtacccaatatcatcacccttcccaagttcaagatgctggactttgacaagtacaaggggactacttgccccaagaaccatctaaagatgtattgttggaagatgggggcatacgcaaaagatgagaaactactgatacatttcttccaagaaagtcttactggggtagctgttacctggtag

SEQ ID NO: 66211 - DNA, 198 bp, Glycine max
  Peptide Sequence Number=SeqID_182989
atggaaattctcatcctgggtcaaggtttatggtggtttgatgtcttgggtcaaaaggcttgcagaacggtcggacatgatgatcatgagcaactcggtgtgtcctactacgacttgagaaacaaaggtgatcaaataacaagcagagatttaaaaggtactaggttgcctcctagtagcgcttctttaacgtcttga

SEQ ID NO: 66212 - DNA, 269 bp, Glycine max
  Peptide Sequence Number=SeqID_182990
atgggatcaagtcaaaagccttcgcttaaaaagaggttttatcaagtcaaaatcaagagcttagaggtcactagtttacgagagttggggcaattaatgggtcaacttcaacggcaagccttccgcaaagcctatggtgcttcacatttgagggacttccagctagtgccgactgtggaagagtttgaagaaatcctgggatgcccactgggaggaaggaagccatatcttttctttgggtctatccctccacgacaagagttgccaag

SEQ ID NO: 66213 - DNA, 237 bp, Glycine max
  Peptide Sequence Number=SeqID_182991
cttgatgatgaaccatttgttcaagtcaagcgttcctttgcaattggtgctggtgcagtgacttcctttggatacctccttaccgaattacgaggtcttcgttcttatgttggtgaacgtttcgactcattggatacacgttttgccggcatggatattcgcctcacacaacttgaagaggatgtgggctacattcgtcagagtttcgatcttccaccaccacctccaccttcttag

SEQ ID NO: 66214 - DNA, 405 bp, Glycine max
  Peptide Sequence Number=SeqID_182992
atgacattgtcagggcaaaactcaaaaacttcgacatccttaccttcaggaacacttgaaaggtggcaacgccactcaaaaaggcacgacttcggctacgtggcggtggtgggagcagcaggtccacttcggcttcaagtacttcacggcgggaaacaaaacgtcagggtggtagcgggatggagttcacggcgggatgaagtagttcaggcaatagcggtggcgctaggtttttggagggacggtgtacctacaagcaccgtcttttatgacttccatcaaaactacaacgacggggttatagacaaatgtcgttgtacaacaaacgcgccacataaaaacttatataattacgtaaatgtcaccgtgttgacaactacgacaggttcttcaacactgacgtag

SEQ ID NO: 66215 - DNA, 833 bp, Glycine max
  Peptide Sequence Number=SeqID_182993
agcttgatgcgcacgtcgtcgaccaggatctcgcccatgccgcagcccggtgcggtcagggtcatcttcacgtcgatctcgcgcttgccttcgtccaggtgcttgatctcgacttcgtagaccaggcccagttcgacgatgttcaccggaatttccgggtcgaagcaggtgcgcagctgctgccataccagctgttccacctgttcatcggtggcatcggcgggcagttccagcggtgccggcgcctccttgccgatggcgtcgccgtccttgccggcgatgcggaacaggttgccctcgacaaacaccgaataactgccgcccagtgcctgggtgatgtacccatagctgccggcaggcagggtcacggtgtcgccctgcgggaccatcacggcctcgcaatcgcgttcgaagtggacaggttcgctgctacgggaatacatggggaccgatatggggccgtggccggggccacgcaagacggcattctagcccagccgccctgcggccgccggtgcactgcggcaaaccacagtcggctggatggcggtactgaccgccctggaactggtgttcatgctgcgcatgggtacgctgggcccgggccggttgcgcatcgcgctggtcgtgctgggcaccctgctggtggccgccgtggccaactgggccatcgccagcgcctggatgggcggctcgatcgggctggatctgtgggacgccacgatgcggatgggcccgcacctggcctggaccctgatcacctcgccaatggcgcgatcgagtggctgtggctgggcctgggcgtggccgtgggcgcctggctggcgcgctga

SEQ ID NO: 66216 - DNA, 288 bp, Glycine max
  Peptide Sequence Number=SeqID_182994
atgagggttcgggagttgtttacgcatagggaagggggtgcccttgctcctacatatcctcaggcaaaaagccactttggggcggttaaagctcacccaggcaagctgaagcttagccctgaaggaagaagctcgcccaggcgagctgcttgcttagccatgaagctatttcatggcccaggccagccagatgttggcctgggcgagctagggtctaggaaaataaaaagaaggacctttttgcctcccttccttggtatcttttgttttcttgatcaaaaacactaa

SEQ ID NO: 66217 - DNA, 264 bp, Glycine max
  Peptide Sequence Number=SeqID_182995
atgtttgtctttgccccaacccatggttctgtttgtagactagcagctggtgtctcgctaagcgaggcctgtgcgcttagcgagagtcatgcgctaagcgaggcactcagctcacttagcgagttgggagaatgtggaggagaatctgagaagcatctacgtgctcaacgcgtcttcagctcgctcagcgaggcatttttctcttcctgcgctaagcgcgcccagctcactcagcggatattcactacctcgcggatcctctag

SEQ ID NO: 66218 - DNA, 1065 bp, Glycine max
  Peptide Sequence Number=SeqID_182996
atggccgggcggctgctgctgagcctgttcctgcaaaccgcgccggggcgcagggtgctggcgcgcttcgacggtggcaacgacggcgtttacgtgcggccgctgggctataaatccaacctgcgctggctcctgccgctgatggcggcgatcgcgctgctgttcccgttcgtcgccaccaaatacctgctgacggtggcgatcctcggcctgatctacgtgctgctcggcctggggctgaatatcgtggtcgggctggcggggctgctcgatctgggatacgtggcgttttacgccatcggcgcctacgggctggcgctgggctatcagtacctcgggctggggttttgggcgatgctgccgctgggagcgctgatggcggcgctggccggcgcgctgctgggtttcccggtgctgcgcatgcacggcgactacctggcgatcgtcacgctggggttcggtgagatcatccggctggtgctgaacaactggatgtcgctcaccggtgggccgaacggcgtctcggtgccggcgccgacggtgttcggcctggagttcggccgccgcgccaaagacggcggggtgccgatccacgagtttctcggcatcgattacaaccccaacctcaagttcattttcatctacgcggtgctgtttttggtggtgctgctggtgctgtacatcaagcaccggctgacgcgcatgccgatcggccgcgcctgggaggcgctgcgcgaggatgagatcgcctgccgctctctcgggctgaaccacgtgctggtgaagctgtcggcctttatgctgggcgcctccaccgccgggctggcgggggtgtttttcgccacctatcagggtttcgtcaacccgacctcgttcaccttcttcgagtcggcgctgatcctggcgatcgtggtgctgggcggcatgggctccaccctcggcgtggtgctggcggccttcgtgctgacggtggcgccggagctgctgcgcagcttcgccgaataccgggtgctgctgttcggcgtgctgatggtggcgatgatgatctggcggccgcgcgggctg

SEQ ID NO: 66219 - DNA, 150 bp, Glycine max
  Peptide Sequence Number=SeqID_182997
gagggagaggccctgacggactcttcggagtgtaggccttgggggtcatccgggtttgagtgctcctgtaagcctgtgccgatcccacatggttggagcattctcgcaaaacagcgtgcccctgactggtctccctatgatttcacttag

SEQ ID NO: 66220 - DNA, 336 bp, Glycine max
  Peptide Sequence Number=SeqID_182998
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttgggggggccgaggccccctactgctggtcggcaaacggacggcgggcgcacgcgtcgcttctag

SEQ ID NO: 66221 - DNA, 261 bp, Glycine max
  Peptide Sequence Number=SeqID_182999
atggcatccttcaaccagcttcagtcacagatgcaatctcagggatctcttgagcctctggttggtcctggtccctccggtcctcgggtgagcacaaaggggagttgtgttgatccctcaggaaacgatcctgagacgggtgactctgacaggtgcggcttgtacatagaagcagatcctgcccgcctggttgccgtggggagagtttatgagggatccactcttgttcataacactcctttgtttcctggccaagtaaag

SEQ ID NO: 66222 - DNA, 1236 bp, Glycine max
  Peptide Sequence Number=SeqID_183000
gataaacttctgcgcacccgcgccctgctcggctgtttcaccttcgctaacttcagcattctgtggacgtcgatggcgtttctgcttgccgccccgccgttcaattattccgaaggggtgattggtctgttcggtctggccggtgccgctggcgcgctgggcgcgcgtcccgcgggtgggctggccgacaagggcaaatctcacctgaccacctccgcagggctgattttactcctgctctcctgggcggcaatctggtacggacacgtctcggtactggcgctgatcgtcggtattctggtgctcgatctcaccgtgcagggcgttcatatcaccaatcagaccgtgatttaccgcgtgaagccagaggcgcgtaaccgcctcacggccggatacatgaccagctactttattggcggcgcagcgggttcgctcatttccgcctcggcgtggcagcatgccggctggtccggcgtgtgtgggattggcgccatcgttgccgcactcaacctggtggcccctcagtctgttaatgtaaacgtaatcatttatcccagaaattttaatgtgggtgacatatttacaatcggcatgaacagttcagacccccgtcctcacatcctctcttcagcgggttcacaccctaccctttctgtgctcaccgggtcacggacttacccggcgctttctgatggttatgcccaaatggatagttcgtttacgcccattgaacaaatgcttaaattccgcgccagtcgccatgaggacttcccgtatcaggaaatcctgctgactcgcctgtgcatgcacatgcagggtaagctactggaaaaccgtaataaaatgctgaaagctcaagggattaacgagacgttgtttatggcgttgattacgctggagtctcaggaaaaccacagcattcagccttctgagctgagctgcgcgctgggctcttcccgtaccaacgcaacccgtattgccgatgagctggaaaagcgcggctggattgaacgccgtgaaagcgacaacgatcgtcgttgcctgcatctgcaactgaccgacaaaggtcacgaattcctgcgtgaggtactgccacctcagcacaattgcctgcacaaactctggtctgccctcagcaccgccgagcgcgaccagcttgagcacatcacgcgcaagctgctcacccgtctggatcagatggatgaagatggcgccattcttgaggcgctgcgctaa

SEQ ID NO: 66223 - DNA, 519 bp, Glycine max
  Peptide Sequence Number=SeqID_183001
atggaactattccttttgagagttaggcttagggaggacgaaataacaagtattgctaggttccttagtgggcttaatatggaagtgagggacaaggttaagctctttccatatagggacctagatgacctagtccaactttgcataagggtagagcaacaacttaaaaggaagcctacttcaaaatcgtatggctctcactcttatccaaagaaagaccaaggtcaaggaattttaggggctgaaccttctaagcccaaagacgataagaggggtgaggaagaaacactagaaaaacaaaagaaaaagaaggatagtaaggccttgtcttcaaaggccaaggggaaggaaaaagaggaaaaggattcctctaacaggatagttaagaaggaaaattattttacaacaaaaggtgatatcaaaagagcactccttcttgaacaatccttttaccttctcctatcaagggaaacatcccttagcactgccatacctcttgagcttgaggttattccttaa

SEQ ID NO: 66224 - DNA, 139 bp, Glycine max
  Peptide Sequence Number=SeqID_183002
atcaactgcttctttcattcttcctcactacgagattagaagttctcacccaataggttccctcctcaaggtcatgacgaaaggcaacgattggtacctcaaagccttacactggggcaatgaggggcaccgtgcatga

SEQ ID NO: 66225 - DNA, 576 bp, Glycine max
  Peptide Sequence Number=SeqID_183003
atcactcttctatctgaagaagaggataggatacttgaggcacatcaagatgctcccccttctcagccacaatttgaacatcagcagtttaatatactacagcgaagtgtggagactcgaggcttagggcgacgtcggcaaactgtggatgcagcaccgtacagtttgccttcgatgccagaacgagaacatggaatgtattacacaccaccggtattcacccaagaaccatcgcagatggcgccgatgtattcatacccacatgatttccaaccagggtacagtatgacaggcatatttggatcctctcctccttcaggggggactccttcattcacccaaaataatgaactaccgaccccaaatgctccacttggtggtccgtggaatgtacctggaaatatacctgacatgaatgacttattgggggtcgatttacgtcatgatttctctgccgaggctgacgaagtggatgaaagggggaatcttagaagaagaaaccctgatagggcagctaggaattgggatcggccatgtgggacatcgtcgcggcatcacagacatagtcatgattga

SEQ ID NO: 66226 - DNA, 427 bp, Glycine max
  Peptide Sequence Number=SeqID_183004
tcctcgccttcagagtgctgcacgccctcgccttttggaggactacacgtcctcaccttcataggattacacgtcctcgcctttagaggactacacgtccttgcctttagagggctacacgccatcgccttcaaaggactacacgtcctggcattcaaagggctacacgtcctcgccttcagaggactacacgtcctcgccttcagagggctacacgccctcgccttcagaggattagacgtcctctccttcagaggtctacacgccctcgacttcagaggactagacgtccttgccttcagagggctccataaaccgaggtgcttccgtaacgcttccgtaagcgattctgtggaaattcttcatcattcttcatcgttcttcatcgttcttcattcgttcttcgtcgttcttcattcttcaacag

SEQ ID NO: 66227 - DNA, 123 bp, Glycine max
  Peptide Sequence Number=SeqID_183005
atggatgcaaaattcacagagagatgtctacctaaaagcctacttgaatgggctttgaagggatttaacaatggtcaaggaagtaaatccaaggttgcagctagatggattatagttaaataa

SEQ ID NO: 66228 - DNA, 273 bp, Glycine max
  Peptide Sequence Number=SeqID_183006
atgaatggtgcagttgaggccaccaataagaaaatcaagaagatcattcaaaagatgacagtaacatacaaagattggcacgaggtgttgtcgttcgcattacatggtatcacctattcagagagtctccaagggaaatgggcctcgaactatgaaggaccttttgtggtgaagaaagctttctcgggtggaacactaatactcagaaacatggatggtgaagagctgccttcacctgtgaattctgatgtcgtcaagcaatactatgcatga

SEQ ID NO: 66229 - DNA, 493 bp, Glycine max
  Peptide Sequence Number=SeqID_183007
ggacgccacagagatccctaatgtcaattttgagatgtcaatcaaccaaactaaggaagatgaagagaaggattggggattgtctcctgatctgttaaggatggtggagcaagaagagagggaaataaagccgcatcaagaggaaacaaagcttgttaacctgggcattgatgaagagataaaaagaagtcaagattggcacttgtatgatatgccaggtttagaacctgaaatcatgcaacacagattatcgttgaaacatgaatgctccttcgtgaaacaaaaactaggcaagatgaagcctgagatgtctttaaagataaaggaagaggttatgttgttagggttgaagaatgatggggcaatatatccgtcggccatgccaaaaaaggatagaagtggatccagacaaagtggaagcgatcctagagatgccaaagccatgtacagagaagcaagtccatggattcctaggaagattgaactacattag

SEQ ID NO: 66230 - DNA, 984 bp, Glycine max
  Peptide Sequence Number=SeqID_183008
atggacacattgccagtgttctactatgagaagatggtaggttacatgccttcaagttttgcagatttagtgtttgcaagcaagaggatcgaagtgagtctgagaagagggaaatttgattatgttgcttctgcgggttctagtaataagagacctaggatgagtggagggaagaagaaggatagagaaacctatgttgtgactgttgttcctacatggccaaattttccactagccccttataatcccatctttgggcatttcatcgagcactgtatggccttgaaacataaggaagacaatcccaatgtgcaaactaacccactcgcagaccatgggagttcttctgtaaatgttataaagaatgaggagatatgggaattgaaaagaagggtggaggatgtcttgacttctaaaagatttatcctgaaagtgttgtgcaaagctagtatggttgattgcgagggtgatgaggaggatcgatgcccattgcatcccaagacacttcatgatgtggaagaatgcttagtgtttaaggagcttttacagggtttgatgaatgacgaccgaattgaaatcggtcataggaggaagaaggaaggtgaggtgtttatgcagttgagtgacgccaatatgattgccccatcatcattcccgtatgataataacaaagaagtacaatggagatatgatgtacaagtatcaaagagaagacaggatgtatccctcgtgtatgatgggcataacacatcaacccctaaagtcacgaacatttatggtatcagtggcatgatgcgtagtgagcgtgtttttactcatcccgatttgcaagctgaattgaaagataagggcaaagtaaaggtgaatgaaacaaaaatcgagaaaataggtctcatggtgaatgaaaaagttcatagtgaaaaccctgaagggaaaaaagagaattctggtcagaaagaaatatctgctgaagaggcaacatga

SEQ ID NO: 66231 - DNA, 730 bp, Glycine max
  Peptide Sequence Number=SeqID_183009
atgactgcgacacacacgctcaccgagcgctacatcagcgccaccatccagagcctccccccggagacacagaacgatgtgcgcgccgagctcgaagcgtccatcgccgacgccatcgaggcccgcctcgaccagggagagaccccggaggaagccgaacgtgccgtcctcaccgagctcggcgatccaggggtcctcgctgcggggtacgcggatcgcccgctgtacctcatcggtccgcgcttctacctggcctggtggcggctgctgaagctgctgctcatgatcgtcccggtgtgcgtgctgggcgcggtggcgctggggcaggtcatctcggctgcgccggtcggcgaggtcatctcgtcctcgatcctcgccaccggtggtgcgatcctgcacatctgcttctggaccaccctggtcttcgtgatcctggaccgcagcgggagcacctcggcgctgcagcactgggatgtcgatccgctccccgagccccacgcacagggcggggcaggagggaacgaactgatcgcctctctggcgtttctaggcatcgccgtcggtgccctgatctgggatcgctttcgcggtttcgtcctcgtcgacggagaagcgctgccgatcctgaaccccgggcagtggccgtggggcatcggagtgctgctgctgatcatggcggcagaagcggtgttagccgtcgtgctcttccagaagcgccgctggaccacag

SEQ ID NO: 66232 - DNA, 111 bp, Glycine max
  Peptide Sequence Number=SeqID_183010
atggaagatgaaatagtgggaggaattggtgttgtctacgctctagaggcttcgtggcttcgagttccggtggatgcggatgaggagttttttgaaagtgttgattggtag

SEQ ID NO: 66233 - DNA, 234 bp, Glycine max
  Peptide Sequence Number=SeqID_183011
atggcgtttttcctaagctacttggactacaaggctcaaaacgcacaagtgagcaatggtctcaggaacggaaacgtcgcgcacattacagacatcttctcaaagatcccaacggttagatcgtggaaatggtgttacactaagcgcgagatcagtgtgctaagtgcagtagttgtcttcaaccaggctcagcacacgactagtgctaagctcaaatccactcactcgcgctaa

SEQ ID NO: 66234 - DNA, 981 bp, Glycine max
  Peptide Sequence Number=SeqID_183012
gtgctttctgtagcggtttataatcactataagaggatatttaatgaaacctctttgcccaagtggcctgcaggagattcagataatagtgtgaaagttgatgctgctgatgatgatagagttgaacttgagaaaagcaacatccttctaatggggccaaccggatcaggtgtagacatttatgcaaattctgaacacagagaagttgagatatatatccaaaacatttccttttatcaaattcaaagtgccctgaaggcaggttatgttggagaggatgtggaatccatattatacaagctcctcatggttgcagattataatgttgcagctgcacagcaaggcattgtttacattgatgaagttgacaagattactaaaaaggctgagagccttaatatcagtagagatgtttctggtgaaggtgttcagcaggcattactaaagatgcttgaggggacggttgtcaatgttcctgagaagggagcccgaaagcatcctagaggtgacaatattcagattgacacaaagaatatacttttcatttgtggaggagcctttgttgacttagagaaaacaatctcagaaaggcgtcatgattcttctattggatttggggctcctatacgtgcaaacatgaggactggtaaagtcacagaagctgctgtggcatcatcattattggaaactgttgaaagtagtgatcttattgcatatggtttaatacctgaatttgttgggaggtttcctatccttgtcagtttgtcagctttaactgaaaatcaactaattcaggtcctctcagaaccaaagaatgctctagggaagcaatacaagaagatgttccaaatgaatggggtaaagctacattttacagaaaatgctctaagatcaattgccagaaaggcaatatctaaaaatactggtgctcggggattacgatcgatactagaaaatgtgttggtagatgccatgtatgag

SEQ ID NO: 66235 - DNA, 591 bp, Glycine max
  Peptide Sequence Number=SeqID_183013
atgattgatcccaattttgtggttgaacgaagccaattttaccgtctgagaatcaatgccggcgatggaatggaggtcaacatggctttcgatggtggtgggcactttgatgggaagaagagaaagaaaaaattgtgggctatgccttgggataatgatcatggtttttgggcgaggagagagggggagaaaagattaagaacagatttgtggaatgcactccactttttgcttcatgcacctccaaactatatgaatggacaaaactacccctcgcctgaatgcccttccacgccaactccctccaccaacaccctcccctcttatgaagcctttgtccatggatggcaggatggtgtaatatggatgatgggtggtagactggtagtgcagtgtgacgttgatgatgttgtctcttttgcaaggccgagaaaaaggattgtcgacgttggtgttgggcagttgcagcagcagtgtttgggtcaacaatggtattggccattgggtggaggtgggaattgcttggtagaggaagcaattgcttgtttgctgatagattgggttttcgacgggatacggtccatctcatag

SEQ ID NO: 66236 - DNA, 252 bp, Glycine max
  Peptide Sequence Number=SeqID_183014
atgaagttcaattacaataaaaagaaggctgactatctcaagtatttggcgcaaagttcatcagatgcaactcaggctcagattgctcctgacagatttgcatgtatttcactattttgtcattgcaaaaacctacctaaaaaagcaagcgtgagggtggaaaagcttcagcaggttgaacatgtaattggagggacaatgatgtgcctcctgaaaaaggttataactcataaaatttacgagaggttctga

SEQ ID NO: 66237 - DNA, 408 bp, Glycine max
  Peptide Sequence Number=SeqID_183015
atgagcgacctgatccttaggaccatcgacccaacaatacaattatcataccacccacccccatcacatcattcatctccatcatcatgtgcttcccacaaagagaacaaggaagagcagtggcagcagcatgtggcgccagaggaggtttctgtggagcattttcctgcagagagttctccagatgttatcaatgaaggaagtgccacgtcgtcaacaccagtgactgaagatagaaaccatgccgttgcctttgcagcagcaactgccgctgccgccgaggcggcggtggcagctgctcaagcagctgctagagttgtaagattggcgggttatggacgccagccgaaggaagaaagagctgcaatactcattcaatcatactacagaggctacctttccttgtaa

SEQ ID NO: 66238 - DNA, 741 bp, Glycine max
  Peptide Sequence Number=SeqID_183016
atgactccattcttcatttgcaaggtggaaaagaagatacttataatgaaaatatttatgatcctgttctgtaaggtgtatttacagaaccaatgttttactattgggaaatcagattcttcaagtaaggccacaattggtgatatggacaatcccaaccctacaaatgatgaggaagtgaataaacagatattgcagcatgaaaaatctgctgctggtattttgtgccagcttaggattcatcatggagctcaggcttctcatcttacattgacaaaggatgttgtgggtattgttgctactctgggcaaagttgaggatgacattcttagcagacttttctcagagtatctaggagtggagactatgctggcaattgtttgcagaacttatgaagaggttaaagctcttgaaatgccttatgctggtaattacatgcttgaggatgcacaacggaagttggatattttaatcccaagattgcccaatggggagcttccatctggatttcttggttatgcagtgactatgattaatttagatagctcaaacctattttgtgttactcccagtggttatggcctcagagaaactctgttttataatctcttttcttgtctacaagtatataagacaagggctaaaatgatacaagcacttccttgcataagtgaaggagctctttctttagatggaggaatggttaggagttgtggtgtattttccttgggcaatagctaa

SEQ ID NO: 66239 - DNA, 290 bp, Glycine max
  Peptide Sequence Number=SeqID_183017
tcgaaattggaattcccggggcgaacgacaatcccgccgccggaccagacttcgggtgggtcccccaacgaggcaacgacgatgtagcctctccgaaccccgaagccggcgcgtggagggcaccgagagctcccggcgcgtgcgtagttgaacaccaagtgcctgaagtgtgcaagtgcgagggacgctgtttccttgctatgtacatggacaatggaggtttagaccttgaggaagaaaaacaacttgcagagaagatttgctcgtggacagtggacactctcttttag

SEQ ID NO: 66240 - DNA, 663 bp, Glycine max
  Peptide Sequence Number=SeqID_183018
atgaaaagggagagagctcttgcttacgctttcaactgccagcggcagctgaagcaatacatgcacatagacccaaatggtgatgatataggatgctacaacactgagcgtgaaagaccacaattggattggaactggttggaacgttggatgtcatcacaacaatcacccaacttaagaccacgtgagaccctttataggactcttgctaatgctaccactgatgacatgtctgaagaaaagacagttgaaatggacatggctgctaacatgggcttcatgaaccaagaatcttatgacacaagcccaatttctaataggtaccaccagcgccagcatagtgcaggtatacctagctacatggccccaaccctgtctgcaaaggccaaggttaggagtcaagggcctcaaggcccgtttaagcaacgtggttcacctgggcctcactggaactcatccaccaggagaagttctgctattgggctaggctgtgactcatctagctccggtgggcccacttcagcccatgtctccccgagaagcccaaacccaaaaattaatgagattcgtctccaatctagacggatttcaggtggcagcccagataatgttcacattgaggattgggcccttccccttggagccaccaatggctggccttga

SEQ ID NO: 66241 - DNA, 1559 bp, Glycine max
  Peptide Sequence Number=SeqID_183019
atacagaagaagagggagcaaagactagagtgtcccataacattgttttcgtgacttctgaagcggcaccatattcgaagaccggtggccttgctgatgtttgtggctctttaccgatagcactcgcgggccgtggacaccgtgtcatggttgtcacgccgagatacattcatggtacccctgaggatctcaagtttgccggggcagttgatcttgatcaatccaccaaagtgttttgctttggaggtgctcaagaaattggcttttaccatgagtatagggaaggagttgattgggtatttgtggaccatccctcattccatagaccagggaatccgtatggagacacgtttgggacttttggggataatcagtttcggttcactttactttgccatgcagcatgtgaagccccattggtgcttccattgggagggtttacttatggagaaaaatgtttattccttgctaatgattggcatgccagcctagttccaatacttttggcagcgaagtatcgtccacatggggtatataaggatgcacgtagtattttggtgatacataatatagcacaccagggagtggaacctgcaattacatatagcaatttggggctacctccagaatggtatggagcactgggatgggtgttccctacgtgggcaaggacacatgctcttgacacgggagaagctgtcaactttctaaaaggtgctgttgttacatctgaccggattgttacaggctattcctgggagataacgactagtgaaggtggatgtggtctacatgatttattaagcagtcgaaaaagtattctcagtgggatcacaaatggaattgatgtcactgaatgggacccgtcatgtgataaacatattgcttccaactattctgctgatgacctttcggggaaggccgaatgcaagatttcgttgcagaaggaattgggtcttccagtgaggcctgattgtccaatgattggattcattggaagactggactaccagaaaggtattgacctgattcggttggcaatgccagagctcatggaagctgatgttcagtttgttatgctaggttcaggaaaccctatttatgaagactggatgagagcaacagaatcagcttataaagataaatttcggggttgggtgggattcaatgttccaatatctcataaaataactgcaggctgtgatatactgttaatgccatctgcatttgagccctgcggactgaatcagttgtatgcaatgagatatggaactatacctgtagttcatgaaactggggggctaagagatactgttcataattataatccctatactgaagaaagcaaagctgaaagcactgggtggacattttctccactgacaaaggatagcatgttagcggctctaagatatgccattcaaacatataatgaacacaagccttcttgggaggggttgatgataagaggcatgacaagagattacacatgggtaaatgctgccactcactacgagcaagacatagagtgggcattctccgaccctccctattgctga

SEQ ID NO: 66242 - DNA, 684 bp, Glycine max
  Peptide Sequence Number=SeqID_183020
atgatttcgaatccagaattgatccactacgcgtgcattgctcgatcggagacgatcctggggcagcaccagagcgagaaggagcctaacatggaggccttagcagcccaatgcgtggcccaagcccctcccaaccacaccctcttctcccacaccgtccataaccgcacctacaccttcctcatcgaccctcccttcgtcttcttcgccatctcccaccactctctcctcaaatcccaaaccctccctttcctccactgcatcagatcctccttccgccaaaccctaccaccctcttccaacaataatcaccattttgcccctctctctttccaatcccaattcacctccatcttccaaaacgcgcttcaccaccaccaccaccaccaccaccatcagctacaagcctctcctcctcctcctcctcctcctctgaaccctccacctcagggcttgaagaaaaagaaaaggcctaacgacgcgcctggcacgctcgacgtctccgacgacgtcgtttcgctcaagccccaccaccagcctctcaactacaaccacagcaacaaggccaaacacgtgtggaagaaacacgtgtgggtcctcctcatccttgacttgttcgtctgcgcggttctcttcgtcatctggttgtgggtctgcagcggcttcaagtgcatggcctattga

SEQ ID NO: 66243 - DNA, 330 bp, Glycine max
  Peptide Sequence Number=SeqID_183021
atgaccagccttgtctctataacgtgttgggcctgtttaagtctgcctctggtcatgggcctttcaaagcatgatggctcttgggtgaagaagggtgctcgacatgttggtgaagaaggacatgatggagaagattcatgtcttctttcaaagattttggacaggtttgatggccttcaaacctttgttggtgaaaggtttgacactttggaattacaagtggatatgcactttaatgagatagagttaagaatcacccaggttgaagaagatgtgtcttacatacgtttgagctttgatctaccactgccgccgccaccatcatcttag

SEQ ID NO: 66244 - DNA, 3624 bp, Glycine max
  Peptide Sequence Number=SeqID_183022
atggaggacgtgccgttgccggcgctctttgagcaagcccgcaagatccacaactcagccaccgccaccgcctccgccgccgaccaggttgtgaagaaggggtgcgaggctctgcatagatgcgaggacatggtcaataacctaggtttgttctctcccaacgagaccaaagaagatatcagcaccaccaatctcaagtacattctggtgccattttatcttgcggagttgacagaaaaattagcacaggatgacaggatacatattctaaaggcttcccaggcaaaactaaaggagtttatttcattttgcgaagcaatggagctggtcccaaaagaggagttagaatcttacattgaaggggcatcaaaaactgttgctgatcagagggccaggaagatcgctaggttcaaacgtcagagagctgcagaatcaaagttgttggaaataaaagagcaaaaggaacggcgtgggcgttctactaaagcagctgccctgtccacccctgttgaggcaggagaggaagaagtattggatgatgatggggaagaagaaagagaggcttggatcactaccatatctttggcaatctgtaaggcactagatctgctggatatgttgaagaaagaggaagagatgctttctgctgttaaggatagacaatccaaggatggggataaggagttctctaaggatgttcttgatgaacgtgccaagaaagcagaagcttggcatcatgattctgcagttcgtgcacggtacactaagccatcatcaccaatcacatgtgccactttcgcccaagatgttctagaaggaagagcaaaggcttcacaagcacacgatcacaagcatcaaccactaatatttggaccggctagccttgtaaatggaaacataacaactgagagagaaagaatggcagctcaggtcttccaacctagtcataggatgccaactatgagcattgaggaagctgggctaaaagaaatggaaataatgaacaaatggcaagagagaaatgtcagactcatggaagaagccaattcatcttggcacaacgataggaagtcaaagccaggagaagacgatgatgaagatgatgctgcacaggagaaagcaagggcttgggatgactggaaggatgataatccacgaggtgcaggaaataagagacttaccccttgtggaggtgccagggaatccgatctcacaggaatgggtgagaaggaagtttctgttttggatagagttagttgtgacaacaagagtgacaccgaaagcatgtatcccatgtattttggtgtttcttgtgcattctttgcactccaagtcctcacagaagaaccacaagttgaagttgaaagatggtctaaaatccgtgacacaatgcttcaagggagtgctcagctcttggggttggttgtgtggaagcttcagaagggaatgccaaatggggtggagggattgtgcaagctcaaaattgctgagagagaaattgagaatctgaaaagaatgaggcatgaggatgccaaggccaatgagaaagttgtggggatctttgcagcacaagagcaaagctggttgagtgaaaggaggagacttcgccaacaaattggggctctactgagtgagctgagagttttggagagaaacaaggatgctgcaatttctgaaatgaatcagaaattgaaggagatgcaggctttggtggagtcaagagacaatgagattgaaaaggaggagcagaagaggaaggagctagaagagaagctgaacaaggttgagagggatgctgaagaaatgagagaatctgctcggcgcgaagctcaagagcattcttctgatctcaggaagcacaagactgctttcattgagcttgtgtcaaaccaaaggcagcttgaggctgaacttggtcgcacggtgaagcaagtggaagctactagacaagagcttgctttggcggcggagaacaaggaggagtcggatttgatggcgcaaaaattgtctttggagatcacaaaatttcacaaggatttggagcagaaggataaaattttgtcagcaatgttgaggaagtctaagctggacactgcagagaagcaaatgctgttaaaggaggttaagttatcaaaggctaggaggaagcaagcagagcaggagacacaacggtggaaggctgtttcagaaggaaagcatgaaagacattccttaaaaagcatgttggtgaatttgagttcaaggatggatgttttccctggtagtagaggtatgcagcatagtttcactgggtcctcacacattgcaaatgaaccagaccaactttcaccctttcctgatcactatttgcagcaaagaaatggagacttatccattcctgctaatgctaagcgtttggaagattgggtgagagctgaggcagaaagatatgcaaccttgattgaacaaaggcatcacttagagctagatgcttttgctgaacaattgcgactcaaagatgagaaattagaggcatttcggtggcagttgttgagaacagaattagaaatgaaacagatgcgggcacatgtggaggggcaggtaaaggatgtgacacagcttagacatgacaagatgagactggagaccttactgttggagagagaagatgaactgacttccctgaaagagcaatttgtatcaaaattgaggcccttaaaaaataactcaaatttgcctccacaatcatcagaactagcacaatatgctgtctggtcaagagtcaaggttgtcaagagaaaaccaggtgaaaaagtgctagaaacaatggaaactttggttgaggaagattgtgagaaggaagtacagtgtctgccccatgaccagcttaacagtgctaatttactagttcaatctcaagaaaatgagattgaagaagaaaagggtgtttctagggaggatagtcctactcctatgcaaaatcaaagtccaaacaaagtagaagctgatgcttctgaaaagatagcatctaccagccagacccttagtacaacaaaacagtccctatggaagatggatcttcatgctcttggaatatcttacaagatcaagaggctgaatcagcaacttgttcttgttgaaaggttaacaggaaggcaagccaatgatgaacaagcagaaattaattatgatagcaaagttggtatgaaggcttatctgtccttgacaacattgctgaataaacaagttggaagatatcaatccctccaagagaagactgatgatctttgcaaacggatgcacgagaatgacctctatgcaaaccgtggagatgtcaatgctgcaagagaaaaggagaaaacatcaacactggagcacttcctagaagagacatttcagttgcaaagatacatagttgcaacaggacaaaaactgatggaaattcagtccaagatagtttctggctttgttggagtggcagaagagatggagaaaggttcaggcattgacatgaaccggtttgccgacagtattaggaatctgttccatgaagttcaaagaggtctagaagttaggacggctagaattataggagaccttgagggaacactagctcgtgaaggaatgacatgtttgagaaggtag

SEQ ID NO: 66245 - DNA, 300 bp, Glycine max
  Peptide Sequence Number=SeqID_183023
atgcaatggaatgaactgtccgtgtcatatctatcagaagataaatgcattatgcatcaaaattgggttctgcttaacttagaagcatatgctcttttgtcaatatgcaatggaattagtggcttctgtgcaaaatgttccctaatttctgagaaagaagaacatttaggggcaagtggtaaggagaaagaacaactcaccagtgacgacgacgttggggtgatactccggcgaaaggcggcgacggagctgaggctacggttccacggcggcggcgggggaggttctttgaacctttaa

SEQ ID NO: 66246 - DNA, 363 bp, Glycine max
  Peptide Sequence Number=SeqID_183024
atggttagaatcagaggattacatcgagctttaggtagagttttaggaagagtcttaggtagacatattgctagtgatgaggaagaagcccctcgacgtcgaaggccaatagcatttgcacatagtcaacaaccagttatcgctgttgctgaagatgttgaccatgtggatcatgttgctaatggggttcatgagcaacctcaagagccagttacgaatcataaacgtactgagttgaagttagtctctcatgggaggaatgtagagaaatttggaaggcttgcacctgagattgaaggcatagttgctgctacaagattaatttctatgattacatgttcgttggagataggtgacaattga

SEQ ID NO: 66247 - DNA, 249 bp, Glycine max
  Peptide Sequence Number=SeqID_183025
atggtgcatactgcatacataggcacttgtagggcacaaccagacaaatacaagcaaaaagcatcaatggctgactttgctatggaccgcatcgaagcggccatcgcagaacttacttccagtcaactcaaattcaccgctgtcgtagacaccatgcccaccaaacttgacgaccttcttcagcggttggcccttcgcaatgctactcaacacttcccatcttcttcctccgagcaatcaccaccgtag

SEQ ID NO: 66248 - DNA, 288 bp, Glycine max
  Peptide Sequence Number=SeqID_183026
atggtgccaaataaaactcggcagcagccaatgaaggcccatagtggcaatgggtattgttcacccatgaataaagcacgccctaaggcagaaggaggaggttctagtgtgacgtgtcgtgtgtgtgaacttctcttgaggaaaagggccctgtgtggggttgctgcggcgaagcaaaacacggcctggggatcagccaaacatatgcaaaccgagccaaacaaagccataatagcttcaccgaagaagaagcacggcggggaagctgctagaggatgcgtcatgtag

SEQ ID NO: 66249 - DNA, 711 bp, Glycine max
  Peptide Sequence Number=SeqID_183027
atggtaggaggtattgtagcaccattccgcaaggctgaggaatctgctccatttggtcggtttgtcgtggacaaagctgcagagagttcccgccggaatttgctcacaaaaataggatcacggtcggagattaggctccgagggaacccatggagcttggaaactagtccaatgaagagttgggccgccgtatgggccatgaagtgggacgacaaagacccgaaatgggggcccttcgagaaccgatcaacgacggtcataatgaccgtggctccgtgcgaattgggtagcccagtaatgaagtcgagggccaaatcttcccagggtcatgacggtggcggaattggttggaggaggcccgccggtttctgggagaaaagggatgaagggattggctcgattaatccatatgcgcccctggtaaagcaagaggttgtctctgatctcaaactccgggcattgcaaaggctcgttgcgatcgcgatacataaagttatggaattcctccgatgcataggcgtgagagtgcgtccaccaccacattattgtgccctgccttgtattggattgtgtaattgcagcaaaggagtttcgcgagatacacatgctgttctggagtctccacaggatgacaaacgcatggcccaggagatattgacgccaacatttcacggcagtggtaatggtgtgcagttcatggatatatgctga

SEQ ID NO: 66250 - DNA, 744 bp, Glycine max
  Peptide Sequence Number=SeqID_183028
atggagcagattcctcagccttgcggaatggtgctacaatacctcctaccattcttccactggcttatctccatacgaggtcacgtacgggaaactgccgctcggaattccagactgcctccttggttcttccgccgtcaaggccgtcgacttccttctcacttcctgccaagatatgttcaacgccctccaccagaactcgaacgttcccaagcacgaatgaagaactcggctgaccaccattgtcgacaggccaacttcgcagttggctactgggtctatgtgaaactgagaccttaccgccgaacatcagtcgctgataagtttcagaaacttaggaagcgcttttatggcccgtatcagatcaccgaattagtgggcaaggtagcttttcacttagcttcgccaccaactgctatgattcatcccgtgttccactgttcaaagcttatgccccatcatggcccccttgtaacagcacaatcccttccaccatcttcatgggacaacaatcctgtgatagagccgcttgtcatcttggatcacaaatgggatgatcaggacccctcggtactgtcagtcctagtccaatgggttggtgtgcagcccgaggatgcaacttgggagaattgggccgatctccaaggaatctaccaccttgtggacaaggtgcttccggaaggagtaggagatagagtagcagctacaagacccaagcggaccattaagagaccactgagttag

SEQ ID NO: 66251 - DNA, 660 bp, Glycine max
  Peptide Sequence Number=SeqID_183029
atgcagatacagactcaatatgaaacacagtatttgatggttgagaatgagtggaagtggattcagatggcagcagaaaaaccagaaggaacagagggagcagaaacagaattagggggaggcatttgggaaagtgaaggtgcaggagctacaaaaggaggagatagtgtttactaccttctaaatttatggtctagatcagtgacgtctgtgcggtacctcaagagtgacaaacctaacctgttagatgaatatgtgcctaaagttattgaagggtttgtatcatcaagatttgattcattgcagtctgaactatcagatgaacttggtgaaaatcctcttgacaatgttgaagtacttcaagatcagcttgaattttttcctttcctctgcagattccagtatgaaagttgcagttcgtatttgatgaagatagtggagcctatcatgaaaagctatatgaacgaaatccatgtggatagttatgaactctctgtaactgaatccaaacttgcttggttcacacacatagttgctgcaattctcagaacaaaacagatttctggttctagtggagaatcgcatgagatacttgatgcggagatttcagcatgtgttctgcagttgattaatatttgtgacagtgggtttcacagtaag

SEQ ID NO: 66252 - DNA, 252 bp, Glycine max
  Peptide Sequence Number=SeqID_183030
atggcggtaggagaagtggtggaggtggatcacgaaatggatgaactccataggctggacagggcgcggataatagtgaagacaccattgctgccattaattcagcacaaggtctccgcatggattaatggggttgaatacactgtgcatatggctgaagaaacatggacgcaaatggcgatcgaaggtgtaatcctagaaacagacccgtcggaggaggacactcttccgagcacagacggtgatgagtag

SEQ ID NO: 66253 - DNA, 237 bp, Glycine max
  Peptide Sequence Number=SeqID_183031
atgagttattcgctatggtatcctctagaggaagaggaagaggaggtcgtggaagaagagggggccgaggaagggacagaggtggccggaacaataatcttgggtgcaggtaggcttccaaccagatggaacctgtacaaccaatggcaatttcagatcaagaactgcgggctagagaaaagccaacaaccatctatgtacacaggaatatacctgaacagtaccaatttcatctga

SEQ ID NO: 66254 - DNA, 513 bp, Glycine max
  Peptide Sequence Number=SeqID_183032
atggctttcgctccttccaattttgtttctcagccatttcccaattcggttgcagagaaacttgatgactccaattatctgcactggcatcaacacgtagagccagcgatcaaatcgcacaagctgcagcgatttgtggttaatgttgtcgttccttcgcgttacctcaccgaagacgatcgcatcgttgatcgagttaatccagaatatgaaacccctgggaggttcaagaccaaacgcttcttgtttgggactgatgttagctttcaaccacatgagtcgctcactctttttgatcctactacgatgcatcccattccttattcagctggtccacctagaacctctaacacttgggttaatcccaattctaagtcaacaggctcagttcataatcagcccagtgccatgctcacaaacttagcctctcatgggactgctccagctggctccacttggataccagattctggagctagttttcatgttattggtgattctcaaaacatttag

SEQ ID NO: 66255 - DNA, 335 bp, Glycine max
  Peptide Sequence Number=SeqID_183033
atggttaggttccatgaaagtgaaggtgaaggtaccggtgttaggtgttgcggtggtggttgtctatggcatacgaggtacgcagtgttgggtgcgttctggtgtatggcaggttgcgcggatcaaatgaacgaagatcattggatgtatgaaggtataatacctgaagaaatggatatgaattatgaaaatgaagaagaatgtggcgtgaatgaaccacatgttgattgttcggatgcgttcaatacttctcaggtgtttgacagccgagatgatgttttgcggtgggctcgatccgttgcttatgaacatggatttgtgacggtgattgtaag

SEQ ID NO: 66256 - DNA, 1530 bp, Glycine max
  Peptide Sequence Number=SeqID_183034
atggcttccgcaaaaaaaattcaatctcctcctccatcgtcaatttcattaactctggtagaagattcttcaattccggtgactagaacattaactccagtgatggagttttcaacagcagttcctcaaccgtttctgatgatggttcctcagcctcagccgtttccgacgatgactctagaggttgtgacaccacttcagtcattctgtattccaacagcaattccggcaactgtgacttctttgtcttcgcagccttcctctttctcgcatgcgatctctgcgaaattcacaaactcaaactacttgttgtggtgtaagcaagttgaacctgtgttgaaaggccatcgccttcatcactttctggtcaatcctacaataccttcacaattcagaaccctagcagatcgagatctcggaatctcctctccaaagtaccttgcttgggaatcacaagatcagctgttgttgtcctggcttcaatcgatgatatctccagaggcacttcctaggcttcttggatgtcgcacttcgtggcatctatgggatagttatcattctcatttttgttcttcaattcgtgcaaaaactcgtcaattaagaactgagtttcgtaacatgcaattgcaaaataagtcagtgtctgaatacttgcttcaaattcagactatagttgatccgcttggttcaattggagtcacaatttcatccaatcagcaacctgatgtaattcttgaggggctacctagggattatgagtctactaagtcattgatttgcagtaagttcgaaactctctccattgatgaggttgaaacattagtgctaggtcatgaagctaggcttgatagatttcagaaacatgactcccaaatcagtattaatttgactcaaggagcttcttctagttctgctgttaatttctcccaaggagcttcaacttctaacagtacagcctatgctcaaccggttcaagtacagaaaagtttgccaagttcctccaatggtagctcaagcactcagacttttgatgctcaagctcacctaactcgagggaattataataatttcaatacttcaaacaacggtaacaacgcaaaaatggtaacggattttttaattctggccaaggtggacatggctatggaggccgcaatggaggaagaggcaatgctggtagaggagatggttgaggttgtggtaggtttgccaatgttcaatgccaagtttgtcacaaatttcgccatgaagcttccttttgctaccatcgctatgaagaaaattgtgttgctacacagcccatggtttatgaaaacacacaaaccacttcttcatcacagcaaacttctccactcagcaagttgtaacctagcaacctccattacaacaagcttcttctgctcaacagtatatgccgttcatggctccttttccatactattaccctccaatgccttatgtgccaaatgctggaatccaagccaccattgctccttcagctccttctcaagccaacatagctactgctag

SEQ ID NO: 66257 - DNA, 135 bp, Glycine max
  Peptide Sequence Number=SeqID_183035
atgcatgaaatggccctgagaaagcttccatcaaagaggtccaggaaggacaccaccgaagaaggctctaacgctgcctcacaggctgacacagacttcgacaggcatcaatttcggagcgcagagcatcagtag

SEQ ID NO: 66258 - DNA, 588 bp, Glycine max
  Peptide Sequence Number=SeqID_183036
atgacgttgctactcagtaacatcctgcctagtgacctcaactctgacctccctttgccgaagtgtcagttggtgtatgccatcctgacacaggacggcacctacgagacaccctatggactcggagaggtccaacagggccttggggttcctagctctgatcacgggcctttgctagttctacggagtgtccgtcgcccccagcaaggtcattcggtctcccattaccagagccttcatcaagaagtactgcatccccaggcaggcgcaaagccaagcatcgcagtagctcgaggaggatcagcagctagtggtacatacgccaccgccgccacgagaggaagcactgtctctaaggcggctaatcacaaagggcaggggcggctgaatgagacgttctatcgttacaacctgcaccagcaaagtcaagaccccagtcttttcccttggctcgctcccgaagcagttcgaggccacggtggcttggcctgggaacgagaccaagtggggacgaagcctagcacgatcaggacatggcagacatgttggatttcctcctctgagaaggacatggtggacatgttgtga

SEQ ID NO: 66259 - DNA, 1042 bp, Glycine max
  Peptide Sequence Number=SeqID_183037
cgcggcgggattaccgtccgatcgtttctgttacgaagggtttctgccggccaaaagtaaaggacgttgcgatgcgctgcgtgcactgagtgacgagccgcgcacgctgattttctacgaatcgacccatcgcgtgctggatacgctacaggatatggtcagcgtatggggcgcggcgcgctacgtggtgctggcacgggagctgaccaaaacctgggagtcattgtacggtgcgccggtcggtgaattgctggcgtgggtgcaggcggatgagaatcgccgcaagggcgagatggtgctaattgtcgaaggccataaagcggatgaagagacgctgccggcagaggcgctgcgcacgctggcgctgctgcaggctgagctgccgctgaaaaaggcggcggcgctgacggcggaaattcatggcgttaagaaaaacgccctgtacaagtatgcgctggagcagcaagaggcggtgccaggtaacgcctggggggcgcaagcctacgaccagtgcaacagagagcaaaccgccgatggcccagtaatgggatcaggtaagggtgaaagggtgcgggtgcgtgctgcccctcatcctaaccttctcccgcaagcgggagaagggaccgattgtgcgtgggatgagttgagtattcggcctccaacaccacacttaactattccctctccccgtgggagagggttaggctatcacgctgcggtttgtgcgtggatggcgtttatttctcacaggagagaaatcatgctgtactggattttattagcgttagcgattgctgccgaaattacgggcaccgtctcaatgaaatgggccagcgttaatggcggcagcgccggctatatttttatgctgttgatgatcgccctgtcatacatcttcctcacctttgccgttaaacgcattgcccttggcgtggcttatgccatgtgggaaggcgtgggcgctgtcggtgatgaaggcggcgggtttgatcacgctgatcgcgggtatcgcgctgatcaaagcggggacattcagccgtaa

SEQ ID NO: 66260 - DNA, 324 bp, Glycine max
  Peptide Sequence Number=SeqID_183038
atgaggatgtctcctccacctctagaacctcacaatcactcacaaactcatctcaagctctcaggacgacttcctcttcaagctctattctctgcaggtggtcttgttggagctttcgcgcttagcgcgactatggaccgctcagcgctcattagtggattttggcttagcgcgtacttttctcgctcaacggatggactgaagtggtgcgcttcgctggatgagccttcactcagcgaacatggaaagctcatccttcttccagatttttcatcacgctcaaccaaaggagtgttgcgctcagcggatggctcgctaagctag

SEQ ID NO: 66261 - DNA, 216 bp, Glycine max
  Peptide Sequence Number=SeqID_183039
atgggggttgcaggtaaggaaggtgaagataacaccattggcaggtaccacaagttggaggataaagatcaagaggagaaaaaagtgaggatcgaaaggaggaagaagggagaagaatgtgggaggaactcatacgtagaaggagtgggagtagcattgatcattggtgccctattggagattttaatagtgtttgtggtttgtgttagtgcttag

SEQ ID NO: 66262 - DNA, 282 bp, Glycine max
  Peptide Sequence Number=SeqID_183040
atggctcgcacccatattccccaatgggacagagatgatttacacgtgattctcctcaaatttcagccagcccgcatcaattggacctttgcaccttacgctttgaggtcatacagtgctcaatggaatgccccggggcttctccatgacaagcacacgttgttttcgagtcgtatcctcggaaaaatggaggttgaggaaccttggttgggtttatggctaccattgaattatcaagtagatatgggagcaagtcaacataggacaccggaattggggtga

SEQ ID NO: 66263 - DNA, 198 bp, Glycine max
  Peptide Sequence Number=SeqID_183041
atggaaaatggtactcctggaaaacaatatacaatcaaacatgacgcaaatggaaatacacaagtttctgatctcacagtagtggatgttcatagtgctaaagaggttgcatttcttttaaatcaacctgcaaatagcaggtgtaacaaactattgcatcttttagctatatatgaaggtgatgctatgctgtcctaa

SEQ ID NO: 66264 - DNA, 429 bp, Glycine max
  Peptide Sequence Number=SeqID_183042
gacacggtaggtggtgggggaagggttcatgggagcgtcgttgaggaactgtttgtagtgttcgagggccgtgtcgggtttgcggcaatcgaggtaggtctggaatacgaggttgtgtgtgatgatgttggggaccacgccggcctgcgtgatgaagcgatggagggagaggaagtcggagtagcgggactggcggaggagggcggcgaggacggcgttgatcgtgaagatggtggggcggcagttggagtagatcgagtggcgcgtgtacagcgccgcctcgtcgagggtttaggtagtagggtgaggattggggcttcggcgcggtttgggtacggtttagggcggagaggggaggttccatgcggagctggcgcttgcggcggcggcgctccgcggcggcctcctccggggaggagaatgaaatga

SEQ ID NO: 66265 - DNA, 1179 bp, Glycine max
  Peptide Sequence Number=SeqID_183043
atgttggggcacactagggtttccgatggggatggcgttttgaggctttatgaggagctgagagagaggttgggtggggttgtggaagatggggttgtgtttgggtgtttgatgaaggggtattttcttaaggggatggagaaggaggctatggagtgttacgaggaggtgttggggaagaagaagatgagtgctgttgggtataattcggtgctcgatgcgctttctaagaatgggaggcttgacgaggcgttgaggcttttcgataggatgatgaaggagtacgagcctccaaagaggttgagtgtgaatttggggagctttaatgtgattgtggatgggtattgtggggaagggaggtttgaggaggctatggaggtttttaggaaaattggggagtatcgaggttgtagccccgatacgttgtcgtttaataacttgattgagaggttgtgtgacaatgggaggattgtggaggctgaggaggtttatggagagatggaggggaaaggggtgagtcctgatgagtttacttatgggttgttgatggatgcttgttttagagagaatagagctgatgactcggctgcatattttaggaaaatggtggactctgggttgaggcctaacttggctgtttacaataggttggttgatgggttggttaaggttgggaagattgatgaggccaagggtttctttgagttgatggtgaagaagctcaagatggatgttgctagctaccagtttatgatgaaggtgctgagtgatgaggggcgattggatgagatgcttcagattgttgatacgttgttggatgacaatggggttgattttgatgaggagttccaggagtttgttaagggggagttgaggaaagaagggagagaagaggagttgaccaaactgatagaggagaaagaaaggctaaaagctgaagctaaggcgaaggatatcgaggcagctgaagctgccaaaagaagtgcaagagcagcagtagcttctttgcttccatccaagttgtttgggaacaaggaaacggattccgaatctaaaacagagggtgaaattcaagctctcggtgaagaaagcgctaatgccactgcttctgaggcagagttggcagagaaaacgactgaaactgagggtgatagagcaagtgaacagttaacaggttga

SEQ ID NO: 66266 - DNA, 813 bp, Glycine max
  Peptide Sequence Number=SeqID_183044
atgcttcaggttggatatgttacagagttgcaggatgttgttgtgttcagaatgcagaacattgtcatgccagtatcatggctagatgcattgtctagggtgcacaaccgatgtcccacttgtagacaagagcttggagatattaggtgtctggcactggagaaggtggctgaatcacttgagttaccttgcaagtactactctcttggatgtccagaaatctttccatactacagcaagctcaagcatgagacagtatgtaattttagaccatatagttgtccttatgctggatcagagtgttctgttgtcggggatattcctttccttgttgctcatttgagggatgaccataaagtggacatgcacaccggatgcacattcaaccatcgttatgtgaaatcaaatccccgtgaagtagagaatgcaacctggatgctcacagtatttcattgttttggccaatatttctgccttcattttgaagctttccagcttggcatggcacctgtatacatggcattccttcgttttatgggtgatgagaatgaagctcggaattatagctatagcctagaggttggggccaatggtaggaaactcatttgggagggtacaccacgaagtgttcgggatagtcaccgtaaggttagggatagccatgatgggctcatcattcaaagaaacatggccctatttttctctggtggggatagaaaggaactgaagctcagagtcacaggaagaatatggaaggaacaacagcaacagaattcggaagctggggtgtgcatgccaaatctctgtagttga

SEQ ID NO: 66267 - DNA, 372 bp, Glycine max
  Peptide Sequence Number=SeqID_183045
atggtgttcgacccgatcctggtgccgatgcagtacgtcaagcagaaccgcctgaaggcgctgggcttcaccggcaagcaacgctggccgaccgaaccgtcgattccgaccatggaagaagctggcatgccgggcttcgtcaccggctcctgggccggcctgatggcgccggccaacacgcccaggccgatcatcgaacgcatggcgcgcgagatcagcgaaatcgtgcaggaaccggacgtgcgccagaaattcctggatgccggcttcctgccggccagcggcacctccgcgcagttcgccgaactgatgaagcaggactcggcgcgctacgccgggatcatcaagcaggcccgcatcacggtggattga

SEQ ID NO: 66268 - DNA, 381 bp, Glycine max
  Peptide Sequence Number=SeqID_183046
atgcctatttgtcgaaatagcttgccaaataacacaagtttcccgatagttcgatactcggttcttaccattttatactacttgtgtgatccgatggcttctaggaaaagaaaggcaccctctacacctacccaagccagatttgatatatccagattcacttcccaagaggcttgggagagatacactgacattgtggtgcctcgtaagcttttaccagagaggaaagtcgtagtttactatacagaatttgaggagttcaaggaggaactcaagaaatgccattgggatgaggagttgattgactttgtggacggcaatattgatgttgccattgtaaaggaattctatgcaaacctctatgaccccaaggacaaatga

SEQ ID NO: 66269 - DNA, 255 bp, Glycine max
  Peptide Sequence Number=SeqID_183047
atgcatacgcatacgcatgcatattgttgtgataaaacaggggcagaatcgtctcgagctactgtcaagggtcgaggcaaggttaaagacagaaaaccaatcaaggtacttaggaacggacgcaaatggaggatagggtcacgactgaccgatcgtcgtcccttcctggcactggacaagcagagaacgtcgttgcaaggcagcccagtatcctttgaattcacagtgattattactattgtttgttttaaataa

SEQ ID NO: 66270 - DNA, 279 bp, Glycine max
  Peptide Sequence Number=SeqID_183048
ccccgagtcgtccctcagcccccacagacaaatatccctcatgtgccggagccaggagcaccgtcgacatctgcgaggcccgctgtggaggagcctagacatgcagtggaagtttgccattggattgctgagaggttggagcgccatctgagcctaggggtggtcacgccaggctcatcgacacatgaggtgatcgaagaatgcctcaggatggccaggagtgtgacacaggaccaactagcatatattaggtttcgacgcaggcggcacacggattag

SEQ ID NO: 66271 - DNA, 270 bp, Glycine max
  Peptide Sequence Number=SeqID_183049
ggggtgtgtagcgaagctctagattctcatctcaaggtggtgagcttagctattggagagcatcctcttcaagcttcttatccaaggcacatgcttggtggtgaagctccttcttccatggcttattctctattggatggtgcctcccgtctcctcttctcctttgccttccgctgcatctccatgggaggatttgtgagtgaaaaaatgagaaagcgtggtggtgatgatgtgttggtcatgagggttcagggtgaaggaagagaatga

SEQ ID NO: 66272 - DNA, 885 bp, Glycine max
  Peptide Sequence Number=SeqID_183050
atggcaccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgatttccaggaggaaatagggcgccggcggtgggcaccactggttactcccatggccaagtttgatccagaaatagtccttgagttttacgccaatgcttggccaacagaggcggcgggcccgatgacaagcagagaccaagtttggtcattctgcacccatgatacgcggagataccttatggttattcgcacccttttgtcatctagaggcggcgggcccgatgacaaagcagagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaaagcagagaccaagtttggtcattctgcacccatgatacgcggagataccttatggttattcgcacccttttgtcatccagaggcagcgggcccgatgacaagcagagaccaagtttggtcattctgcacccatgatacgcggagataccttatggttattcgcacccttttgtcatccagaggcggcgggcccgatgacaaagcagagaccaaaggcggcgggcccgatgacaagcagagaccaagtttggtcattctgcacccatga

SEQ ID NO: 66273 - DNA, 278 bp, Glycine max
  Peptide Sequence Number=SeqID_183051
ggatcgcgcgcgcaagacacacagtggacccgaagaagtccaacagggtcttgaggtttccaacactaattatgggcgtttgtcaattctacagagtgcccgtcgcccccagcaaggtcatcaggccccctactaacttagctttcatcaagaagtactgcgcccctaggcaggcgcaaggcgagacaccacaacagcctggagatggtcagcagcgggcaatagacgcactgccaccacctctagagttcacctcagctcatccacaaaaaggttag

SEQ ID NO: 66274 - DNA, 108 bp, Glycine max
  Peptide Sequence Number=SeqID_183052
atgaagagattgaagagtagtttgcatgctaaatctgatcaagttgcacctcactggattgaactaaagtggtttggtgatggaacaccattagcatggagaccataa

SEQ ID NO: 66275 - DNA, 279 bp, Glycine max
  Peptide Sequence Number=SeqID_183053
gttctagaagaggagccaaacaagaattatttctctttgttctgggtcatacccaagatcctaaacgcagtttgggagctaattagaggatttcttatcccattcatagaaggtagagactatatacagaattggttcatgacgattttcaggcttgttggattgataattccaggactaccagctcatcttcctacagattacgtcaatgttaccagattgggatccttaaacaagtctctggagcttcaaaactcacaagattccaaggctgactga

SEQ ID NO: 66276 - DNA, 576 bp, Glycine max
  Peptide Sequence Number=SeqID_183054
atgcctgaagtgtattctgctgcagttggcaaatattggtgtcagaggtatagtttgttctctagatttgatgatggtgtaaaactggatgaggaaggatggttttctgtcactccagaggttattgctcggcatcaagcaatacgttgtgcaagtggtgtgataattgacggtttcactggtgttggtgggaatgctatccaatttgcacaacagtgcaggcatgtaatcggaattgatattgatccattgaagatcgaatatgctaggcataatgctgctatttatggtgtagatgatcaaattgaatttgtagtgggtgatttcttccacttggcaccaatgttaaaggctgatactgttttcttatctccaccatgggggggacctgattatgtcaaggctgctacttatgacttgaagacgatgcttagaccacatgatggatatacactgtttaatgttgcaaaggagattgcttccagagttgttatgttccttccaagaaatatcaatttcaaccaattggcagagttatctctgtcatcctgtccatcatggtcactagaggcttaa

SEQ ID NO: 66277 - DNA, 1639 bp, Glycine max
  Peptide Sequence Number=SeqID_183055
atggaagacggcgatacgacggaggaggcggttgtcgttccggtctccatcggcgacgagcaaccgtttcctcattctttgtcacggcaccgcgattcggaggaggaatctccgcatgaaacgttgcgtgacacgaaagcctcaatagagaacatcgtggccgagattctctctctgaagaaccagggaaaacccaaaccactcctcactctccgactcagagagctcctcactcaaacgttccttcacttcgtcactctccgccaggcaaatcgctcgatcttgatggaggaggagcgtgcgagaacggaaacggagcgtgcgaaggcgcctctggaactcgccacacaccagcttcagaacctgacttacgagaagagtcaattcgtgaaagcgataaaggcgtgtaacgattccaagtcgaagtatcctgatattgaagtggtgtcggaggaagagttttttcgcgatgcgccgcaggatatgaaggattctgttttatccaatcacagtgagcataatgtcgttcttaagaggctcaattttgagctgttccagcgcaaagagctttgcaaacttggtgacaaactggaacagaaaaggaaaacccttctggagacaattgcaagccgaaagaagttcttatctagcctcccttcacttctcaagtctcttaagaaagcatccttgccggtgcaaaatcaattaggagttcagcatactaagaaactaaagcagcatcattctgcagagttgcttccaccacctctttatgtgatttactcacagctgttggctcaaaaggaggcgtttggagaatctattgatgtggagattataggaagtgtcaaagatgctcaagcttttgcccatcatcaagctcacaaggagactggcattttcatcactgtggagagtcccaaattggaaaatgatgaacctaatgaagaagatggtcagagacagagtaaaaggccaaggaggtttcaaggcaaggagagccttgaccaggaaggaatatttcaaattcacccacttactgtcaatctccatgtgtatgatgacgagatttctgatcttgagtctgcaaaactcactactctaaagtttgagtacttgatgcagttgaatattatatgtgttggaaacaaagcatctaatgatggtcccgagaatgacatcttaagcaatttattccctgatgacacaggtctcgagcttcctcaccagtcagctaagctctttgttggggatgctataatgttcaatggtgatagaacttcacgtccttacaaatgggctcagcacttagcgggtattgatttcttgcctgaggtggctcccttgctgcttgctagccgtgaaacttcagacagtgatgaagcagccaaagaagctattgctaatgcaaataatgattatgaaatagaaggcagcaacatagagtgcccaatattgaactccaagattgttgtgaatattggagcaatcatagacttgagttctcgagtgggaaaggagcagaagacagcaatggaagttgcaatggaagatgtaaatcgccaaagttgttataagcttgccttgaacttcaataataatactcatgggaacccatctcctactatattggctgctg

SEQ ID NO: 66278 - DNA, 1524 bp, Glycine max
  Peptide Sequence Number=SeqID_183056
atggtcatcgtcgattccgattacgaaggtgccgccatcgaagccctcggttctctcttcaaggtcacccaagtcttcctctgggatgatggccttcaggtttcatcctcagctgaacgctggaaattggatgaagctgatgacaatcacggctctgaccccgttcctggcaaaaaatttgtgttttctgcagcagatttgattgaccttattacacccgaggatttggagcttaccaaacagctgaatgaattggggctccctctttccttccagacaaacaaagagaaaaatggaccagtaaaaggcaaaaaaaagggtaaacttttgaagcatccaaatacttgtcacaaccctgtagatgaaactctatatgaagtgagtggggaggagattgtatctcccgctaaatttcatgataaaactagcagtcctttatcttgtatatcaatgctgggccaaagtgaatcttctttccttgaaggtgccatggatattgatatgacccaatgtgcctatggtgaaggagctaattctgcttgctgtactgggtttgctagtggtgtttgcagggagataaataatgataatataaatcaggtagcaactaatgatgaccaagatgatgactttttaatcagtaatgatcgtgttgatttgaaaactgcacctgcttcagatactggagtctctgctggaagccatttgaaaggtgctggtgtcaattattgtggtacagaatatgatgaaagcttgattgacagtgaatgtttagaagtttcaccaattgttggcaaaaatacagattgtgatactatttacaatgatgatggtgctgccacttgtcatccacattctattgaatcagagttgcatcctgtgagttcagaagggattgaatgtgacagaaatgatgtttcaaataattatgctgaacatggagattggatggtcgtctgggatactttctatgagagaacatacttctacaatattagaacacacacttctacatgggatgcaccctcagggatggagcatctggcaactggcaggtatactgaatcagatgatagtaaaactctcaaggcatcagaagaatggggaatacaaaatagcaccaaaccacctgaggaaaccttgattgaagagaacttggaagtaaagcaacatgaagagtatttgacagagagtggagttgctgttggcaatttggtctctgatatcactacacatggtgaagaccaatcgctcaatcattcagatgggtgtcatgagagaagtagttgcaatgatggagtttcatgctgcttaatatcaaatactctggatcatatcaatagctctaatgaaggatgcattcaggcagcatcagaggataatcatacacccttggaaaacatgttaattgatatgtctggattggattctaaatctgatcctttcgagtcaaaacagggaaagaaagtaaaaagaagacaaaggcagaggaaattatataatgaagctgagggtttgtgctaa

SEQ ID NO: 66279 - DNA, 714 bp, Glycine max
  Peptide Sequence Number=SeqID_183057
atgcaaggtgttgtggggtgcaaaaccaacttcatggaaatgagtgaaacgttcaaacgcttcaaattcatgtttaggagaaagtttggattggaataccctgaagaagaaaactcccaattaccaagtatctttgctcttagggcttatgatgctgtttggaccattactcatgcattgaagaaatcacaagggaacttttccttatcagaaaatattttacatagtaatcatgagggtcttagtgggaagataagcttcaaggacaaaatgttattggaaccaccaacctttaagatagttaatgttattggaaaaggttacaaagagttagcaaattggtcaccagggtctggtttcagtgagaaccttgtagagaatatggtagtgaacacaagaagaactagtagggctggttctgctagagtgcttttaggttctgtggattggcctggtgggttgaaaacagtcccaaaaggttgggtttacaatagcactgaaggaagacctttgaaaattggggttccagccattgatccatgtcctcagtttgtgaatgtgagccatgataagagactgaatgaaacccaattcacgggtttctctatcaatgtctttgaatcagttgtgaaacgcctgccatatcacctgccttttgtttttgtgccattctatggctcttatgatcaaatagttgaacaagtgaacaataag

SEQ ID NO: 66280 - DNA, 585 bp, Glycine max
  Peptide Sequence Number=SeqID_183058
atgtggatgttgatggcagtgatgcacctgttcatagcatttgtaatctggttcattgaaggtgaaaacaattcagagttgaagagtctcggggccattctctggttttctgtcaccacattattctttgtacacagagaacccgtgaagagcaacttggctcgagctgtgctagcaccttggttatttgctattctcatagtgacttcaagttttacagcgagtctttcatctatgatgacagtgtcccatcttgaaccatctgtgccagatatacaaacactgctgaggacaaatgcaatcataggctgcaacaagaacacttttttggtccattacttagttgatgaactcaaattccagccagagaatatcagggtatttgactccatccatgatttcccaagagcctttgagaacaaagaaattgtggcttcttttaccattgcccctcatgctgatgtcttcctagctacttattgcaagggctacatcaaagcaggacctactttgaagcttggtggattaggctttgtgagtttctcttctatctcatttccctacaattgtcatcctacatgttag

SEQ ID NO: 66281 - DNA, 486 bp, Glycine max
  Peptide Sequence Number=SeqID_183059
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatgggaacatggtcagaacttcatctgagttcgaatcctactgagaggtctactagagatcagaaattgttgaagaaagaacaaaagaaacatctttgttctttccaggcgatcggaaaataa

SEQ ID NO: 66282 - DNA, 447 bp, Glycine max
  Peptide Sequence Number=SeqID_183060
atggcttcccgtaagagaaaagccacaactttagcgtctcgggatggttatgatagatcaagatttgtatcacaagaggcctgggaccgttacttagataatgttcttgccaggaacattctgacagaaacaaatgtcaagttgtatatcaatgagtttgatgatttcagaagagaattgattagaagaaactggcataaaaaactgactaacttgaccgagagaagcattgatgtggcaattgtgatggaattctatgaaaatctttatgtcccagacgacaagtttcccaagcaagttagggttcgagggcacctgataaaatttgatgttaattccctcaacacctttttggagactccagtggttgtggagcaaggggagagcttgcccttttactccaggtttgctatactgaggcctaatcctcaggagcttgcagcctag

SEQ ID NO: 66283 - DNA, 210 bp, Glycine max
  Peptide Sequence Number=SeqID_183061
atggagtttccttcttcttcttactcctccatcttctccccacgcccatcaaatgacactattttctatgatgtataccctgactccctcaccacaaccaccaccacaaccctccatactacaagaaaaatgttgatttccgatggccaaaatatgtcggcaagaatgaaaatccgtcagacaaaaatttgttggtcatatcatcgttga

SEQ ID NO: 66284 - DNA, 286 bp, Glycine max
  Peptide Sequence Number=SeqID_183062
gctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacg

SEQ ID NO: 66285 - DNA, 1635 bp, Glycine max
  Peptide Sequence Number=SeqID_183063
atggatggttacgacgccaccgtcaggctcggcgccatcaacctcaagcacggtcgcgccgcagattttgactccgcctcccccgacgtatccgtctcctctccggtcacgcgccagaaagccgccgccgccaagcaattcatcgagaatcactacaaaaactatctccaaggattgcaggatcgcaaagacagacgcagagcgcttcagagaaaagtgcaggagtctcagatatcggctgaggagcaggaggaaatgatgaggaacttggagcgccgagaaactgagtacatgaggcttcagagacgtaaaattggaatggatgacttcgagcagttaacggtgattgggaaaggtgctttcggtgaggtgaggttatgtcgtgctaaaggtacgggagagatttttgccatgaagaaattgaagaagtcagagatgcttagtcgtggacaggtggaacatgttcgatctgagaggaacttgctggcagaggttgatagcagatgcatagtcaaactccattattcattccaagattcagatttcctatatctcatcatggaatatttacctggtggtgacattatgacattgttaatgagggaagatattctttctgaagatgttgctcgcttctacattgctgaaagcattcttgctattcactcaatacatcaacacaactatgtacatagggatattaaaccagataacctgatactggataaaaatggccatttgaagctttcagactttggcttatgtaagcctcttgatgataagtattcatcaattttattggaaaatgaagatcttactggtcaagaatcaactagtgaaactgaagcatattctgtctctccttggttgatgccaaaggagcgattacagcagtggaaacgtaatcgccgtgcattggcatattcaactgttggaactcttgattatatggcacctgaagttttgctcaagaagggctatggaatagaatgcgattggtggtctcttggagcgatcatgtatgagatgcttattgggtatcctccattttgttccgatgatccaaggatggcctgccgtaagattgttaactggaaaacatgcctgaaattccctgacgaacccaagatatcagctgaagcaaaggatctgatctgtcgcttactatgtgatgttgactcaagactaggaaccagaggagtcgaagaaataaaggctcatccatggttcaagggtattcagtgggacatgctttatgaatcagaagctgcttataaacctacggtcactggggacttggatactcaaaattttgagaagtttcctgaagtcgatggcccaccatctgtaacagcatctgttggaccttggcggaagatgctgacgtccaaagataacaatttcataggatatacttttaagaagtcagacatccttaaatcacttgaaagttcagatgcagatatcagagtaaacggatcattgaaaaccccttccttgattaccttgttaggtatgaacagctatatatacttaatgcacatatgcaaggcatgcacgtatgcagtctttcttttggttccattggatggagtaaacaatttacatgtctcaaaatttcgcaatcatccctga

SEQ ID NO: 66286 - DNA, 597 bp, Glycine max
  Peptide Sequence Number=SeqID_183064
atggccccagagtggacagacgagaaacacagcatgtatatcaagtctatagaagcatctttcgttaatcagttatatgattctaagcaaatgaaaacttcatatgactctgctaccacttccggccagttcaaggtactacgtggtggctgttggcaaaaaatcaattttgagagagtgaatccgcaaatgagtaggattaaccagtgtcatgatttgatggaaaatccatggattcagcactaccgattttcaagcaaacagagaagcatagtagctccatctcttcaagaaagtgttactaccacaagtaatgttgttgatttaggccaaaggaaaggagttccctctggatcaggacatcttcatttgtgtgaatctcgaatctgccataaggatatgctttgtagtgatacagagatgtcagaccagaactttgttgatgaagaagtgaaaggcaaaaagcaaaataaaaaaagcaaggtgaaacgacagagatctttgataagtgatgcacaaagcaatgatcagatggtccccaacagaaaatcttcttctggtggagattttaccaagaattttgtttctgctgcttag

SEQ ID NO: 66287 - DNA, 489 bp, Glycine max
  Peptide Sequence Number=SeqID_183065
atgtgtacattcataaacactctcgaatcaagttgggcaaacaaccaagatgttaaagagtattggaggaccttcgtagtgcttctgatgtggaatcaattcaacattgcactcatctctaaatttgaaaggcctacatccatgagggacttaaagccaattgctctctatgtaatgtcaattggaaaagcaggaacaagactatttgggaaggtaagcatcaaacttctcaaggaaagtttcattatgctaaacatttccttgatgattggattactgccagaagtgtggttaattcctcggaacctcacatatctccccaacttttgcattgctgggtactttaagtgtaatgctgatgcaagtttccaccctcaggatcacaaaactggtatgggttactgtttttgggatgattctggaacctttgtggcggctagaacatcctggagcatcgggcctcttgcaagctctgctatgggcttctga

SEQ ID NO: 66288 - DNA, 129 bp, Glycine max
  Peptide Sequence Number=SeqID_183066
atgacggtggacaaggaagtagggtacaaggtggcgatagtggtgacccatagacctgggccgagtcatgcccaagggagaaaacacattggatcatgcaagtcaactaaggttaattataaaatttaa

SEQ ID NO: 66289 - DNA, 954 bp, Glycine max
  Peptide Sequence Number=SeqID_183067
atggaacacagagaggaacaagtctctcaaaaagagggagagagaaaggaaccgagagagttatggaaatggaaggtggtggcgacatcttcctcgactcagattcagtggtttgggaagaagttttctgagattgcaaaacatacatatagcttcgatacagttttcacactccgccatgctttctctaacagctgctcagttgaggaaagatttgaagaggctttggctttgtatgaccgtgccattgttgttaactccaagaaagcaacatatcattgcaacaagaatgcgactttgataagcttgggaaggtttctgcaggcaattgttgagtgtgaggaagctatcaggttggagccttcgtgtggcagaccccacaaccgtttagcaacaatttatttcagattgagagaggctgaaaaggcactgaattgcaatgaaacaagcccatgtgttgattccgtacttgctttccaagctcaggctcttcaaaatcaccttagcaaatacactgaagctcggaaagtcaaagattggaaagttatattaaaggaatcacaggctgcaatatccttgggtgctgattcagctccactggttagttggtttgaggatgcagtgacaacatctcagcaagcatctaagttagatccaagtagctttgaggtgaatgcagtggtaaggagggccagagcagtggcatcagccagaatgagtggtaacttactcttcaaggcatcaaaattcacggaagcatctgctgtatacaatgaaggactagagcatgatccatacaactcagttctgctatgcaatagagcaacatgtcattctaagctaggtcaattcaagaaagcaattgaagattgtaatgtggcacttatagttcagccaagttatagcaaggtaaggttgaggaggacagattacaatgtcaaggtgcatccctag

SEQ ID NO: 66290 - DNA, 240 bp, Glycine max
  Peptide Sequence Number=SeqID_183068
atggctgatggtgatgttgatgcaggtgaatggttacacaaggctcaacgtgacagggtaatctatggagatactgaggtatcaattacaaggggcacctgtctcgttctcgcatctcctgatgaacgcgtggtgacaatccaccttgcacgtactggcactaatttggctatggtgcccagtgctcgttatgagaatatatgtatttctgttattgtgaatgttgctcaagttggataa

SEQ ID NO: 66291 - DNA, 215 bp, Glycine max
  Peptide Sequence Number=SeqID_183069
ctctgattacgggcctctgtcagttctacggagtgcccgtcacccccaataaggtcattaggccccctattaatcgggctttcctcaagaggtactgcgcccccaggcaggcacagggcgaaacaccacagcagcctggggatggctggcagcgggcaacaaacgcaccgtcaccacctttagagttcatctcagctcattcacaaaaaggctag

SEQ ID NO: 66292 - DNA, 375 bp, Glycine max
  Peptide Sequence Number=SeqID_183070
acatttcctggtgctgagaaagttcatgccattttgtcttggttgtgtaatgggaagaaggctaaggaagcccatgaagtgtatgtggtggcaacagagaaagggaaactgccactcgttaatgtgattagctttttggttttgaagctttgtggagaagatgaaactgtgaaatctgctctggagatcttggagtatatccctgaggagaagagtgagcgggcgataaagctgtttttggcggttgtccgagccttgtgtaggattaaggaagctggggaaatggggaaagctgtggagatgacgaggttgatggaaagtaggggcttgagaccagatgtgtacacttatattgttcttgctagcacttattga

SEQ ID NO: 66293 - DNA, 129 bp, Glycine max
  Peptide Sequence Number=SeqID_183071
gaaaagaggaagctaggcgcgagggacacttcttccaccacagatattctctcaaaaatcccaatgacacaaaaatttcacgatgatccaacggtttacgagtctgggatcgtcgttttacagagatag

SEQ ID NO: 66294 - DNA, 843 bp, Glycine max
  Peptide Sequence Number=SeqID_183072
atgaaaagtaggaggaggtataacaatgtgaggggaatcctcatggagaatgatttccttgtgggtgatttctcgaaagaagagattagacaagcggcttcattgaagcaaaacttttgtgggttagaggcaaattcagaatgtaagggtttgtatatacaccaacttggagggtgggaaggaaatatatggaagtggaggaggcagtggtttatgagcgagttggaggaggttattttatcacatgtgataaagaaaaatgtggaagataggtgggaaggctacgacctacattgtaaggaagggatagatgaatgcaagaaacaaacattcatgtttctctggtccattattccagctcccccgaaagaaacaacttcacacctattctttcactgcaaggtggcttactcagtatggtgcatgtgctatgattggttggagctaaagctggcattaccatttgaaactgttgctcattgtgggtgtggttggctgttgtgtggggtgtctggcatatgcggaatgacattgagtttaaccaagtacagctggacgtggggaaaattatggactctgaaattttgctcttggtcgtggttaaaggtgaaggcaccaggattcacgacatcattttatgagtggtgtaattgtcctagacatattcttcgggttgatgttccatcattgattcagctttttgatcgggttttatgctggaggaaagctaagttgtcactcgcattagcgatatatcgggttgacgtggagggtatttcgccaacagcattgacgaaacagcttctggtgtcagaaagagcaggcatggtctcgctaccatga

SEQ ID NO: 66295 - DNA, 339 bp, Glycine max
  Peptide Sequence Number=SeqID_183073
atgtttgacctcatggcacttcatcatcaggagtatctacaacactgtgtcgaagattgtaaaccattgaagcaaatggagatctcgatcaactccttgcgactgtctcctctgcctggggggtcggacctggggaattcctccttagttcattatttttccaaatgcggaccaaccttttccaatcttggagcggtttcacacgtgccttggaattggagtttgggtcgtccccttttgagtgtcccaggtccacattattcaagttacaataacatggatccgtcaacgagtgttactcaacctttatttcccttgcaaatcgaacccaaggactaa

SEQ ID NO: 66296 - DNA, 546 bp, Glycine max
  Peptide Sequence Number=SeqID_183074
atggcttcctccgaagaactatttggtttgaattacctgttgctgaaaccacaagaggcgagtgctgtggatcttggacgcctcttgttctcttccaacttgaacaatagaggattcattgagtgccctcgtgagattgaggcaagagaatttcgacaaagatggctcctcttcatatccattgtggcgcagaaggttctcgttgcctcaagaaactccttgaagaacgttggggacacgttggagttgtggctcaatcttttatcaagcaatggaggcttaataaggctcttgttcaaatttctaacaggaaagatgaaaacaccggaaagatcatcggcagcattcttatccgtggtgggcatcactgacacacgagttgacttagacaaaacaattaaggagaatgatgccaagtacaaagggttcctctcaatgatggcttcaaaattagcgtatgagaatgaagaattcgttagtaacgcagtgcaaaatcattgggatatggagtttttggggtcacacagcttctggaacggtacgtaa

SEQ ID NO: 66297 - DNA, 600 bp, Glycine max
  Peptide Sequence Number=SeqID_183075
atggacccagccttatgcaccttactcatagtctataaacatgggtttgccaccccgataggcctgcaaccaactagatcccatgatcatggaattccgttgttggaagggagcaaccttgttaaagtcaagcaatatagatacccctatagccaaaaggaacaaataaagaatatggtttccaaaatgcttcaagaagggatcatccgccccaacaccagtcccttctcctctcctatccttttggtcaagaaaaaggatggtacttggcgttgttgcacagactatagagctcttaatgctatcactatcaaggatagctttctgattcccacaatagatgaacttggtggcgcctatttcttctcgaaactggatcttcactctagataccatcagatattagttaggcctgaggataagcacaaaacaacgttccggactcatcaagggttgtacgaatggctggcgacaatgttcgggttgtcaaatccacctactacatttcaaagcctgatgagttcaattttccaacaacaactcttccatcatggctcttacatttggtcatctagaagaagtgttacagattttgagtaa

SEQ ID NO: 66298 - DNA, 153 bp, Glycine max
  Peptide Sequence Number=SeqID_183076
atggctaaaataagggttgcttcctatgagtttaccaccttaacttgcatcccaggtgtgatcacatatcgtggagctaaaatccagatattctgcttgtgggttgataagcttgggatgcctaaagctgaatttagttgtacctttttctga

SEQ ID NO: 66299 - DNA, 582 bp, Glycine max
  Peptide Sequence Number=SeqID_183077
atggagactctagcaaagtttcaccataatctgttagggcagaagtttatcattaggactgatcaacgaagtcttaagtctttatgcaatcagatcattcaaacccccgagcaacatgtatggattcacaaattttgggggtatgattttaccattgagtacaagcccgacaaggaaaatgttgctgcggacaccctttccaggtcctttttcatggccttatccgagccacatgcctccttattgtctcaaattgagcaagccacgaatatggaccttccttgttggatattcccaccaatggttccaaaccaacccgaattagctacgtcaattctcaaagaattccattcaccacaaattggagggcattctagagtagcctgcaccaaggctcggattgcaagtctattttattggcctactatggcgaagtacattaagttggttgtgtcccaacacttggtgtgccaacaagctaaatcttctaatgccttacttgctggcctcttgcaaccattgccgatatcgacacagatttgggaggatgtggccatggattttatcgtccgttgccgatag

SEQ ID NO: 66300 - DNA, 1601 bp, Glycine max
  Peptide Sequence Number=SeqID_183078
gactacacgtcctcgccttcagagggttgcatgccctcgcctttagaggactacacgtcctcgccttcagagggctacacgtcctcgccttcagagtgctgcatgtcgtcgcctttagaggactacatgtcctcttgcacgtcctcgcctttagaggactacacgtcctcaccttcagagggctacacggcctcgcctttagagggctacacggcctcgccttcataggacgagacgtgctcaccttcataggactacacgccctcgccatcagtggagcacacgtcctcgccttcacaggactgcacatccttgcctttagagaactacacgtccttaccttaagaggactacacaccctcgccctcataggactacacacccatgccatcagaagagcacacgtcctcgccttcagagggctacacgccctcgccttcagaagactacacgtcctcagcttcagaaaactacacgtcctcgccatcagaggaatacacatacttaccttcagaggactacacgtcctcgccatcagaggattgcacgtcctcgccttcagagggctacatgccctcgccatcaaaagactacatatcctcgccttccgagggctacacgccctcgcctttagaggactacgcgtcctcaccatcagagggctacacaccctcgccttcatagggttggactccctcgccttcataggactagacatgcttgccttctgcgggcaatatgcactcacctttagaggagtacacgacctcgacatcagagggctacacgcccttgcctttagaggactacacatcctcacctttagagtgctacacgccctagcctttagagggctacacgccctaacctttccttcagagggcaacacgccctcgccttcagaggactacacaggactacacgtccttaacttcagaggactacacgtcctcacgttaagagggctgcatgccctctcctttagaggactacatgagatcttgcacctcctcgctataagtgggctagacgtcctcgccttccgaggactaaacgcccttgccttcagaggactagacgactacatgtcctattgcgcgtcctcgccttcagagggctacacgccctcgcctttagagggctacacgccctctccttcagaggactacatgtccttgccttcagagggctacaaagggttgcatgccctcgcctttagaggactacatgtcctcttgcatgtcctcgcctttagaggactacacgtcctcgccttcagagggctacacggcctcgcctttagagggctacacggcctcgccctcataggacgagacgtcctcaccttcataggactacacgccctcgccatcagaggagcacacgtcctcgccttcagaggactacacgtagtcaccttcagagggctagacatcctcgccttcagaggactgcacatccttgccttcagcggactacacgtccttaccttcagaggactacacgtcctcgccttcagagggctgcatagcctcgcctttagaggactacatgtcctcctgcatgtcctcgccttcagagggctacacggccttgcctaa

SEQ ID NO: 66301 - DNA, 1694 bp, Glycine max
  Peptide Sequence Number=SeqID_183079
gtgatctttctcggcgcgctgcagccgaacgacgacagctcaccgcacctggcggcccgccgcctgaccggcgaaattttgcgccagagcggcgtgccgtcgtcgccggtggcgctggagaacctgctggtttatctggccgatctgctggcgcacccggcgcaggagcaccgcatcttcgacgttgccgggccggagtacctcagctatcaggatatgttccaacgctttatcgccatcagcggcaaacggcgctggctgatcccgatccccttgccgacgcggctgatttcggtgtggttcatcagcctgatcacctcggtgccgacgccgatcgcccgcgcgctgatccaggggctgaagcacgatctgcccgccgacggccggccgctgcaggcgctgatcccgcagcggctgcacaccttcgatcaggcggtcgccaccacgctgcagcgcgaacaggaggtggtcgattccgccgactggggctacgatccggcggcgcgggcccgctggcgccccggctacggttactatccgaaacaggccggctgttcgctggacaccgccgccacccgcgaggccctatggcaaacggtgcagcagttggggggcgaagaaggctatttctacgccaatattctgtggcggatccgcgcccgcatggacgacatgatcggcaacggcgtggtctatggccgcccggcgcgcgcgagcctggcgctgggcgacgagatcgacggctggaaagtcatcacgctgaaaccgctgcggcaactggcgctgctgttcggcatgaaggcgccggggctggggcggctgagcttcaccattaccgatcacggcgatcgccgcacgctggacgtgcgcgcctggtggcatccggccggcttcagcgggctgctgtattggttcgccatgatgcccgcgcatctgttcattttccgcggcatggcgaagcgcatcgccgaacttgccgagggtctggaccgccaacagcgctgaacgccgttcatttgtcgatcaaccgcacagtttgccgctgtgcttcggggctttccgattgcatagcgcacgaaatcacggaagaatggcatcttatttgctgggagcgccgcaagcgcccgccggtattccgattttgggtgagaatagagtccgttatgaaggtattggtcaccggtgccaccagtgggttaggccgtaacgccgtcgaatatctgcgccgtcagggcatcaaagtgcgcgccaccggccgcaaccaggcgatgggcggcctgctggaaaaaatgggcgcggagttcattcatgccgatctcaccaatctgatctcttcgcaggccaaggcgatgctgacggacgtcgacgtgctgtggcactgctccagcttcacctcgccctggggcaccgaagaggccttcgaactggccaacgtccgcgccacccgccgcctcggcgaatgggcggcggcctacggcgtggcgcagttcattcacatctcttccccggcgatctatttcgattaccaccatcaccgcaacgtggccgaagactttcgcccgcagcgctacgccaacgagttcgcgcgcagcaaggccgccggcgagcaggtgatccagcagctggcgctgtccaatccgcagacccatttcaccattctgcgcccgcagggaatggtcgggccgcacgacaag

SEQ ID NO: 66302 - DNA, 1466 bp, Glycine max
  Peptide Sequence Number=SeqID_183080
atgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactg

SEQ ID NO: 66303 - DNA, 255 bp, Glycine max
  Peptide Sequence Number=SeqID_183081
atggcaaaggggtgcggaatgaccataatttgtctccgcatgtcatcaggtccgccgcctctggatgacaaaagggggtgcggaatgaccataatttgtctccgcatgtcatcgggcccgccgcctctgcatgacaaaagggtgcagaatgaccataatttgtctctgcgtgccacagacccgacgggtcagtatgacagagattgtgggtcggccgacaaatgcgaggctcttgctcctacgtatcctcaatga

SEQ ID NO: 66304 - DNA, 285 bp, Glycine max
  Peptide Sequence Number=SeqID_183082
atggaaggttcccaacaaaaaactcactatcctaaggaaaaattgcctaaaattattacacacaaatggaagtttggtaacctattggaggctcccaacacacttccaatgaaaggcctttttgttacaaaacttgaaagcaataaagtgcttcttagtccaatagctcttaaggtggttggccccttgcttcttgactcaaattcttcaagggatggcaccaatcctccttccaattccctatatggcaacccacaaacaaggaaacaaagagacaagcaataa

SEQ ID NO: 66305 - DNA, 174 bp, Glycine max
  Peptide Sequence Number=SeqID_183083
atggcccgaaagattctgagggcgggatattacgggctcaccatggagagcgactgttgtatccatgttaagaaatgccgcaagtgccagacattcacagacaatgtcaacgctctgcccatgcctttgaacgttttggcaacaccgtggcccttctccatgtggggaatagat

SEQ ID NO: 66306 - DNA, 345 bp, Glycine max
  Peptide Sequence Number=SeqID_183084
atggcattattgaggataaaaatgaaaatttacaagctaaaactaagcactacttcaaaatcctcgcctgcaaagaacacgtgtgaatgtgcaaacctggaaacattagggcccattggcccaaggataaaatggggttacacactcaatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 66307 - DNA, 366 bp, Glycine max
  Peptide Sequence Number=SeqID_183085
atggggtatttaggagtcaagggacgaaaatgtgtggggtgcgagaatttggtggctgatcatttatctaggttggtgaatgaagaagtcactcaagaggagcaagaaatttgggacaagtttcccaacgaatccctattgtctgtgggtgaaaggccttggtttgcggacattgccaacttcaaggcagttggaatcattccagatgatcttaattggcatcaatggaagaagtgtgtcactaaaaaggaagctaggagtatattgtggcattgtcacaattctccctatggaggacattatagtggggatcaaattgctgcaaagactgggggtatttatgggaggaatgagatgctcttgtag

SEQ ID NO: 66308 - DNA, 504 bp, Glycine max
  Peptide Sequence Number=SeqID_183086
atggcccggagtgtaggaggagaaagcgaggggaaaaacgctgatactacactagtcgtagcttcaaacatggcaatggcaagaggtatcgttaggaggatgaggaatacggttggtgctgttcttctactacgctcttcaacaacaacaactcattcacactccttccatttttataaagattctctctctccattggaatcccacctttgttccttctcctctactttccttcgctccttctctcaccatttcccagatgagacaactgatgaaggtgcaagcacagatggatgggaagaggaagatgaggttgaacccaagattggtgatgggggtgatggtggtggagttgccttgcaaaatgttccttggggtcagcgagctctctctattgctgaggaggtgcttatgcagttcagtgaggacatcaaactatttgctttcaagacaactcctcgtggatatgtttatgtgagattggacaaattaactcatgagtaa

SEQ ID NO: 66309 - DNA, 297 bp, Glycine max
  Peptide Sequence Number=SeqID_183087
atggttcaattcggcatcgcctcagcttttctttttttcttcttctctttctcctttctgcgtttttcctccatttttcagttttcagacccccggaacctcttcccctacatggctatttatagaaaaaaccatttggtgcaaggaaagctcgcccaggcgacctgcttgcttaggcttgaagttattagctcgcccaagatgcaactactctggtatatccatctcaaccatgtcttgatgacacttcaaaccatcctttgtcttgtcttgaatgttaagaagggtgccaattaa

SEQ ID NO: 66310 - DNA, 633 bp, Glycine max
  Peptide Sequence Number=SeqID_183088
atggatcaaagttggaagaaagaatcacacattagtgatgagatcatttggaattacactaaatggatatggcaaggggaattgcttgttatgctaacagttggtcgcactaagccgattgatgaagacgttgaggattgtatagaagacatgattcgcaatcatgggcaagactattttcaacaagcacatgcacctttgtatgagaaaatagaaaatgattcaaagaagcctttgtatttagggtgcacaactttcacaaggttgttagcggtcttagctttggtcaacttgaagacacgatttggttggagtgacaaaagcttcaatgaattgcttgtgttattgaaaaagctgcttcctaaagataacatgttgtcgaagaatcactacaaggcaaagaagattttatggccagtgggaatagagtaccagaaaatccatgcatgtccaaatgattacgtcttgtacaaaaatcaatttgtagaattgaataagtgccccacatgtggtgtatcatgtggtccaaggcagccagggaatgacattaacatctatctgacttcgttgattgaagacttgagaaaattgggggaagacgaggttgatgtgtgggatgcaaatctgcaatag

SEQ ID NO: 66311 - DNA, 222 bp, Glycine max
  Peptide Sequence Number=SeqID_183089
atggcctctccggaatggcgccggagagacaacaagcatgatttcattgattacaagctcggccgcatcctagtcattgaagtggggtttgttctctacgccattttcatcactaccacatgtaaaatgatggtcaaggccatccaccacaatcactccctggcaagggtcgctcccgagcagccggagccacctcaaggggaggctatgcatcaagtgtag

SEQ ID NO: 66312 - DNA, 501 bp, Glycine max
  Peptide Sequence Number=SeqID_183090
atgtcgtctcttgcgacagatgtgtggggtgctaataccttccccgtgcataaatacaactcccgaacttttcacttaaaagttcgtagaccacgtcttttctggtttttccgacgttttcctcaaataaacgttggtggtgactccgcgcgtattcctttcttggaagacgcatcccgtgagtctcggcgtcaccctcccgccgaaggatgtaacaacaggttgaagataatcttgaagaattggatcctcaagcaaaggtgtaacactcatataggcaacaagtacaacataacaaccttcacaatgataatggttacaatacaggcgttaaacggtgaacatcaccatgcacacattgactcccctggcgtacccaatgttgagctcgttgtagcacctgaccaggttagggctggcttggcgatgaggaggtctagcagtgacagagagacgcctgttccgatgcacgaactcatattcctatttgagtatcaataa

SEQ ID NO: 66313 - DNA, 3576 bp, Glycine max
  Peptide Sequence Number=SeqID_183091
atgaatcaagaacaagatgaatctctcagtgttcatagcccttattacctgcaccctagtgaaaatccagcaatcgcattagtttcgcctcttttggatccaacaaactacaattcttggagcagatcagttctcacggccttgagtgcgaagaacaaagtggaatttgttgatggttcccttcctcgaccagcctcgaatcacagactgtatgcagcttggaaaagagcaaataacatggtggtttcatggcttgttcactcagttgcaacttccattcgtcaaagcatcttatggatggacaacgcagttgatatctggaaagatttgaaagctcgatactcacaaggtgatttgctttgcatttctgatttacagcataaattagcttcaattaaacaggggaacatgaatataactgattattttacaaaactaagaacaatttgggatgaacttgagagttatcgacccgatcttgtgtgtacgtgtgcctctaaatgtagctgtgatgctcttattgaagcaaagaaaagaaaggatcaagatagaataatggagtttatgcgtggtctcaatgatcaatacaatcatgttagatcaaatatactcatgatggatcccttgccatcaattagcaaagttttttcttatatggcacaacaagaaagacagcttgcaagttctgatgcacttgggaatttgagtttagttaatgttgctgctagtacaagatcatctaattcttgcagctactgtggtagagacaatcatacagtagaaacatgttataagaaaaatggttttccacctaacttcttctctaatagaggaggtggaggtggaggtagaggttttggtagaggggggacaggaggtaaaagcaccaatggtaaagtttgcacccattgtggtatcattaaccatacagtggatgagtgctataagaaacatggttatccacctggtcacaagttctataagcctcaaggagcttcaattaataacactgttaaggaagaagaaaaagtttcaagatcagagactagtgatcatggccaagacattaaaataactcagcaacagtatcaagcacttatgtctttgctggctgccaacaataatagctctcatggatcacaggttaacaagattgatacaaattctgctcatacatcagccgtaggtaatacgctatcctttatttgcaatatgcacaagtttgaagctgcaacatggattttggactctggtgctacttatcatgttgcatcctcattgacctattactctacatacagagaaataaatcccatagtggttcacctgccaaatggtcaacaagtcatggccacacactcgggaacagtcaaatttactgagtttttacacttagaggatgtgctatacttgccatcttttaatttcaatttaatctctatatcaaaattggtttctgcattgaattgcaagttaacttttatgcctaattcgtgtttgattcaggatataagcaatcagaggatgattggtacagttgatgtagtggaaggcttgtacaagcttagaatacctgctaccaattcagttcccaagactaacaacaatttcatttccattaaatctattttgtcttgtaataaagaagctattgatatctggcattttcatttgggtcatccttcatatgatagaatgcaattgttgaaacaaacttaccctatgttgacttgtgataaaacctttgtttgtgatactttccatagagcaaaacagagaaaactcccatttcccaatagtgactcttatgcttctagtcctttctctttgatacatgtagacatttggggtccttgtgccacaactgctttgaatggacataagtattttcttacaattgtggatgatcatactagatttgtttggatttttataatgacttcaaaagttgagactcaaactcatttacaagcctttgtttcctatgttgagaggcaattcaatacaaaagtgaaagctatccgatcagacaatggtgcagaatttattatgaaacatttttatcataatactgattgtttcccttatgcgtctcctagtgcctctcaatcttttcctagtttccctgtacattcctatcctaccatttatgaccatggtaaagatttggtttgttcttcacctttttcacactctaatatccttgatgattctcaatctaacatgtctgttgatcattcacaattggactcctcaaacacttcttctaatccattaaattccccaattattgttcctcctagaagatctaacagggacaaaaccagaccaaagaagtttcaagactttcacactacatttatatcaactgttactggtcaatcctcaggtattcgttatcctttagcttctgtcttatcttacaagaatttgtctcctacataccacagttttattatggttgtatcctctgagatagaacctaagtcatttaaagaagcttctcaatcagacaaatggattaaagcaataaatgctgaaattgaggctttagaggctaatcatacttggattttgactgaccttccacctaacaaatctgctattggatgtaaatgggtttataaaatcaaacacaaggctgatgggtcagtggagagatataaagctaggttagtggcaaaggggtatactcagattgagggtcaggactatctttataccttttcaccagtggccaagataactactgtgagattattgcttgctttagctgctgctaacaactggcatttacaacaattagatgtgaacaatgcttttttggatggagatcttaatgaagaagtttacatggctttgccttctggcatgttaggaagcaaacctgtctctactcccattgactatgctgtaagactacaccaacaatctggaactccacttgatgatacaacaacttcatcgtactgtaggctcattggtcgcctcatttacctcataaacacaaggcctgatatcacatatgcggtgcaacatttaagtcaatttgtagctcatccttcttcagctcatcaacaagcagcttataggattctcagatacttgaaagcagcaccaggttcgggatgcgttgatacaagacgatctatcactggctactcagtctatcttggtaattcccttatttcttggaaattcaaaaagcaggccacagtgtctagaagttcatccgaggctgagtatcgggcactagccagtgctacatgtgaattacagtggttaacccacttgcttaatgactttggaattgtttacactcaaccagctcttttgttttgtgataatcgcttcgctcttcacattgctgcgaatcctgtctttcatgaatgtacaaaacatattgagatagactgtcacattgtgcgcgagaaattgcattccggccttattaaattgctgcccattgcttctgctcaacaacttgcagacatatatactaaatctcttccaccaggcgctttccattttcttcagtgcaagctgggaatgtcagacatacattctccagcttga

SEQ ID NO: 66314 - DNA, 297 bp, Glycine max
  Peptide Sequence Number=SeqID_183092
atgagggagacctcgactggaaaatggaaggaatacaaagagacgttcttggaccactgtgaaaaaacccaatgcaattgtagtctaagattcttcctgcagaaggctgttgcttctggaggaagcaaccttgctcttctgggcgagctgggtggcaagctcctcccctattttgctataaatagggggaggagtgaagggagaagaggttcagccttcttggcacttcttattctctcaaaattgctgaggaaaattgtttccatgaagaaaatccaagccgaggcgcttccgtaa

SEQ ID NO: 66315 - DNA, 579 bp, Glycine max
  Peptide Sequence Number=SeqID_183093
atgcattacaatatcccaggggtgcacaacttgcttttcacgtatttatcccaacagttgcagcttgtaaatgaatacaggaaaaaggtgcctattgtccctagtcatgtgcattcgattaacgattccgtgtcagcagaagaagctgccgatgattacgagtttgtcattcgacagctggtgaaaacccgtgttgtcagcgtgtctgagattagtgattgtcccaagtttgacctcattctgcttggattgggtccagacggccacattgcctctttgtttcctaaccactcagcactcaatgaaagggaagaatgggtaactttcattactgacttccccaaacccccacctgagagaatcacattcaccttgcctgtcatcaattctgcatccaatgttgcagtagttgtcaccggtgaaagcaaagcggaatccgtacacttggcaataggcgatgttggacctgatggccccttaataccggcgagaatggtccaaccagctatggggaagttggtgtggtttttggataaactggctgcctcaaaacttgaagattccaatttaaacaagtag

SEQ ID NO: 66316 - DNA, 1095 bp, Glycine max
  Peptide Sequence Number=SeqID_183094
atggcgtgtctttcttttccccagtttctcttacttcataggtaccacatgacttggtcctattgtttcacttcttttaacacagtacaacttgggaaactcggtcctgggtgtaaatggggtcatgtggcaatggctaggaaaaaggcctctctagactctgctatagaagaagagcttagtgacaatgaatccttggtagaaaagaagacaactaggtcatctaaaactaagaaggagacgactaggacaaggaagaaaacaaaagatgagtctcctggagatacagatagcgcctccattgaaggaagcacagctgcctctagtgataattccaagaaaactcaaaggactcggaaaaaggatgcatctagttctgctggcttggaagaaaagaaggaagtcaaggaagagaaaaaggttagaagacgaaagaaaactgaagaggagaaattaattgtagaggataaaggtagtgaagctgaaatcagtgaccaagatgagccttcatttcttgaaaatgtggaggatgatagtgacagtggcttggaactgataaaagatgatggagaggacattagctttacttatggatggcctcctcttgtttgttgctttggagctgcgcagcatgcttttgtgccttctgggagacctgccaataggcttataaatcatgaaatccatgaaagcatgaaggatgccttatggagccctgaaaattttgttagggcacctgggagctctgctggtagtgtggccattgcgcttgctacattgggtggcaaggttgctttcatgggaaaacttgcggatgatgattatggtcaagcaatgctgtactatatgaatgcaaataatgtccaaacccgatcagtgcgtattgatagtaaaagggcaacagctgcatcgatgatgaaggttggtaaaaggaatcgacttaaaatgagttgtgtaaaaccctgtgctgaagatagtttgacgaagtcggagctaaatattgatgtgctgaaagaggtggaaccaaaatttattagtagcaaaattggaagattaatacttaatggaaatattgatatggcagtggaatgctga

SEQ ID NO: 66317 - DNA, 229 bp, Glycine max
  Peptide Sequence Number=SeqID_183095
atgggtatttccaaggtaggcatggctataactcttgtgcttattttatgcaaggtgtttgatgatatgcctcaaagaatgtggactctttatgataattgttttccccttgtgaccgatggctgggatactgcatgtaatgtgcactttgtctattctcagatgagtattttgaagtgtctgggggagcccaggaataagctttttgctgccagaaagtatcttgaag

SEQ ID NO: 66318 - DNA, 1475 bp, Glycine max
  Peptide Sequence Number=SeqID_183096
gactgggtttttcctcttttcacacagcttcaaaatcctctgtggagcttcactcacaagaagaggaagtagtgattgctttgggaagtaatgtaggtgacaggctgcataacttcaaggaagccctgaaattgatgaggaactcaggcattaacatcacaagacatgcttgcttgtatgagacagcaccagcatatgttactgatcaacctcgctttatcaactcagcagttagagctgttactaaactcggtccacatgaactattgtctgcactcaaaaaaattgagaaggacttgggccgtacaggtggtatacggtatggtccaaggccaattgacttagacattttattctatggtaaatataaagtcagatctgatatcctcactatacctcatgaaagaatttgggaaaggccatttgtgatggctcccttgatggacttattgggatcagctattgacagtgacacagttgcttcctggcattcattttcaggccattctcgtggactcactggattatgggaagatttagggagtgaatcacttattggagagtttggaaaggaaggaatgtatagggtaatgcctgttgcaaatggcttacttgactggtcgcggagaacttccgtcatggggatccttaatgtgactccagatagttttagtgatgggggaaatttcaagtctgtggagtctgctgtttatcaggttcggttaatgatttcagaaggagcagatatgattgatatcggggctcagtctactcggccaacggcctctaggatctctgctgcagaagaattaggtagattaatccctgtcctggaagctgtagtgtcaatgcctgaggtagaaggaaagctcatttctgtggatactttctactctgaagttgcttcagaagcagtgagtaaaggggctcatcttataaatgatgtatctgctggacagttggatagtaacatgtttaaagtcatggctgatcttgatgttccttatgttgcaatgcacatgaggggggacccatctacaatgcagaatagtgaaaatctgaaatatggtaatgtttgtaaagagatatcatcagagctatactcgcgggttagagaggcagagatgttaggaatcccagcatggaggattatgattgaccctggcattggattctcaaagaaaactgaacacaatttagacattctcatgggactacctgatatcagagaagagattgccacaagaagtttggccatctctcatgctcccatgcttattggaccctcaagaaagagatttttaggtgaaatttgctctcgtcccgacgcagccaagagggatccttctaccattgcttcagtcacagctggtgttttgggaggggctaatattgttagggtgcataatgtcaaagataatctagatgctgtgaaggtttgtgatgcaatcctaagacagaaaagtctcacttga

SEQ ID NO: 66319 - DNA, 201 bp, Glycine max
  Peptide Sequence Number=SeqID_183097
atgacatgctcactcgctcgctgcaaggatctcatgccacaatgggcattcgcgaagtgtcaaatcttgagggttgtgcgtgtaatgtgttgtcataactccattgctagttcattcttgttgcagatttgggggtttctatacgatctccgacgtgcttacatcaatgtcttggttttgcttgagtttctgatcgcatga

SEQ ID NO: 66320 - DNA, 1008 bp, Glycine max
  Peptide Sequence Number=SeqID_183098
atggatcggagctctttctcaccgggaaccggaaaaacccgaaccaaaccggacatatactctaccttcgtggtccacgacgacgaagacgatgacggaggaggaaccttccggcgccggaaatccggcggcggcgcgcagccacaggacgatccgtacgcgacaatggtgttcaaagacaacggccacgacgacgaggacgacgaagactcctctcttcctccgctcctcaagcgcctccccaaggacttcggcggcggagcgccgctggactacgacgacgaagacgatgacgccggcgacttcggcacaatgatcgtgaagtccgaccggagccggcagcgcgaccggccttcttccggcgtggcttcgccagcgtggaaggctcggagtcctctgaacagattcggtggcggcgatgacgacggcgatgacgacgacgacgacggaggaggattctcgacgttcgtagtgcgatcaacggtgaagtccggcgagagagagtcggtgagcggaaccgtggttcgacggaccagtggcggcggcagcgtcggtgtcggtgtcggtgtcggttcgacgatggagagagcggtggcgagcatgcaagggatgggagagttcggattcggaaagcagaggaagggaagtggatcttcgcagaacgatgaaggaaggcatcaatcgataacgacgaaggtttcgacgagttcgatccctgatagtgttaccagagaggaccctacgaccaaatacgaattgctcaatgaacttgggaaggggtcttatggagctgtttacaaagcaagggacttgagaacctcggagatggttgctatcaaagtaatatcgttatctgaaggggaggaggggtatgaggaaatccgtggtgagattgaaatgttacaacaatgtaatcatccaaatgttgtccgttatcttgcaagctatcagggagaagagtatctttggtttttggcagatagtgatggagtattgcggtggtggtag

SEQ ID NO: 66321 - DNA, 166 bp, Glycine max
  Peptide Sequence Number=SeqID_183099
tgcaaatggaacgaaggaggaggaggagttttatagggaggcgtggaaggaagtatctggcagaccaacacgtgtggtcgcgcctggtagaccaacaagtgtgaccgcgcctggcagagtggcaggccaccacgtctggtcgcgcctgacaggccaccacgtctga

SEQ ID NO: 66322 - DNA, 264 bp, Glycine max
  Peptide Sequence Number=SeqID_183100
atgaagcttttacagggaaccactcagacgttgacaatctcgcaccctatctgtgcgtttgataaagaaagccacaagctaagctatcgtgggggtggcaagcacaacacaaggattggagaccagacattgatgattgaatcgaggtacaggatctctataaccgtattagtgtggcaaaagtctttaatcgtttccaccgtatggtctccatccctacccgtgaatggtaccttgatatatatgttcagaggctttgattag

SEQ ID NO: 66323 - DNA, 174 bp, Glycine max
  Peptide Sequence Number=SeqID_183101
atggaacaaaacaagcacttactaaagcaggcagtagattctcaccaacccaatgtgcccagactgcacagtgacactggtaatctgattcaatgtcctagacatctaaatgctggaggagcaactcaaaatttctgcaaagcagggagattagatgatgaatcatgcgactaa

SEQ ID NO: 66324 - DNA, 561 bp, Glycine max
  Peptide Sequence Number=SeqID_183102
atggttttcatttttgatgttgtgacagttagaccaagaatagaaatttctaatcagccttctccttcacaggtggcagagtggggaatgatgagtatgtgtgatgctgaaagaagacttctggctaatgcattgcttgatatctcaaatgaatggtttatcctcttatcagagtcctgcattcccctccaaaacttcagcattgtgtacctttacatagcacgctcaagatatagctttatgggtgcagttgatgaacctggtccttatgggagaggacggtatgatggaaacatggcacctgagatcaacatgagtgactggcgaaaaggctctcagtggtttgaaattaaccgagaactagctcttaggatagttgaagacaatacttactatcctaagctcaaagaattctgcaaaccacacaaatgttatgttgatgagcactattttcagacaatgttaacaattaatactcctcatcttttggcaaatagaagcctcacttatgtggactggtcaaggggtggtgctcacccagctacctttggggaaggatga

SEQ ID NO: 66325 - DNA, 246 bp, Glycine max
  Peptide Sequence Number=SeqID_183103
atgaagattgttgagtaccatgataacgttgttgagcctgttcctaaggcggagaacaccgaataccgggcttcgcatttgaagccaccgttcagtccacggcttcattcttttgcctcgcatcaacccgaaggacccgggttcactatcaaaggacatagtataaggtatagttcatggcttcatggtaatattccatttgatctccttaaaccatcagatttgatgttcaaaccttggaaataa

SEQ ID NO: 66326 - DNA, 192 bp, Glycine max
  Peptide Sequence Number=SeqID_183104
atgttgacagtgttttattatgccctggcattgacgttttgtgcattctttgcactgctgaaatggaacagcttaaggtactcaaggaaaggaatgcctccaggatcattgggttggccttttgttggggagactctaaaatttctcacacaaggaccagatttcatgaaagaaagcagatcaagctcctaa

SEQ ID NO: 66327 - DNA, 1158 bp, Glycine max
  Peptide Sequence Number=SeqID_183105
atggatcctgatgtcaataggtacatacttctgaatgaagcaaaaggcctagttcctggctaccccgactccatgaggaagatactagggactaacattgctgaggttcatggtgccattcataaacgaattagagggtcactattatctctcattggtccaattgcagttaaggatcgtcttttgccagaagttgatgagttcatgaggtcttaccttgacaactggggtggtaaagtaattgatcttcaagaaaaaactgttgagatggcattctttatttccatgaaagctgtggtagaaaatgagccaaactctttcgtcgagtcctttaaagccacatttgatagcatggcattaggaacaatatccttgccaattaaaattccaggaacccaatattatcgaggacttaaggctagggaaaaagtggttacaatgctaagagagctcttagctaagagaagagcttcttcggctactcatgatgacattcttgatcaccttatgagaaatgaggatggcaaacacaaacttgatgatgaagaaataattgagcaaatcatcacaatcttgtattcgggttatgaaacggtatcaactactacaatgatggctatcaaatacctatgtgataacccaagtgttcttcaggcaataagggatgagcattttgcaatccaacaaaagaaaatgccggaggaacggatcagctgggatgactacaagaatatgagcctaactcgtgcggtgatacttgaaaccatgagattggccagtgttgttgctggagtgatgaggaggaccaccactaatgatatagaattgaatggctttatcattcccaagggatggagagtttatgtttacacaagggagactaactttgatcccttcatctatgaagaaccttttacttttaatccatggagatgggtggagaagaaagacttggagtctcataatcacaacatgctgtttggagcaggaggcagggtgtgtcctggaaaggaatggggcatgcttaaaatcagccttttccttcactactttgtgactagatacaggtgggaagaagcagagggaaacaaacaacttatgaaattcccgagagtgttggcaccagaaggcctacacataaggatcacaaattactag

SEQ ID NO: 66328 - DNA, 222 bp, Glycine max
  Peptide Sequence Number=SeqID_183106
atggctccagaagttattcaggaaagtcgctatgatggaaaggtagatgtttgggctcttggtgtgtctgctattgaaatggctgagggtgttcctccaagatcatcagtacatccaatgaggagggaggtggtggtgtcaaccagcaaccaggctttgaggatgctggtggggttgggttcaatagaggctttggtggctagcagggagaggccatcatag

SEQ ID NO: 66329 - DNA, 426 bp, Glycine max
  Peptide Sequence Number=SeqID_183107
atgtcatcctccactattgtcggtgctgacaggagtgcattcttcaccacttcatcgaaaaaattgtcgaagcgcaaaaggagttgtgatactctccctttattatggaatgatcgtttcaaaatgtataggtatttcggaatagctacactgaaatatgattttccctattttggaatagctatttcggaatacttatacttttctaaaatacacaaatatgagcagagatgtgtgaaatgccacaacctcaaccttgaacatggtcatcaccatatctccgtatcgagtccttatattaaaggaaggttatgcaaaaacccttgtggcatgtcaaagattgtcgcgtccctcaccgttgttgcaatccaagagagcgtgaagttatggaacctcgaagcagcatcacggtttgagagcacatga

SEQ ID NO: 66330 - DNA, 1686 bp, Glycine max
  Peptide Sequence Number=SeqID_183108
atggaattcacagctgccaccgctactctcacgaagaagctctccaacggctgtggctacagcgtcaccggaagatctgcgtacgacggtgtcttcgccactcctatcaagctccgcgctccgagcttctcctctcacttcgacgattaccgcgagattttctgcacgtcgtcgcccggttcctcgattccgatccttgaacttccggagctcaaccagaggagaaagaacgacgatgtttggcgctccaagctcgattactcgaaagtcttcagcgggttcgggaatctagacgccactgctgcggtgcctttcgaggagcttgttgctgagcctaaggagaaagagagcttcagagcaaagagcaaggtcaaaggagaaaaccaatcttccagggaagatctaactaattgttcaaaggaaattccagtggcatcatggtcgtctaatgataccagaaggatcaatatgtcatttcacaaagttaaccaaggaagcgaaaatggaacaaatgggatgacacatattgctcaactccgtgctgtccctgcttacactcaattaattgaagaagtcaatccgctgaagatgaacagagttaataagtctataccggtagcacaggatactacttgttctggtagtcatggcaatgaggggaaaaaagaagctgcacattctactaaatcatttactggtgcttcacctgataattctaagaaacagccttccaacaatggagtgaaagttacaagtacatctgattctattgatctgttttttggtgcatgtgagattagcaatggaagtaatggaatacatcatgtcaaagttcctctatcagagactacagaaggtaacagtgaagctatgaaatcaatgccaaccaaatgtcaggcatctaaaagtagctcatctgaaggtgttgctggtggtgattcgccatcatacttagatgacatggtagactcaaattcagaggtagctgcttctgtagctgctttaagaaaggcaatggaagaggctcaagtaagaatgaaggttgcaaaagagttgatgagaagaaagaaagaaggttttcctgatcatgtcaaacgaaagtctaatattgaattgaaagctgagagaaaaaaagaggctaaagacacatataaaacaaagaaacctgatacaaagcaaacatttagagaaatggatgcttttccaaatgcttcttctgagttagggaaatcaacaatgagaatagagcaagtgaggccagatctgggggcaaaagaaacaagtgttgctaaagaagctgtacaaaaagcacagaagaaattgaaatcaactcaagtgaaatatgagaaagaggttgaacagaaagacgcggatcataaaggaaaaattcttgagcttaaagaggcaaaaaataacaagaaagagctgtacgttaaaaacacagataggagtgccactaataaaccagaagaatccgatcaaacaatagaagtggttaagaaatattgtaggctggagaataatgaagagaaggtccatgtggataatgaagcaagtgtgtgtgaagaacttgtccaggaaactaagcataggtgtcaggaagcagtagatgaaacaaaactggttcatgagacacttgaatgtggaacaatggacaagagtttgaagtttattgaaactggggaa

SEQ ID NO: 66331 - DNA, 123 bp, Glycine max
  Peptide Sequence Number=SeqID_183109
atgccaaaaaaggaacttgctgaggagcatattcagcttctctttgtgaatgctataagagataataccatcgatcctattaaagacgaggtacttggtcctctgaattcttctgaaaaataa

SEQ ID NO: 66332 - DNA, 1560 bp, Glycine max
  Peptide Sequence Number=SeqID_183110
atgcaagaaagtgaagatgtcaaagaagaaatggccaaaaggaaaggcaaagagattgagtattttgtgaataagggaaaaggtgaagaacccaaaaggatggatatggaatcaaagaatgacctaaccacagagacaatgcaagaaactaaagatgtcatagaagtaatggtcaaaagaaaagacaaggagattaaaaattttgcagataaaagtgaaggtaaagaacccaaaagaatgcatacagaaccaaagaaggacttaataaaagagacaatgcaagaaaatgaagatgtcaaagaagcaatgttcaaagaaaaaagtaaagaaactgaatattttgttgttaacggtgaaggaggggaacccaaaaggatgcatatggaagaaaataaggacttaacaacagagacaatgcaagaaagtgaatatgttaaagaagcaatgagcaaaagaaaaggtgaagaagagattggctattttttgaatgagggtgaaggtgaaaaccccaaggggacgcatatggaggcaaaggacacaacagagataatgcaagaaagtgaagatatcaaagaagcaaccattaaaaaaaaaggcaaagagactgaatattttgtggatcaaggtgaaggtagagaacccaaaaggattcacacgaaagaagttgaatatgatagtgaaccaattgtcaaaagaaaagacaaagaaattgattattttgtggataagagagaaggtgaagaactcaaaatgacgcatatggaagcaaagaaagacatagcagaagaaacaatgcaagaggaaattaaaaagaataagaatggaactaaggatattgatcaagaaaatgtactagagaaaactgataaaggaaaatttgaagtaccaactgaagagttgcccaagctggttgggaggcaggatggaagtagaggactaaaggttgcaaagatggaagaacaaaaagaaattatcaaagaagcaatggcagaaaccgaatgttcaatggaaaaagtgaaaggagaaaagtccaatacaacaggcagggttactgagaaaaacatagcaagtgagatcttacagaaggaaactgaggagtccaacattgaaagaaaatctagagatggaccatatgtaccaaacaatatggtcaaagtagtatttgaagtgttggggactttccaggcaaagcttcccaagcaggtgatggaagcaatttcccaaaataaaagggataaaaatgaatatgttattgtgaacttgagaggagaaggctctataaagatgcatgttgaaccaaatgatgcttttgatgagtatgaaactgaggacataaatcagaaagaaatcggaacgccaaaactcaattctagtgaccaaataagtgagaaagataatgttgatgtttggggggagtcaactcagacagaaagagaaggttctaagatccaaacaatagaaaaagatcacatcgttgaccagaaaaaaggaacaaacgaagatttgaagcaagcacaactgccaaagaagattcctgtgaaacggggattcactagctga

SEQ ID NO: 66333 - DNA, 297 bp, Glycine max
  Peptide Sequence Number=SeqID_183111
atgaaaagtgaactttggatgacaaagtggtggaattatgtgaattacattatatatgtgaggggtagagggtgtcacaccttgaagaaaaaaagcgcccaagagatgaagaaccccactcctagagagcaatacctaaagcttcaagaggaccaaaatgcaaattcggttgcgctacatccctttgttgataaaattatggaggcacaactcctgcctggatggaagtcgctgaccatcgatcgctatgatggactatggtacccaaatgagcacatggacacattcgtcacatag

SEQ ID NO: 66334 - DNA, 342 bp, Glycine max
  Peptide Sequence Number=SeqID_183112
atgcttaaccatagaggaattaaggccaacccagagaagtgtgtgatcataattgagatgagaagtccaaacactctaaaaaaattacaaagacttgctgaccgatcagcagtgttctccagatttttgccaagaggagctaacacgacgaagcctatcttcaaactattggagaagcaagggggaacaaagtggaatgaggattgtgaggctaactttcagaagctcaaagagttcctcgcttcaccccttatcctcactagagtcctcaaggatgcagagacttggtatccgatgattgagaagttagccttagctttgtcacttttgcttgaagactaa

SEQ ID NO: 66335 - DNA, 294 bp, Glycine max
  Peptide Sequence Number=SeqID_183113
atggtgaagaatttccaaggtttagcacaatgcgaggtatctatgtcccttatgacgtcgatgccattgatgcatatctacaagctgtcgttcaacccgaggaagataaagatgaggagcctctgccgagcccatgaagtcaaggtagatccatccttcacaccaccctataagtccatttgttcgcctatcagttggaactacattgttaccaactatggagtagatcttcataacattgaccctaatgtggaggaagtggcaaggcaaaaagaagaaatgaaacaacaataa

SEQ ID NO: 66336 - DNA, 255 bp, Glycine max
  Peptide Sequence Number=SeqID_183114
atgactaagtttgactaccaatccattaagaaggcacgagccaagaagaggccaaggttggagcctatgtcgattatttttcctttctccactgagagccatcccgactttctttccatgaataagggttttgtttctctttgggtctcaatggacatgaactctattgctcgcttccaggccaggacttataagattgttgagttttgggatgacgaatttgagaaggctgatgttaagtccaagaaggcttaa

SEQ ID NO: 66337 - DNA, 237 bp, Glycine max
  Peptide Sequence Number=SeqID_183115
atgaagctttgcttctacagctacaatcagctaaggaatcttggaagcctcttgaaagctttgaaggtcaagatgaccatgatcgaggactctaccaaacctctccaagaagaggtcgaatgccttaataaggagtctactctctttaagccaaatgcgaagaaggttgaggagaaattaaagagtgatctcaacaagattgaggccgagatccttaagactcatgaagttgagtaa

SEQ ID NO: 66338 - DNA, 729 bp, Glycine max
  Peptide Sequence Number=SeqID_183116
atggaaatctttattcagtcaattgatcccggtgcatggaatgctatttttaaaggaccatttatagaaactaaagaagtaaatggtgaattggtacctaaagaatgggatgagatgaaagatgatgagaaaataaaaaatgaagaaaccatttcaggactccaaacaagattcacccatattgtgaatcaccttcttgttcttggaaaaatgtttgaagatgataagctaaacatcaaaatcctcaactatcttacaagaacttgggaaccaaagattacaacgattaaggaatcaaaggacttagcatcaatgtcgatgaaagctctcttcaaaaaatttcttgcatactacaaagaaatctctagcgatgtccaagatgttgagaatttaagcttgatggtgaagaaggcatacatagctttggaagacaatgcatccacatcctccaactcttctaatgaagaagacgttgcgaatgtgtgcttgatgacagatttaatgaatgactcttcaaccattgaagaaattgagaaaggatctaaaattgcatatcacaaattggcttcaacacaaagtaagctagataaattgaaagaagaaaatgaaaaacttgtttcaagctataaagccactggtcgtgtttgtgcatctacttctcttaatatggatgattacaaagctttgcaaattgagtttgaaaagttcaaaaggatcactatgaagaac

SEQ ID NO: 66339 - DNA, 780 bp, Glycine max
  Peptide Sequence Number=SeqID_183117
atgatgcgcacattttcgcttgatagaaaattgattgatgaatatctgcttaagatcaaaggttatgttgacgagctcgccgatgttggagtgtcggttcgtcacgaggagtatgtcgatgcacttcttaaaggcctttggtccgattatgcgccggcgatctccgttattgaaagcaagaaccgtatgccgtccattgctaaaattgaggctttactctatgatcatgaaactcgccttgttcgttacaacaaggaaactcaggggcttagctctccttccttgaactatactctgggttatttgaactctaactcgtacaaatctggtgattccgatggttctcggggtttgtatggccgtggcggtggtaatcgtggtggtttcgctgaccatggcagtggtggcagatttgccaattttcagtgtcaaatttgccttaggtatggctataccgcgaatgtttgtcactttcagtctgacatgagctttcaacccatgaatccctcaccttctttgatccagatacacttcaacctattacctactcctctggttctgtcagaacctccaacacttggattaatcccaattccaagtctggaactgctgctccagcctcaagacagccaagtgctatgctcaccaattccaactctcatggaaatgctaactccacctggatttcagattctagtgctagtttccatgggaccaatagagtccttctttgagttccctgatcagattttcataggaaatggtgaaggggaccaatag

SEQ ID NO: 66340 - DNA, 1581 bp, Glycine max
  Peptide Sequence Number=SeqID_183118
atgctcacgagacttcgtctgaagactgaagtactcgtgaatcttttctcaaacctgataggagtgattcaaacaaagaatgcgtcacagaacagatttcgaaagagtagattggagccgaacaaggagtgtttgatcctgaacttccaacgcttcatactcaggattgacatgatcagctacacaatcttctttgatgttagagaagtcttggatacgttgcgaactgctgctgagctagggagcgattcatttggtgcctatgtgatatctatggcctcaaatttgtctgatatctttttctgccattttttgtttgcacctgattatcaggcaagtgatgtccttgcagtagagcttttgcagaaggatgcacgacttgctgctagtggagagttaggaagagcatgtcctggtggaacgctgcgggtggttcctctatttgaaactgtgaaggacctgagaggagctggttcagttatcagaaagcttttgtcaatagattggtaccgccaacacatcattaaaaaccataatgggcatcaagaggttatggttgggtattctgattctggtaaagatgctgggcgcttcactgctgcttgggaactttacaaagctcaggaggatattgtggctgcatgcaatgagtatggtatcaaggttactctcttccatggccgtggagggagtattggccgcggtggtggcccaacatatatggctattcagtctcaaccacccggctctgtcatggggacccttcgatcaacagagcaaggagagatggtgcaggccaagtttggcttgccacagacagctgttagacagcttgagatatacacaacagctgtgctacttgctacccttcgtccacctcaacttccacgtgaagaaaaatggcgcaatctcatggaagacatttcaaagatcagttgccagtgttaccgcaatgtagtgtatgaaaatccagaattcctgtcctacttccatgaagccacacctcaatcagagcttggcttcctcaacatcggtagccgccccacaaggcgaaaaagctcaacaggaattggaagcctccgcgccattccttgggtgtttgcatggactcaaaccaggtttgttcttcctgcctggcttggagttggagcaggtttgaaaggtgcttgtgagaaaggacaaactgaagagctaaaggcgatgtacaaagagtggcccttttttcaaagcacaatagacttgattgagatggttttgggaaaagcagatattcctattgctaagcactatgatgaagttcttgtctcacagaagagacaagaacttggagagcaactgaggaatgagctcatcacaactggcaagtttgttctagcggttagcgggcacgagaaacctcagcagaataataggagcttaaggaagctgattgagagtagacttccctttctcaaccccataaatatgttgcaagtggagatactcaagaggctaagatgtgatgatgacaaccttaaagccagagatgccttgcttatcaccataaatggtattgctgcagggatgaggaacactggttaa

SEQ ID NO: 66341 - DNA, 724 bp, Glycine max
  Peptide Sequence Number=SeqID_183119
tcctcctcccaactgggaacaagtcaccattagagtcagtcacgaaggtccaaatttggcatctggcaagtctatgttgtatctgatgttggactcatgctattgggtggttttgttgttctatccatggagacttccttcgaggtgttgccaatcaacagataaagggagcttcaaggaggtggtgttgtgtcgtagtgatgatgttgggtggggcatagtgttgggtagggcgcaatggtgttggatgactagggttgtgcaagttagtggtgatgagaaagaagcccctcagcatcgaaggccgacaacatcgacacatagacaatgggcagttacagttgttgcagaggatgttgagaatatggataatgttgctaacgtgtctcatgaggagccttacgattcagttatagagaatgatacattagtgttgacagattatgcttaccatgtggcatccaaagtgtgggcaagagagttgacctctcgtaggaggaaggtggagaaatttggaaggcttgcatctaagattgaaggcatgatgcacaaggaaactaagagtttccatctgcctataggagagctgactataaccctcgatgatgtggcatcctttttacatctaccattacagtcttggatctacgagaatttccctacaattgcgtccattactgctgatgaggattaccatgagaggaaaccacgtgcatgtcactag

SEQ ID NO: 66342 - DNA, 171 bp, Glycine max
  Peptide Sequence Number=SeqID_183120
atggtgcaagatgatacatatattataccagatccatctgtgttgctcgttcacacagcagttatgccacaaccacctgtacctgcaactattgatgcaaacatgcctcaacatgtagtgtgcatacactctgaatgggcattgtctaacattatccaagcgtgtcactga

SEQ ID NO: 66343 - DNA, 620 bp, Glycine max
  Peptide Sequence Number=SeqID_183121
atggagaacaacaataacaacggagaccctacgccggtgccgcgggtagcggtggtcgttttcctcttgaagggtagatcggtcctcctcggccgccgccgctcctccgtcggcaacgccaccttcgcccttcccggcggccacctcgaattcggggagagttttgaagaatgtgcagcaagagaagtgaaagaggaaacagggttggtcatagggagttcaaagtttttgacagtaacaaacaatgtgatgttggagcaacctaaaaagtgtcactacgtaaccattttcatgagggcaatggtgggtgtggatgcagtagaagagcaagtgccacaaaatctcgaacctaccaagtgtgatggttgggagtggtatgagtgggatcatttaccacaccctctatttgggcctcttgagaaaatggtcaaaggagctatgctagatcggtccccaaacgtctccaaaattgaggttttcggaggacaaaattttcgaaggtggcaggaatgtgtctacgacattttggacatgagcgaagttgctttcgcattaaccgagcccaaactgcgtcctcctattggcatagactcgttgagaaatggacttttgcaaacaag

SEQ ID NO: 66344 - DNA, 363 bp, Glycine max
  Peptide Sequence Number=SeqID_183122
atgaattgcgttttcgttcatgggtcctccacccacgagtttggagccatgcgtagtgattgcttagtgaaattctccattctcaaccctttttcggagccgatgaattgcgttttcgttcatgtgtcctccacccacgagtttggagtcatgcgtagtgattgcttagtgcaattctccattctcaacccttttgcggagaacatgaattgcgttttcgttcatgtgtcctccacccacgagtctgcagccatgcgtagtgattgcttagtgcaattctccattttcaacccttttttggagccccatgaattgcgttttcgttcatgcgttttccacccacgagtttggagccatgcgtag

SEQ ID NO: 66345 - DNA, 435 bp, Glycine max
  Peptide Sequence Number=SeqID_183123
atggtggaagagttagaagagattctgggaagccctatagggggaaggaaaccatacctcttctcaggattctatccctctttaactagaatttctaagatagtccaaatctcggcgcaggaattagaccacagaaagcaagtcgaaaatggggtggttggagtaccgagaaaatgtttggaggcaaaagcaagaatcttggcaggtagaggcgaatgggccccgttcacagacatcctcgcacttttgatcttcggaggagtcctttttccaaatgtggatgggttggtggacctagcagcgatcgacgcttttcttgcctttcatggccgcaaggaaagcccggttgtcgctaccctagctgatctatatgacaccttcggccgaagatgtgaaaagagcagtacaaggatgtttgggggagggcgaccctaa

SEQ ID NO: 66346 - DNA, 456 bp, Glycine max
  Peptide Sequence Number=SeqID_183124
atgtatgaatatcctaggagaacccgcgcattaacgtgtaagcattcctttcaaaattcatatggatgttcatgcttcgttggaaaaagggaaatggttccgaagaaactttccacgaagaggtctagaagagacgccgcagcggaagggtccagtgccacccgcgagtttgatagtcatcgtttccggagcgccgagcaccagcagcgcttcgaggccatcaaaggatggtcgttccacagagagaggcgtgtccagctcagggaggatgagtatacggactttcaagaggagatagcttgtagacgttggacgtcactggtgactcccatggctaagtttgaccctaagatagtcctagagttctatgctaatgcttggcccacagaggagtgtgatgtgccattatttctcctatttcttaaccctttttgcaccattttaaatactgattag

SEQ ID NO: 66347 - DNA, 669 bp, Glycine max
  Peptide Sequence Number=SeqID_183125
atggctgcacgctctcgccttcagaggactacacgtcctggccttcagagggctgcacgcccttgccttcagaggcctgcactccctcgccttcagggggctacacgtcctcgccttcagagcgctacacatcttcgccttcagaggactacacgtcctcgccttcagagcgctgcacgccctcgccttcaaaggactacacgccctcgccttcagagagctgtagtccctagccttcagaggactacacatcctcaccttcagaggactacacgaccttgcctcttgggtactagtaccctcaccttcagagggctatgcgccctcgccttcagagggctatgcgccctcgccttcagaggactacacgccattgcttttaaagggctacacgccctcgcctttagagggctcaacgccctcaccttcagagagctacacgtcctcgccttcacctcttggatactagtactctcaccttcagagggctacgcgccctcgcctttagaaggctacgcgtcctcaacttcagaggtgtgcacgcccttgcctctagaaggctgggcacccttgcctttagaagactacacatcctcacattcagagggctgcacgccctcgccttcagaggactacacgccctcaccttcagatggctacacgtcctag

SEQ ID NO: 66348 - DNA, 1287 bp, Glycine max
  Peptide Sequence Number=SeqID_183126
atgcagcgctgcaacagcgcggacgagctggaagaagcctttacccgcgtgaagcggtctagcagatttttggcgaaggtcggggcaaacgtgattgcgctgggcgaacgtgactgctcggcgcagcgccgtaatcagaaggtgctggaggagacgcccgcgccgcggctcagcgatgcggtgcgcgcgcagttgcaggccaccgccgtacggctggcgcgcgcggttaactatcgtagcgccggcacggtggagtatgtctacgatgaggtcagccagcaattctggttcctcgaagtgaatacccgcctccaggtcgagcatggcgtcactgaactggtatacggcgtggatctggtgcgctggatggtcgaactggcgcagcagcgtctgcccccgctggcgacgctgcaaccggaggcgcagggccatgctattcaggtacggctgtacgctgaggatccggcgaagcagtttcagccgagcgccggactgctcagccacgtgcagttcccgacggcgctcgatcacgctacgctgcgcatcgacagcagcgtagagagcggcatggaagtttcaccgttttacgatccgatgctggcgaagatcctcgtgcacgcggccgatcgccagcgcgcgctcgacggcatgaccgcggcgctggcgcagagtgagctgtatggcatcgagaccaacctgcgctggctgcgtcagctctgtacgctgccggacgtgcagcagggacgcatcattaccgccacgctcggcagcgtggcgtggcagccgccaacgctggatatcctcagcggcggcaccctcaccacggtgcaggatgcgccgggccgcgtcggctactggcacgtcggcgtaccgccttccgggccgttcgacagccgcgccttccagctcggcaatcgcctgctgggtaacgaggcccaggcggccgggctggaaatcacgctgcgcggtccgacgctgcgctttaatcaggcgtgcagctttgtgctgagcggcgcgccgctggcggccaccctcgacagccagccgctggcgatgcatcaggtgttgcatgcgcaggccgggcaaaccctgacgctgggcgacgtgcgcgacggctgccgcagctatctgctgctggcgggcgggctggatacgccgcgctatctgggcagccgcagtacctttacgctgggtaagtttggcggtcacgccgggcgggcgctgcgcgccggcgacgtgctgcagctggccgcgccgcgtcaggctgcggcgggcgcgcctgcctga

SEQ ID NO: 66349 - DNA, 189 bp, Glycine max
  Peptide Sequence Number=SeqID_183127
atgaccccttcacagcaatatcatggcccaattccaacacctaatgccccgctgacgaagaagaagcggggaggcatcggggcagaagaaatcctgatcgccaagcacgaagatgggatcgaccatgtggcacatcctcacgacatcacggacaccaaaatgaatgatttgcatgtcttcgtttattaa

SEQ ID NO: 66350 - DNA, 294 bp, Glycine max
  Peptide Sequence Number=SeqID_183128
atgattttatcgccggacgcccggcgctggaaaaaggtgggcgtggagctggtggcgtcggtgctaccgtgggaagaggcgaaaatccgcatcctcaaggccacgcatgcggcgattgcctgggcaggcacgctcaccggccatgactacgttgatgacagctcgcgtcagcctgccatttatcaactggcctactactacatcacgcaagaagtgatcccgtctctgtcgcccattccgctggatctggcggattaccgcgacatggtgctggcgcgctttagcaatccctag

SEQ ID NO: 66351 - DNA, 318 bp, Glycine max
  Peptide Sequence Number=SeqID_183129
atgttttctatacaaaagagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagttgcagcaggtggacagacaagaactaagttagaagaaagtgataccattagccttgaccttggaatgggaattacctcagctgctgaacataggtcaaatgggcaagggaaaatgctgcattcagagtttggggacacataa

SEQ ID NO: 66352 - DNA, 192 bp, Glycine max
  Peptide Sequence Number=SeqID_183130
atgtttgtattgaacaatgctttgaaaggatttgacgatactccacaaagtaaatccaaggctgctgctaggtggattattgttaaatatttcaatgatgctagactattggaatcagagagattgaaagtgttttgcatccagcgggcaagctactatttgaaagttaaaaataaaacaattagtgtttaa

SEQ ID NO: 66353 - DNA, 198 bp, Glycine max
  Peptide Sequence Number=SeqID_183131
attctactcgcaggggaacaaggagcagaaccaacaaaaccaagagagatcaagctagttgctgcttgtattgaacttgtaatttttcatgatcaatgtgatgatgatgagttgccatttctcgtggatgtaggcacattgttgaaccacgttaaatctagtgagatccttggttgcttgctttgctgtgttttataa

SEQ ID NO: 66354 - DNA, 534 bp, Glycine max
  Peptide Sequence Number=SeqID_183132
atgacccatgaagttctatctggaaattgcgatgaacccgctaagtgcgcctatggcttcttggaaaagaaaggcaccttctacaccctctcaaatgagctggatagaagacactggaggaaggagttgactgactttctggatggcaacattgatgttgccattgtaaaagaattctatgcaaacctctatgaccccgaggacaaatcacctaagcaagtaagggtgagaggtcatctgattaagtttgatgaggatactcttaacacatttttgaagacctctgttgttgtggaagagggggaaacactttgtgcttactctagatttgcactccttgggccttatcctcaggagttagctgctaagctctgtatcccagggaggggattcgagcttaatgctgatggttatccggtgaagattctgaggaagaacatgacccctcttgctcagacttggagcgttctttctttttcaaaccttttccctacttcccacacttctgatgtcactcttgacagagccaaatga

SEQ ID NO: 66355 - DNA, 303 bp, Glycine max
  Peptide Sequence Number=SeqID_183133
atgtttattctaggtatcgcaacatgcccttttgcgggcgagcgaaggcgaggctcatgggtgcgctttccaaaggaggaaagatgcgcggagttgccaccaacgtttaattgtgaaaaacgtcggaaaaaccgaaggaaaccggtcgacaaaagcggggctcttgctcctacgtaccctccatcgaagaggaaatcagacctacgtagttctttcttaagggtgaatcacacgatttctttttacttgaaaggtgatcatttaaaggtgttggaccttaaaaatgatccattaacttggtaa

SEQ ID NO: 66356 - DNA, 201 bp, Glycine max
  Peptide Sequence Number=SeqID_183134
atgcaacaagaaatttcttctttagcttttcttcctcagtctcagctccctcaacaggaagagaagtccatgatctccaagcagctttccaaaaagggagtggatgtgactcaacaaacttggagagatttattagagatggcggtaaatgaggttgggataaggatgatggacgatgatgttgagaagagtcatgagtag

SEQ ID NO: 66357 - DNA, 498 bp, Glycine max
  Peptide Sequence Number=SeqID_183135
atggaagcccaaagttcccacttttgtcctgcaaatccatgttgggctacaatgaacgaaacaagacctatgtcaaactacaacgaggaacaagacgtaggtcgggtattcaatagtgaattggacaaggaaacaacaaatgacatcatggtcaggggatccatgatagccaagcaacaaaatttttgtgtcaccaatataaagacaatgcgcccagaaatcaatgtatctcacatagttgtgcctcaattggacttggatgagatagagcaagaactgataaagaaagagcaaagaacaaagaagaagcatgacttagtctctctgtctaatcctcatgcacctgatagcaagcgtccaaagaatgttccttcaagaaaaagtacaaggagacctactgagaagaagaccaccaatgagaatctaaaggatttcaatgaaactgatgatgatggtccgatcatccaaattaaaagaaaggatgaatatcaacaatag

SEQ ID NO: 66358 - DNA, 183 bp, Glycine max
  Peptide Sequence Number=SeqID_183136
atgtgcatgatcagattgaggttgttggctcccaatgagtatgggagtggagttattgacattctcattgggagtgtgcgcatctcttgcccaagcttcttagagtcttctagtcatggctctggtgataggtacaatgcaatgaccatggctttcattatttgtgtgtgcagcacaagatga

SEQ ID NO: 66359 - DNA, 318 bp, Glycine max
  Peptide Sequence Number=SeqID_183137
atgacatccaagtgtaaagatcgacctgagaagagtataatcaataattttatggataacacaaaaggacccaaaaagatttgggtacctaagaaaaagattgtttatgttgcaaatgcccttgatagcaggaagcagatacatgtcatggtatcaggacagtggctgctcatgacacatgacaagagaaagtttgttgagggtcttaaacacaatctactgagcataagtcaattatgtgatagtggatataatgtctccttcaacaaagatgagtgtgtcgtcctatgtaaagatgggtctcctctacaaaattag

SEQ ID NO: 66360 - DNA, 330 bp, Glycine max
  Peptide Sequence Number=SeqID_183138
atgaccctcatttacatttcgaagacgacaatgtcttttgatgaggacatgaccaagagcaagggcaaggatccacttgaaggacttggaggacctatgacaagggctagagcaaggaaagccaaggaagctcttcaaaaagtgctgtccatactatttgaatacaagcccaagtttcaaggagaaaagtccaagggcccaattggcaacctaggcatcagccttttgggagaccaaatagtggctgacttgatggctgttgggggtgacttttggttgccacaatttcagttacactcagccattaagttctttaattccctaggttaa

SEQ ID NO: 66361 - DNA, 681 bp, Glycine max
  Peptide Sequence Number=SeqID_183139
atggctaaaatcaaagaacctagaggcacttatcctatatcaatacagaattcaatgtatggttcccagatatttgtgaatagcgacatcaaggagattgtggacttcaaggattgtatggatccaagtcagctaacaatgattcactgtacccaaagtggaaaccaaatttcggggtcttcattgtattctgttggagatcgctttatgcataatgcaaaaatgatatattttgatgaagtcagcaaagtgaaaaagccaatggttggatttatgatacttatcccaaatgtaacaagaaggttgatggagaggctttgcctattttttatgttggctgtgcaaatgaaagtagatatatcgaaagctcttgatcatgtattggaaaaaagactgaccttcatgttcaaggtagtccctggcaatacatgtcattttgtttctcagttatctcaagacgaggcattaatcaattctattgttgctaagcttcctacctttgaccttcagcaatgcttctctaccactgctgagtctaatccacttttatcaggatccattacaccagctaagcacaatctcgtcctatctaatactcaattggatgatataccatttgaagatttatcatccatacaactatcctcaatcggggtgaccaaacatatcaagattgagtga

SEQ ID NO: 66362 - DNA, 180 bp, Glycine max
  Peptide Sequence Number=SeqID_183140
atgggtgttcctcttcgtgcggtggttcgacagcaagtaagggtggctcgtggtggccatcgatggtcgtgggtagtggaggagaagatcccgcttagtgacacgagctcgctaagcgaaatttcacttttggtgttgagagcgacctctcgcgctgagcaaattacctcctcagattga

SEQ ID NO: 66363 - DNA, 231 bp, Glycine max
  Peptide Sequence Number=SeqID_183141
atgaagacacaacgatgtcgggaagtggcgacaccagtggagaggatcgacacggtgaagggacaaagaaatagagattgtggccatatgtgcgaggagtggcgacaactggaggagttagtgactctacgagactgtgtgaagagagaaaaaaatgacactggaggagaaaatggaaaaggaagaagaaggaataggaaaatgaaggtggtgggtgtgggtttttggtga

SEQ ID NO: 66364 - DNA, 345 bp, Glycine max
  Peptide Sequence Number=SeqID_183142
atgacgaaggaagtgattcacggtcacaactctacaacgcctcagctcgacttttcctcttctccttcttcttctgcattttctccctgttttctaggctgcggaaccctttttcctcctcaaccatgcatggctatttatagaaaacaaccattgagtgcagggaaattcgctcaggcgagttgctggcttaatggtaaagggctgaagttatatcttagcccaggcgagctggatgttagcctgggcgaatttagggtcagaaatcttcatgaagagaccattttgccattccttgtggctttgtttctggatctaacaaacaaccatcataaccctgagtga

SEQ ID NO: 66365 - DNA, 330 bp, Glycine max
  Peptide Sequence Number=SeqID_183143
atgaaggttcgtgatcatcacaagtaccaaccacatggtacaaaattgcaagatatgaagtatgacacatgggaaccattaatgcactggccgtggataattaaagattctaagccaccctttcactccagaccgtatgaacgttcttcttcatgcgatggtctggcaacaagcaacaatggcttgtggtggccaccggtggttgtcgatggtggaggagaagggatctcgcttagtgagctcgtctcgctaagcaaaaatccacttttggcactgagtgtggcctctcgcgctgagcgagttacttcctcaaattgggattacatttag

SEQ ID NO: 66366 - DNA, 126 bp, Glycine max
  Peptide Sequence Number=SeqID_183144
atggcagctcgcccaagcgagctgatgcttgctcttgaagtaactggctcgcctcggcgagctgcagctcatccaggcgagctggcaactggtgaaaaccaaggaagtgaaaccgaaaaagcatga

SEQ ID NO: 66367 - DNA, 555 bp, Glycine max
  Peptide Sequence Number=SeqID_183145
atgcaggtagccatgctcgggtgtttcgatcacattggcgctgcgcagctggccgtccgcaccgatgtgccagaccagcaggccatggccccccatcaggctgatcgagccgaagttccagaggctgccgtcgcgatcggtcagcgggtgcgccgagaacggcagcgcggccaggtccgggcgccaggtgaccgggccgagcgtctgcagcgaatcggggtccacttcgaacgcagaaccggattcgcacagcgcgaacaggcggccattgatcatcgtcaccgaggtgttggccacgttggcatcatcgttgttgcgtaccgccagcgcaccgggaacgctggtgccggcagccggatactggaagcggccggccttctgttcacgggtgaatttcggcgtggcgaccatgcgcccgtgatgggtcaggctgccatcaccattgaaacgccagccatgcaccatgccgtcgccgtcgaaccagtggtcgtagcggaagccatcgcgctcggtccacgccgggccgttgcggtacagcgtaccggccaggcctga

SEQ ID NO: 66368 - DNA, 146 bp, Glycine max
  Peptide Sequence Number=SeqID_183146
atgaccgaccagcacctggtgttcgtgatgatgccgttcgatttcaccggcgcaggtggcagcttcttcgagcgcatgcagttcgcaccgcagcgtcctgtgcgtatcgcggtggtcgccaaggatgcgccggacaaggcgcaatg

SEQ ID NO: 66369 - DNA, 857 bp, Glycine max
  Peptide Sequence Number=SeqID_183147
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataagatttatagctacttacgaagctgatacacacgaaaacttcaaaaaattaattgtaaaatccggtatcagagataccgttgtaactggtgcaactttaggtcatcctgcaagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 66370 - DNA, 441 bp, Glycine max
  Peptide Sequence Number=SeqID_183148
atggcaaaaattggcttaagtgactcaggtggctcaagcaagatccaatttcaggctttacatatttatacttttgctttagcaagaagagatggcttaagcggaatgtcacttaaaatagaatttttgctatgtataaatggagctagttgtcatttatggcataatacaatactttggggttcttcatttggcattgtcgcaacctacccttcggcgggagggcgacgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 66371 - DNA, 324 bp, Glycine max
  Peptide Sequence Number=SeqID_183149
atgaggaaaatgcaaggatcatgcatgagtgaacataacatgcgaacgatgaaaatagaatggtcgacaagggtgttgcccttgctcctacgtatcctcaggaaaatgggcaattggggcaatggcagctcgcccaggcgagctggttacttcaccctgaagtcttttgggggcccaggaaactcaataaaaagacccttttgcccctcctttttggtatgttttgcatttctgatcgaaacactgaatggttccttgctttgcactataactggtgttcaacactgtaagtcaactagcaaggatcaaaagatcaacgaatga

SEQ ID NO: 66372 - DNA, 285 bp, Glycine max
  Peptide Sequence Number=SeqID_183150
atgaagcttctggaaggagatcaacttgatgttctatgcttcttgaaggtggcagttgtcgcaacctacccttttgcgggcgagcgaggcgaggttcacgggtgcgtcttccatgggaggaaaatgcgcggagtcgccatcaatgtcgacaaaagcggggcttttgctcctacgtatcctccatcgaagaggaaatcagacctatgtagttctttcaaaaggggcgaatcaagtgattctttttacttggaagggggtcatttaaggcgttggaccttaaaatga

SEQ ID NO: 66373 - DNA, 168 bp, Glycine max
  Peptide Sequence Number=SeqID_183151
atgcacaaatgccctaggtgtggggtatcacagtacaaagtaaaggatgatgatgactctagtagcgatgaaaactcaaagaagggtcctcagcgaagacgatgcaaaagaccttacatgacatacaaatgggagaaactacgatggaatgctccgtcatccggttga

SEQ ID NO: 66374 - DNA, 231 bp, Glycine max
  Peptide Sequence Number=SeqID_183152
atggaaaaatccgacaagatgaatttcaaagagaagaaagaaaagaaaggatatatcacttgggaagataatgtcataaattattcaagtgattcagagaagaaaatcataagtctggatatcatgatgaaagactatgaaaatggagaagagcaaagtcgatacattgatagcaatttctccaaacacatggcatgcatccaagtttattcatttttctctccaagataa

SEQ ID NO: 66375 - DNA, 168 bp, Glycine max
  Peptide Sequence Number=SeqID_183153
atgtgtggtgacctcggtcatgaggctctgcttcctcccaagaaactaagcaagtccgtcatttcttcatccatacgggcctcctctgcctcaccgggggatcctgcgggctcctcccctgttgggcctcgggccatgcgacttcagccccaaactgctctggagtag

SEQ ID NO: 66376 - DNA, 765 bp, Glycine max
  Peptide Sequence Number=SeqID_183154
atgggcgaagcgcaactgctggaacgtattacgctcgatcggcaggccatttcgtttaatcgcatgtataccaccagcgtgctttactaccactggcatcaatgcgtcgaattgctttatatatccagcggctacggcatcgtggtggtggataaccagcactacaccgcccgtccggggcgattatttatctttccgcccttccgtttgcacaaagtgcaggtcgatcatagcgataaaaatccttatcaccgcaccaccatgcacattgagcagtcggtcgtcgagagcgcgctcagcacctttccgcgccatcaggcccgcttcgcctcgctggccgccagcaatctcccggcacaaatttacgatctcagcacgcacgcggcgtttattgagagaatacttgaacagtttcagcgcctggaggacaacgcgcagaccgaggcctgcgaggtggcatttctggtgatgcagttgatgacatgtctgcccgagcagccgcagccctacccgccgcgccagcagaccgtcgcctcgcggataatgagctgggtcgaagcccactatgccagcaagttttcgctcgatcggttagcgcacgacctggggctctcgcgaagctatacctcacgcattttccgccagcagaccggcggtagcatccacgaatatttgctgacccggcggattaaaagcagctgcgatctgttacggtacagcgatgagcctgttgacgccattgcactggcagtggggtttagcgag

SEQ ID NO: 66377 - DNA, 676 bp, Glycine max
  Peptide Sequence Number=SeqID_183155
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgcgctcgcagacggccgtttagtcgcctgtcaggcaacatacacaggtgcggacatggtggactcaatcggcgcaaagccgcagcaggcaagtggaagcgtatcgcgcgtcgccgcacccgcggccccgccgacggtgcagccagtggtacagcaggcgacgacgcgccagcccgtcgcggcagcgccggcgacgcagctgagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 66378 - DNA, 504 bp, Glycine max
  Peptide Sequence Number=SeqID_183156
atgggtcagctccagcggcaagcttttcgcaaagcttacggcgaatgggcctcattcatagacattctcgcattgttgatcttcggaggagtcttctttccaaatgtggatgggttggtggatctagcagcgatcgacgcttttctcacctattatgaccacaaggaaagcccggttatcgctatgctagccgacatatatgacaccttcgaccgaagatgtgagaagaccacaaacaaagaaggagcgtctgtcaactggttccctcgatggacagaaggaagaaccggggttcttattttgtgcgaaggatttgcaaatgttcccttgatagggacaaggggttgcatcagttacaatcccgttcttgctataaggcaacttggctaccctatgagggtcaccactagaggaagagctcgcgcctgtccgcaaggcatgggaggtggtgcaaaagaaggacagaactcagaggcagtaacaatgggcccatcggtggctacc

SEQ ID NO: 66379 - DNA, 345 bp, Glycine max
  Peptide Sequence Number=SeqID_183157
atgtggggcatcccttttatccttgaaccaaaccaagccctgacatgtatcatgtctagccattctacgagctttgagccaaaatcccgactcaccataaaccttgacccaggaagaagaagaagaagaagaagagaaaagaaggaaaattccccaatcaaagagtgggggaaagcaaaaagaaaagaaaggaaattcccaatcaaagaatgggagaaagtaaaaaaggaagaagaagaaggaaagaaagctcctgatcggggatcgaaggaaaaacagaagaaatgtgcagagaggtctttggaccggacaatatctgaacaatacagaattgtcaccaaatga

SEQ ID NO: 66380 - DNA, 300 bp, Glycine max
  Peptide Sequence Number=SeqID_183158
atgacaacgaaatggagaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaaagagctctaaaatctgaattatggttcagcccactaatccaagatcaattccaagattctccactaagtgtgcttaggtgtcacgagacatgcaaagcaagaaggacatgcacaaagtgtgactgtatgatgtga

SEQ ID NO: 66381 - DNA, 1405 bp, Glycine max
  Peptide Sequence Number=SeqID_183159
atggtgggcaaccgggatatggccgatgcgatgggccatatcgccgccggtggtggtcgtgcggtgctgagcggtgaccgggaccagctgctgccggtggataacggcgcaccgttcaccctgctgcaggagcgtagcccgttagataccgccatcatgcaggacattgtgcgtcagagtccggcactgaaaccggctatcgaatcggtcattgcccgccaggtcccggcggcactggataccatacgcagcgtgacgccggatacggtgccgagaacgccgggacgctggtcaccgacgcaatccgtggtggccatcccccagacgaaagaacagaaggaagagcagggggaccgggtgatacaggccatcgtcgatgactttaccggtcgtaccccggaggcgagggacaatacgctgattgtcacccagaccaacgccgacaagaacgccatcaataccgccatccacgctcagctgcaggagcgcggtgagcttggccgggaggtcacgattaccgtactggaccgggtgaaaacgcagaccgacaggctgaagtcggtagcagggatggctgcgcagcacggtaatattgcgctgattaacgaccgttactacaccattcgtgccgggcaggacagccgccagaacggttatgtcgagctgattgatgacaccggtcaggcgcaggcgctgtcagcctttgagagcagtctgcgggacatcgcggtgtttaaaccccgtgagattgctgtatcggtcggggagaaggtcagtttctcccgttctgaccgcgagcgcggacgcgaagcgaacagcaactggaccgtcaccggcgtgacaaaagacggcgagctgcagcttacccagggggaggagacccgcatcctgaacccgaacgccgacctggccgaccgtcatctggactacggctatgccggaacagcgcacaaggcccagggagccagcgcactgtatgtcatcgtacttgccggcgtggacggtggacgccaggcactggcctccctgcgcgatgcgtatgtcggcctgtcgcgtgtaaaagcacatgtacaagtctataccgacaatctgggcaagtggctgacgaaggtctctcagcctgcagagcggcagacggcccacgatgtgttgctggcagacagcgaccgtcaggcagcgaccgcgcaacagctatgggaaaaggccacgccgttgtctgccagcgccctggggcgggcgctggcaacacagttaccggaggcgggcgaggcccgctttatccacggcagccggaaatatccggcgccgcacgtggcgctgccggtgcatgatgccagcggcgtgcagcgggcagtattattgcgggaggtacagcttgatggcgatggccggttacgtggcttaa

SEQ ID NO: 66382 - DNA, 594 bp, Glycine max
  Peptide Sequence Number=SeqID_183160
atgatagaagtttcagttgaagcaatcgcatctcacactcaatactatgaccaatcactcagatgcttcacttttaaggactttcaattagccccaaccgtagaggagtttgaagggatcttaggatgctcgataggaggaaggaagccataccttttttctgggtactatccttctatggcgagaatagcaggagtgcaaagtaggaatagagtagcaggaataccaaggaagttcttggaggagaaggcggagactctggcaagccaaagggagtgggtaacattcatcgacgtattagcattactagtgttggagacaattctatttccaaatgtagacgggctggtggatctagcagcgatcgacgcttttcttgcttatcaccacaacaaggaaagcccaatcattgctattttagcagatgcgtatgatacattcaacttgagatgtgagaagagtagtgcaaggattgtctgttgtatgcctggtctttatatctgtctgtcccctacaaggtcatcgcatgtgctcgagaaaggacaaagcaaattgggaagaactcttggcaagcatgacgggagtgtccattag

SEQ ID NO: 66383 - DNA, 234 bp, Glycine max
  Peptide Sequence Number=SeqID_183161
atgtcagcgatgtttatgaagaggaaagacatgcattggcagtttgctgaacctgtcccacacttcttcctattttcccacttcttgtccttaaggaatggcgattttaagttttgctctatcgctgttcctgatcagggagagggggagctggcgcaaatgtttgctcagaagaaagtcatgctgagcccggggaggcacaagatagtgatactggatgaagctgataggtga

SEQ ID NO: 66384 - DNA, 399 bp, Glycine max
  Peptide Sequence Number=SeqID_183162
gtaagccttgcggaatgggcattgtacaacaaaagaagaggaacacttgaggacatcattgaccccaacatcaaaggacagatcaaccctgaaagcttgaaaaagtttgctgatgcagctgagaagtgtgtgtctgatcttggattcgaacgcccctccatgaatgatctcttgtggaatctcgaatttgctctcaatgtgcaacaaaaccccgatggtaaaactcacgaaccgcgtcttgatgaaagtgagtttgaagaagtaaacttggaaaacaatgacatggcagctcactacaaaaaccttagccttggaagtgagcatgaccttagccacgagtccagtagtgataaccatgcttccatcttctcgcaaattgccaatccaaaaggacgatga

SEQ ID NO: 66385 - DNA, 480 bp, Glycine max
  Peptide Sequence Number=SeqID_183163
atggaaaaaaatgagattatgcagcgagactcaaacttattaactgaaaaacaacactatgaacaagcaaaaaagttccattgggtaaaaactcaaaaactcgatgatggttgcggaaccgaacataatataatcaaatggggaaacaaatcctcggtaaccctaaatgcggcgtgcaagccaacaagaaccacggcgacgatcagcgagagcaagacgttgaggccgacagaagtagaggtagtaccaggcgacgaggacgaggaggaagacgatcatggagacggggtgccagaggaggctgaggaagacgatgaggagcgtgatggcggcgtagttgaagcggaagtggctcaggggcaggagagggctgagaggtctagaaactcgcgccatggacggggagtcaccaaggaggtagtggtggtggtggtggtggtggtggttccagtgggagtggcgccggcgagggtgccgtag

SEQ ID NO: 66386 - DNA, 2135 bp, Glycine max
  Peptide Sequence Number=SeqID_183164
atgtacatccacgtgtgtctttggttggtgttatgtttccctgttttcttaaacgccgtaccccccgacaaaggtggcggcgattccttgatgttggggtgtggattaggcgaaggtggaggcaaagatagcgacggaagacaatggacgcccgacaacaaatacctctctggtggcaattccgtcacttccaaagcctctttccaagacccttcgcttttgtccgaggttccgtacatgacatctcgtgttttcacctccgaagcaacctacaagttccccgttaaactcgacaaacgttactggctcaggctccatttctaccctgcagtttacaacaccttcgaccccgtcaattcatatttctccgtcacagcaaacagcgttacgcttctttccaatttcagcgcctccatcacatgccaagctctctcccaagcctacctcgacagagagtattccctcgcgcctttggattcggacactctctcccttaccttcaaaccctctgggaaacagaatggtgctttcgcttttgttaatgggattcaacttattgaaatgccggagttgtttgattcggctcctatggtggggtactccgaccaaaccatggatacaaaaagttttcattttcagacaatgttcagattaaatgttggtggacaatttatatctccgaaacaagattctggtctaagcagaatgtggtacgatgatacaccttatttatacggtgctgccactggtgtcaccaaccacgctaccaaggatgtcaaaattgactacaaaaccatgccacagaacattgctcctcctattgtgtactctacttcaagatccatggggaacaataaggacgtcaacatggggttcaatctcacgtggatcttccatgttgatccgggttccatgtaccttacacgattgcatttttgtgactattactattccaaggtgaatgaaattgttttcaaaatcttcatcaacaatcaaacagcggaggctgaagctgatgtgattgggtggacaggaggtaaaggagtggcaacttataaagattatgtgatatatgtgaaagatgaggcaggtgatgatcaactctggcttgctttgcaccctgcacctgaaacggagccagaattttatgattcgttagttaatggggtggaggtgttcaagctcaatgacacggatttatctggtcccaatcctcaaccttctgagatgttgattgaacatgaggagcatgcaaagactttccaaaacaaacatggtagtaataagacttttgttattggcagtgctgcagggggtgctgcaggttttgccttaatggctgcaataattgttgttgttcaacaccaaaagaaaaagagagctccgggatcgtacagcacatcaagctggctacctatttatgggaatacgcacaccgcaggcaccaaaaccacagggtcagggaagagtgttggcagtgccaacatatcagccatggctcaaggattgtgtcgctatttctccttgcaagagatgaaggaagcgaccaagaatttcgacgagtccaatgtgataggggtaggagggtttggaaaggtttacaagggtgttattgataatgggttcaaagtggcaatcaaaagatcgaacccgcaatcagaacaaggagtgaacgagttccagactgagattgagatgttgtccaagttgagacacaagcatctggtgtccttgataggtttttgcgaggaggatgatgagatgtgtttggtttatgactacatggcacttggcaccatgagggaacacctttacaagggaaacaagccattggacacactatcttggaagcaaaggttggagatttgcattggagctgcaagaggccttcactaccttcacacgggtgcaaagtacaccatcattcatagagatgtcaaaacaaccaacattctccttgatgaaaattgggttgccaaggtttcagattttggactttccaaaacgggtccaaacatgaaccaaggtcatgttagtactgtggtgaagggtagctttggatacttcgatcctgaatattttaggaggcaacagttgactgagaaatcggatgtgtactcatttggggttgtttt

SEQ ID NO: 66387 - DNA, 390 bp, Glycine max
  Peptide Sequence Number=SeqID_183165
atgggtgccggccccaatgaagcctataaatgcaagcacacatctaaaccaacagcaaggcaaagtgtcaaacataattgggacttgcttgctgtgagtgcatattgtgccacttgggatgcagaccaacccttctcatggcgaagcaaatatggttggacagcattttgtggacctgttgggcctcaaggcccaccttcttgtggcaagtgcttgatggtgacaaacactcgaacaggagatcaacaaatagctagaattgtagatcaatgcacaaatggaggttttaacttggacgttagtgtgttccaaagacttgactctgacggaaatggaaatgctcaaggccatcttattgttcactatgagtttgtggactgtgctgactaa

SEQ ID NO: 66388 - DNA, 1212 bp, Glycine max
  Peptide Sequence Number=SeqID_183166
atgaaccctacaccagtttgcaggaaatgcatatatgagaaactctcggatgaggagacggattgctgtcctgtgtgcaatattgacttaggctgccttccggtggagaaactcagaatgtttgccttccactgtgttatgacatctgccattgataacattgccttaaatatctttcccaatgtatcgctgaagtacttcgccaaactcattctatttctttcaatttttaaaaaccagcagtgtcataaatctgtaggaagatctttgcaaaacaatcaacgaaaaaagatcaaggcccaagaagttttgtcttcaatatcattgcctgcaaaaaggaaggaaagatcactttcatcattggtagtcagtgctcccaaagtttcaatgcaacctggctttacaggaaagagaacaaaaaacagtacaagaaaggctgccgctttacgtggatgcagtttccttcttgacgaatccataaagaaggaacaagcaaatggtgacgataatatggattcttccatgcctgaaccttctaagaagcataagccccatgaagatacagagaacaatgtggaacatacagaagggaaggttgatctctggacaccactgaactgtcttgttgaagctgccaacagaacaaagtcctccaggtcaaattcacaagcaactcctcttgccaaattagagtccccaactactcctcatggtggacaagatacatctgaaactacaaccaaaacagacctacctgcttctgccaagagtgaattaaacattccaaaatccaaaaataaggatactggacataaaacaatatttggagatgacaaggatgcaaacagcttgccttcaggaccagggaagcgaagaaggttgcgtcctgctggtcagaaaagagttgctgcatctgagatgtctgcctcttccccagccccactagatacaacagggggcaagtgcaacaggaaaaacagtcctatttggttttcattagttgcttcagaggaccagaaaggagatgttcccttgccacagatctcagcatgttacttaagaataaaggatggtgcggtgcctgtctcatttattcagaagtaccttgtgaagaaacttaatcttgcctgtgaagcagagttgtttgtgagaactgataaattgctccaggaagccaagcaacatagtgcaagccttgtggacattgtctga

SEQ ID NO: 66389 - DNA, 429 bp, Glycine max
  Peptide Sequence Number=SeqID_183167
atgatgacaaagcttaccctatttgtcttgtccatggtgtgtgtactagctttggcctctgcgcaaagtgccattgtgcagtctacatatcatttataccaacctgagcagcataattgggacttgcttgcagtgagtgcatattgcgccacttgggatgcaaaccagccattctcatggcgcagcaaatatggttggacagccttctgtggacctgctggacctcaaggccaaccttcttgtggcaggtgcttgagggtgacaaacactcgaacaggagatcagcaaatagcaagaattgtggatcaatgcaaaaacggggggttggacttggacgttagtgtgttccaaagacttgactccgacggaagtggaaatgctcaaggccatcttattgtccactatgagtttgtggactgcgctgactaa

SEQ ID NO: 66390 - DNA, 1530 bp, Glycine max
  Peptide Sequence Number=SeqID_183168
atgccgccattagcgtctctgcaacttcggaggctcttactccgttctcgttccttaccattcacatctccctctccgattcatcactctcctctgtttccccgacattcctcttcccatttctattctcgaactctcttcaccccttcgttcttcataacaagacatttctcatcggaaacccaaacggatgagattgctagctccctctcctcagagcttctcaaagagccagactcggacgctctctccgtctcgcagcgcctcaacctgagcttctcccacatcactccaacccccaatttaattctccaaaccctaaacctctcccctcaagctggccgcactgtattagggttccaccaatggctctcttccaaccctcaattctcccacaccgacgacactctttcatacttcgtcgactacttcggccgccgcaaggacttcaaggccacgcacgacgtcctcgccgccgcttcccccgccgccgggcccaaaaccctagcctccgcgatcgaccgcctcgtccgcgcgggccggtccagccaggcggttcagttcttcgagcgaatggagagagactacgggctgaagcgtgatcgtgattccttaaaggtggtcgtagagaagctgtgttcggagggtttcgctagttacgcggaaaaaatggtgaaggatttggcgagggagtttttccccgacgaagccacgtgtgatatgttgatcagagggtggtgcattgatgggaagctcgatgaagctcaaaggctcgctggtgaaatgtatcgtggaggatttgaccttggtgtaggggcttacaatgccatgcttgattgcgtgtgcaagctttgtcgcgagaaggatccgtttcagcttcattcggaggcggagaaagtgctggtggagatggagtaccgcggcgttccaaggaatacggagacattcaatgtgttgataacgaatttgtgtaaaattaggaagactgaggatgctttggggttgttgcacagcatgggagagtgggggtgttaccctaatgagactacttttcttgttctgattaggagtttgtatcaggcagctagattggaagagggggatgaaatgattgataggatgagatctgctggctttggtgagtttcttgataagaaggcttactatcagttcctcaagattttgtgtggcattgagagggttgatcatgctttgagtgtgtttgctatgatgaaggatgatgggtgtgaacccggggttataacttatgacttgttgatggggaaattgggtgcccacaatcgtattgataaggttaatgctctattcaatgaagcaaagagtagagggttgcctgtgatactcaaagagtatgctgttgacccgaggtatttgaagaagaagaagaaggttgtcaagggtgtgaagaagagggaaaccttgcctgagaaaatggctaggaagagaagccgcctgaaacagattcggctgagttatgtgaagaagcccaaacgagtgatgggtcgttga

SEQ ID NO: 66391 - DNA, 112 bp, Glycine max
  Peptide Sequence Number=SeqID_183169
atggttttggtgataataatatggggtgcagtggggcgagggaaccgcgccgctaagatgctgccacgtgttgcggttttccgttgttggatcatccgtgggttgtcgggtg

SEQ ID NO: 66392 - DNA, 225 bp, Glycine max
  Peptide Sequence Number=SeqID_183170
atgcctgtacggtatgcaatcattggggcgagcatgaatcttctgatactccataaccatcgaacacagtatctttttcaccttatagggcgtgtgctggctgaaaagactcttgcccaaggtcactgtcgcaacctacccttcggcgggagggcgacgcgagactcgcgggatgcgtgttccacgaaaggaatacgcgcggagtcgccaccaacgtttatttga

SEQ ID NO: 66393 - DNA, 150 bp, Glycine max
  Peptide Sequence Number=SeqID_183171
atggccattcctcagagaaaggaggagatagcccgcaggaactgggcaccacttgtgacacctatggttaaattcgatccagagataggcatgaagttctatactaatgcctggcctactaaggaaagggtctgtgatatgcgctcctag

SEQ ID NO: 66394 - DNA, 207 bp, Glycine max
  Peptide Sequence Number=SeqID_183172
atgtttggcgaaggaatcaattgcgaaaataacaaagacaacatttcccagtcaagaggatccgcacttgacggtggaggacacatgaacagcgctaggcaatcaattcatggggctccgaataaaaggcgagaatggagaattgcactaggcaatcactacgcatggctccaaactcgttggtggaggaatcaatcaggaaaataa

SEQ ID NO: 66395 - DNA, 258 bp, Glycine max
  Peptide Sequence Number=SeqID_183173
atgggtcttaatgagggagaaactgctgttgtgaaaaagattctaaggttaatgtctcccaagttcaattatgctgacgaggcaaggacgaaggttggaagttacagaggtagacaaagcttcaacaaacaaacggtagaatgctattctcgtcatgagcttgggcattttcaccaggaatgtccagctaagcaagaaggagaggctaactatacaggaagtcaagaacaggttgtagtaatcatatgtgcggaataa

SEQ ID NO: 66396 - DNA, 507 bp, Glycine max
  Peptide Sequence Number=SeqID_183174
atggcaggtaatagcagctcggaggggttggtcgatgatttcttcgaacagatcttagcagtgcctgaagctgctgctttcagaggagctgctgggttaatgcctctgggcttgaatttggagcaagctggctttctaagacaccaacaccaaattaacgttgacgacgttgttcatgttaatgttgatgatgccaccattcaccaccatcacctcactctccacaataacaccacctcctcatcaccttcttccactgcaccaatcacccaggatagggattcgatgcatatgagaggcttattttccgcgtttggacaactccatactcctactcttgctcactctatccgccccacgctgccatcgcctccaccccctcgtcagccacaactccacctccaccatcataataaccaacagcgaaaactcagtattgggtttggaggctttactttacagtttgacccttctgcctgtggatgcgctcattctgttgatttataa

SEQ ID NO: 66397 - DNA, 843 bp, Glycine max
  Peptide Sequence Number=SeqID_183175
atggatagggtattctcagtggacgatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctcccccgccgacgtcgtattcgtggagatcgatgatcagcccaaacccacccctccgcctccgtcacacggcggcgttctgcccagtgaccctggtcccgtggcccttgactccgaggaataccaggcctttctcaagagcaagctcaacctcgcatgcgccgccgtcgccatgactaggggatctttggctaaatctcaagacccgtcccctttttctgatggtggatcacagccgactaatccttctctagttggatctcagactacttctaaaggatctattccttctggaaatgatcaatctaagttacaagataaagatatcaatgcaccagttgggattccttccatacctgccatacaaaagaaacctgctgttgcaattaggccatctacaagtggatcatcaagagaacagtcagatgatgaggacattgagggagagacatctatgaatgacaacacagaccctgctgatgtaaaacgagtaaggagtaagttgaacaaattttatactggtggcaagttcaactgggggacaaattatgcttcggttaattcaatgcctaatagttacattttatatctcaggatgctatccaatagggagtcagcccgtcgctctagaagaagaaagcaggctcatttaactgacctagaaacacag

SEQ ID NO: 66398 - DNA, 189 bp, Glycine max
  Peptide Sequence Number=SeqID_183176
atgacccaccaagaagacgaaacgaaaggaccactggaaagaggaagaagcagtgtcagggataacacgaagacgaaagaagaagaagcgcataactgctgggtgtccaaagcaacaaccaatagactatggggaaagtcacatgttttgaactcaagttcggcagaggttagagttcttgactcctaa

SEQ ID NO: 66399 - DNA, 888 bp, Glycine max
  Peptide Sequence Number=SeqID_183177
atggagctatatttcctatttctcttccctgattctctctccttcaaccccctcttgaaccacatccacctaatctcttctcctcccctagcgacgaagacttctccactgcgctctccaccctccacctccccttattggagcgcctcatcctccgccacaacgtcaacccctcatccaccacacatgcggcaccttcgttgccatcttccaaatcctcgttgtgttaacctcaagcccctcgtcctcgacaccttagccgcatcttccaccactgcgtctacttccatgacatcctcgtcgtcggctgctccatcgccagaaaaccccaaacaacctccatacttcctcgggctagaccttgattccttcgcctaccgcgtctttgttagacgccctgtcgagaaaactaccttggtgcatttgacatcgttaggcaaacatggacgatttgatttgatggcatgtttggtgtttaatgatgtaggtggtctactagttttgctggtggttcttatgggtggtggcgttaaggtggtggttgttatgggtttgggagaaagggggatttgcttcgtgctcatgcattttgtctttctccctcaaagcctcaaaccatatgagagttggaggagctgctcaaagcctcagacgagacgagatgagacgacacacactagagtgcgattcgcgacacgtgacaccaggcgacacgcgacacagcgacgcgcagtgcgatggctgccttgttctgttggaagccgcgagtcccacaaggtccacgacgagctagagagaagccacgacccacgaggtccacgacgagctagagagaagcagaagccacgagtttggggggtgagaatttcagaaatttcatggtgttag

SEQ ID NO: 66400 - DNA, 351 bp, Glycine max
  Peptide Sequence Number=SeqID_183178
atggccttgtttgctcttgcagtgcttcttttagccttcactggctcttcaagtgccacttggtgtgtttgcaaggaaggaagtgatgcaatattgcagaaaaccttagattatgcttgtggagctggggctgattgtaaccctttgcatcagaatggcccttgtttccaacccaacactgtgagagctcactgtaactatgcagttaacagctatttccaaaggaagggtcaagcacaaggatcctgtgactttgcaggaaccgccactgttactgcatcagatcccagcactggaggttgttcctaccctgcaagcgccagcttggaatttgattcttctaacctttga

SEQ ID NO: 66401 - DNA, 648 bp, Glycine max
  Peptide Sequence Number=SeqID_183179
atggaggctgcgataaggattaggtctgataaaaatgcttcaaatgctcagtctcgcatgcctagttatggaacacaggtgactgttcaaacagaatcagaaaagcaaattgacaagcttcgacgcaaggaggaaaaacgaaatagacggggagtagaacatgctggtgatggtgaattgtctgcactggatttctcatctttacatcaagcaagtgagaggaaaaaaatgtttgatgagatgattggttctggagataagttcgagtcaatagctgttactgctcttcctgaaggaactgtaaggaagcattttaaggggtatgaagaggttaatattcccccaaaaccaactgcaccattgaaacctggagaaaagctgattgaaatcagggagttagatgactttgcacaagctgcgttccgtgggtacaaatcacttaatcgcattcagagcaggatttttccaactgtttatggaactaatgagaatattttagtgtgtgctcccacaggagcgggcaaaactaacatagctatggtttccattttacacgagaataagcgagggaaatggtataagggggataacgtgactgaggaggcagagagaagatttttggaggtaggaagctcagctctcgcctga

SEQ ID NO: 66402 - DNA, 243 bp, Glycine max
  Peptide Sequence Number=SeqID_183180
atgagtatgacatcctccaccgcctcaagcagaatgagatatccgattataagaccaccctcaatcatgcaattcaaagcagctttgcacaatgaccagactttcatagaaatacccccattctaccatcaacaatgggtgccaaatacccagaatcgatccagtggggatacaagggagcaacctaccaaatacaactccaacaacaccgaggcagatattttctggcagatggactcgtag

SEQ ID NO: 66403 - DNA, 465 bp, Glycine max
  Peptide Sequence Number=SeqID_183181
atggctagaatactccttgatcttcagcatttccctcatgttaaaatgaaattaaaagttcagaggaaggacactgatggtgacaggtctcgcatattatctgttagattagagaagaccaattctagacgacactcttctagagcatttgtacctcgatttccaaagataaaagaggaacaatggtggttggttcttggtaatacctctacgtctgagctatatgctttgaaaagagtttctgtttcagatcacttagttacctcaatgaagttgcctctgactccagctaatcttcagggtttaaatgaagtgtccaccatttgcattccatcagcaaggccttttaacatccaaaatgggcctggaaataataaagggataatgtcagaagctcaaatgaaaatattcaaccatcacatttccatttctacctataacctatttccagcaactaaaaattaa

SEQ ID NO: 66404 - DNA, 1065 bp, Glycine max
  Peptide Sequence Number=SeqID_183182
atgacttgtatgcagattggacaacactttagggatggctacttgcataaagaagaatttaagatagtttatgttgctccaatgaagatttgctttttgttccctgcatttgtgtgccattactcatttctaagtatagattcttgtcctttccaggctttggctgcagaagttacatcaacattcagccaacgtttatctcctttgaatatgattgtccgagagcttactggagatatgcagctctctaaaaatgaacttgaagaaactcagatgatagtgacaacacctgagaaatgggatgtcattacacgcaagagcagtgacatgtcactgtcaatgctggtaaagctcttaattattgatgaagtccatctactcaatgatgatagaggtcctgtgatagaggctctagttgccaggaccctacggcaggtggaatctactcagacaatgatacgcattgtgggcctttctgccactcttcccaattacttggaggttgcacaatttctcagggtaaatccagacacgggtctgttcttctttgattctagttatcgtcctgtgcctcttgcacaacagtatattggaattagtgagccaaactttgcagctcgtaatgaattgttgaatgatatatgctatacaaagattgctgattctcttaggcaaggccatcaggcaatggtgtttgtccattcacgaaaggacactgcaaagacagctgataaactggttgaactagcacgaaggaatgaggattttgaactttttagtaataatacacatccacaatataccttcatgaaggtgaaagaagtcattaaatccagaaacaaagatcttgtgcaactttttgaatatggtgtgggtgtacatcatgctgggatgctacgtgcagatagaggacttactgagcgacttttctccgatggacttctgaaggttcttgtctgtacagcaactttggcatggggtgtcaatctacctgcacacacagttgtcattaagcttttaagggtgggttccccaagtgcttgggcgcttatcacactagcatag

SEQ ID NO: 66405 - DNA, 420 bp, Glycine max
  Peptide Sequence Number=SeqID_183183
atggctgttattctccagggtacccaattatatgatccaaaagctggtgggtggcgagacctgggtatgcttgacgttatgcagatatttgggcgagctggaagacctcagtttgacaaaagcggtgaaggtatcataattacatctcatgacaaactagcatattatctgcgactgctgacaagccaactccctatagaaagccagtttattagctccttgaaagataatttaaatgcagaggtggcattgggtactgtaactaatgttaaggaagcctgtgcatggcttggctatacatatcttttcataaggatgaggatgaatcctttagcatacggtattgggtgggatgagaaagaagaggatggggagagccacagggctcttgaacatcctggaagccgtgtgctagagtag

SEQ ID NO: 66406 - DNA, 327 bp, Glycine max
  Peptide Sequence Number=SeqID_183184
atgagctctggtagggttttattgagagacatgggtcaaggggcggagggagaaataccaccgagaaacactaaaaaagtaaagagaaaggagccagaaaaaaaaccagggggtgataaggatgctagagaaggtggggagaaggataaaaaaacaatgaaagatttcctcccatgcccagtggtacctaatagtgaatttgaagattggtgtaggccatggaagggatcactagtggttcatgtcttggggaaacgtttaaatttcaaaagttggaggttaatcttcaaaaagactgggcaaggttggaagattgataatagttga

SEQ ID NO: 66407 - DNA, 1134 bp, Glycine max
  Peptide Sequence Number=SeqID_183185
atgcccatcatcaccaaagatgcaatcaccgtctacactgagggtgaacctactattcatattgagcacttcttcgacataggaatgctagaagggctaggtctcaacatacaacacacactgatgtattgtggcattcatggttacttcaacgacccagaattcatcgagatgttttggaggaatgcacaactcaaggactggaagaccattgtgtccaaggttcttggcaaggaggtagtgttgtccatggatttcattgcacaggtcatcgggtgcatcagggagggaagcacataccaagaagactgggagaagccctatgagtgtcatgtcctaaaagctctttatgacaggaatctcaaggaaacagatgggaagaagaagattcaatacaatcttctatatgatatggcaaaattttggaatggacaaggactccaaccagtccatcatcagcagcaaaggaaccttcatcaccaacacttcagtgctgtcaacctaaagaagaaactagccaagactattgttgatgaagacaaggctctggaagcctttggccttgccaaaaaagtcaaaaagatcctcggggagcaaaaagacaagaactatggcaggccaagtgagatcgtccagcgtcctaagatggagcccatccaacgacagcataaagttgtgacaacaccacaatggataagtggaacccctagaaccactcatccatcctctaagcaagcaaagcaaaagcataagataactatcacttctaatgatctctttgccaagacaccaaggttcaccactcctatagtaaccatcagaatggacctgtcaaaggagaatcttactcctcaagtccaatggtctaaggaggccactacttaccctctgggactccatattaatagaagtactaacatcaagatggtgccaggtagaacttgtccaaggctacccatttgtgatgaaggcaaaaagaagggcttaaagctttacatcaacaaagaaattcccaacagggatagtgctcagtatgaagtagcctggaaagcaaaattggccactgaagttaagtacaaagttgatgcagaagctagacggcaagctgctgctaagagaaaggctgaagcatag

SEQ ID NO: 66408 - DNA, 282 bp, Glycine max
  Peptide Sequence Number=SeqID_183186
atggagatgtcctcaatgccgacaacgaaagcaaccaatggaggcggtgcggaaaaggaaccaagaggaacaaagaagatgaaggcgaaggctctacccatcaacccctttttccctgccacatgttgccaccgagagttgcaagatattcagtttaggcctgaaaggttccttcaagatgatgagaaggcaaaagttgacattaggggaaatgactttgaggtgataccctttggtgctggacgaaggatttgtgtgggtcttagtcttgggcttcgaatg

SEQ ID NO: 66409 - DNA, 234 bp, Glycine max
  Peptide Sequence Number=SeqID_183187
atgatgataggaacaccgaaagaggaacaagcggatcagaggaaaaggaagacgaagaagcggccattggcagaggagaaggaaagttgtacggacaacttttttcatttacgctatgctttgttgtttactttctcgctttcgtgttggtttttcattgttgagataggtgtcacttcggtcgaggtgaaagtgttacgaaggttcatcggtggtgattattgcggtggttga

SEQ ID NO: 66410 - DNA, 451 bp, Glycine max
  Peptide Sequence Number=SeqID_183188
ggagtggttggggaattctgctgccgggcgtactggtgatggcgttaggcatgattggcctgccggtggaagcctggcgcgtgatgattgtgctggggttactactatcggcggcaatgatctggcaccgtcagttacgtcatttcgtactgttgccgtcaagcgtagcgctgggaaggcctggcggcacgtcgagcatgccgccgatgggaaaagaagattatttcctggcctggcgagtcatcaccgtgcggtaaactttgaaacggccggtttgggcgatcacttcgtggaagccaaacgtctcatccagcacctgcggatacggcaggaaggcgttggcaacgatacgcagttcgccgccgctgttcagatggcggaccgcgccgcggatcagcgcctgcgccgcttcaagactggtctgcaggccgtcgtggaatggcggatttga

SEQ ID NO: 66411 - DNA, 318 bp, Glycine max
  Peptide Sequence Number=SeqID_183189
atgaatcttcaagaattgttcgcccaccgaggccaacgccgccaccacgacgtcgacgaagccgaggcggaggtgcatcagcgggccgtggatgcgggccaaggccgccagggagtggtgcggtaccgggcccatgtgtggggacaaacatatctgaagctgttaggagaaagttgtcattccgctgaagaagatcaaaaaactttcaaatatctcgagcaggcagttgggttgcctaatccatcacttgatctcaaagattcttgttgtcaagcttcgatgagtagcgaaacctaccgtgtgggctctaagctttag

SEQ ID NO: 66412 - DNA, 258 bp, Glycine max
  Peptide Sequence Number=SeqID_183190
atgatgattggactccgagtgttcaacgatggcagtggagggtgtgatcctagggctgatgagtttaaggctatggtggtggaggcccgaacaatgttttacgatatcggacggtgtttcttgaagaagacggagcacaatagttcttccaagaatgagaagcataagaatttgttgagcatcttattgtcgcttaaagatgagagggatgatcatggaaatcatctcaccgatacggagatcaaagggctacttctg

SEQ ID NO: 66413 - DNA, 564 bp, Glycine max
  Peptide Sequence Number=SeqID_183191
atggcagcattacgttacctttttaaagaagtgtcacgtattcatttctttctcaaatttaatgaagaggtagctagattgacatgcaacttggcaagttcagacacaaaagcagtgaatttgggacaattattgaatgtatgcaccaccaacgcattagcgagggcaatgattggacgaagagtgtttaacgatggcaatggagggtgtgatcctagggctgatgagtttaaggctatggtgatggaggtgatggtgttggctggagttttcaacattggtgactttattccttccttggagtggctagaccttcaaggggtgcaagctaagatgaaaaaattacacaaaagatttgatgcatttttaaccagcattattgaggagcacaataacagttcttccaagaatgagaatcataagaatttcttgagtatcttattgtcacttaaagatgtgagggatgatcatggaaaccatctcactgataccgagattaaagcactacttctggtacctatactcttccataactcgtttatagtaggattgccaactctttaa

SEQ ID NO: 66414 - DNA, 183 bp, Glycine max
  Peptide Sequence Number=SeqID_183192
atgtttcaagacaaaaggccattgttatttgttatgcactttgtcacaaggatgtttgatcacgtcaatgttgttgtgccccacaagggtaaattcagaagggatgatcatggcacgatgaagtttgttgattgtgagttctatgtttgggaggacaatgaagtggatttgatgataatgtga

SEQ ID NO: 66415 - DNA, 609 bp, Glycine max
  Peptide Sequence Number=SeqID_183193
atgaatgactggagtattccggaaatccctcaggactcactgtatgttcttgagacaatcaaagacaaacataattttaattacataatcaaaactgtagaaaataatattcctctaggacatgatatagtggaagaatttcatttactttcaaaaaactcaatttatgaacatagtcgaaaatacaaatacctacacataggatgtgtacaagtagccatcaagcctttaattgatatgggcatagatgccgcagtattaatgtgtcttagagatattaggcacaacaaattcgaagattccttaataggaacggtagaaacaagcttaggacaaggtccagtctatttcaattgttatccaaacaaaacagtgagtctagtggatagaaacattcttgactctctgttcctaaacatccactttcatggacttgacatgaaagaaggatcaatcccaacatcattaatatataggattcagtacaaggtcatgaacagttatgcatcacgagtccatctaaaaccacaaagaggtgagacaactttgtttatcactgatatgacaaaggccaatgtttctctcccaagaaccataaaatgggatgag

SEQ ID NO: 66416 - DNA, 489 bp, Glycine max
  Peptide Sequence Number=SeqID_183194
atggctccgagaaagctttccgcaaagagatctaggaaggacgccatggttgaagggactagtgccgctcccgagttcgacaaccatcgtttcaggagcgctgagcaccagcagcgtttcgaggccatcaagggatggtcattccaccgagagagacgcgtccagctcagggacaatgagtacacagatttccaggaagagatagctcgccggcgttggacgtcgctggtcactcccatggccaagtttgacccagattggattccttttgatgcagacgccctcagccagttcctgggagacctgctagtgttagaggagggccaggaatgcgagtatagccattgcccagctgttatgcataccgggtcaggatttttcccggaccgctgccgggagacgggtgcggatcatgcgcacccgcatgactaccttgacctagacgtggatgacgttgctgctcagcaacatcctgcccagcgatcataa

SEQ ID NO: 66417 - DNA, 252 bp, Glycine max
  Peptide Sequence Number=SeqID_183195
atgggttttcctttgccggcagtcccttaccttgctgaaaatttatctggtgtcggtctcgggccaaactcccatattactccacaaggcacgcgtgacaatgatgatttgaaaactacgtgcaaaattagtcatggctacagccaggtgggcactcaagcatcccgtttatggaattgcgatactacggttgggaatttacacaaacagacccaacgtttcccaaattatgttcttctatcagttcaatga

SEQ ID NO: 66418 - DNA, 144 bp, Glycine max
  Peptide Sequence Number=SeqID_183196
atgtcattgtcagttgaggaccagttaattaggcaagctttgcgagcatccgctaagcgcaacactcctgggctaagtgcgaggaagactctagaagaagataagttatacaggttcgctaagcacaccgcttcgtctcactaa

SEQ ID NO: 66419 - DNA, 777 bp, Glycine max
  Peptide Sequence Number=SeqID_183197
atggcgaggacgtgtagtcctctgaaggcgaggacgtgcagtcctctgaaggtgaggacgtgcagtcctgtgaaggtgagagcgtgtaaccctatgaaggagaaggtgaggacatgtagtcctctaaaggagagagcgtgtagcccactaaagggtaggacgtgtagtcctctgaaggcgagggcgtgtggccctctgaaggcgaggacatgtagtcgtctgaaggtgaggacatgtagttctctggaggcgaggacgtgtagtcctttgaaggtgagagcgtgcagccctctgagggtgaggacctgtagccctctcaaggcgagggcgtgtagccctctcaaggcgaggacatgtagtcctctgaaggtgaggacgtgtagtcctctgaaggtgatggcatgcatccctccgatggcgaggacgtgttgtcctctgaatgcgagggcgtgtagccctctaaaggcgaggatgtgcagtcctcttaaggcgaggacatgtagtcatctaaaggtgagggtacgtgaccctctgatggtgaggatgtgtagtcctctgaaggtgatggcatgcatccctccgatggcgaggacgtgttgtcctctgaatgcgagggcgtgtagccctctaaaggcgaggatgtgcagtcctcttaaggcgaggacatgtagtcatctaaaggtgagggtacgtcaccctctggaggcgaggatgtgtagtcctctgaaggtgagggcgtgtagccctctgaaggtgaggacgtgtagtcctctaaag

SEQ ID NO: 66420 - DNA, 258 bp, Glycine max
  Peptide Sequence Number=SeqID_183198
atggtcagcccttctggtattgaggattctctcgaaattagtgaaaaaaattgtttccatgaagaaaatccaagccgaggcgcttccgtaacgctttcaagacgttttcgtgggcgatttcgtggagattcttcaccgttcttcatcgttcttcggtcctcaaccgttctaaaagaattacataggtctgatttcctcatcgcaatagaggaatacataggagtgagggaaacacccttgtcgaccacaaaaagataa

SEQ ID NO: 66421 - DNA, 630 bp, Glycine max
  Peptide Sequence Number=SeqID_183199
atgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccagagatacaagatatccatttttttttcagattggaatcttttaaagagatatatggaattatatgggtatttgcccctattttgattcttatattgggaattacgataagtgtactagcaattgtatggttagaaagggaaatatccgcagggatacaacaacgtattggacctgaatacacaggtccttttggagttcttcaagctctagcagacggaacaaaattacttttcaaagagaatcttattccatctagaggagatattcgtttattcagtataggaccatctatatcagtcatatcgattataataagctattcagtaattcctttaggctataacctttgttttatctga

SEQ ID NO: 66422 - DNA, 177 bp, Glycine max
  Peptide Sequence Number=SeqID_183200
atggacatagatgcagcaatattaatgtgccttagagacattaggcataacaaatttgaagattccttgataggaacagtagaaacaagcctaggacaagtgagtttgatggacagaaacattcttgaccctctgttcttaaatatccactttcatggccttgacatgaaagaatga

SEQ ID NO: 66423 - DNA, 294 bp, Glycine max
  Peptide Sequence Number=SeqID_183201
atgggactcaatcagacatccgagtatagagtcatggtcgtttggaattggctcagagcttcaacattcaatttcgagcgtctcgatatgttacgggactcaatcagacatccgtgtaaaaagttattgtcgtttgaattagctcagaggatcaacattcaatttcgagcgtctcaatatgatacgggactcaatcacacatctgagaaaaaaagcttcaacattccatttcgagcgtctcgatatattacgggactcaatcagacatccgagaaaaaagttattgtcgtttga

SEQ ID NO: 66424 - DNA, 276 bp, Glycine max
  Peptide Sequence Number=SeqID_183202
atgcgggggtccggggaattcgtccccttcttagacacaacgtctaggggtagcaaagtgccccaacgtacgtttttaagaaggcgacacggaccctccgttggtttgtttacacaagggatcaagacagaacccatatgcaatgcctatgcaaaagacacaatgcgggaatgtgcacaaggtatcatcccctttgaagaacatattgtagcagtagggactactagcaacaataggttttcaaagagaaaagctctagatgagggttcactgtaa

SEQ ID NO: 66425 - DNA, 1139 bp, Glycine max
  Peptide Sequence Number=SeqID_183203
ctggtgaccccagtttgcaagatcatcatttgtcttataatgctttaaaaggctcatcaggtcttggaataatgaagtttcaaggatcaataaatggattgggagtgcagattctactagatagtgggagttcagataacttcctccagcctagactagctcaatgcctgaagttacctgtagaaccaattcctaatttgcaggttttggttggaaatggaaatgccttgactgctgaaagattaattcaagacttggaggtgaaaatccaaggtcatacactgaagctaccagtttacctacttccaatttctggtgctgatctagtgcttggggctgcatggttggcaacaattgggcctgatctttttgattatagtactctgacgttgaagttttacttggaactgtttactttacaatactcaaggttggatggtccacaggatcagttattagatataccggatgatatggaaccagaactggccatgatactttacatttatagaacagtctttgatgtgccatcagaagcccttttttcacctcccatcattcttgtcaagaagaaggatggcacttggagattttgcacagattacagggccttgaatgccatcacaatcaaagatagctttcctattcccactgttcatgaactaattgatgaacttcatggggcagtatatttctcaaagcttgatttgagacctggttatcaccaaatactagtaaatgaggaggacaggcataaaacagctttcaggacacatcaatggcattatgaatggcttgtcatgccatttgggctcactaatgcccctgctacatttcagtctctcatgaatgagatcgattacttgggccacatagtatcaagcaagggagtaacaatggatcaagaaaaggttcaagcagtcctgaattggccatatcctataaatatgaagcaattgagaggcttcctcggtctggctggatactacaggaaatttatcaaaggttatgtgtcaatcgcaactcctttatccaatctgttgaagaaggaaaactttcattggaatgaccacacttccatggcttttgacaatttgaaagctgcaattaccaaaggcaccagtactggcattgcctga

SEQ ID NO: 66426 - DNA, 435 bp, Glycine max
  Peptide Sequence Number=SeqID_183204
atgctctatacggtgcggtgggaaggggcgcgtggccatcggatttgttataccacttattcggcaccgctgccagaggagcagaaggcccggcgcgggggccgggcgacgggatcagctgcgcgccggagacggctgcagcgcggccggttgcgcttcggcggccgggcggttttgcagcaccgtccagatgacgatggcgccgagaatatcgaagaccgacagcgcggcgaacagcgggctgaagccgagagtgtccgccagggcgccgaccaccagcgcgaacagcgtgctggcggtccaggctgccatgccggtcaggccgttggcggtcgccacctcattgcggccgaacacgtcggaagagagggtgatcagcgcgccggacagcgcctgatgggcgaagccgccgacgcacaacagcgcaatagccgc

SEQ ID NO: 66427 - DNA, 204 bp, Glycine max
  Peptide Sequence Number=SeqID_183205
atgaaaacccatgatgtcaacttagcatcaaggccaaaaattctagctgcagatatgccaattagagaagaagagctcgccaatctcgtgaaaatggttggttcacatgaagggactgtgaatgtatctatacatgattttgatgatgccaaagaagaatcaaacaaggctgcttcaaatgataagcatttgcttcaagaataa

SEQ ID NO: 66428 - DNA, 890 bp, Glycine max
  Peptide Sequence Number=SeqID_183206
atgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcagaccttttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaatatgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactg

SEQ ID NO: 66429 - DNA, 2277 bp, Glycine max
  Peptide Sequence Number=SeqID_183207
atgactggagacgatgaaagcaaccttggtgggcaaggattaataacaagaaatgggaaaaaagttacttgtaagccagaagaagatggcaacaaatttgaagggtcctttgatctggaagaatgccaaacaaatttgagagctgctcaggaactgggagaggttgagaagaacattacccaagagcaaaaaggaagtgaggatagagttgcagtgtccaatgagctggaagaatgcaaaataaatttgagagctgctcaggaactgagagaggttgagaagaacattacacaagagcaaaaaggaagtgaggatagagttgcagtgtccaatgagcttgaagaatgtgaattgacagagattctggagccacttaacaatgagaatgtgcacagtcaacatggctcagatttcataagtacagatgaagacatagaaaactttggttgtttagagaatagaaagaaaaggaatgattctggttttcttgatatctatcaagaaatcgaatattctggtcagagagaagccactgatgatgcattgtataataaggagccaactgaagtaattagagtgactcaatctgatcctagttgtgaggaagtaaaagccgaggaggctggcaagtccacagaaaccagctcaagctatgatccagatgaaactgagaagttgaacaaaactcaggtagctgatacaactattgaaaatgaggaaactctgaacgtaaatccagaggttcattcatgtgatgtgcaggatgatacaatggtagcgagtagtgcttcatttcaacatcaagagagatatgaagaaacagaccctgttcaggagacaaacgatttccatgagaaacataatgcaggtgagacttcttccttcattcaaattgcccctgaactcaatggggcagtcaatcaaatgcaaaatatatttgaaacagagacctccgaaggtaatgctacaagtattggtgacactgacataaatgataggcaaaatcaagatcagtgctgggaaaagtcagaaaatgactgcaatctggaaatgcttgttgaagacataataactcctgagtctgcagaaatctgcaaggatgctaaggagaatagggttacattaaatgaagaggcagatgagaatcaatctaatttttctaatgaggaaaatttgtttgacaatgaacacaatatagaagaatctcagatatctagttcatctgatcggaaatcaagtcttttcaaagaagaggaggttgaatcaagtcacagcaatctaagggagagtaatcgagcatctgtaataatggaagagaaggaagcaaatggcaacttgcataaggaagagcaggaaaaggaacaactcaaaaaacttgctgaagcaaacgagacgaaaagagaaagagaaaaggaaaaattagctgtagaaagagcaattcgtgaagcacgtgaaagggcatttgctgatgccagagaaagggcgactctagagagagctgcagcagaagcacgtcagaaaaacatttctgatggacgagaaaggctaggaaaaaccactagtcaggcaaatgagaagacaccagctgagaaggctgctatggaagcaaaacttaaagctgaacgtgccgcggtggagagagcaactgcagaggcacgggcacgtgccctagaaagggcactctctgagagagctgcctctgaggcaagaaataaatctgacaaatctgttgcaggttttggggcttcccgtgataatggaataaagcataacttctattcaaaatctttcagctatggtgttcgtgattctactgatgtatttgatggagctgatggtgattctgctcagagatgtaaagctaggtttgagaggcatcagagaataggggaacgtgtggcaaaggctcttgcagaaaagaatatgcgtgactggcttgtgcagaaggagcaagagcacagaaatagggtagcagaatctcttgatgctgatgttaaaaggtggtcaagtgggaagacaggaaacttgagggcattgctttcaacattacaatatatccttggccccgatagtggttggcaaccgattcctttgacagatatagtaaccaccactgctgtaaagaaagcatatcgtaaagctactctatttgtgcatcctgacaagctgcagcagcggggggcaagcattcaacaaaagtacatctgcgagaaggtttttgatcttctaaaggtttggccttcatttgttcttttaagctctaaacaattctactga

SEQ ID NO: 66430 - DNA, 270 bp, Glycine max
  Peptide Sequence Number=SeqID_183208
atgagaacaatttcctcttccttcgacgaaggcattgatgagcaagtttgtgacgcgtgcgttatcatcatagaacttgttatggtggctggcctcaatttgcacaagggacttcacaacgaggatgctattggtggtgttgacgttgtcgatgataggatctggaaaggaccagtcactagagccatgagcaagaagctccaagaggattgggctagagctgttgaagaaggtcctagggttctcatgaaccttaggttagatttctga

SEQ ID NO: 66431 - DNA, 291 bp, Glycine max
  Peptide Sequence Number=SeqID_183209
atggaaaccgaagaccacatgcataacgaaacacgacagtttcattgggatatatcctttagccatgtgcaacaaggcacgtatgatcagcttgaaatctcaaaattgatgggtccacagactttactcaatgaacttgcagctccttatctcactcctatggtgctttgtgataattccaatgttgtgcagatggctcatggtccagttcttcatgctaaaactaagcatatggagttggatctatctcttctttgtcagagaaaaagtcttgtccaagaagctgattga

SEQ ID NO: 66432 - DNA, 162 bp, Glycine max
  Peptide Sequence Number=SeqID_183210
atgtatgcttatcaattgtctccacaagtttatgaatacaaggattgcccctacaacctatattcagcaatcagtaatacaccacgaccattacctctccaagctcctcaaactcaagtcgacaatgatgaggaagatggtagaaggatggtactgcagtga

SEQ ID NO: 66433 - DNA, 582 bp, Glycine max
  Peptide Sequence Number=SeqID_183211
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaatttgcccccggtcaacttcgtggttttgcccgttgtggctggctagggtcgcgtgctggggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 66434 - DNA, 165 bp, Glycine max
  Peptide Sequence Number=SeqID_183212
atggatgcttcaatgctagcctacatggaagagaacggaaaaggaacacgcaaatctattataatgaattgggttaactcatcctcagaaggtgactcaagagacaaggattgctcaagtctatactgttctttgatcatattcctagtcaatgtaatatcttaa

SEQ ID NO: 66435 - DNA, 228 bp, Glycine max
  Peptide Sequence Number=SeqID_183213
atggatgtgtttatctctgacctcttcattattgctactggtaacgtcacccattgtgaccaattacccacttgtgatctgttttgcaagtggtataagtcattgctgtgtgatccaaacccaaattcaccagcaaattctgaagctgctcggatgttcagtgaaaacaagcgtgaatacaacagaagagtacgtgagattgttgagcagagttggactgctgactaa

SEQ ID NO: 66436 - DNA, 2127 bp, Glycine max
  Peptide Sequence Number=SeqID_183214
atgaagatcttgtggctttgtttcagttacttgtttcctgcaatcattcttgttctgcttactccttcctcagttgcacagctatcaccaagtgagggtagaattctattccaagttcagaagcttcttgagtatcctcaagctcttcaagggtggacaagatggaccaacttgtgcttcctccctccctcaccttccctcaagattgtttgctccaatggtcatgtcacagaacttacaatcattggaaacaagacctctccatcttcacacaaccccaaagcaggtgcttggacttcccttcagacactgtctgaaagattctccattgactctttcttcactgtcatgacaaagctttcaaatttgaaggtgttgtccttggtgtctttgggtttgtggggtcctttaccagccaagatcaacaggttttggtccttggaagtgcttaacattagctcaaatttcatttatgggggaattccacaatctctatcctctatgaggaatctaaggagtcttgttttggttgataatctcttcaatggaagtgttcctgacctccaaaggctaacttctctagaagagctcaacttgggaggcaataatttgggtgctcaattcccttcagtgggaaagaatcttgtcactattatgttgagaaataattcactgagatctcatatccctccacaacttgtgcactttgataaacttcaggtatttgatgtgtcttccaataatttttttggaaacatcccatcctttttgatctctttgccttcccttcagtacctaaacttggcttcaaaccatctaagtggtaacctctcagtgaatatggcatgtagttcttcactaacatttgtggatatctcacacaaccttctggttggaaaattgccatcctgctttggttcagtgtcttcaaaggccaaagtgctatattctgggaactgtttgtcaaccgaaaaaaggttaaatgatcaacagcatccattttctttttgcaagagagagggggctttggctgttaagcctccagctaaaaatctgaagaaggaatcgggttcgggtgcaaaactaggcctaatgcttggaataattgtaggaattgtactaattggaggacttctggtactacttgttgtgtgcatctttaggaagtccaaagcagaaagatcacatcctaaaatggacaaatctgttgctaataaatattctatcagtgtatcccccagaccaattggtacaataggacatattccacaggcaatgaagcaagctgcagttggactgccaccataccgtatcttcacatcagaggaaattgaagatgcaacaaataactttgacccatcaaatttaatagaagagggatcactgggacagcaagtagaggtattacacaatttgaggcacaggcatatggtgagtgttctaggacactgcatcattactgaacaggagcatccccaaacaacaagcacagtcttcattgtgtttgagtacatctcaaatgtgtcattgagggatcaactttcagatgggagaaagagggaaatgctgaaatggccacaaagaatggcaatgagcataggcattgcaagaggagttcaattcttacacacaggagttgctcctggcatatatggcaacaatttaaagattgagaacattctgttggatgatagtctcaatgcaaaagtcagtagatacaacattccattgccatccaagattgcacatattgaacaaaatgccaccaatcatattggcagcacaaacgatgcagaaaaggaagatatctatcagttgggtattattctacttgaagttatcactggcaaacaaattacatcctcgagtgaaatagaggagctgaaggaagagctggagaatggttcatcagaagcaacatcagtaattagaagcgcaattgatccttcactgaggggaacttatgcatatgaatcaatgaaaactgcagttcagatcaccatcaactgtctctccaaggtttctagtcagcgcccttcaatagaggatgttctttggaatttgcagtacgcaatgcaagttcaagagtcctggaccagcagtggaaacctcagcacaaaattgtaa

SEQ ID NO: 66437 - DNA, 192 bp, Glycine max
  Peptide Sequence Number=SeqID_183215
atgaccgcatggaatggagtttgcaaaaaggatgaaggcaaacacacgagtaatagtgtaagacaaaaggtagtaatcacactccacacaattcaaatgatggaccatagacctttctttccacaaccaagtgatcaccttgaccacatcacagttgttagacaagaaaaggagcaacatgaagtacattaa

SEQ ID NO: 66438 - DNA, 168 bp, Glycine max
  Peptide Sequence Number=SeqID_183216
atggctttacttggctggatgaaggcaattggggtacggtattttgcaaattgtcatgcaattaccgaccgggacatggtaaggactaaggagaaggaatctttagaaggatttggagtacctatgataagggctagaataaagaagatcaaggaagtttttcaataa

SEQ ID NO: 66439 - DNA, 99 bp, Glycine max
  Peptide Sequence Number=SeqID_183217
atgtcttcttccttcgtcaaaagcggtatacacatggaaggaaactcagtgacagtggtgaatgctagaattctcgtggttgcttatggattgatttga

SEQ ID NO: 66440 - DNA, 501 bp, Glycine max
  Peptide Sequence Number=SeqID_183218
atgaaaagaattatttatttctgtttactgattctgtcgaatctggttttctctcaaaatttatcaaccggttttgaggaattacaaccggaaaaaataggggggtacaccgtaaaaaatactgaagggaaagaggtttataaaacggaatatcaacatctagactcagtaaaaattttcggatataattatttatcagaagacaatcttaaaataagagggtttcttatagagcccaaaataaaagggaagtatcccgtaattattttcaaccgtggaggcaatggtgaacttggagctgtaactctaccagtattaaccgattttctatcaaaaattgcggctaaaggctttgtggtaataggctctcagttacggggaggagcccgtagtgaaggaaaagatgaatttggggggaaagatattggagatgtcttaaaattatttgaaattattgatcatcaggagactattgatcccaaaaaagttggaatgctgggt

SEQ ID NO: 66441 - DNA, 666 bp, Glycine max
  Peptide Sequence Number=SeqID_183219
atgacagctcctttgcagacacataaatcccaaaactggcaggagaagaaactgaatacgtgtgctctataccatcgagcacagcacaaaggagttgcagagggcttggatctggatctggaggccttggttgtagcaggagatggatctattgacctggccgagcatggagaaggcggcgagggcgtcatcggcgccgcattcgacgttagggacttcaatagcgcgttcgaggacggggacgacttcttcaaagtgtccgaggctgcagtagatggcggcgaggatgtggaggctcatggcgaggtcgaggctgggctctcccttgccgacgcaacgctcgaaggacttggaggcccggatggcgaagtcgagggccttggagggcccatcgcccgaggcaatggtgtcgcgagccaatttaaggaggaatgggccgagattcgggttgttgagagaggcatcaaagagaagcggaggggtttctggagttttctttttagaggagcgagaaggagatggggtgggtggttttttgggattggctgggtgtgtccgggatggagattcggaggggttgggtgtccgatacgagacgtggcggtggagggagtgggattagaaattagggtgtggaggatgagctgccgtgaatggggaggatga

SEQ ID NO: 66442 - DNA, 294 bp, Glycine max
  Peptide Sequence Number=SeqID_183220
atgactaaagctatagtttcattgttgttatcctctttggtccccaaagtggtggatcttgcggttgatcctcaggaatatcgtctttaccgttaccttatttgttggaatctttcaagctgcatttggtatttccaggttacatttgatggacttgtgatatgcacaatgttcattcagacaaaatttcatgctaaggatgagggtgacaataaaagcaagcaggttcttgaagaaatttacaaggtggagcttttcggatgcaatggagaagaatttgatttgctgaattaa

SEQ ID NO: 66443 - DNA, 1443 bp, Glycine max
  Peptide Sequence Number=SeqID_183221
atggatgttctggtggtgtcttccgagacatccatgtctactccaacatctggagccaatgctattaaaggagtgctatcagaaaaggaagtagttagtgtatcatcaaatgatggggtaattctttcaattgaagacaaacaggacaaagcacaatcactcgctaatattggttctggggaccatcaagaaaaaatcgggcaaatagaagcagctataatagttcaggctgctattagaggctatcagtcaatagttaaatttcaagcattggctcgtgggtacaaggttaggcactctgatgttgggcttgcagtccagaaaatttttaaggatactaaacttccgaattttattggagtagattcaaccacacaggcagggaagctctcggatagtatctttattaacaaggcttcatcaccctcttctgtttctccaaatctcaaatataatgctggtgaacctaacttggcttgggagtggcttgatcgctggacgaaatcacacttttgggtacctcttcgagaagcgcggaaacctgattcaatgtctgataagaaaaatggaagttgtcaaatagttgaaactaacaagggtcaagttaaaagaaatgccaggaaagcaccttctgtgagggctggtgatgattcagtttcagattctaacaaacataaatgctatccgaaaaaggattcaaacctcccattgcattcagccaaggaacatccacaaaaggatcttgagaaaaggagttctaaaaaacctcaaattcagaatggttttgataaatccgaggttgctaataagaaaagaacacacatcacaagaaaagtttcagatcatacaacagtcactgatgttcaagaggatgatgctggtgctccttcaaagaagttggaaggtttggcagtgtcagagtcaaaacagtctgatcttgaaaaaagtttaggacagcaaacagaagagcatgatactaatgagtcatgtaatgatactaatgctcccttgcagtctagcttggtgaatggtaaagatggagaattcattgaggacttgaataatgtaaattcaaagaatttccagagaagagcttccctgccggctaattttgcagatcatgaaaatctgttacataataacactccaagacgccctagttatatggctcccactgaatctacaaaagctaagctaagaggacatgaacaaggctctccaaggtctgttagcgatttggcggacgtaagtagtataaccaggcggctttcactttcgtcttcgcttaatggcaagctaggttcattccctccatggtcagatagattggctgccttgagcaacaagataaggaccaacagatgtctatcatcttcaaaggatggcactggtaagaatataggattttgcacctttttgctttttcatctattcacgagataa

SEQ ID NO: 66444 - DNA, 936 bp, Glycine max
  Peptide Sequence Number=SeqID_183222
atggattctcagcaagactctccgccgtctgctcatgggactcaaggaccagttgcctacaataggtttatctacatctactacttcacctatttacgttacttcttcaacaagtacccccatacactctacactgtcaaatcaacccccaccgcatacaccaacagggtttgtaagccaaacctatgcatgaataccaacactcatttcacacctattcctacctattttcataaacattaccccaaaccttcttcccctcttcgttacccaaaaatccatttaccctcttttgatgggtctgatccacttggttggttgtttcaagatgaccagtatttcctgtactatcagatccctcttgaacaaagtttaattacccttggcagctttttatatggaggagaattggatatccttcacccctactttatcacacaagctataggtatggttaaactcatggaagacaaaattagagatgttaggcctaaacaattttggtcttctaatataaaccccgactctttcaccaaacttgttgctaccccagccctagttactattgtctctccctcttccaccaccatcctacttaaacatttttctattgcatacatgcatgaacgcagggcacaagataatgattgtgacactattgctccattggaagaagccatagtcccattcccttttaatgaggaagaaccaatgcattttcacttttatcaccacaggccattaatggacaacattcacccaagtctttcaaattttttggtcaaattagtgatcttatcggttatggtagaacaaccaaaggtgacctttggagttcaggtcacgctggctgtggaagcttcgggactccacctgacggtaccatcggcgtgccgaactccaatgtgcgaagttgtggcgacaacgcatctgtga

SEQ ID NO: 66445 - DNA, 399 bp, Glycine max
  Peptide Sequence Number=SeqID_183223
gaatcacacccacaaagacacccagtggacccggagaagtccaactgggccctggggtttccagctttggttacaggcctttgtagtcctacagggtgcctgttccccccgacaaggtcacgtcatcatgacatagacacccagtggacccgaagaagtccaacagggtcttggagttgtcaagctttaattacgggtctctgtcagttctacggagtgcctgtcacctccagcaagggcatcaggccccctactaatcgagctttcatcaagaagtactgcgtccccaggcaggcgcagggcgaaacaccacagccgcctggggatggccagcagcgggcaacagacgcaccgccatcacctctagagttcaactcagctcatccacaaaaaggttag

SEQ ID NO: 66446 - DNA, 297 bp, Glycine max
  Peptide Sequence Number=SeqID_183224
atgaaggattcaagaaatacaagtagtggggatgtctcctccacctctaggacctcacaatcactcacaaactcatctcaagctcttaggacaactttctcttcaagctccaatctctacagcggtgcgcttagcgggatgatccttcgctcagcgaacatgcacaattcatccttcttcctgattcttcctcgcgctcagctgagaagtgttgcgctcagcggatggctcgctaagccagaagattggcttagcgagagggtgaaaattagcacttcacaaacttgcctaaattaa

SEQ ID NO: 66447 - DNA, 238 bp, Glycine max
  Peptide Sequence Number=SeqID_183225
atgtttgtcaccactttcaacactcctccatctgtatataatcttgcaccatcgagttcttgttatcgtccatcattacctactcaaatacgtgacatgagtcacgaagatgaggatgagaatgaggacgaggatgaggataacaacaataataacgatgacgatgatgatggtgatggtgttgatgatgatgacaacagtggtcatcatgttcctcaacaacatcggacaattgcac

SEQ ID NO: 66448 - DNA, 709 bp, Glycine max
  Peptide Sequence Number=SeqID_183226
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggttttgttggtgattttggaggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgccttttggggggccgaggccccctactgctgctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 66449 - DNA, 282 bp, Glycine max
  Peptide Sequence Number=SeqID_183227
atggctatggacttgaacttctctttgactacccgggctctttcaagctctgcctttagggcttgtacctcatcactttcttccgaaatttgggagccaatccaatccttgtgttcggactctcagccacttatgatagccgccgatgatcccattactgcttcccctaagctctctgtcctttcttcacgccgcatcccatgccttgcgaactccttggagtaccctcgcgttgtggtcactgaaaccccgtgcgatgaaaggcgtgatgctttcgtctga

SEQ ID NO: 66450 - DNA, 702 bp, Glycine max
  Peptide Sequence Number=SeqID_183228
atgcaacgagcagaagtcatgataaaaggtcctggtctcggaagagatgcggcattaagagctattcgtagaagtgagaaaataagagtatctactcggacactacaatggaaatgtgttgaatcaagaatagacagtaaacgtctttattatggacgctttattctgtctccacttatgaaaggtcaagccgatacaataggcattgcaatgcgaagagttttactcggagaaatagagggaacatgtatcacacgtgtaaaatcagaaaaaataccacatgaatattctaccataataggtattgaagaatcagtacatgaaattttaatgaatttgaaagaaattgtattgagaagtaatctgtatggaactcgggacgcgtctatttgtttcaaaggtcctggatatgtaaccgctcaagacatcattttaccaccctctgtggaaatcgttgataatacacaacatatagccaacgtaacagaacccgttaatttgtgtattgaattaaaaattgagaggaatcgtgggtatcgtataaaaacactaaaaaactttcaagatggaagttatcctatagatgccacatttatgcctgttcgaaatgtaaatcatagtattcattcttatgtgaatgggaatgaaaaacaaaaagatactcttactcgaaatatggaaaatggaagttttaactcctaa

SEQ ID NO: 66451 - DNA, 534 bp, Glycine max
  Peptide Sequence Number=SeqID_183229
atggaactcagttttaagcaccaacttgggctagtttgtgtcatattgttcttccctgcactgtgtaactgtcaggaatatattggccctgttgatgattactggaatccaattggagcttgtgggttcggcgaatatggaaagacggtgaataatggcattgtcgcagcagtgtctgagccgctatggagggatggagctggctgtggtacatgctatcaggtatgctgcaaactgcaatgctgcgatgagaagggagtatacgtggtagtaagtgatgcacagggagacagaagaaactccagcttgaccttgagccctggagccttgtcaatattagtacacaacaaacctggatgtgcaaatcggatcaaacatgacatgggcgatattgtaatcaaaagggtgccctgtagataccctggcaacatcaagctccgtgtccaggagagcagcaaaaacccaggctactttgcagttgtcattctcgacgtaaatggaatacgcgacatcactgcagttgagatgtggctg

SEQ ID NO: 66452 - DNA, 141 bp, Glycine max
  Peptide Sequence Number=SeqID_183230
atggcgaggattcctgacaagattaggtctattgatggatcaaaagagacgcttaagcttgttgttagaatcactgatctgtggttcgttgggactcccaacaagtctgagcaagcggaaaaggtttttgttgattctgag

SEQ ID NO: 66453 - DNA, 585 bp, Glycine max
  Peptide Sequence Number=SeqID_183231
atgatggaggaaaatacatctctaattgacaaaggacaatggcagccttattctccaaatcatctaattttcgcgatcaatgactttgctacaaatagcattaaaaacaaaggcactttcattttcttgactcccattaaaaactttcttcaatcgccgatacaggtgataaggacatgcgtgatgtcctttaacactatatccactcaaatttccatatgctggaaagtcattaatggtacaaaaaaccatagcacgctctcatcccacacatcaaccccgtcttcccacaattttctcaagtcttcaatcaacagagtgagatacacatcaatatcatttcatgattgccttggaccagcaatcatcatacaaagcattatgtactttcgcttgatgcacaaccaattagggaggttgcaaatcatcagcaaaacaggccatgaactatggttggtgcttaagttacaaaaaggattcattctgtcagaagcaagaccaagcctaaggtttcttgggtcatctgaaaaatcgagatacaaacgatcaattgtctcccattgtggagaatccaccggatgttag

SEQ ID NO: 66454 - DNA, 1095 bp, Glycine max
  Peptide Sequence Number=SeqID_183232
atgcaagatgagattactgcacttgaaacgaatcatacttggtttcttacggatcttccttctgataaaactgcaatcggttgtcactgggtttgcaagattaaatacaatgctgatggttctattgagctttacaaagctcgattagttgcgaaggattatactcaactggagggtgtcgattttcttgatacattctctctcgttgctaagttaactattgttcggctgcttcttgctcttgctgccattcataaatggcaccttaagcaacttgatgtcaacaatgccttcttgcatggtgagcttcttgaagaagtttatatacagccacctcttggtctacatgtttccaaacctggccagtctttggaactcgatcatacgtgcatgccttttcatctccgcacgtctcactctcgccttcaccctaccttttcatctccgcaaatctccgttgtgaccttccacaaacccccttcacactctcagctttactctcgacctctcggaagcctagcggtgggggcgacacctccatcgtcgcagcagcagggactctggttcttcctccgcttccacaatatgccacgtgttcataccctcgcgcatctcccccaggtcgaatctgtcttgattgcggcaagtaatgctacgaaggagaaggcacagctaaaggcattgcaattgctttgttatatgtttttttcatctgaaatatcaaattcaaggttactgcaagacttgaagtggggaaattttgggctattaagtttggggaagtttggggcattccctgaggctgtaataagaacctacacaaagcagctactacttgtactcgagtacttgcacaaaaatggaatcatgcacagagacattaaggtggatttttatttcgttggggccaatattcttgtagataataaaggatgcataaaacttgcagactttggggcatccaaacaagttgttgagctgataatctcagtcttatatgtagctctactattgtgtatgtcgctttacctttgtgttgaccattctaagaaaaagctttgtatatctagagttgtgttagaactgcctgcctaa

SEQ ID NO: 66455 - DNA, 192 bp, Glycine max
  Peptide Sequence Number=SeqID_183233
aagagtcaacaaagatgggaaccactgcgcaggtcctatggggcagtgtttgactttgctaacccacccagtggtgaaatcctcttgaggtttaaagcgggcttttggaagcaggcgaaaatccctgctaattggaagcctggagcaacttatgacaccaaagttcagatcccaggaacatattacaaataa

SEQ ID NO: 66456 - DNA, 816 bp, Glycine max
  Peptide Sequence Number=SeqID_183234
atggcattcatagccatctttaccttcatccgagtgagaatcctgctactcctcttgtgtctccttttacttgatgcgaataattatgattcttggagtcgttcaatgttaactgctcttagtgctaagaacaaggtagaatttgttgatggaagtgcaccacaaccttcttcttctgatcctttgttcaatgtttggcgaccgtgcaacaatatggtggtttcttggcttgtacattcagtcttcatttctattcgtcatagcattttatggatggatcgtgctgatgaaatttggaaggatttaaagtctcgacactcgcaacaagctcagcaggaacatcaattacttggaaatgttacttatgatacaaaggaaacattgattaatgttgtgaacaatagttattgtactcattatggacgtgcaggtcacactgaagttgtttgctatagaaaacatggattctcttccaacactgacaataaaagtggaaaatctatcactaatcgtggtggaaaaatttgtacacattgtggtaggactggccataccgttgaagtttgttacagaaagcatggatttccatctagacacaaattctacaataacaaaaacaatgttgtaaacaacatcgtgataggtcatggtagagtcatggagaatgatcctcaacagtttcaagccttgtctttaatacaacaaccaaacaatggcacttcaacatcttctacttcttgtgtcaatcaaattggtttaatgtcctcttctattactgtaggactcgaaaaccacgaggaagattggtacaattga

SEQ ID NO: 66457 - DNA, 1332 bp, Glycine max
  Peptide Sequence Number=SeqID_183235
atgggccacattgacggaactatatcgtctcaatcacccactattatccaagatggatcttctactcccaatcctcaatacaccaattggttcactattgatcaattgatcattaatctccttctctcagccatgacagaggcaaacaatctctcttttgcctcgtatgatacggctcgatctctatgggtcgcaattgaagcacaatatgcaaacacgtctcgttcccacgttatgtccatcaagaaccaactgcagtgttgcacaaagggagacaaatcaataaccgattacttgttctcagttaaaagccttgctgatgaacttgctgtgattgataaatctctgtctgatgatgatgttactctttatgttctcaatggacttggcgctgaataccgtgacatcgctgcttccattcgtacacgtgaacatcctttcacctttgaggaacttcatagtcatttacttgctcatgatgactacattcgtcgtgaagaggctcagattaacgttcaggtacccactactaattttgcccaacatcagcgcaattcaaaacaagctggtcttttaccattgccatccgatggccgtggtcatgtctcctctaaaccatcccaaaacatgcatccttctcttctcacggatagagttatcatccacgcaagactcgtggctttaattcccgtggtaatagacctccaccacgatgccagtgccagtaatcatgtgacaaccaatctcaacaatatgcatctttactccgagtataatggactggaagaagttcaaattggtgatggtacaggtttgaaaatctcacatgttggttccactacacttcccacacccactactatgtttaatcttcgtgatgttctttctgtcccacatgctaaacacaatctcatttcagtttcaaaattttgcaaatctaacaaagcttacattgaatttcatccttcctttttctgtgtcaaggaccaaggaacgggggcgacattgatgcacggtccaagtaatggtgatctctacacttatcgtctagcctccccaccatctcctattgccttgtcaaccacatgcacttcctcccctctttggcattctcgctttggtcatccatcatcaagagttcttgctcaaggaatgccatacatatctcagtctgctatcagtttcaattatgtaggtgtagaagtgacagaggggatagctggaacaattagagaaggagagttggtaacaatagggtcaaaagaagtaggatgcgtaggtgaaaaagaagtagaagaaggtaatgatgggtctgaggacaatgtttggtga

SEQ ID NO: 66458 - DNA, 156 bp, Glycine max
  Peptide Sequence Number=SeqID_183236
atggcgatgaatgcgctaagcgtgtcttgttgcgctaagcgaatggcttctaggaaaaggaaagccgcagcttccaggccccagccttactacgatactcacagattcacttctgaggatgcctggaaccgctacgctgacaacattcttggctag

SEQ ID NO: 66459 - DNA, 264 bp, Glycine max
  Peptide Sequence Number=SeqID_183237
atgtatcatcttattaagaagcgccgaatggatattaatgggatggtggtggagcctagaccttggggtttttttagacatggtgtggaagttccaatgactcgtgatgatgatcccatggagtcgaagccttctagcaaagctggtattaaaggggaaaaaaaagtagaatctagaaaggttgagtatactagaaagaagtgtgatgagaaggaaacatgtgattattcctgtgttgatataaagcttggagtcctattttag

SEQ ID NO: 66460 - DNA, 375 bp, Glycine max
  Peptide Sequence Number=SeqID_183238
atggcccccaaatttatctggtctcgaagcactagtgttattgagagagaagacaatagttttaacctcctccatagaagaaaggttagtcaacatagcattatcttcagaagtgatcaaattgggaatgaattgagataccaaatcattagggaggaaaaaaaatttagtagcaaaaagggaagagaaaaactggatggcatgttcctagatttgatatatggaatcaaggattcggccaccatccttgagaaggttgatttggttgattgcatgcctttgtttagtgactcagtggaagaaggttgggttatgatgtacgttaccaaaaacatttttgttccagagtttaaaagccgcctttacattctttaa

SEQ ID NO: 66461 - DNA, 618 bp, Glycine max
  Peptide Sequence Number=SeqID_183239
atgcatgaggtcttctcacgcaatgtggcagaaaaatgcaagaagattgaaggaagaggtacactgaggtatagtgggcggagaggttcgaagaacctaggggaattagcaagtggtgattacccgacatttggtgcactcatctatgtgctctcaagcatcgagaatgttgtttgcctagaaaaaccatacgccatggttatgagtagaggactcatccctacaaccaacaactttcaaagtcaggagatgtcaagggagtcacaccttttgcgagcttggagtagtaggcagacagaaagagtgtggtcgtgtcaggaaatgcacacgtcagtgtacacatgtcacactctagggcatattgtgtcggtagataaaccagatgtcacattcatcaccatcgatcaccatcggtactactatattccctgggatttacgtctcaccgacaattgtggtgtgtctcacgatgctcaagaattcaaagtgaccccagtgaggcttgacacgaggggtaatgagagttggagattcgagttaatgatgacaaaggagatgacaaaaagctcaaagattaatcaaagaacaactcaagtgaatcaaagatcaatcaaataa

SEQ ID NO: 66462 - DNA, 216 bp, Glycine max
  Peptide Sequence Number=SeqID_183240
atgtcaaatttctatatccaaaacaagaatctccataggtcctccatggaagctagcttacaagaaaagggagaatggaaatggagtgcaaaggaaaatgagagagagtttaccatgccaaggtcaactgtggaactccaagagaagaagaaaatgactttctttgagcaagagaaccaaagttctcaaatccttaaggagtgggtttcttggtga

SEQ ID NO: 66463 - DNA, 618 bp, Glycine max
  Peptide Sequence Number=SeqID_183241
atggcaacaagaggaggaggttctgatgattcgtgggtggcgaagatccacaaagcgatgaagaaggctaacaattcggttattgggtacgtgagttccaagtctcactggccattgccgcaagtccacataagcttgaggcctcaacacaagagtatggagaagattctgagcatgggttttgatctctttaagcataagaaatcttcaaagacgagagctcatgctgtgaatcgtagaatgtctcttctggctatgggaaatttgataggtgctttggatggtctagccaatttacgatattcagtggtgctatcgaagatagagtttgagagagaaaagcttgagttgaagctagatgatgtactacattctcaaatgaagctattgcaagtgtggggaagtatagaaaagcgacatgtaactgcaattaccataatatacgagtgtttgtatgctgttgcgtgcagagttcatcttttggatggtgcaatggtgagtccaactaaagacgtttatagtgtgtttggattgacattctattcacgctatccgagtggtgcattaagtttaacgtggattcagttgaatgcaactatactccaaacacactcttag

SEQ ID NO: 66464 - DNA, 456 bp, Glycine max
  Peptide Sequence Number=SeqID_183242
atgcctccctcatgttgggctcactgcaaaaccattgggcatttagtctccaattgtaaggttatattttcctcttcagataatgttattaaagctcatgcccaccaaggtaagaaaaacgctaaagagaatggagctgaattgaatgttgttgtagtagagcctatcctcactaaaccttcttcatcctcacctcttgaggatgttatagatgccacccaaaatcctcaacaacagattcccctgtcttttataaactcccccatccccatcgaaaagacagtttccccttttcatgaaagggtagtcaatgatcttcgtatagcatcaaaattcggggaagacttggtggaggaagagtttgaagatgaaagtatccctcctgaaggaacttctacaattaaccctgactttgatgttgttttgtccaaatctcagaaaaagaaactcaagtag

SEQ ID NO: 66465 - DNA, 339 bp, Glycine max
  Peptide Sequence Number=SeqID_183243
atggcctcatttgcacgtggagccgcatctctaacccgcattggtctctcctcttccaagacgccccttcaactcatccaccgccgtggcctcgccgatcaccatggccctcccaaagttgcctgctggaaagacccaatgagcccgtctaaatggaaggaagagcattttgtgattgtctctttaactggctgggggctactcatctatgggggattcaagttggccacaggaggcaagggcaagaaagaagaggctgtttgctttttgataagcaatattgtaaggcaagataataatcagataagttcagagggtgcaaaggatcagtgggtctga

SEQ ID NO: 66466 - DNA, 1500 bp, Glycine max
  Peptide Sequence Number=SeqID_183244
atggcttacaacaaaggggtgcatagcagcagtggagggagtcacagaggaaggccttatgtgttggtattgcttatcacatttgggattgcactgcttggtgtcatggtgcttcacaagctcagagagaggcgcatctgcacccttcttgtcaaagagaaagaccaacagattcttgctcttcagcttctcttgcagaaggaaagagatcgcagcaaagagttgagaagcaagaatgaagagatgaaggggaagttatacacactgagaagtcagaagatggagctggctagaacagttggggagatgcaatccaccctggattcgctgaaagatgagcagaagctgatggaatcagcatttgaggagcagcagaatgagctgagatcgatgcaagaaaaggggaaaagtgttgcacaaggaggatatgacatagaagcattaagagacaatcttaagcataaggaagaagagttagaggacttgaagcgccgtcttgaaaccccggttaatgatcatcctaccatctttaatgaaattgtgactgcaaatggaacaattgcagcacaggatgaaattgagaaggatgagaattcaggtgaatctgccaagcatgagggtgataacaatgaaggtgcaagtaaaagtgaattaaccaagttcaaagatggggaggttgcaactgagatgagagatggaattcggactgatggggatggcgccacaaaagatatggatgacgccgaagtggtggatgggagagaaaagaaagcaatgagagaagagcatgcaggacaagtagagaacaatacagatggtggaggtcgggtgaagcaattggctgggacgaagaggaagcatagccgtgcaagtagaatgaaagggaagcgctggagaaccactgtcaagaatagttcaatggagaacaatggggtttttgaaaaccactctgataatagaaaggtttacaaagatgagttgaaaggtagaagagttgggaaagtctctaatgaggaaaattttgcaagggaggatgaaggaaggaacaataacagccaaagaaaagaaaagccacatgccaaattgttgaagactgaaaaccatgaaagcaaagaagatgccaatgacatgaaagtgaataatacaaaacatcaggtgacaaatagtggaagtaacatatactcacagaagatactggatgaaattaggcagtcagaagagaatgaacagagtcaagtccaagaaaactggaacaaggggcatatcaacaaagttgacaggaatgctgcgcaaacaaaatccaaggtgttacttgaagggcttgaagaattaaaggaggttttggatgtacagaagcaagagaaggattccattgacagtggccaagatgatgaggacaatgattacgatttcttcaaggaattgcactctgaatttgaagatgagaaggatgaatacaagggagagatagatgagtcggagtttcagactggtttgtaa

SEQ ID NO: 66467 - DNA, 1328 bp, Glycine max
  Peptide Sequence Number=SeqID_183245
ccattcttggattacttagttctgatggcgggggagaacagtcaccgtttgaaatcatttccttcaagagatcagaggattcaagtggatattttgtggaatcagatatacaaaggtccttaaatgttagtgtggtgaagagggaggcaccgaggtttgcatatcttatttcaggcaccaagggtgatagccgtaggatgatgagaacactagaagctgtgtaccacccaaggaatcaatacatcttgcatttagatcttgaggcgccgccacgggaaaggttggaattggcaaatgcagtgaaagctgatccaatatttcgtgaggtggagaatgtgcgtgttatgtctcaatcaaatttggtaacttataagggtcctacaatgattgcttgtaccctccaagctattgcaatattattgaaggaaagttcagagtgggactggtttattaacctcagtgcctcagattatcctcttatgacacaggatggaagtcctacattgcctgacctcaattctcgggttgcagcttatatatctgttggacaacttcacttggtgcctattggttttaagctgaaatctaacggggatggatctctatgtaacattgtaacatcattcgatttgcttcatgttttctcaaatctgtcaagaaatatcaatttcattgaacacacacgcattgctggttggaaactgaaccaaagagcaagacccatcattattgaccctgctctttacttatcaaagaaatctgatttagcattgactactcaacgaagaacacttccgacgtcttttaaactgtttactggctcagcttgggttgtactgactcggtcctttgtggagtattgtatatggggatgggataactttccacggactatgctaatgtattacacaaattttatctcctcgccagagggatattttcacactgtcgtttgtaacactgaggaattccgtcacacggcggtaaaccatgatcttcactacattgcttgggacactcctccaaagcagcatcccatctctttaactatgaaggactttgacaaaatggttaaaagcaaggcactcttcgcgcgcaaatttgcaaaggaggatcctgtgctagacaagattgacaaagaacttctggggcgcacacatagattttcacctggtgcatggtgtgatgggaacacagatggtggggcagacccttgttctgttcgtggcaatgatacaatgtttaggtcaggacctggtgctgagaggctacgtgagctgcttcaggtgctgttatctaaagaatctctaagcaagcagtgtttgtga

SEQ ID NO: 66468 - DNA, 132 bp, Glycine max
  Peptide Sequence Number=SeqID_183246
atgaaaggtagtaaaaagaagtatgtggaactaggctgtaaggtcaactcaaaattgtcttcaagcaaatgttattgggaccttgaggatggtcatgaacataagtttctgggattggggtattgtaattga

SEQ ID NO: 66469 - DNA, 208 bp, Glycine max
  Peptide Sequence Number=SeqID_183247
atggcaatcgcttgtgactgtttcagagacagtcaactaggagggtgtactgcagcgcggatcttcggcgtggttggcaacacgagtccggatctgcaactacgaccaagaacaagggtgggtctgcagttgagcgatggcgcggtggcggctagcgctgttgaacaagaacaagcactgccaaaggaggaaagtttatgtgttgtgg

SEQ ID NO: 66470 - DNA, 486 bp, Glycine max
  Peptide Sequence Number=SeqID_183248
atgtgggcctttcataccggccgacaaattgattgggcacatctagtcccatatcacatgcataaggcattgcgattaaatgctccttttccctatccttacttagttactttgttccttcaacattttaacatccctcttgattctgaaccttatgttccaatcaagagatctttcttgatcagtgctgttgtgcttgcctcctttggttaccgcaaagagcgtgacgactcttgggtaaaaaaggatgctcaaccaaatgatgaagaaggacacttaccagctggagaggattcttctctccttcaaagtattttggacaggtttgacggacttcaaacctatgttggtgagaggtttgactctttggaacatcaagtggacacacgattcgaggagatggactcaaggattacaaaggttgaaggagatgtcacctttattcgcgattgctttgacttaccaccaccaccaccatcaatttag

SEQ ID NO: 66471 - DNA, 513 bp, Glycine max
  Peptide Sequence Number=SeqID_183249
atgtcctctcgggggaagaaaaccatacctttcctccaggtgtctcccctctttgagcagaattgcaactgtggtcaaggattcagcaagaggtttggaccgcataaaacagactcggaacggcatagcgggcctaccacggaggtacctagaagacaaggtgaggggtatggccaatcaaggagattgggtcccgtttatggatgtgttagctttgctaatttttggcaagacacaaggcatccatgtccgctccagagccatcgctcgtgtactgaaaagaggagaatagattgggaccagcttttggctgggataggaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgatggaagaaagcatgtctcctttcctt

SEQ ID NO: 66472 - DNA, 705 bp, Glycine max
  Peptide Sequence Number=SeqID_183250
atggccatggccagaatgcgtgcagtcgatgcagccgtgcttgtgctggagagagaagggatcaattgtgctttcggtgtaccgggcgcagcgatcaatccgttttattcggcgatgaaggcgcgcggctcgatccgccatatactggcacgtcatgtcgaaggcgcttcgcatatggccgaaggctacacccgtgcaaagcatggcaatatcggcctgtgcatcggcacctccggcccggccggaacggatatgattacaggtctctattcggcttccgccgattcgatcccgatcctctgcatcaccggtcaggcgccgcgcgcacgtctcgacaaggaagactttcaggccgtcgatatcgccaagatcgcggcccccgtcaccaaatgggcggtcacggtcatggaaccggctttggtgccttatgtcttccagaaggcgttccacatcatgaagtcgggccgtcccggtccggtcctcatcgacctgccgatcgatgtccagcttgccgaaatcgagttcgacatcgacacttaccagccgatggaagcctataagccagctgccacgcgggcacaggccgaaaaggcgctcgccatgctgaacgaggcggaacgcccgctgatcgtggccggtggtggcatcatcaacgccgatgcgtccgaccttctggtcgaattcgccgaaatcaccggcattccg

SEQ ID NO: 66473 - DNA, 255 bp, Glycine max
  Peptide Sequence Number=SeqID_183251
atgaagggaaagaagaaattcaagtctaagaaaggatggaaatctattgtaccacttcatttgaaaggaaaatcggcgactcgtttttctttatttcgcaaagtcaattcagctggctatggacctggcaaaacacccgtttatctgaatgtgtatgacttgacacccatgaatggttttgtgtattgggctggtcttggtatctatcactctggtgtagaaggtgcagttttaatctattatgttgaattttga

SEQ ID NO: 66474 - DNA, 168 bp, Glycine max
  Peptide Sequence Number=SeqID_183252
atggcttcagaggcagtgaagccaggaactgaagacaccttaagaaatagccacaagaggaatgttaaccaggcactggtggcatggcatactgcatcactagcacatactgaaataaaggataccaacgagttgttgattcgagtggtattggactcagtttcttaa

SEQ ID NO: 66475 - DNA, 486 bp, Glycine max
  Peptide Sequence Number=SeqID_183253
atgagcaacttgatatatgttttggatggtctagccaagctccggcattcagtgatgcaaaagaggatagagcttgagagagaaaagattgagatgaagctaaattttgtactgcattctcaaatgaagctgttggaaacatggggaagtatggaaaggcagcatctaactggaattaccataatgaaagagtgtttgcagtctgttgtatgcaaagttcctctcttggaaggtgcaaaagtggatatgcaattagtgtccattgctcagcggcgtgcatctgatctagctgattctataaagtcagtgctatctaccttttcacccttggctggtaagactgctgagttgctatcagagttagcgagagttgtcgcgcaagagaagttgctcttacaggaattgaatgatatcttccacaacatgtctgtccttgagcttaaagaaaggagcctgatgtgcagtctcattcaactgaagtgttga

SEQ ID NO: 66476 - DNA, 159 bp, Glycine max
  Peptide Sequence Number=SeqID_183254
atggaggaagaggatgaggaagaggaaatttcaatcaagaaaaaaaaaccaataattttaggtcattcgaccaaggaagaggtggagatacttttggtgctgttaaccaaggaagaggcagaggttatgtggagtttgattgatctgtgttggaaatga

SEQ ID NO: 66477 - DNA, 996 bp, Glycine max
  Peptide Sequence Number=SeqID_183255
atgaagagcgattccaatgactctgtctctccttattctcccaaacccagaatccgtcaagtaagttcccggttcatgtctccacactcgaccggttcgcccgaacctggttcagcttctccgcttccccggttccaccgggcagcgaagagaaactcctccactctcgcggatcatatcggcaatgagaggctcaaagaaagggaagaaaatcatcagaatcagaaccagacacccacaaacagaacaggctctgttttctctgttctcacgaaacagaggagcctcagagagttcagaaataacatcaatgggtcggaagaaaacgatcaagatcaatacattaatggcaagtccacgaggaatggtttctctgcaaaatttcctgcttcgccggtggtgaagaaaccgagttctcatattgctccgggaagactctctctggatgaaaatgccctcaagaaaaactttcattgttctaagaactcaattgattctgaatcagataatacgagtttggattctgtttctctgcaaagaacatttagttcgaggaaattgggtagggaggtttcatctaagtacatgatgacaacaagtggtagaaaaggagaagcttctgattcagaccctttatcctctgatgattcatggatgatgaaaaagcttattacacagaaagctatgaagagggctaattcgcttattgggtacatgagttccaagtctcagtgggcattgtctcctgggagatcagggtcacctcctttgtctttggaaagtaaggacaagccgttgtcgttttcaagcttgagacctcaacacaagagagtggagaagattcttagcatgggttttgatctctttaggactaagaaaccttcaacatgtgaggtggttcatcagttgcgtctgcttcataaccggttgattcaatggcggtttgcaaatgctagagcaaatgatgcgaatcacaccatgtctcttcaggctgag

SEQ ID NO: 66478 - DNA, 207 bp, Glycine max
  Peptide Sequence Number=SeqID_183256
atgtggagggtttatcttgaaccttcttgcatggaggcaacttgttttactgaatcgaaggggagagtactctttaaacgaggctcgttgaagttctggttgggcagcctatgtaagattctctccgttgatcctgatattcttgaaaaagctactgacttggccgaaaggctatcaatttgtttcatatttgttttcgttttctaa

SEQ ID NO: 66479 - DNA, 432 bp, Glycine max
  Peptide Sequence Number=SeqID_183257
atgtccaatcacaagagcacagagtctgcgataaagaacctggagattcaagtaggacaactagccaagcaaatagctgagaattcttctggaagtttcagagccaatactgagaaaaatcctaaggaagaatgcaaagttgtcatgactagaggcaagaaggcaatcatgattgaaggtgaatggaggaatgtggatgagcaagagccaatagttgaagaagaagatcagttgagagagaacaaaataaatgatgaaattggagataactatccctttttgagaagccttacaacaaatgccactctactcaaagtttctgaaggatatgctaaccaagaagagcaaatggcctctaggaagaggaaagctaccgcttccaagccccaaaagccctatgacaccactagatttaattctgagggcgcctag

SEQ ID NO: 66480 - DNA, 812 bp, Glycine max
  Peptide Sequence Number=SeqID_183258
gaagtggcatcctaggctacctgaggaatatcctaagttgtagcgggccaaggatcccaggtgaagtctgtggagtggcctcaggtgtcacctccggttgtggctgcacctctggctgcagttcttgggccgtaggagcctcacctccctgtaaaaaggatgaaatttgtaaaggcttgaagctagtgtttagcgaggcttgtgcgcttaacgagaatcatgcgctaagcaaggcactcagctcgcttagtgagttgggagcatctggaggagaatctgagaagcatctgcgcgctcagcacatcatcaactcgctcaacgaggcatttgtctcttcccaaggtactgaagctgatgctggtggtggtggagctggagtagaaggagctggaactgaggaggaaggagcagaagtgtctgatggtccccgagcccaagctttgcgggtccccggaaaggtgattgaaggatcattcgggtaccagcaattcttccggatatacgccaaattaatggcgaggctcaaggactcaaatgtcaatgaatctggaactactcatctagcgatgcataggcaggcgctccttcagcatttaaaacaaactcgtgccctggaatacagagcttggaagcaagctcctgagggtctgaacgtgtgcggtggaacctggagtaggtgggtcttagagattggcataaaactccttgaccaaggccacatcaatgtgactgttaggctacctggtcaaggatctacgccactgcctctgttcgagctcctggcggaactcatcgtactctatgataaataa

SEQ ID NO: 66481 - DNA, 435 bp, Glycine max
  Peptide Sequence Number=SeqID_183259
atggtaatagtccctcaaaactatcattctagtgggactaaggtatctcataagcttcgatactttggatcgatcatgaaactaattctcggtttgagcttagtcacacatatagctccttgtccttcccccaaaagtatatcttgcgaggatcaaactcagtcctccctcacagatctagcatgtgttgccaatgaagtcacacccattgagttgagtctttgtgaatataaaaatggtcaaatgagctacagctgttacatcgtaaggaaccaggcagggctagcgaaatgcattgtgcgagctgttaatgcgtgccatccacatctccattctgtactctacgaaagcatcatattaacgggtggaaacaccttatttcctcagtttgctgagagattagttccttggacaaagtttgaagaagaaaagtga

SEQ ID NO: 66482 - DNA, 1305 bp, Glycine max
  Peptide Sequence Number=SeqID_183260
atgggtaattgtctagattcttcagctaaagtagaagcagctcacagttccagaaccccttctgtccttttagatgtgaaaagagcagggaaaactgaaaagcataggagtcctaataacatatgtgggactaactcttttcctctcttgcctgcatcaggaatttcaaaaactagtccttcatctgttccttccaacttatctattctgtcatatagtgaagcaagtgatttctcaaatcttcccacaccgaggtccgagggtgaaatcttgtcttccccaaatcttaaggcctttacctttaacgagctaaagaatgccaccaggaactttcgccccgacagccttcttggtgaaggaggatttggttttgtttacaaggggtggattgatgaacacacacttacagcttcaaaacctggatcaggaatggttgttgctgttaagaaactcaagcctgaagggttacagggtcataaggagtggctgactgaagtggactaccttggacaacttcaccatcagaatctggtaaaattgattggatattgcgtggagggagagaatcggctgttggtatatgagtttatgtccaaagggagcttagagaatcatctgtttagaagaggaccacaacctctttcttggtcagtgaggatgaaagtagccattggtgctgccagaggactttcttttcttcataatgccaaatcacaagttatataccgtgattttaaagcatccaatatcctactagacgcagagttcaatgctaaactctctgattttggcttagcaaaggctggccctacgggtgatagaactcatgtctctactcaagtcatgggaactcaaggatacgcagcacctgaatatgttgcaacaggtcggctgacagctaaaagtgatgtatacagctttggggttgtgttgcttgaactattgtccggtagacgtgccgttgacagatcaaaagccggtgaagagcagaatctagtagaatgggcaaaaccatatttgggtgacaaaagaagactatttcggattatggacaccaagttgggtggccaatacccacaaaaaggagcctacatggctgccactcttgctctaaaatgccttaatcgcgaagctaaggcaaggcctccaatgacagaggttttagaaacccttgaactgattgcaacctcaaaacctgcaggaagaaactgccaattagaacaaaagagagtccatgctcctgacagaaagtctagtgtgcaaaaagggtcccatttgaatcatactcctactgcattcccataa

SEQ ID NO: 66483 - DNA, 267 bp, Glycine max
  Peptide Sequence Number=SeqID_183261
atggaaggagattttgggaatgtcccaactacaagtggatgcaacaactttcgatggctaccaaatgaagtagttgatgacaaaagcctagttattgttagacaaagaaggaagattgtgaagcttgagatgtcgttgaagaacaaagacaaatggctgaagtttgtgattgtaatttgttgtttgctgttaatgttgaatgttatagtgatgaacatgtggtggagcacaagaagtaaagacaggaggaatgtgtatcttaggtag

SEQ ID NO: 66484 - DNA, 213 bp, Glycine max
  Peptide Sequence Number=SeqID_183262
atgaaggattggagaaatacaagcggtgaggatgtcttctccacctctagaacctcacaatcacccacaaactcatctcaagctctcaggacgacttcctcttctaactccattctctgcagcgcgactatggatcgctcagtgcgcattagtggattttggcttagcgcgtgcttttcttgctcaacggatggactgaagcagtgcgcttag

SEQ ID NO: 66485 - DNA, 780 bp, Glycine max
  Peptide Sequence Number=SeqID_183263
atgagtgagatagaggaagtgcaagaacagatgaaggccgatatagaggccatgctaagcatgagacgaatgatggagagcaatgcggccacagttgtcgccaccagcgccgccgctgaggtggacctgactcacccatccgacataaaccaaacaagccgtccagtcctgtacatggtaggtcagggaggacaggtgttaggcagcacgggcggtctgcatatggtgcaaaataagaattctttcccaccgtacggcctacctcccaactatacaccacccaatccagtgcacgtgcccaacgagaacaccaaccactctattcccattccccttgaaggccaacaaccccagttggggcatgcaccctttgctaagcctgtgggggaagccccgtttagtggcatgcctcagcccaatgccgcgggagctcctcaacaccacccgttgcaacctctgcacttctcggtggggagactacctccgaccatagaagaaagagagaagttggatctcatagaagaaaggctgagggccattgaggggatcggtgattattcgtttgtcaacatggcggagctatgcttagtgcccgacatcgtcatccatcccaaattcaaagtacttgacttcaacaagtacaaggggaccaccttacccaagaaccacttaaaaatgtattgtcaaaagatgggggcatactcaagagacgagaaacttttgatgcactacttccaaaagagcttggcaggggcgacaatcacttggtatactaactag

SEQ ID NO: 66486 - DNA, 273 bp, Glycine max
  Peptide Sequence Number=SeqID_183264
atggtccatgacatctttgtcaaggtgaaactggaagtaacagggacatctttggcagtagacgaaacagcgatgatggttacttccatacttcaacttgactcgatgaaccttttcgtaaaagcacgagcttggttcaaccccataacccagggaatggcaattttgatcgccaatacttcatcaacaattcatagggatgaaagactcaggaatatgcatgctatgcatggaaaatgggaaaacgcaagggtcacgcatgagcaaacatga

SEQ ID NO: 66487 - DNA, 363 bp, Glycine max
  Peptide Sequence Number=SeqID_183265
atggagtgcctagagggtgtttgggagaccctcgaaggcaacgagaggtgccgattctgtggcacaattcgactcactgctacttcgctacctgtggagtggatattacctacgcctactccatatcgactagtggagccggttcaagtgatagaggtgtcatcctctgaagaggatcttgaagaggacccagaggagttacatcctgaacctgctatggacgcccctgactttccaaaggatgatgaggacccactccctgatgttgattctccagaggatattatgtcagcatctgaggcagactctacagaggagagtggccctggagggacaacgattagtgacgactattcatcgtag

SEQ ID NO: 66488 - DNA, 285 bp, Glycine max
  Peptide Sequence Number=SeqID_183266
atggaagaaaagaaaccgaaagtgaacgaaataaagatgaaagccaaaaaaacaagaaatgaattgaaagtctcagatttggaaaattacccgttgaagaatgaagaacggatgaagaacggaaaaagggggaagaggttgccgcccagctcgcccaagcgagctgggttgcttactccagaagcaatccagcttcgaaaaacagtctggaaggcccaattcaaaatttcaaaatttctatttgcacccccccgatttgataagttcactccccttctttcgtaa

SEQ ID NO: 66489 - DNA, 294 bp, Glycine max
  Peptide Sequence Number=SeqID_183267
atgatattggtttatcatgctgcagcccaaaataacaagattcaaggaacatttctcaaaaaagatgacccaaagataagtgcattgatgcaacaggcggagttactaagttcactagctctaaaagttgatacagagaatatggaccaaagtcttgaaaacgcatggaagagcccaaaagtatttgttatatgctacgatccaattgcaagttatgtggcttggagtcccacattggaagtatgggattctagtgtggggtttataaggccttgggctctccaaccacaatag

SEQ ID NO: 66490 - DNA, 495 bp, Glycine max
  Peptide Sequence Number=SeqID_183268
atgatcatcatcaaaacatcaaagtcattttcttctacagacccctcagggaatgatcttgagacgggtgactcagacaagtgcgggttgtacatcgaagcaaatcctccccgcctgttgcctggccaagtgaaggttggtgttgaggaggttaaagatgcacaggctcccgttcctgtacccactgatgaggttaccttagtgggacagacacttaacaccttccttgcttggttgacacatcttgtggagcctttatcagaacatgcaactgtttctctagcaaaacctccacaaaggccggatcctaaggtcgatgatccactatatttgatggcattgaccatcccaaagcttttcttgaagcctttccaggttaactgggatgctaccatgttttgggtgtttaatccagacttctcgttgtgcataaagcacaaagatctctccgaaattgtacacggtggtcaatgtctcagcatatctatcatatag

SEQ ID NO: 66491 - DNA, 630 bp, Glycine max
  Peptide Sequence Number=SeqID_183269
atgctctttcagaaacctgaagaaggatcaatcaatcatagagttcagagattggcaaagtatcgctttctaaggaaacaatccgatcttttgctgaatgctgatgatttggatgcaatgtgggtgtgcttaagagagaactgcatcattgatgatgctaccggtgcagaaaagatgaattatgaagacttttgccacattgcctgtgtatgtacagaacaaataggtcctaaatgccggcggtttttcagtccttcaaactttatgaagtttgagaaaaatgagcagggaagaattgccattctacccttttacctttatgtgatgcgaacggtttcacttacgcaggcaagaatagatatgagtgagcttgatgaggattctgatggtttccttcagccacatgctactaatgttgaaccgggaaatgaattgggaaaacctgtggatattaacaatgctgaagatcacatctttggacttgttctgctcaatgactggagtggcacaacaatatcaccttggattgtgaccatggaagcattagaaccttttgctagagaaaccccaaaacaggaaaatgattattctattgggtttgatactgctcgggcaagattgtacctgtag

SEQ ID NO: 66492 - DNA, 603 bp, Glycine max
  Peptide Sequence Number=SeqID_183270
atggtggtgttttgtttcgtggtttctctttttgggctggattctgtggtctgtgatccggaggccgtgtatatggagatcggtgatgcggtccacgttactgaggatggcctcgttagctggcatggtggtggtgatgaagccagcgtcaatgccgacagagcagtcgatgaggatgaagtcgggggccttgccgccgaatccgagggggagtttgtagcgaggtttggagatgcagaggagttcaaagttggaccagcgcttgtcacggacgagggcttagtcgacacagcagtcaccattcaggacctcaatcatggtgtagttgataaggttctcgaggtcgaggaggaggtcaaggttgcggaggctgacgtcggcgtcgatggcgaccacggagaagccgagacaggcgagggagaggccggtgttggaggtggtggtggtcttgcccacaccatccttgttggaggtgatgacagcgacgtggggtatgatcctcccatgaatgcttgtcaaaagagcatcattgttgggctgatgaaggacctagatgagttgttggaaaggggtattgatgttgtgggtataggcctgacttag

SEQ ID NO: 66493 - DNA, 504 bp, Glycine max
  Peptide Sequence Number=SeqID_183271
atggtgcttggtgttgtgcgcttcgatggtgctgacaatggttcaaatgggaaaaagacttgtgagctatcatcaactcatcgtaatgaggttgataagtgggagtggaagtcaaatagcttgaacctgggatttaagttatgtagggaatgggaattagtgttgtttgtgctctttcctttagtaaaacgatgtcgtgcagtgatcaacaaaaccataaactctgagaaaagggcgaggtttcacgagaaaggagtgaggttgaaatttggagaatctgtcatggatgagattgacctcaaagctttgacaaatgataaaggttccatggagatgatagacataacaaagagggatggaagtgtccatttgtttgttttgcatccagttctaaagcaagctaaaaatgtccaagtgccaaataacctgaggacaacaatggggcagcccaacataatggacctataccacttaatagtccacttcaagtcaatggaccaatag

SEQ ID NO: 66494 - DNA, 411 bp, Glycine max
  Peptide Sequence Number=SeqID_183272
atggctacaaggcccaacaccaagccaaaggacgatgaaggcagtgacaatgacggtgaaggcccaagaccaagccaaaggctcgagattatctttgataggaaaattacgggtatgtgcttctcgctcctctcctcttcgctcatgctctttgctccttcttccacttcctctccgagaatggactcaaagccacgctctttcacttacgggtctgggtttctcattaagtccatcaaattgatccttggtgtgaagggatacatagatgccaaaaaacaaaaggcagaagtggttgcaatgacagctgcacttcttggaagtaaggaaaagaattctggaggacaaatatgtggcaacatgacaccaagcgggactgagtatattattagctatcaagtcatctcgtga

SEQ ID NO: 66495 - DNA, 336 bp, Glycine max
  Peptide Sequence Number=SeqID_183273
atgtatgtgagcggtacttatcgtgaatataaatggagttgggatgtggatgacatgtcatatattgacatcacgaagatgatttcgttttttggatacaagacattcaatgataaggatggtgtgaaggttaaggaccaggctaatgttgagaaagaaggtgaggtgcaaggtgaggttcacgtggacacacaacgggaggttgatgtaaggaaagaaagtgagatgtgttggagaccccatttgggagtgaggatgaaaggacaaagaccaagaaatgtcctaggtttaaaatgtcaagggatgattcagatatttgtcttgagaaagggttga

SEQ ID NO: 66496 - DNA, 384 bp, Glycine max
  Peptide Sequence Number=SeqID_183274
atggtggtggtggtgactcaagaagagccttcagggtttctaagcgtaaatagagtcatgagcctggacagtttggaagttgatttgagtaaagaacccgcagctccaataaatcataatgcacaccagcaaattgatgcagaaactaatgtgatagtaagcaatagggtaagatataaatcagcaccaatatgccgcgagcaagaaaaatgggatagagctaccaaggcagcaattggaggcagtttaaagaggaagttgcaaatgtttaccttgggtataggtggtgttggtctggtttcagcttatgtttcttattcccctgagattgcagctaggtatttgaattcttcatgtactattgacatagttattctgaattag

SEQ ID NO: 66497 - DNA, 348 bp, Glycine max
  Peptide Sequence Number=SeqID_183275
atggctcaatcctctaaggaggacttgattttgatgttggctttccttaccggtgctggtgcagtaacttcatttggttaccgtaaggatcgtgatggacaattactgaagaaggacacactacctccacaagacgagcgtactccttctcctcctcctcctcaaagagatgattcctcagtgcttatgaatgaagttctttcagaattacggggcctccgcacatatgtaggagaacgctttgattccttggatagtcgctttgaaggaatggatacccatatcacgaggcttgaagaggatgtgacttatctttgtcggtgctttgatcttccaccaccttcctag

SEQ ID NO: 66498 - DNA, 147 bp, Glycine max
  Peptide Sequence Number=SeqID_183276
atgtcttcctcagctgaccatccaccttttttgaaatcagaattcaaagaaaaactgataacagcaagcacagagcctcgtatgagaagcaaagtggagagtgaaactgggtgtcttttagaccaaagtacttatgttgatctatga

SEQ ID NO: 66499 - DNA, 963 bp, Glycine max
  Peptide Sequence Number=SeqID_183277
atgattgaggagttgaagagtggtaataaggaaggccaggttcttcaggagcttctgaaccgaaccaaagaatcagataacgctggacataatattccagatttacagcctgtagatcttaaagatatgattgagaacttgaagagtggtaatgaggaaggcctggtacttcaggagtttctgaaccaaaccaacagagcagatatccctgaacataagatcccacatttatggcttgtagatcataaagatatgattgagaaatttaagagtggtaatgaggaaggccaggttcttcaagagtttctgaacagaaccaaagaatcagatatacctggacataagattccagatttacagctagtagatcttaaagatgtgattgaggacttgaagagtggtaatgaggaaggccaggcttgttggaggcaagtggaccgttatgaagactctccaggcagttctggatatagtacaggatcaattctcctgtgtgagtcagctggtgataatctggagccttcatttcatcaggatattggaactgaattgaagtctgaacaacttgaagatgagaaaggagtaggtagagatgatgggaaagtggttctgtctactttaaatgtagatcaagatacgttaccgtgttttgaggaacagataaacaatgatgggattgtttctgcctcatcaagattggagttcagctcccctcttcaagtaacccctctgtttagatccttggcagcaggaattcccagcccacaattttcagaaagtataatacctttaataaatcttaagtattcgtcaatctattgctacttcaaggtccattcaggtttagatgaggaaaggaacttcttgaggaaaacactaggaatggaatctccatccatcaacccaagtgccaactcatcacaaccgccaccctgcaaaagagccctactacctagtctataa

SEQ ID NO: 66500 - DNA, 159 bp, Glycine max
  Peptide Sequence Number=SeqID_183278
atggtaccctcaaaagaaaatagagtagatgatcatggagatgacaaggaaggacgaattggtgctgtgggtgcttcagatggttcgtggtggcgatggccaacatcaacggtggtggaggatgttccctttctcttcttcgacgattatgccatttga

SEQ ID NO: 66501 - DNA, 285 bp, Glycine max
  Peptide Sequence Number=SeqID_183279
atgcaaagagaagaagaggacaaaaccaccatgccagatctggaaaaagaaaccatggaaaaaggaggaaggggagtggatcttagatctggaaaaagaaacgatgttgagggtgaaactgtatctcgcgatggtggcaccaacaaggaggagatgaagtggttgtcttcaaagtcgcaatcgttagagaaaaagtctttggctggagatgggaaagcgtctggatacaaaaaaattttagtctatatgtattggtcacccagaaaaatatttagagatagttga

SEQ ID NO: 66502 - DNA, 225 bp, Glycine max
  Peptide Sequence Number=SeqID_183280
atgcatgatccgagggttgatcatatgtcagctctcaaaaggattattcgatatgttcaagattggggtgggtgccctgacacgagacgatctacttccggttattgtgtatttttgggtgataacttgatatcttggtcatcaaaacgccaacctacgttatctcgttcaagtgccaaggccgagtatcgtggtgtggcaaatgtggtctcagaatcatgctag

SEQ ID NO: 66503 - DNA, 1197 bp, Glycine max
  Peptide Sequence Number=SeqID_183281
atgtctgtggttaacactcaatcagctgcagtttactttctctatggatatggtggaactgacaaaacatttgtttggacaaccttatcatctggtatacgctccaatggtggaattgtttgtacagttgcttcaagtggaattgcttcattactattgcctggtggtcagactgcacattccaaatttgctataccagtccctgcaacagaaaattcaacatgcaatattcatcaaggcagtgagttagctgaattattaaaggttacaaaactaatagtttgggatgaagctccaatgtgtcacaaatttgcatttgaggcactagataaaagtcttaaagacatcatgcaaaacaatatgccttttggagggaaaattatggtttttgggggagatttccgacagatcttgccaattgttccaaaagaaatcactattccagatgagtttctcataaaaaattatgatgatcctatccatgctattgttgaagccacctatcccagcttgatagataactacagtgacacagattacttgcaaaaaagagttgttcttgcgtctaaaaaagaaattgttgacaaaataaatgattatgtcctatcacttatacccaatcacgaaaaagagtattgcagcgcagatagtattgataaatcagatgaattgctcaatcctgtttttgcattattgccacctgaattcctatattcattgcaaacatcaggtatacctaatcataaattaaaacttaaggttggaactccaatcatgctattacgaaatctcgaccagactgatggcctgtgcaatggaactaggctcattatcaccaaactcggatctaatgtgattgaggttgaagtaattactgtgcctaattcaggaaataggacatacatacccagaataaatatgtctccttctgaatctgcatggccattcaaacttataaggaggcagttttcattcatagtttcttatgctatgactataaacaaatctcagggacaatcatttcatcacataggactgtatttgccacacccaggttttagtcatggccaactatatgttgcactctcaagggtcaaaaacaaagatggacttcatattctcatacatgacaatgatggtaatccaaaaaatattaccactaatgttgtttacaacgaagtctttgcgaatttataa

SEQ ID NO: 66504 - DNA, 213 bp, Glycine max
  Peptide Sequence Number=SeqID_183282
atggagatgggagtgagctcgagacccactgagagggcaaaaacacctggggtttggagatgcaggaagttgtggaggagatttaggtacagggttccgattatgtgcatgaggttccaaaagtataacaactcaatgttgctatcaatcacccattttccatgggtgtggaagattgggcaatggttgaatggggggactgagaatggataa

SEQ ID NO: 66505 - DNA, 342 bp, Glycine max
  Peptide Sequence Number=SeqID_183283
atgtcgtctatgtccattagttcttcatctgggaggttgcctacttcttgcggattgtggatgttctcgtccatattcttgtggtttaagttgttcatcaggaacaacaggttgttcttcatggacaaagtcattagtggaagaactgctaataatactttggtgaagggatgcaaacgaaggtataagcatagtttgcatgtacgcataagcagacttcattgttcgaagatctatatctatgagattactcataaagtattctttgctagccttaaagaactagggattgtacccataaccttcttaatgatgatgaggttgtggcatgaattcatataa

SEQ ID NO: 66506 - DNA, 183 bp, Glycine max
  Peptide Sequence Number=SeqID_183284
atggcggagggctccgtcgcatccttgtgctcgccttctgcgtcgccggaatctggtccgcgtacatctaccaaggcgttcttcaggaaaatgtgtaagaatccctatccgctccgaaactctcgagctcgcggtcgacgaagcgattcaacggtgaaaggttcgagcaccttgcgtttctga

SEQ ID NO: 66507 - DNA, 1542 bp, Glycine max
  Peptide Sequence Number=SeqID_183285
atgaagaagcagcagcagcaggagaaacataagaagcaaatggtcaatgaagaatctaagaagaaggagcgtcacattgtgacgtggactcaagaggaagatgacatactgagggagcagattggtgtacatggaactgaaaattgggcaattattgcttctaaattcaaggacaaaacaacaagacagtgcagaagaagatggtacacttatttgaattccgatttcaagaaaggaggatggtcaccagaggaagacatgcttttatgtgagcagttgccattcaagtttaagaacttggaaaaattttgcacttcatcttttgctgtctacttttcggtctttccattctgtatggtagacctcaatccattgatgtacaaggattgtatcattgctcaaaaaatatttggtaacaggtggacagaaatagcaaaggtggtttcaggcagaacggataacgctgtgaaaaaccgtttctccacattgtgcaaaaagagagcaaaatatgaagccttagtaaaagagaacagcacttcatacatcaattcaaataacaaaaggatttttctccagcacgggtgtgatacagatgtagcatcagaaactgcaattaagaagatgaggaggtcacatatccctgatgccgcagagaagatcaactttggagacagatcacataaacaaaatgggattccattaaatgagcaatcaagagccccatttgcggttttagctcaaaacactcacaatgtcaacttgccagaccagcatcatgtctgcaatttgaaatttagtgattatgctgaaaataacaagattcaaggaacattccttaaaaaggatgacccaaagataaacgcattgatgcaacaagcagagttattaagttcactagctctaaaagtagatgcagagaatatggaccaaagtcttgaaaatgcatggaaggttcttcaagaatttctgaaccgaaccaaagagtcagacattcctagatataagattccagatttacaacttgtagatctaaaagagttattggcggacttaaagagcagtagtgaggaaatccagccatgctggaggcaaatggaactatatgaagactctccaggcagttcggaatacagtacaggatcaactctcctgcctcattcagctggtgaggatttggaacactcactgcatcaggatattggaaccgaactgaatatacaaattgaagattcagaaggagttaggggatgtgaccaaggggttctttctagtgcaactctggatcaagatttattcccatcttgtgaggaacagataaacaatgatgcaattgtttctgccttatcaagttcagcggagttcagttcacctcttcaagttacccctctgtttagatccttagctgctggaattcctagcccacaattttcagaaagtgaaaggagcttccttatgaaaacactcggaatggagtctccgtcgctcaatccaagtgtcaacccctcacaaccgccactctgcaaaagagccctcctaatctga

SEQ ID NO: 66508 - DNA, 462 bp, Glycine max
  Peptide Sequence Number=SeqID_183286
atgggtaccattggtagaattgttatcgaaaatcattcatggtataggcttgaggtcatggtttaccacaaggaagaatgcacaaattttttgctctgggaccgtgaatgcgcaaacctaattggtcaatcagatgacgaagttaataggttaaagatagcagatggtgatgttgatttgaatgtttatcttgaagcactagataaaatcctgggttatacacttgcatttaaagtcaaggttcagtcaaagttcaggaattttgtagttttaaaatactcatttgactcagatttgataaacaccacaatagacttattaccagatattgaggcaccttacaaggttcattttccactctctgatactaatgatcctctccaatatgagactataaatcatgatccacttctcgaagttccccttacaccaacaaagcaacagacacctcaggatatatga

SEQ ID NO: 66509 - DNA, 693 bp, Glycine max
  Peptide Sequence Number=SeqID_183287
atggttcatggtccatgtggaaatttagggaaaggatctccatacaggaaagaaggaaagtacagtcgtttctatcccaaaatgtttcagccacatactcttctagatgcagatggttatccaggatatgatagagtcactgttgttatagttcatgatgaaaacgatgcaaccttgcatgttgcaactcaccatgatgagataaaggactatctagattgcaggagaattattctacttgaggatgatgcttactgtttgcaaaggtcccaatctcattcgaatatctcaggacagttcctaatgttcaatatcctacatgagaagcatgcttcgccatggggtggtactaagaacaaacctgaagaagtttggcaacaaacttggaattggttagctgatggagattggcctaaccaattaggcaatggattgatattatcagaactcaactacaataccgatgagcttaaatcaaaatttctacatcttttcgctacattgacagctatgaacaagcaagaaggtgagatgttttccctatatggatatggaggtacaggaaaaactttcatttggaaaatgctagcaagttcattgagagcagacaacaaaattgttgttcttatggttgcttctagcggcattacttccttccttactattgtctggaggcagaactgcacactctaa

SEQ ID NO: 66510 - DNA, 834 bp, Glycine max
  Peptide Sequence Number=SeqID_183288
atgaattctggtgggtacgctgttgaggttacgggtctctcgccaaaagccacggacaaggatgttcgtgacttctttgctttctccggtgtcattgagaatgttgaaattatcaggtctggtgattatgcttgtaccgcttatgtgacattcaaagatgcatatgctcaagaaactgcatgcttgctcagtggctgttgcactactcgatcccatgtagcaacaccaagatatacttgggaggagatttacacacgatttgagaaactaatcctcaaccccaaatatcagggagccactattttagatcaacgtgtatgcataacacgctggggacactatgaagatgaatttgatttttggaaccagccttcgtatagtcatgaggatgagactgcttcaactacaccacaaagcaatcaatttgtttcctctgctggagaagcagttaccatggctcaagaagttgttaggaccatgctgtcaaagggatatgttctcagcaaggatgcactagctaaggctaaagactttgacgagtctcatcaggtttccgccactgcaacagcgaaggtttctgaactgagccagagaattggcctatcagataagatatctgcaggtattggagctgttaaatctgtggatcagagatataatgtctctgaaacaaccatggcggctgcatccacagcaggaagatcggtagcagcggctgcaaactctttggtaaatagcagctatttttcaaaaggagccttgtgggtgtcaggtgctctaacccgagcagctcaggttgcttctgatatgggtactcacagggataggcagtaa

SEQ ID NO: 66511 - DNA, 153 bp, Glycine max
  Peptide Sequence Number=SeqID_183289
gcttcttgtgttccaaggttgttgtataaagacactgaatcattgaagtctaggttattgtacgataatggttgtggagatggtagttgtggttgtggacacgatggttgtggagacgatagttgtggttatggagatggtggttgtggttaa

SEQ ID NO: 66512 - DNA, 195 bp, Glycine max
  Peptide Sequence Number=SeqID_183290
atgtctagcagaagatctcgttcaagacaatccggtgcttccgctgagatcactgatgctcaaatcaccgatctcgtttccaagttacaacaacttatccctgagcttcgtgctaggcgctccgacaagccacaacttgaggctatagtatatgggactcatcatcagattcttccccctcttgccccctattga

SEQ ID NO: 66513 - DNA, 291 bp, Glycine max
  Peptide Sequence Number=SeqID_183291
atgaagtatttgggtttgcctattggagctaatctaaggaagttgagtacttgggatccggtggtggaaatgtttatatggggaggtgaatgggtgtttagtagggaatggttgaaaagggtctcattggtggaggtcaatttgaaggttggaaatggggataatggggtgaagagggggtggttcacatattccatagggagggtggttggaaatgggactaaagctttcttttggaaagacaattgggtggagggtgtgtcgttgagggagaggtttcctaggttgtag

SEQ ID NO: 66514 - DNA, 294 bp, Glycine max
  Peptide Sequence Number=SeqID_183292
atgtctggttgttccgatgaggaggagatttcgtactcagaatccgatcgtcacggttatgaaggagacaatgacgacgacgattccgaaatcggaaagaatgaacatcgtagcaaaagaagaatgggtagtgtggttttggaaaggtggcagtgcaccacgaaagcgaagaagcaagtgcacaaatttagaagcagaaaaaatcttcttgcaaaatcacgttcggggaataatattaaagacaagaatgatttctattccaaagaatgcaacccccacttggagttggattag

SEQ ID NO: 66515 - DNA, 324 bp, Glycine max
  Peptide Sequence Number=SeqID_183293
atgccaaagaccaaagtagtagaagactctttggatttaattgttaaagattcttttgatacccaagacgatgaatactttttggattcacaagatgaaggatactctatagtttcaaaaaaagttcaagactgcatgcatttagagattgttaacgattatgtggtgaagactctatattttcaaaaatttaaatcttcctacatccatgtcgtgttggacgtcgaggaggcccctggattgggagcggtagacaatctcatcgagcgagtaggactccgtcttgatgcatgttattgctggggggttgttatggctttttga

SEQ ID NO: 66516 - DNA, 546 bp, Glycine max
  Peptide Sequence Number=SeqID_183294
atggaatcacgtcctttgcacatagcaatgtatccatggttagccatgggtcaccaaaccgcattcctccacctatgcaacaagttagcgataaggggccacaaaatctccttcatcaccccaccaaaagcacaagccaagttagaagcattcaacctgcacccaaattcaatcacctttgtcaccatcacggttccacacgttgaaggccttcccccagatgcacaaaccaccgcagatgtcacttaccctttgcagccgcagatcatgacagccatggatctgactaaagatgacatagaaacccttctcagtggcctcaaacctgatcttgtcttctacgacttcacacattggatgccagcattggcaaagagtttaggcatcaaggctgtgcattattgcactgctagttctgtgatggttggttacactctcccaccggctagatatcaccaaggaacaaacctaatagaaagtgacctcatggaacccccagaagggtacactactaagcacccatacttaaatttactttgcatatga

SEQ ID NO: 66517 - DNA, 274 bp, Glycine max
  Peptide Sequence Number=SeqID_183295
atgaatgcacgagggaatgtttatgctatgcatgacaaaatgtgtttatcgatggacacaaaaattcgaaagagcgtcccttcttacccgcaatgcatcgggtttctagagatatcattctctttgatatcaaacattgtggcggtagaggctaccagtgacaatgtatcatcaaaaagaaaaactctagatgaggcttcactgtcatcaagtgagtcggaggctcagcatgaccacaaatcaacctccacttcctatgtttccatggatccgg

SEQ ID NO: 66518 - DNA, 552 bp, Glycine max
  Peptide Sequence Number=SeqID_183296
atggagattacaaatcccaccagaatgatttcatcatctgttggatgtcatcctcaagtgaagttggaaatcatgtcctttaagaagccaaagattgcttttttgtttctgccaatgatgaagagaaggcctaagtatttgccagaatctatggtgatagatactccaagggatcaaagacattattttttgcctcaaggattgttcttttttaaggctggaggaaagatcctgggtgcacagaataaaaagggcatattgtcaaggattgatctaccctctacaaaagcagattgctcaaaggagatttatttttggagaagtggtttgagtctgttggctacagttttgtatatgattttgtatatgacattgcatagggaaatatgtatagtctttcatgggtgtgaggttgttaatttttgggaggagagcaatggaggtttggttaatctaagggggaaaggaaccttgctcaagccagaaggtagttgcggtaaaaatatcaaaaccacaaaggttccaaaaacgtttgtaaaaagtgggatttaa

SEQ ID NO: 66519 - DNA, 132 bp, Glycine max
  Peptide Sequence Number=SeqID_183297
atggcgttacatttttgcttcataggtattggtcaaggaaggaaacctccggaacgaattccatctcttctttggctgcgagcaagcaaagcaaatcttgatagctgctggtctttggagattaatagatga

SEQ ID NO: 66520 - DNA, 1065 bp, Glycine max
  Peptide Sequence Number=SeqID_183298
atgagcactggggagcttctcaacatcgaacctctcgaactcaagttcccctggtttccgtcgcacctctctcatttcccctttctttgttcgttcgtgcttttagttgagctgaagaagcagatctcatgttctcttcaattgtccaataagaccgatagctatgtggccttcaaggtgaaaacaaccaatccgaagaagtattgtgttcgtccgaacactggtattgtcacgccacgatctacgtgtgatgttatcgttaccatgcaagcgcaaaaagaggctcctgctgatatgcaatgcaaggataagtttcttcttcagagcgtaaaaactgttgatggtaccagtccgaaggatatcactgcagacatgttcaacaaggaggcagggcatgtggttgaggagtgcaaattgagagtgctgtatgtttctccacctcaaccaccgtctcctgtcccagaaggttctgaggaaggatcctcacctagaggttctgtttcagagaatggaaatgccaatggttctgacttcacacaagcagcaagaggatttactgagcggcctgaatctcaagacaaatctgcagaggccctctgcaccaacgagcacttctgccacgtgataggcggcgacggctactcccctgactggcgggtgcagttccacgtgttcccctacgcccgcacccgatcgacgctccgcgagcttggacggtgctgctcgaagaagaggatcatcggcttgagggaagagttgcgagttcgagaacatgattttgagaactttcaggtggaagagaggatgaaggctagagctcttatctcaaggctgactgaagaaaagaataatgcaattcaacaaaatagcaagctccaccaggaactgatgtggggaaaaagtgacaggtcttctcaaggaaagctgatgaatgtagattttctgcatcagaatgagctactgaagagggaaggcaacaaaagtcgtggtggagtctcatttgtcattgtcgtattaattggcttgcttggcataattatggggtatctcatgaagaagacctaa

SEQ ID NO: 66521 - DNA, 201 bp, Glycine max
  Peptide Sequence Number=SeqID_183299
atgtctagaagttcatcagaggccgagtatcgggcactggctagtgccacttctacaggcacactccttatgagcaccaatgaggcagaactgagtgagagcaagatccgtagctttggcaaaagttttcggacagatctacacactagcaggaaaatccctcgctttgcaaaggctgagaggtgtgttcaatggatatag

SEQ ID NO: 66522 - DNA, 172 bp, Glycine max
  Peptide Sequence Number=SeqID_183300
atgactaccatcgttgtcatcaacataactgtcggcggcggcacagtggtaatggtggcagcgataatgacgatgagaacaatcatgttggtggtgttggcggcaattgacaatcgcggtgataacaatggtagttgtgacagttatggtgaaaacggtcatcaaagtggtg

SEQ ID NO: 66523 - DNA, 1239 bp, Glycine max
  Peptide Sequence Number=SeqID_183301
atgggaactcgaacaaatttctacaagaacccatcaatctcctacaaaaaacgtttaagcatctcctccgttcttcagaacctccatgcttacaacatcgccgccggcaatgttcctcccgccgatccaccgcaagcgacttccaccgccaatgttcctcccggcaatccaccgcatctcactccctccgccagactcaaacgcagccggaatcccgagccaccggaatttctacgcgaataccgtgacgatgccccttcctctatgtcacaccacgattacatccaaaacagaaggaaagaagtcgtttcgtctcggaatcacgatcgcgttgaattgactgaagaagttttgggaaactctaattctactcttcccttggtggattatgatgcaagtgatgaagatactccttcagaatgtgaagaaacacatactcttctaaattctggtcaacaagaagaatttgatggagtaaaaaaaagcagaaatgagcagcgattccctgtctctggggaacctgtttgtcttatatgtggaagatatggcgaatatatatgcaacgagacagatgatgatgtctgtagcatggaatgcaaaagtgaacttctggaaattcttaaactcaatgagggatcctcccacaaccaagttagagatatctcctcatctggaattagtgctgctgtaccagttccagtttttggtgatgatacctgggattataatcaacatcactggtccaaaaagacatgtagtctttctacttatgaatgttggaaatgtcaaagacctggccacctagctgaagattgtatggtcactgatggaagtaatagatctagttccattccaaaggatcttcttcaactgtatagaagatgccaccagattggtaaagacttgttagctgcaaactgtaacgtgtgtcgcagatcatcaaatttggcaacatgccttgattgtagtattgtcctttgtgatggggcaggccacttgattgagcatataagaacacacccttcccatcaaaaatattattcacacaagcttaaacgtctggttaaatgctgcaagtcaacatgcaaggtcactgacatcaaggatctcttggtttgtcattattgctttgataaagcctttgaaaagttctatgatatgtatactgcaacatggaaaggagccgggcttgcaattatgtggggttctatatgctgtgaagaccatttcacctggtaa

SEQ ID NO: 66524 - DNA, 891 bp, Glycine max
  Peptide Sequence Number=SeqID_183302
atgacaatgatcggttgcagcagtgatggacaaatggatgacaccaagttcagcaaaccgatgccatggattggcatatacatagcagcagcatctcttgcctgtctcataacaatggcagcagatctcatacacggaattcgcggtcgcaaactttggttcccttgcaaattcttctgcttaaacgccacttccttggccataatagctgttgcagtgaagttatcagtggatctcaacacccccatgcctcaccgccgtgatcagctatcgaaactcagcagcagtgccttgatctgtacaataatggccaattccatgccgactcttgggatcacagagaacaaggacaccatgatgaacctcatggccatggccatacttgtgatcaccatgattgtgaacatctgcatacagtttgtgactggtgttatctatgtgttttgggtggaacatgctgtcatcatgctcctcatgctaattctgttgatgaccatgacctcctcagtcataagtcttccaaagatgaagcactattttgagctgaaatataagatgaatgaagaagcaattaaagagggttcaaaactatttggtgaggaagggaatcaaatggtcagcatactcagagatcatctgatgaaaatttggatgatgactcacacaagcagccctcaatttgttcttggaaggtcagtgacttgtactgcttctggtgccttttgtcttctaagtaccttgacattaattgaggctatgcttcgatcttacttgatgccatggttgtttgatttttgcactggtgactgtgactacaagtggtccacaatcttaattctcatagttcaggtggctgcagtggtggtgggtggggattgtgctaatgtgtaa

SEQ ID NO: 66525 - DNA, 264 bp, Glycine max
  Peptide Sequence Number=SeqID_183303
atgatgaaggaggtggtccacggtcacaactctacagctccccaactccacttttcctttccttcttcttctttcactctttctctgtgtttttctcttgtttctacttcagctgggatgatttctccttcaacatgcatggctatttatagaaaacaacctaggagaccagacaaattcgaccaagcgagttgtagctcgcccaggcaagtttgttgcttactagtgaaggcatccactcgcctaggcgagtttcttgcttag

SEQ ID NO: 66526 - DNA, 858 bp, Glycine max
  Peptide Sequence Number=SeqID_183304
atggatgaatccaatagtacgcaaactgaggatcacattgagaaagatgcagagctgaaacatgggaatttcaaagctggggaagatcatgctgaaaatgtaatggatgggcctggagcagtattggtaaacttgttgacaagtttaaggcatttgccacctgctatgcattctgtcctggttgtaatggctctcacttggttgtcatggtttcccttctttctgtttgatacggattggatgggcagagaagtttatcatggtgatccaaaagggggcacttctgaagtagatctttatgatcaaggagttagagaaggtgcatttggtttgctattgaattctgttgtccttggaattagctctttcttcattgaaccaatgtgtaaatggatgggtgcaaaattagtatgggcactgagcaattttatcgtctttgtttgcatggctagcactgctatcattagtcttatttccataagagattattctggagggatagaacacgtaattggagcaaatgaagcaatcaagattgcttccttggttgtgtttgttcttcttggttttcctcttgcgattacctatagtgttcccttcgctgttacagcagagttgactgctgattcaggaggtggccaaggattggctataggagttcttaatcttgcaattgttattcctcagatgattatatcccttggttctggtccttgggatgctctctttggcggtggcaatattcctgcatttgttttggcttctttgtgcgcccttgctggtggtgtcattgcaactctcaaactgcctgatctctctagtagttcattccagtcaacaggatttcatattggctag

SEQ ID NO: 66527 - DNA, 1165 bp, Glycine max
  Peptide Sequence Number=SeqID_183305
atgtcgtggacgaaacagaacgaagtgggagtagaagtaactcttagcatagatcatcttagctcttccattgaagaggctctaccatgcaactctctgttcttgtatcttttcaagtttccttttgattccctcatcatgaccaacgatttgcttccacaagatcaatccctgaatgttcacaatccatactatcttcatccaggagaaaatcttgcgattgcactggtttctccagttcttgattcgacgaattacaatttgtggagtcgttcgatgcttattgcattaagtgcaaaaaaaaaaactgattttgttgatggatcaatccaaagatatgcctcaaatcatcctcttcaagcagcttggaggagatgtaacaatatggtgatttcttggcttgttcactcggtctcgccttcgatcagacaaagcatcttttggatggataatgcacgagatatatggaaggatttgaagttgcaggattcacaagaagatttgttaagaatttcagaattacagcaagacatggcctctataagactaggtgatcaaaccataactgattactttacaagattgcgcgtgatttgggataggcctgatccagtgtgttcatatgagtcaaagaagaatggttttcctcataactatgcttctagaggaggaagaggtaatcaaagcagttatagcaaagggaattcaggaggaaaaggaaacaaactctgcatacattgtgatttcactaaccttactatcgatgagtgttacaagaagcatggttatccacttggccacaagtttcaaaaatctcaaagttcaaacatcaacaatgtcaatgatgtgaaaaaagaaggtgacaactcaactacagatcaaaaccaagagacacacaatgaggaagtgaagttaactcctcagcagtacaaagctttgatgacactgcttcaacaacaaggctcaacccacaaaacctcacaagtgaatcaaattggtacattcaacaataaaggtagtgtattgtccattacttgtagtgtaagcaagactagtcaagatgaatggatccttgactcaagtgccacagatcatgtcacagcctttcctcctttattctctttatgcaagaaaataaatcctataatggttaggattctcactg

SEQ ID NO: 66528 - DNA, 342 bp, Glycine max
  Peptide Sequence Number=SeqID_183306
gaagatgctctagctagagcgcaagctgcaaaagctgtgcaaatgagatgcatagctgtaaggaccacattatcagatgaggctctagaactagctggcccgacacttatccgagataacataggaagtgttttgcttaatgatattctcagtggtggctctgttactaagccaggtttaagtgtgcacactgagaatccacaagaagttgtagaatctcttattccacttatggaggaagcagaagctgttgttccttacgaattgcaccacaggatgccagttaaacttggagtgcgtattcctcaacttaataccatgaaaattactttatttaattag

SEQ ID NO: 66529 - DNA, 471 bp, Glycine max
  Peptide Sequence Number=SeqID_183307
atgtcacccccaaatcaatgggcaaatcaaagtggcaaattgacaggacctttgactaggtcaaggaccaagaagcttgaagaggaactcgagaaaactcaacgcacttggggagcatggagtagagagattggatttgaagtggctaaatttgaatcaaatattagaataggtatgagcctagatccttgctgtccaaggtgtggtttgaaggaggaaacactaacacatgcattattgacctgtgaggaagtcaggagatggtggttcgcatgtcctcttgcaataagagtggaagagaatgaggaaatagatattctgcagtggatagggggcatgagtatggggatgatattgaaagatgatgagggaatggtgcttttctcggcatccaaaagagaggaacaatgctttagacctgtgattgcagaggccctaactcaggtggagtgtgaaactagttttcgatag

SEQ ID NO: 66530 - DNA, 864 bp, Glycine max
  Peptide Sequence Number=SeqID_183308
atgacgacggggaagtctgatttggtgtcgatccgcgttccctacaagaacctccacgacgattcctccgcccccgaactcgaactcgtcgacgtccaccaccgcggcaaccaccgcaactcgccgccgccgaatcactctccctcgccgccgaacagcaacaacgctccgctgcttcatctcgttctcagttgcaccgtcgccgccggcgtccaattcggctgggccttgcagctctctctcttaacgccctacattcaggtccctctccctctccctctccgactgaataattttgactttttcgatattacggtttcgtcgttgaccagatccttctgtaatcggaaccggatactctacgtgtttatattcaactttccgattaactgtgtgcttagttattgcgttttggtgcagacgttgggaataggacatgcgttttcttcgtttatttggctctgtggccccattacaggtcttgtgagaattataaacagtgtgatacgtacaagtttatgctttgctcttgttggtttggaactagaaaatcacaagacgaccattcattctggcaggatctcttatgatatgtctggctacattggatatgtattaggtgatacacacgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctgtattttgctcgtggatggcagttgggaacatcctaggatattcttcaggtgctagtggaaagtggaacaagtga

SEQ ID NO: 66531 - DNA, 363 bp, Glycine max
  Peptide Sequence Number=SeqID_183309
atggaggatttattggagacatgcaacaattcctgtgacatctatgtacttgggtttcaagaaattgtgcctctaaaagcatccaatgtattggggtatgaaaacaataagatctctaccaagtggaattccataatcggaaaagctctaaacaagagcacacatcacagtttcagagatgataaaaaggaggaggatgtgaagaacaatatttgttgcaataataaggaagctggaaataataataataatccaggtcagcagtgtgaagccccacaagatttcgaatgtatcattagcaagcaaatggttcatatattgatatcagtatgggctaagagagaacttcgtccattcatttaa

SEQ ID NO: 66532 - DNA, 222 bp, Glycine max
  Peptide Sequence Number=SeqID_183310
atgaaaagaactattaacatgagggagagagagagagaagggtcggggtcggggtggatacaggaatcccatacccgtacccgtacccgacttttggttatctgggaaaacccgaacccgaacccatacccggttaactcgggtattacccgtcaaagtcgggacgggcttgggcgggtacccacgggtacggattttcttgccatgtctaagcctaggtga

SEQ ID NO: 66533 - DNA, 456 bp, Glycine max
  Peptide Sequence Number=SeqID_183311
atggataatatgcataatcatcatgaatcaataggtctttttaaggagagcaggcataaagatttggctagtagctttaaaagggcgattacttcctatcctttcatgcttttggccatgttgtcgttatttttcttccatttcgctctttacaacaactccacacatggttcagagaccacgggtgagggttggggtcctggcattgccggtgcagtgtatactgatagaagctatcattcaactgcacctagcccctatggtttgttgcctgctggtcaaccaaatgctacatgtatgcgtgcatctagagcttcatcctctgcatgtgagttgagatggactttagggacggtggttgatatggaggcggtggtggtgcgtctgctgccggctgctgctgctggtcttgcctcgactgctatgcctaccttggtatgcaatacttctcaatga

SEQ ID NO: 66534 - DNA, 531 bp, Glycine max
  Peptide Sequence Number=SeqID_183312
atgatgattgcacacttcaagtacacacatattgatctgtgggattttgtagacaatggaaaccatattccatatgatgttgagctaaatgagatccacggaagccagtggacggaggagcaaaaacaaatatttatgcttaactccaaagctctagatgttctatcgtgtgctctctctgaagaagtatacacaaaggtccttgaagaacttgttggaaccttaaaggtccatgaacaagaacttcaacaagatgaaggaaccaagaagggcaaatatcttgctctcaatgcttacaaattaaagaaagtaccattgtccaaggaattctcatccaggccatcgtctaaaagtgtatccaaagcattgagcatggacaactcttctaataaggaatttgaagaagaatctaatgaggatgatgagttggctttaatatcgagaaagattaggaagatgtggaagaacaagagtagatctaaatggaagaactcctccaagaaggtgttcaaggagaagaaaggtagataa

SEQ ID NO: 66535 - DNA, 306 bp, Glycine max
  Peptide Sequence Number=SeqID_183313
atggaggctctccctatcatctttaatgatattgtgtatgaccttacaaagatagatgaaagggattttaaggatcagaatgaaggacaagcaaaatccattactgctaaggctgatgaggtcgtccaattgaaactacaacaagctcaacaaaacatgatgggtgttttcatccaaccacctcttatcgtccaacaactacctacaactggaccatctattgaacaacaaccaactccaaatatcctacctgcacctgttgaaccaacaccaccaccaccatcttcaccgccactagatcaatga

SEQ ID NO: 66536 - DNA, 462 bp, Glycine max
  Peptide Sequence Number=SeqID_183314
atggctccgaagaagctttatgctaaatgggctaggaaggccaccgcaggggagggatctagtgcaaccccacaagcggaaattgagtttgacgggtaccgttttcgatgcaaggagcatcaacaccctttcgatatgattaaggattggcattggacccagctgacggagcccatggctaagtatgaccctgagatagtcatggagttctatgcaaacacttggcccactgaagaaggagttatggataagatcttcttcaccaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 66537 - DNA, 1020 bp, Glycine max
  Peptide Sequence Number=SeqID_183315
atggcagctaatcaggttcagacacttatggagtatctgacccctaccttggggaagccaacaccatccaacttcctaatctacatatgggagtcatatttgacttcaagcatgggttcctacaaatattggagaacaacacgttcagtgagtacattaaactctatgtttttcctttctttctcaatgggaaggtatagggttggttgtgcacactatctgagaacaatatcgctacatggaattagtgcacaagtgcctttacaaaggtatttatctcccataaagatggatcaatacatcagggacattggaaatgttgagcagagagatcaagagagtctacctgaagcttcaaagtggttgcaaaagatgatcagaagatgtccacaccacaacattactcaacagagacttgcccatattttctatggtggagtgtcctcacacaataggacaggtttagatgttgcttgtgaggatatgtgctctaacccatataacaacttaggggatatgaggattatgaagaaaggcatcaaccaggtagagaaagataatcccctaactgagttgggaaagcagatgcaagctctaacactgaagattgagacactcatgatagctcaagctcaaaagcaagaggactctgaggagaaggaatgctctttcccaaaagctgcagattatgtccttactaagaagaaccaaacacctaagaaagttgaggttcctactgatgggaatctagtgctaatgaaggaagggggtgaaaagaaggagatattgacatatccacaagctcgtataaatttgatcccttgttccatacttaagaagttgggcatcacaaacttagaacctagtaacatcactcttcaccttgttgatcattcagttatctatcctagaggggtgattgaggatgtgctggttaaggtggacaagttcatcttttcggctgattttgttattttagatatggaagctgatgagaatgtccctatcatattgggatga

SEQ ID NO: 66538 - DNA, 171 bp, Glycine max
  Peptide Sequence Number=SeqID_183316
atgggagtgaaaggagaagggttgagggtgcaggaaagtcaaaaggataataaggagactgtgaccactattggaccggccgtcggagaagttgatgatgggaagcccgaaagaaagaagggaggaagtggaaaacaagataagaaatcacggggatggggtagccggtag

SEQ ID NO: 66539 - DNA, 261 bp, Glycine max
  Peptide Sequence Number=SeqID_183317
atgatattcataaggaaaaggctgcaatgcgaaaggtatttctctcagctcaaagattatatcacaattctcaacggtgagaattctcgtaattgggcttcaaacatggtgctcaaatttcatgacgatccaacggtgaacgagtccgagattgtcgtttttctgagacaggttaggtggcctacgggaaaaagaaagggttttggaagaagagaaaagaaacgaaattgtgaggcagaggaggctgagaagtcagtctga

SEQ ID NO: 66540 - DNA, 312 bp, Glycine max
  Peptide Sequence Number=SeqID_183318
atgacgttaaacgggaacttactgggagttaccatttacactaaagagcatttcgtccccacacttttgtgcattgtgcccatcttctgctgtgcatcaagtccttgcatttcctttgcattttctgcttcttcgtgcatttcatacatcaatccaagggcttttgctgaaaaaaggggtgaaaacccctgtgtatttctggaaatcacgatgaacatgctaagtgcgcctgctgtgcttagccggttcatcgcatctgatgaatattttgatttccaaatgatcgcgctaagcccgaccctgttgcgctaa

SEQ ID NO: 66541 - DNA, 498 bp, Glycine max
  Peptide Sequence Number=SeqID_183319
atggctactccacccagctctcctcctccttctcctcctcctcctcctcctcctcctcctactgaagttgcatcacagtcgtcgtctaccttgaagcaaacacgaaaagccacacaactaagatcattggcgactagaccacctagggtagacagactggtggtccacgtcgatcttgcgatcgggaaggccgacagtccccacaagaagaaactaagaacatatttggggattgtcactcgttataaggtcgatgtgacatatgagaattggaagcaagctgaatttgatatccctgaagcatctggtggtaggacaaaaaagaaaatacttcagattgtgagggagtggtggacacagtttaagtctgatttgacgttaaaatgggcacttgcagccgacaaggacagtttggatgacactgtttgcgaaaaatacgacactagcaaggagaaatgggcccaattttgtcagagccacagagacccctcatgggag

SEQ ID NO: 66542 - DNA, 654 bp, Glycine max
  Peptide Sequence Number=SeqID_183320
atgggtgtgcattttttcaactttgatcatttgagaattaaacttcaaagttcagacttctttagaggcactaaatttcgtgctcttctcttcctctcccttcattcatcttcttctacctttaagctcttatccatggcttcctatggtgtggtgtctccattcatctttctccttctccattttgctgcaatcagacctcaagaagcaaaggaatccattgatgaagaagatccaaggcctacaagctccacatggagctacatcatcctagctgttgcttcctcctctgacgccactatcgcgcttagagcgagtaagtggatttgggcttggcaccaatgctgcgctgagcctggcaagagacagatgactcgcttagcgactgatctcgcacttagtgcgctgcttcaattcaggtgctcttccagattccttcttcacgctaagggcactgaagccgcgcttagcgatggatatgaactaagcctactaagttcgcttagcgcaatagccactttggcacttcaagaaattagctcctttttacctgaaattgtacagatgttaacattaattccaataaaagagaccttaatgacagagatcaaaatacaacaaagtttatttaaaattcctacaaaagaactataa

SEQ ID NO: 66543 - DNA, 234 bp, Glycine max
  Peptide Sequence Number=SeqID_183321
atgctgaagaccgtgaaagctctctttttcttgtccatcgccaccttacctaggtttgttcctgtaacacatattcatgtatgtgatcctggaaaccaaattgagcttcctggaagaaagttagtagttgattccagggttttacacagttctgttactgttgttattgtttcaccaggtcatcctcaatcccaagctaaagaagaataccaccaggagtaccctattctttga

SEQ ID NO: 66544 - DNA, 375 bp, Glycine max
  Peptide Sequence Number=SeqID_183322
aaagtgaaggtcggtgttgaggaggttaaagatgcagatgctcctgttcctgtacccactgacgagtttaacttagtggggcagacacttaacaccttccttgcttggccgacacatctcatcaagcgtttatcagaacatggagttgtgggactagcaaaacctgcagataggtcggatcatgaggtcgatgatccccaatatctgatgacattgatcatcccagagctttttttgaagtcgttgcaggttatgtgggatgctaccgtgtttggggtgtttaatcaagactttcccttgtacataaagcatgaagatctgtctgaaataacacacggtggtcaatgtctcagcatctctgttatacagttatga

SEQ ID NO: 66545 - DNA, 339 bp, Glycine max
  Peptide Sequence Number=SeqID_183323
atgatgagttttaatgtggcgaggttgcaaggcttgcgttgtttagccttgatagtggcgaggttcttgagtatcaagttttttgttaaaggagacaaggtttcttcctttgaccttgcagctagttggagggcttatcaggataattttcgtccttcatctgtgagatggattccagatgtgagcataagttcagcacctcagactggcggtgaggtgggtctgccagccagagaaagatatgaaggattaaaagataaagaaactcaggatattattgcagaagaaggctgttttattgatctggaaagcagagtacattttacaaagagatgctaa

SEQ ID NO: 66546 - DNA, 159 bp, Glycine max
  Peptide Sequence Number=SeqID_183324
atgcatatgacacggatgcaatttacgaatacgggagcccgagaaactgtctccttcttagatacaacgtctaggggtagcaaagttccccaacaggggatcaagacagaacccatgtgcgatgcaaatgcgaaaggcgcaacacggaaatgtacatag

SEQ ID NO: 66547 - DNA, 625 bp, Glycine max
  Peptide Sequence Number=SeqID_183325
tcttcggctaaacaacaatgaagttgtggatgaaattcattaccggcgaccagtggaagatacaagtaacaacatttactttgaaagtatgcaattgaaaaatgacatggatgtgaacaccatgttaatgtataatgatgaattttcatttgttggaccgattgagttgttatgtaccgttggtagaacaacagatgcaattttaaacttacttgaatgccccagcatccctacacatgatgcggttctgtattacaacggaaggtggaacatgtcacgccaaaacaactttgtgggttacgcgttcaccggaataaatccaaaaaaatttgatattccaaaaggatgtagcatagatcaactgaaggatttgatcaagcaagtagcacctaaagggaatcctcctcatgggattcacgaatcccaagttgtaaggcgtttgttttatcgacaacctagtcatttggagtattttgagaaagttttagaatttaaaattgttgagctgaaatgtgatgacgacgtgctgaaggtgctggtagagtctaattactggaaacaatttgtgtcaatagaaattttggctctctttcataaagtggttatggaaaatgaggacgatgtg

SEQ ID NO: 66548 - DNA, 978 bp, Glycine max
  Peptide Sequence Number=SeqID_183326
atgagtagtgttttttcagaacacaaattccaacttcaaccctcccaccaacttctctccctcaagaaatccctcggagacattgacatcccagtcccaccaaggaagctcctcacccgccgctccgccgccgtccacgacggctccggcgacatttatctgcctcacagtggctccactgactcctccaccgacgatgactccgatggcgacccctatgcctccgaccaattccgcatgttcgagttcaaggtccgacgatgtagtcgcagccggagccatgattggacagactgtccctttgtgcatcccggtgagaaggcccgtcgtcgggaccctcgccggttttattactctggaacagtctgtccagagtttcgccgcggtcagtgtgaccgcggcgatgcatgtgagttttcacatggggtgtttgagtgctggctgcacccttctaggtataggaccgaggcttgcaaggatggcaagaattgcaagcgaaaagtttgcttctttgctcacacccctcgccaactcagggtttttcattccaatgacaatagtaacaagaaaaagtgcaccgatataagccctcataataacaacaattgttgtttggtttgtcattgctctaattctactcgttcaccaacttctaccttgtttggcatgtctcatttttctcctccattatcaccaccttctccttcttcgccttctatgtttgagaccaacaaccatcatcatggtgttgtgaaatataataaggatgttttctctgagcttgtgtgttccatggagggtttgaattttgatgaggcttcttcactgttgtctgctgcttctaagcctcatcatcacaacaatttgtcttcttggcttgatgtttctaaggatcacaatcaaaaacaattatatgcaacatctgaagaagaagatgatgatgatgacaaaaagagtggttcgtggtgggatttgtga

SEQ ID NO: 66549 - DNA, 402 bp, Glycine max
  Peptide Sequence Number=SeqID_183327
atggtcgccattttgccaaagggaaatcttgttgtctggttttgttccttgcataatgggccaaacaactaccttaaaggaataattaataggtcagtgttatttttcaatacatttgcattaccattactcaacagatacattgtactaatgttccctgtattcaacaatgctttgaaaggacttgatgatactccacaacctaaatccaaggctagtgctaggtggattgttgttaaatgtaatagacaaaaaggaagcactgagtgtggctattacgtgatgcactggatgcccactataatcttaggaagtttcaggaataattggaaaacgaccattggaagcagagagattgaaggcgcttcgcatccagtgggcacaacattatctcaaagttag

SEQ ID NO: 66550 - DNA, 432 bp, Glycine max
  Peptide Sequence Number=SeqID_183328
atgattcatggattgcttttcttccccttatcaccactaccgccaccaccaccgctctcgaacaaagtcgtcgtcgcgtttggctcgaaagagcgaaaacggaacggtggagccaattcaaatttccctcgacacggttacgtcgccgccgccggcgaccgcgaagccttcggcggcgtctccgacgagctctcttccgatcaaggagcttctgcttctgtcgccttcctcggcgcggaggtcgaaggcgcggttcgacgaggaggtgccggaggccgccggagtgcggcggcggtgcaagagccgggcggcggcggcggcgcaggcagcgtcgccgaggagcttgcggaggtggagaagggaggagaaggagggagtggcggtggaggaggttgtgaaacagaggaagaggaggcacagtgggagacatag

SEQ ID NO: 66551 - DNA, 174 bp, Glycine max
  Peptide Sequence Number=SeqID_183329
atgcgccaacagagtggagaccgagaggcagcgatgacatggagatcgagaggcatgagaggcagagaggagccgcgagaggtggcagtgccggtggtgagggagtttcaatgtcgcaagtgcgaaagtgagggattccgagtgagagtgcgagctagaaatgtttcaaagtaa

SEQ ID NO: 66552 - DNA, 1178 bp, Glycine max
  Peptide Sequence Number=SeqID_183330
atggctacaccacccagctcccctcctcttcttcctgagtcagcaacaccttcgtcatctatgtcaaagaagacaagaaaagcaacacgactcagatcattggctactagaccaattggtgtggagagactagtggctgaatttgatactcctgaagcatccgatttgaggacgaagaaaaaaaatacttcagaccgtatgagagcgaaagcacaagacattcagaaacaaaacattgcccctcatgtgttgtctcgtgggggttatgattatctagaagaaaagttgatggaggacaagaaaaataaacgattggaggaagcagcccaatccaagagcattggaacaatatttggtcttccatctcccattagacaacatgtgaagtggaagatggtccgcacgaaaaaatcttgtcaaatgacgtataaggcagcaaaggaaattgcagattggattgcctcacagggaagctttgtcgcccatgaacgtctggatgtactgactactgccattgggcgaccagagcaccctagtcatgtccgtgttgctggagtcggtgtcatgatcaaacaatactttggattgacttcaaggagctcccgcacatctatgtccatggctcctaaagacctggagcaccagatgcagtcgcagatgcaatcacagagactcgcactaccacatcagcctaagcctggtccttctattgcttgtgttagcacaaaggaaagttgtgtcgatccctcagggcaggacctagacactggtgactcaaagaaatgtgggttgtatgtcgatgagaatcctcctcgactggttgcccttggaagagtttatgaagggtcgatgaccatccacagctttcctttgggcaatgatcaagtgaaggtcggtgttaagaaagttcgagatgctgatgcacatgttcttgataaacagggagctaagggaccgacgaaacttgtagataggctggatcctgatgttgatctcctatacctgatggcattaaccatccaacaacttttccttaacccgttgcaagtgtcatgggatgttaccgtgtttagggtgtataatgatagcttccccttgtacataaatcatgaagatcttttagaaatagcacttggtggtcaatgtctcagcatctctgttatacaattgtggatcat

SEQ ID NO: 66553 - DNA, 159 bp, Glycine max
  Peptide Sequence Number=SeqID_183331
atggagctcattgttggaggtagatgttggaaatcaagagatttggtgaaagactacagcagaacctgtttctttgtttatagcaacatcacaaccgtgccggaactggcactaccaaccaccatcggtcgaaagttcaacatctttctcacgaggtaa

SEQ ID NO: 66554 - DNA, 693 bp, Glycine max
  Peptide Sequence Number=SeqID_183332
tctctagtagaagagtctgagacattcccgtgcttgacatttcagcattttctcggccatatcgcgattggcaattctcttgttgggtgtttcattcttctcaaactcagtttgtcaaaggttgagaaaaggagttttgccaagctgaaagaagatgacattttacatctagcaaaattgattcttcctgcactaaattttgcaatttcaaagactagagaactgttttcaggagaaccgtgcatgaccctgaaagtggctcctttccttctactaggagcggagtatggtcatcttattacaatttggaggctttgtgccattggattttttgtcagcttcagtgtaccaaggctttattcttgttactctgctcagataaacctgcgagtcgagtgcttgaaattgcgattgttggacacatggagtgcttgcactcacaagaagatagtgattgcatcagtgcttattgcattctggaatctatctaccataaagactcgaatcttcacagcatttatattgcttgtaatactccgatatttccgggaaactataatgcaacctgtagaagatggtgaagctcaagtggcagagaaggaacagaagcaggcattggtggtggtggcagaacctgaggaagaggaaccgcagaaggcactagtggttgctgaaaaacagcgccaatgctag

SEQ ID NO: 66555 - DNA, 765 bp, Glycine max
  Peptide Sequence Number=SeqID_183333
atggaagggataatgatgatgatggaacattttggtgttgatggagacccaattgggataattggagaaagattgttgcttttggagaacaaaagaagtgccactcatgctcaagacccaactgagcaattggagaaaagcttgttgcttttcgccttgaattgcattttgaaaccagaaaaatttgagaaccactactttaatggtagtatttggggaatggacgctattgggagtggttgttgggggctgtggaaatggaatccgttaccgcagtctcgacggcgtcgtattcgctccaattcgggttcggcggatgcggccggcggaggcggttaccggtttccggtgaagcaggcggtgaccgccgcctccctcgccctcaccggcgacacaatcgctcagctcagccaccgttggaggaaagcaaaggagggcggtggcagtgtttctcaggatgaattgtggagatacctttcagaccatgattggctgcgtgctctgcgaatgacttcatatggattccttttatatggtcctggttcttatgcctggtaccagtgccttgaccactgtctccccaaaccaacagtccagaacctagtgttaaaggttgtactaaaccagattgtgttaggtccatgtgtcattgctgttgtttttgcatggaataatttatggctacagaagctctctgagcttccagaaaaatacagaagagatgctcttccaacgctactttatggtacaaaccttgttgcctaa

SEQ ID NO: 66556 - DNA, 366 bp, Glycine max
  Peptide Sequence Number=SeqID_183334
atggcatccgccgccgccagatcgatattccgatcatgctccgccagccggtcagcgtttcgcgtcgcatcggaatccaaaccggttcgttctccgttccgtatcgcgtccaataagcctctctcgcagtcccaatccactctcaggttccccgtggaattgagttcgtgtgttgaatcgatgatgccgtaccacacggccactgcttctgcgctcatgaattccatgctttcaatttcaagccgcacgagcgcttggattcccgaaggtatcgtcaattgtgctaatacttttggaaattcaatgcgtttgcgtgaaattttgaatggctttgctttagttagtggaattgttgactctgtataa

SEQ ID NO: 66557 - DNA, 1005 bp, Glycine max
  Peptide Sequence Number=SeqID_183335
atgggatggtacagaaggggaaagcttgctcttgatcgttttcacagcttggcttcaagggtcgtgcctcaaaatcccatttttcagcatagttcaaggatttggcaatctggctatttggattcaggttcaaaaggagctagatttagtgggttgtctttgtgttgttcaatttctcagagactaggagcacaaggtgttgttggagttaacgggaactttcacaatccgtttcttttgggggctaatagattttactatgttgatccttgcaatgtgcgccatttcaagccaagggggccaaggcattggtttcagaattctagacatatttttgttgctgtgatggttggttgggttttaatcactgtgttttttgggaacttggaaacagttccttacaccaagcgaacccatttgattctgttgtcaaaagccatggagaggaggcttggggagagccagtttgaacaaatcaaggctgattttgaggggaaaatattgcctcctatacatcccgaaagtgtgagggtgacaatgatagctaatgaaataattgatgcattgctgagaaggttgatgaaggagcaggggtggaatgattttgggtatgcatcagagcatgctatgccggttgaaggagatggaagggagacattgagtgcattggttggtagtgaagagaaggttgaagggagttgccacaaggagaataagattcttgatggaaaatgggttcgactaagccggaaaaatggtcaggaaagagggtcactgattgctacatcacatttggttggattggattgggaaattttggtggtaaataagccggatcttaatgccttctgcttacctggtgggaagatagttgtgttcactggcttgtttgatcattttaaaagtgatgcagagatagcaactattattggacatgagaaaaatgatatttgtcacgacatgttgaaatatgttgagttgtggagcaatgttgctgcattgtag

SEQ ID NO: 66558 - DNA, 2139 bp, Glycine max
  Peptide Sequence Number=SeqID_183336
cataatgcagaacctgaagctgttgatcttttgatggaggttgaagatctggatatgttgagtggacatgttgacaaaacaaattttaaaaggacttgcctatatctcaccagttctgcaagatacctcccaggaccagatgatatgctagttttggacattgcatattcaatttacaaacaatttgaagaatatccaaatgcactccaaattgcattgttcatggataattcgcagcatgtgagggaggtgttcacctcttgtaatgatgtgctgcgaaagaagcaattctgttacatgcttgcacgtcatggaattacttttgagcttgatgaggagatggttccagatgatgaagacagagaattgttgcaggaaatcataaacaattctaagttaagtgaaggatatctcacccttgctcgtgatattgaagtcatggagcccaagtcccctgaggatatatacaaggtgcatttcatgctaaagcagcagccgcatgttctggcacatttgcttgatggccgggctagtgctggtgcaagtgttgattcagctagacagaaccttgctgcaacttttgttaatgcatttgtaaatgctggctttggtcaggataaattaatgactgttccatcagattcttcaagcagtgcttcttctggaaattggcttttcaaaaataaggaacatgggaagactagtgctgcagctagtctgggtatgattttactctgggatgttgactcgggacttgctcaaattgacaagtacttccatagtaatgataatcatgtcattgctggtgcattactgggagttggaattgtgaattgtagtatcaagaatgactgtgatcctgcaatggcacttctaggtgactatatagataaagaagacacttcaatcaggattggtgcaattatgggtttgggaattgcatatgctggttcccagaatgagcagttacgggagaaattgacaggtgtactgaacgattctaaagcttcacttgaggtgcttgcatttgctgctatttctttgggcttgatctatgtgggttcttgcaatgaagaaattgctcaagcaattatatatacactaatggaccggagcgagtcagagttgggagagccccttacacgacttttacctctcggtctgggtcttctatatcttggaaagcaggacagtgttgaggcaactgccgaagtttcaaagactttcaatgaaaaaattagaaagtactgtgacatgacactcttatcatgtgcctatgctggaactggaaatgttctcaaggttcaaaatctgttgggtcattgttcacaacatcttgataaaggtgaaactcaccaaggtcctgctgtgcttggaattgctatggtagctatggctgaagaattgggacttgagatggcaattcgatcattagaacatcttctacaatatggagagcagaatattcgccgagcagttcctttggcccttggtctactctgtatatcaaatccaaaggtcaatgttatggatacgttaagcagacttagccatgatactgattcggaagtagctatggcggcagttatatccttgggtctaataggtgctggaacgaacaatgctcgaattgctggcatgcttcgcaatctttcaagttattactacaaggataccagccttctattctgcgtgcggattgcccaaggtcttgtacatttgggaaagggcttattaacccttaatccatatcattccgatcgcttcctactatcaccgacagcacttgctggattaattaccatgttgcatgcttgcctagacatgaaagctattgtgctgggaaaatatcactatgttctctacttcctcgttttggcaatgcagccaaggatgttgttgactgtggatgagaacttgaagcctctgtcagtgcctgttcgtgttggacaagccgtagatgttgttggacaagcaggtcgtccgaaaacaatcactggctttcagacccactccacccctgttctcctggctgctggggacagggctgagctggcaacggaaaaatacattcccctatcaccaattcttgaaggtttcgtaattttgaaggagaatccagattacagggaagagtga

SEQ ID NO: 66559 - DNA, 1263 bp, Glycine max
  Peptide Sequence Number=SeqID_183337
atgcctactcttctctacaatgccctcatcagtgcctatcacattcacaaccacaacaaggctctttccattttcactcacatgcttgcaaaccaagccccgcccaatagtcacactttccctcctcttctcaaaatttcccctcttcctttgggtgctacccttcactcacagaccctcaagcgtggccttttatctgacggcttcattctcactaccctccttgctctctatgcaagaaaccacctccttcctcatgcacgcatggtgtttgaggaatttcccatgttttgcattgttgcgtgcaacgcaatgatcaatgctttctccatgaatggggacatggaggctgctgtggctctctttgaacgcatgccccgaagggatgtcttctcgtggacgactgttgtggatggttttgctttgaaggggaatttcggtgcctcgattcggtttttcaggaacatgatgaatcataaggatgtggtggccggtttggtgaagcctaatgaggctacttgttctagtgtgctctcttcttgtgccaatttagatggtaaagcagctcttgattggggaaaacaggttcatggttatgtagtgatgaatgaggtcaagttgggagtttttgtgggaacttcgttgatacatctttatgggaaaatggggtgcttgagtaatgctgagaatgttttcagagtaatggttgtcagagaggtatgcacttggaatgcaatgatttcttcattggcttcccatggtagagagaagaatgctctggacatgtttgataggatgaagcttcatgggttgaaaccaaatagcattacctttgctgcagttcttacagcgtgtgctcgaggaaatttggttagggaaggattggatttgtttcgatcaatgtggtatgactttggaatagagccaaatttgaagcactatggatgcgtgattgatcttttgggtagagcagggcatattgaagaagcagctgaaatcataagaaatatgccttttcagcctgatgcatctgttttgggagcatttttgggagcatgtaggattcatggagctattgaactaggagaagaaataggaaaaaatatgcttagattgcagacacaacactctggccaatatgtgttattgtcaagcatgaatgcggagaaggaaagatgggatcgtgctgctaatctgaggagagaaataatggaggctggaattcagaaaattccagcatacagtatgcttcacttgacataa

SEQ ID NO: 66560 - DNA, 633 bp, Glycine max
  Peptide Sequence Number=SeqID_183338
atggctttgttgctcaatatcagaacttgcaattggagcatcgaagtattcaaatctgattcttctccatttactgttagtgaagtagaggccttgcatgaactctacaagaagttgagcaattcaattattgaagatggtcttattcacagggaagaattccagctggcactattcaggaataaaaacaagaaaaatctgtttgcagataggatttttgacttatttgatctcaagcgcaacggggtcattgagtttggggaatttgttcgatcactgggtgtttttcacccaaatgcagcattagaagacaagattacctttgcttttaggttgtatgatctgaggcagacagggtttattgaacgagaggagttaaaggagatggtattggcacttttgcatgagtcggatcttgagctttcagatgatatgattgaaaccattgtggataagacttttagtgatgctgatataaacggtgatggaaggatcgatcaagatgaatggaaagcatttgtgtccaagcatccatccttgataaagaatatgacacttccatatctgaaggatattaccttggcttttcccagttttgtcacaggaacggatattgaagagtcagagatgtga

SEQ ID NO: 66561 - DNA, 1755 bp, Glycine max
  Peptide Sequence Number=SeqID_183339
atggagtatggaaggttgggaccctctgatcctggtggctcctcgcgcctcaacaacgttcctccgacatcttccgggaggaagaagattgtcttgctttcactctttagcgtcttgttaatagccgcgtctgctgtaactgcagttgtcgtccgctctcgtattcaacaaaatacgagagcccatgagactaggctcggaaagcccactcaagcgatttcacgcacgtgcagcaagacacgctttaagaccttgtgtgtcaaatcgcttttagactttccgggatctgaagaggcgtcagagaaggacctcgtccacatttccttcaacgtcacgctgcagcacttctccaaggctctgtactcctccgcggccatgtcctacaccgccatggatccccgcgtccgcgccgcctacgacgactgcctcgagctcctcgacgactccgtcgacgccctcgcccgctccctcaacacagtctccgtcggtgccgtcggctccgccaacgacgacgtgctgacgtggctcagcgccgccctcaccaaccaggacacctgcgcggagggttttactgacgccgtcggcacagtgaaggaccatatgtccagcaacctcagggacttatccgagctcgtgagcaattgtctcgcgatattctccggcgccggtgccggcgacgacttcgccggcgtccccattcagaataggaggcggttaatggaaatgcgagaggataatttcccgacatggttgagtcgacgagataggaaattgctgatcttgcctctgtcgcagatacaagcagatattgtggtttccaaagacggtaacggaaccgttaagaccatcgccgaggccattaagaaggtgccggaatatagttcacgccgcattattatctacgtcagggcaggaaggtatgaagaagagaatttaaagttggggaggaagaaaacaaatgtgatgttcataggggacgggaagggcaaaaccgtcatcacgggcggaagaaattattaccagaatctgaccacatttcacaccgcgtccttcgctgctagtggttctggtttcatcgcaaaagacatgactttcgagaactacgccgggccggggaggcaccaggcggtggccctccgcgtcggagcagaccacgcggtggtgtaccgctgcaacatcatcggataccaggacacaatgtatgttcactcgaaccgtcaattttaccgagaatgcgacatttacggaaccgtggacttcatattcggcaacgccgcggtggtgttccaaaactgcaccctctgggcccgaaagcccatggcccaacagaagaacaccatcacggcccaaaaccgaaaggacccgaatcagaacacgggcatttcgatccacaattgtaggatcatggccacgccggatcttgaagcatccaagggtagctaccccacttatctgggccgtccctggaaactttacgctagaactgtttacatgctatcttacataggggatcacgtgcatccacgtgggtggctcgagtggaacacttcctcctttgctttagacacgtgttattatggtgaatacatgaattatgggccgggttcaggtctgggccaacgggttaattgggccgggtatcgggttatcaattcgacggtggaagcttctagatttacggtgggccaattcatatcgggctcgtcatggttgccctctactggagtggcattcattgctggcttatcaacctga

SEQ ID NO: 66562 - DNA, 180 bp, Glycine max
  Peptide Sequence Number=SeqID_183340
atggaattgggagagggggtggtggtggaggaggaagcagaagaaggcggtaggtcctccgacctcctcctctccaaatcaagtaactatgcaccattcatttcatttgtgtctgttggaaatgatgtcttcctcggtgcttgtttgcctccttcttcggaagagagagattctgtttga

SEQ ID NO: 66563 - DNA, 612 bp, Glycine max
  Peptide Sequence Number=SeqID_183341
atggattttaacactatgtttaagaagtgtctggacatggccaaaatttcaattaaatttgcgtcatgggagcctatcaacatagtttttaaggtgaagatcaatgataggatccatgatatttgtgtcgtggaagaggattctgtgccagtgttttatggagaagttgaggctagaaagtcagtatcttcgtcttcgtcgaagatgtcgaagtggcctaagaaagggtggtcagagtggcaagaattttttgatgaggaaaattgtgttttcaatgtgaaaaataatgaagaatcgaggattgaaattcaaaaagatttagatgaaaataaggggtggggcaaaaggagattgagaatggacaaaatgatatcatttgcaaaggagggtgtgtgggtctgggccttggagccttatgaggtggagggcttttgtgtggctaagactagtaatgatgagtctgaggccttcttggaggctttgggtagggactggtattggggtgatggtgttgtaatggagtctaggaggtctaaatttaagggcagttttaaaaatccaatgaatggtgagggtgaagagaatgatatacaagctctagaaacatcataa

SEQ ID NO: 66564 - DNA, 222 bp, Glycine max
  Peptide Sequence Number=SeqID_183342
atggatctcaaaatcgagaacaaaccatacctgacccctcctaagcaacactgtaatcgccaaaacaatcagaggactactgctacagggtttggtagtggtagtggtggcaaacccactactttcttaacccagatcatttgtttcaggtgtggcaaaaagggcatatccatagagattgcccatatcccaagaaggaatagaatggtggggtctgaatga

SEQ ID NO: 66565 - DNA, 321 bp, Glycine max
  Peptide Sequence Number=SeqID_183343
atgttccctcatgggaaatgcacaggaaagggagttttcagacgtttccctactccaacatgccaaacaccactaatatatatgttattattcattttacagggttccataatgtacatccaaggtcactattggcaacatgaaggcaatctaagagatagcgaggataaatgggttcaaatgttccttatatacttggagtctagacccgatggactgcttgatgcacattctgtaaaggagtcttggcaagagggaaagggttattgtggcatgataaaactagtgggagtctgcatgtggatttcttatgtttattaa

SEQ ID NO: 66566 - DNA, 597 bp, Glycine max
  Peptide Sequence Number=SeqID_183344
atgggagatcgcttggaggatatgattcgtgaccttggacaagagtcttttcagcaagcccatgcccttgtgtatgaaggattgcagagtgacttaaagaagcctttgtatctgggctgcaagaattccttgacgctattgtctgtggtgttaagcttggttaatgtcaaggccaaatatgggtggagtgacaaaagctttaatttactgcttgaagtagtgcacgatctgcttccagaggaaaacacgttgcctaaaagctactatttggccaagaagatactatgtccgatgggtatggagtatcagaagattcatgcttgccctaatgattgcatactgtacagacatgaatttgaagaaatgtccaaatgccctaggtgtggggcatcacggtacaaggtgaaggatgataaggagtgcagttctgatgaaaactcaaagaagggtcctccagcgaaggtgttgtggtatcttcccatcattccaaggtttaagcatctttttgctaatgaagacaacgcaaaagaccttacctggaatgcaaatgggagaaactctgatggaatggtctatcatccggctgattcctcctag

SEQ ID NO: 66567 - DNA, 309 bp, Glycine max
  Peptide Sequence Number=SeqID_183345
attaacgaacaagtgaagttgattcgagagaagataaaagcatctcaggataggcagaagagctattatgatagaaggaggaagccactagattttcaggaaggagagcatgtgtttttgaaggtttctcccgtaaccggagtcggaagagctcttaaggctaggaaattgacgcccaagtatctaggtctgtatcagattttgaagaagattgggcctgtagcttatcatctcgccttacctctgaatctttgtaaggggaaacaaaagatatctcaggtggttagtcctttgaaatcttttgcttaa

SEQ ID NO: 66568 - DNA, 243 bp, Glycine max
  Peptide Sequence Number=SeqID_183346
atggcaaatggcaccgaagacgatgtcagtctcttcgtgtcaacgggctcgtttgccccctggttgatgaaaggcatgggtaaccataagcaaaaggatgtttatacggataaccacttgggtacttctgcctgccccctaactttacggcaaaaggatgtttatacggataactacttgggtatttccatctgccccctaactttacgggttaggatgatagagattgatggtgcgcagtag

SEQ ID NO: 66569 - DNA, 546 bp, Glycine max
  Peptide Sequence Number=SeqID_183347
atgacaaaagctgctctggctcataatcgggatcgggaggtagccgttcggattatctacagccgaaagcccatcccggttaggattcatttcctcgggttgatgctctatttcttcttggtgctcagcccttggaacttgaacaaaaatgggttcagttgttggaattggatctgcttcctcgattggtcccatctggctttcaaaggtggttggggtgctgcaagattcggtcaaacttctgtccctgatgtattaggtgcctgtgttaaagtagaaaggtttaagacagcaggacagctgaagggtgagattctttcttcagcggcggatggaaaggcaattctaacgcaactggcttttgcacatgaatcagaaaaggaagaagaagctgttgagtcagatgtggcattatactgttttcaaatagaatccctaaagaaagcaattcctgaagctagggagtctttggtacttccaaccaatgagagtcatttcaccgataaccgatttgaggaagaagaccccaacacctctatcgattga

SEQ ID NO: 66570 - DNA, 201 bp, Glycine max
  Peptide Sequence Number=SeqID_183348
atggccttgtggaggtttctaaggatcgttaatcccaatggacaaaccttggatcccattagcgcgggcgccggactttcgatctaccttggcgaactgtcgtcgagaaaggacaacaaggactttcccctatgttacgttttgtcaacatatactattttcatgggcggtgccgcgattactagcgattccccatgctag

SEQ ID NO: 66571 - DNA, 456 bp, Glycine max
  Peptide Sequence Number=SeqID_183349
atgaactactttagcgactgggggggccggttccctaaaccaagcctttccttctcttcttatagcatagcccttgcttgggcaaggaaaggctctaagaagaggttcgaaaaccttggattttcagttgaacccgcttacggacttgagttgctacaactggaaaaagggagcacagcggatcacgtggctcgatggaggttcctcagcgtcttttgtttgaatgactaccgccccggaagggaagatgaaagtgctccttcttcttcttactcccgcccgatcagggagaatgactcttttaaatataggatccgaccactatttggtacactggactatgttggtttccaagagatcactgataaacgggtactcccggatggaaggaagagtattaccggcgcccgcgctaatgggatccaaggtttgtccattgggattaacgatccttag

SEQ ID NO: 66572 - DNA, 264 bp, Glycine max
  Peptide Sequence Number=SeqID_183350
atgactaagtatagtcccattcttcaacattcggaatggcgatcttggcccgaccctctttcttataaggtacttttgctacagcagagggcagttgccaagagtggagttcacgtgtcccaaagggaagagctcttgagctccctctccctctattttaagacagactttgagtttgagcggggagggcgagatgacaagggaatcggccaaaggcatctatcatctcatcggagaagcggtcctaatctaataaagggttga

SEQ ID NO: 66573 - DNA, 314 bp, Glycine max
  Peptide Sequence Number=SeqID_183351
ggatagaaagtctatcaaaatccattggtaagctccagaatttggagaccttggatataagaggcacagatgtgtctgagatgctagaggagattacgaagcttaaaaagctacgtcatcttcttagttactatatatcttcaattcaatggaaggatattggaggcatgacatccctacatgagatacctccagtgattattgatgatgatggagtggtcattagagaggtaggaaagctagagcagttaagggaactgacagtgacagattttacgggaaaacacaaagagactgtgtttcttgataaatga

SEQ ID NO: 66574 - DNA, 447 bp, Glycine max
  Peptide Sequence Number=SeqID_183352
atggacccgggtatagggccccttttttactcaaacccgtgggtgcttagaatgcagtgtaaaaatgtggaaaagacagcaattattacattttacacagttcaacaaatgcacacacaaagtttcacaattccacaattccttaaaataggcctaactcacaaaaaacagtccccagtggagtcgccaactgtcgcaacttgcacttttgcgggcgagcgaggcgaggctctcgggaaaccagtcataaagaatattccaagttcgggagttgtatttacgtttgaggaaggtggacaaaagcggggtcttgctcctacataccctccattgaagaggaaatcaaacctacgcagttctttcaagggtgaatcaagcgattctttttacttggaaggtgatcattttaaggcgttggaccttaaaaatgatccatttacttggtaa

SEQ ID NO: 66575 - DNA, 474 bp, Glycine max
  Peptide Sequence Number=SeqID_183353
atgaacaggcacattgatgtggccctggtcaaggagttttactggaacctgtatgaccctgaagacaaatcaccaaaacaggttcgagttagagggaggctgattaaatttgatgctgtgtcgttgaatgcctttatggagacgccaccagtaattcagccaggggagcagtacccctcatactctattttttgtaggtcgtgcatggatcctcaggaacttgcctccaagctttgtattccagggcgcggatttgttcttaatgttgaaggagcggcctggaagctcctaaggaaggatctgatgacattggcccagacttggagtgtgttatcatactccaacctcacccccacttctcatacgcccgatttgaatatggacagggcgagatttcttagatggcccagtccaactcctcgaggttcgactttccagccctcatttccgcactctgcgtggcccgaggagtag

SEQ ID NO: 66576 - DNA, 255 bp, Glycine max
  Peptide Sequence Number=SeqID_183354
atgacctcagagcatcggcactggaatgatgatgctgatggagcagaggtgccggttagaactagagctgacggaagtggtggtgctgaagtaaaaggggctggagctggagaaggagcaagtgcaaaggaaacaggagtaggggcaacagctaaagatgaacactcagatcctcgagctcgtgccttgcgggtccctggaaattcgattgtgggatcatccagggctgagggactagaaggtcaaagaatctga

SEQ ID NO: 66577 - DNA, 998 bp, Glycine max
  Peptide Sequence Number=SeqID_183355
gatggccgccagcgccccgagctgatacaccacctgcgcgtacaccgtttccggcggcagctgcatgcgggtgcggccgaagttctcccgatcgggaaaactcgggtgggcgccgatcgccacgccgtactgcaatgcccagcgcaccgactgacgcatggtctgcgcatcgccggcgtgaaagccgcaggcgatgttggccgagctcaccagttgcaacagcgcctggtcgttggcgcagccttcgccgagatcggcgttcaaatcaacgatcatgtaacccccaggcaatctgtcgaaggaagagatcctgctcggctttggcgcgctgcgcctcggccagcgatacgcgggtaaccgccggtggtttgcgcatcggccatcagcacgatcggctggccgttgtgcggcacctgcaccacgccggacagcaggccgtgcgacagcatctcgcggtcggtggtgcgctccagcggcgtgccgccgtgcaggcggtagcccatgcggttgctctgcgggctgagctgccaggcggtgcgccagaacgtgtcctgcgcctcttcgctgaactcggcgtactccggccccggcagcgcgcggatgcggttggtgaacagcagctgcttcacgccacagcggtgttgcggcagcgcggtggatttgcccagcggcagccgatcgccgtccttcagattacggccctcgtggccgccaaaggcggctttcatgtcggtgctgcacgatcccagcatttccggcacggcgatgccgcccgagatcgccaggtagctgcgcatgccgcgtttcggcgtgcccagcgccagccgctgcccctttttcaccgggtagcgccagccggtccacagcggcttgccgtccagctgcgcgtcgcagccggcaccggtcaaggcgatccagccagggcgggtaaactcggcgctgaactggccgagggtgatctccagcccggcggcctccggcgcattgcccaccagcag

SEQ ID NO: 66578 - DNA, 426 bp, Glycine max
  Peptide Sequence Number=SeqID_183356
atgtctccttatcaggttgtctttggcaaggcatgtcatcttcctgtagagatagagcacagagcctactgggctgtaaagacctgcaacttctctattgatcaggctggagaggaaaggaagttgcaactaagtgagctagatgagatccgtttagaagcctatgagaattccaaattcaacaaggagaagaccaagaagttccatgatagtttgatagctaagaaggacttcgtggttggacagaaagttttattgtataactctaggctcggactcatgagtgttgagatcaaaagtgaatacacagataagagcttcaaggtcaatggacaccggctgaaaccattcctcacaaatccctccttagtgaatgtagtggtggaggagacctccttacttcaccctacttctcttccgccatga

SEQ ID NO: 66579 - DNA, 330 bp, Glycine max
  Peptide Sequence Number=SeqID_183357
acaggcgcagggtggcgcaccgcagacccagacgcaccgccgccacctcatcaggctgatccagctaggtcatttgacacggagcgggcgcacgtgcagacccatgactgtctctaccagctcagcctcagtctgcagagccagggtttcgctccttttccgtgccctactccagatcagtttagggcaaaggttgcatggcccagagattggcctgaggcccaggcaggggaggcgcctgcagaggctcccgacgatgcagatgaggcccgcatggacgaggagatgacagatttactcgatttcttgggagggagcggagccacatga

SEQ ID NO: 66580 - DNA, 199 bp, Glycine max
  Peptide Sequence Number=SeqID_183358
atgatgccatttctcccatcattggtgagcatgacccttacattagtgtatatgggaggatctaatgaaaagatctcacttttaggagctgactcatatacgagttgtcactatacttatgacctctatcatggttgtcgccattcttacatcaattgctattgttcgccgcatccttatggcaacatctgtcctgaag

SEQ ID NO: 66581 - DNA, 141 bp, Glycine max
  Peptide Sequence Number=SeqID_183359
atgtgggaggaggagggcaaggtttccgacagatttcaggcggcaggaaaaagagacgagaagagcgatttcaggaaggaggagggcaaggtattttacatgagtatgattgacgctaaattgtgtgaaaatttatcatga

SEQ ID NO: 66582 - DNA, 732 bp, Glycine max
  Peptide Sequence Number=SeqID_183360
atgggtgaagcagaggaggtgcaagagaagatgaaggccgacatggaggccatgaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagtacgggcagcccccataatgtacaaattcaaaacgagcacgccttcccgccatatggcttgcctcccaactatacaccacccaacgtggcgtacactctcaatgaaaatctcaataactccactccgatactcattgagagccaacaaccccaaactgatcaggcatatatctctcaaaccatgggggagacacaagaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgctggactttga

SEQ ID NO: 66583 - DNA, 192 bp, Glycine max
  Peptide Sequence Number=SeqID_183361
gctatgagagtattagtaatggaataaggtcaggttcaagtgaccgacttgaggccttggaaattggttgctctgaagcaactaacatggttttaggttatgttagccattggagcaacaactgtttattggctacggatgttatcaagaaaccgattaagatggctaacatggctaagttggggttaaaag

SEQ ID NO: 66584 - DNA, 577 bp, Glycine max
  Peptide Sequence Number=SeqID_183362
caccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccaatgagccggcgactcataggcagtggcttggttaagggaaaccaccggagccgtagcgaaaagcgagtcttcacagggcaattgtcactgcttatggacccgaacctgggtgatctatccatgaccaggaatgaagcttgg

SEQ ID NO: 66585 - DNA, 180 bp, Glycine max
  Peptide Sequence Number=SeqID_183363
atgcaaaagttgggagacaaacaacaacgacgacgacaaaatttgagggggttcggatatcgaagccacgatgttggtagcttttcttcgatctcttcgttttggtctcctaagagaagagaaggggtgaccccatgcatgtggtggagacagataaagccagcaaagagaaatagctga

SEQ ID NO: 66586 - DNA, 201 bp, Glycine max
  Peptide Sequence Number=SeqID_183364
atgtcaagtgggtgtttacccatgcaacccgagtcttacgagttgcaagagaatcttcaaagtgatagcggacaagtcttgggatactttgaggtcttcctcggaatatctagtgtttttgaagctgagttagttagtgctatcaattttattgagcaagcttataatagaaaagctaaaaactgccagaagacatcgtag

SEQ ID NO: 66587 - DNA, 1155 bp, Glycine max
  Peptide Sequence Number=SeqID_183365
atggacatgaacaaagtttggtgtttcattttaatgctagatgttgagccacaatattcaggagcaagaatagagggggatgctgttactttggattttgtgaaaaaaatgatagaagatttcaagaatcagaaattcttacataaacggtatgcattccagattgtattgcaaacaagagagatgttgcaagctttgccttctcttgttgacatacatgttcctgatggcaaacattttactgtttgtggtgatgttcatggtcagtactatgatcttctgaatatttttgagcttaatgggcttccttcagaagagaatccgtatctatttaatggtgactttgtggataggggatctttttcattggaagttatcctcactttgtttgcatttaagtgcatgtctccatcagccatatatttagccagaggaaatcatgagagtaagagcatgaacaagatatatggttttgaggaagtattctgctgtttgcctttggctcatgtgataaatgagaaagttttcgtagttcatggaggtctttttagtgttgatggggtcaaactctctgacatccgatcaattaatagattttgtgagcctcctgaagaagggttgatgtgtgaattgctatggagcgatccacaacctctccctggaaggggcccaagtaagcgtggtgtaggcctttcttttggtgcagatgttacaaaaaggtttttgcaggaaaataatttagatttagttgtgagatctcacgaagtaaaggatgagggttatgagattgaacatgagggtaaactcataactgtgttttctgctccaaattactgtgaccagatgggtaacaagggtgcctttattcgatttgaagcgcctgatttgaaacctaacattgtcacattttcagcggtgttgcgtctaacatgccaatgtgaagataatttccgccaaggagtgaacaaagttggaagacgtggagatcctcaatacaagtgcaatgaggtgggtaacatgacttggatgaacccaacaatgcagtgcatgcttggctttcagtttgggatgaaactcatgagttctagtggtgaacctaactcggtgactctcatgaggtgtacaaacctaggatcaatgaatgttgaatgttga

SEQ ID NO: 66588 - DNA, 1575 bp, Glycine max
  Peptide Sequence Number=SeqID_183366
atgaaagtcttcaactttaaagcagtagctgctgctgcatacaggaccttcagcagcaagagggttgcaaaaccctcagcttgggctttaacaaaccccaaaaccaagaacaccaacaccacagtggaacaatgcagaacccccatgtccaaaattgaatggagtgaagagcaaaagcaagttctgtcttccgtatctgagggaaaatctgttttcattactggctctgctggcactggaaagacccttttgctagaagagatcatcaagttcctgaacagattgcacaccccatatggggtttatgtcacagcttccactggggttgcagcttgtgctctaaagggccaaactttacactcttttgctggcattggcatcatcttcagtgatgatgaccctcagcttttggtggagagggttttatccaaccagggtgcatgcaggaggtggagaaaggttgaggctttggtcatagatgagatcagcatggtgagtgcaaaactgtttgagagtcttgaatttgttgcaagagagatgaggggtgtggatgaaacctggggagggattcagcttgttgtgagtggtgatttctttcaactgccaccagtggttagtaacaaggattactgttgttcttctcaaggggtgatgtatgcatttgaggctgagtgttggaacagaagctttgatttgcaggtggagctcacaagggtgtttaggcaatcagattatggacttacaaggctgcttgaaggaatcagaagaggggagagtgatccccaagatttggagttcttagagaacttatgcttagggagtagtgagtgtgatcatgatccttctattgtgcagctctttcctttgaataaagatgtggagagagtgaatgatgagaggctgagaagtttgcaaaaggatgttgttgtttatagggctgttgatagtggtaagggacattggaaggggaatcttaggtatggcatagtgcctgatgaaatttccctttgtgaaggtgcaagggttatgctggttaagaatttggacactgaacatggattggtaaatggggctactggtgtagttgtggggttttcatggtcattgggggaagaagaacatcttagtggaatatgtaatgataaagtgttgcctgtggtcaaatttgatggagggaaatttttgacaattaagccagcaaaatggcatctaatggatggacctgaagttgttgcttgcaggaagcagattcctcttatattggcatgggctatgagcattcacaagtgccaaggaatgactcttgagagagttcacactgatctgtctagagcatttggttgtggcatggtgtatgtagcactttcccgggttagaagcttggagggacttcatctatctgctttcaatagatcaaagattaaagtggaccaaagggtttcaaggttctataggagcttggcttctgaaaagagtaaggaggttatggtagttgataggaggagagaaaaggtggccacagaagtagcagtggtgtctcaagaaaattgtcatatattatataaactgacctga

SEQ ID NO: 66589 - DNA, 432 bp, Glycine max
  Peptide Sequence Number=SeqID_183367
ctgagatacggattttatatcagcaaagatgcatatacagtttatgcagtgtatggaaatttgccttctgaaagtcagttagcggaatgggaattcgccttatctcagcattcagctgtaccacaaggagttttggatatgatagaatcaatgcctcatgatgcacatcctatgggcatgcttgtcaatgccatgagcgctttgtctgtttttcatcctgatgcaaatcctgctctcaaaggtcttgatatctacaactcaaagcaagtgagagacaagcaaatagcacgggttattggaaagataacaacaattgctgctgcgattaatcttagattggcaggaaggccgcctgtgcttccatccaacaaactttcttacacagagaacttcctatacatgctagattctttgtatgtcttgctgtattaa

SEQ ID NO: 66590 - DNA, 132 bp, Glycine max
  Peptide Sequence Number=SeqID_183368
atgaagaataaatctatccagaggaatccaagttcatcaagcttcaagaagaccggaagcatttctggaattggttcaacttccaaagatcccaaacctacaaagaggatgctggcatgggggattctatag

SEQ ID NO: 66591 - DNA, 408 bp, Glycine max
  Peptide Sequence Number=SeqID_183369
atggttgtacgccacaccaaccacccgagctatgcttatgaagaaaacaccatcaaatcgatcatattcagcaaaaagattcgatcgaaacaacgaaggtggatccgaaagaagggacagaaacgtcgacggatccgagatacgaacgtaactaaggtagagagagaaagaaagagtgtcgacaacggttgcaagaggacgaggaggactcaggcgcgtgagtcccacgcgctttgtttttttgtcaacaatgctaacatgcgccgtgagggagtgttgtgccaatgtagagtggttgagagattagtagcaccattaaatattcgcgtggcgcgtttttttaaccgcctggcattctttcttactttaaccctttctttgaggaaattacggagattcattgattga

SEQ ID NO: 66592 - DNA, 1398 bp, Glycine max
  Peptide Sequence Number=SeqID_183370
atggctaccataaaagcttctcacactgtggttccaaatcaaccaacaccaaaaggtcgattgtggctatccaacagtgacaattccacacgtaaagcacattcaccagttatttacatctacaaagcaaaacacaacattgaatacaacattgagaggatgaaagagtctcttagcaaaactctagtgtacttctatccagttgctggcagattgagcttatcagaaagtggtagaatggaagtggattgcaacgcaaagggagtgacattgatcgaagccgaaaccgcgaaaacattggctgattttggagacttttcaccctctgattccatcaaggaagaacttgttccagcaattgattatcactctcaacctatacaagagattcctttgctatttgttcaactaacaagattcaaaggtgaccaacaacaacaacatggccttgccattggaatggcttactcacatcctgtggctgatgggcttgcttggactcgctttgtcaacacatgggcaatggtcaatagaggagactcattagatgttaatgaaatgccatttctagatcgaactatactcaaatttccaacatggtcatcgtcattgtcgttactgtcaccaccaccactatcacactctgatcacccagagctgaagcctcttccactcatactaggcagatctgacagcactgaagagcaaaacaagaagacaacagcatctgtgttgaaactcacatcaaagcaagtggagatgctgaagaagaaggccaatgatcaagggtcaacaccttgtaccagatttgaagctgtggccgcacatatatggagatgtgcatgcaaggctcgcggacaacatcacaagcaaccaactatagttcggttcaatggtgatattcgcaacagattaatccctcctctccccaggaactactttgggaatgcattggtagcaacagtgacaccagaatgttatgttggagaaatcacatcaagaccattgagttatgcagcaagaaaattgagagaagcaatagcgttgctcagagatgagtacatcaggtcacagttagaagctgtgtttggtgaggagcaattgaagtgcataagggctttcttcttgggacaaggtgaaggtagaagtgaaccgtttggagggaatccaaatcttcaaatcacaagctggatcaacttcccggtggatagtacagattttgggtggggaaagcctgtgtattttggtctaggatatgtgtgtgcacttgatagggggattattgttcgagatccacaagatgatggttctttgattgtgatcatgcatttccagatagcacatatgcaactctttaagaaactcttctacgaggatatattcacttcaaggctgtaa

SEQ ID NO: 66593 - DNA, 777 bp, Glycine max
  Peptide Sequence Number=SeqID_183371
atgaccagatatgtctggaaccttgaaggatcagaatgggtgccaactcttgttatccttagactaaaccgtgctgccctttgtgttgaatggagtccaaaaggacatcatgaccacttggagaaagcttccgattccgttccaaatgacaagagacctgaatgggagaagcttgactatcagctctgcgctgtattatggcagtcagttgagccagatattttggaaattcttaggtcctttaaaacgtgtcgttctttttggaagaaggcccaggaaatttttgccaatgatattcaaagtctgtttgacgcaaccatgaaggttacaaccctcaagcaaactagtcatgacatgatcgctcatgtgggtaaggctcgggctgccgtggaagagctgagaaagttccttgtagctgattcattggaagaagtgaacaggaaacttgacaagttctacatggtccttattctgaggagcctacattcagactttgatcatgtttgtgatcaagtacttgctggggaccaagttccatctatggattccctcatcactagacttctccgcgtgcctcatttattgaaggatgagaatcctgtcgatggtgtggagacgttagccatggtcgcgtctcgaggaagaggaggcaactgcaacaacagaggaggtcgcagtggaaggggtggacgtcctcattgcacttattgcaagaggatgggtcacacccaagagaattgttattcgttgcatgggtttcccgacaaggtcgcacag

SEQ ID NO: 66594 - DNA, 1422 bp, Glycine max
  Peptide Sequence Number=SeqID_183372
atggtaaccatcaaagcttctcacactgtggttccaaatcaaccaacacctaaaggtcgattatggctatcaaatagtgaccaaaccgcacgcccagcacacacaccaaacctttacatctacaaagcaaaacacaacatcatcgaatatgacattgagaaaatgatagactctctcagcatcattttagtgtactactatccggtagctggcagattgagtgttacagaaagtggtcgaatggaagtggattgcaacgcaaagggagtgacattgatcgaagccgaaaccgtgaaaacaattgatgattttggagacttcacaccttctgagtcagtcaaggaagagcttgttccagtaattgattatcactctcaacctatagaagagattcctttggtctttgtccaagtgacaagatttaaaggtgataaagaacaacaacaaggccttgctattgcagtcgctgtttctcatcctgtggctgatgggtctgcttggattcactttatcaacacatgggctaaggttaatagaggtgacatgttaggtcttaatgacatgccatttatagatagaaccatactcaaatcttcgtcgtcgttgtcgtcgttgtcaccaccaccctcaccacgcttcgatcaccctgagttgcagcctctaccattcatactaggcagatctgatagtactgaagagcaaaagaagaagacaacagctgctatgttgaaactcacatcagaacaagtggagatgttgaggaaaaaggttaatgaaaatgaaaacttatcaacaaaacaagggtcaagatcaagatcaagatcaagaccttgtagcagatttgaagctgtggctgcacatatatggagatgtgcatgtaaggctcgtaaactggatcgaaatcaaccaacccttgttaggttcaacgccgattttcgaagcagactaactcggcctctcccaaggaattatttcgggaatgccttggcggccacagtgacaccggaatcttatgctggagaaatcacatcaagaccattgagttatgcagcaagaaaattgagagaagctgtggagatgctcaaggaagaatacataacttcgcagttagaagttgtgttgggcgaggagcaattggagtccataaaggctttgttctcgagacaaggagaacgtaggaattctccttttgcaggaaatcctaaccttcaaatcacaagctggatcagcattccactatatgaagcagattttgggtggggaaagcctgagcattttgttctgggatatgtgtgtccgtttgatagagggattattattcgaggtccagaaaatgatggttctgtgattgtgatcatgtatttccagatagcacatatgcaactctttaagaaattcttctacgaggatattgatccatga

SEQ ID NO: 66595 - DNA, 948 bp, Glycine max
  Peptide Sequence Number=SeqID_183373
atgtcatgtagtattcctctttatgttattaactggaggcttacactttccttcatttgtcaaattctgtcttttaatcagttctctgaagcatttggaaagttttatggccaatcaaagcatggagtgagcaatgatgcagttgaaacttcaagaactcgtggaactgttcacgaaaactgtataaattgtattatgcctcttggggatcatggcacattggtaaggcgtttcagtacatcagcaccatgctttgatcacctagaactgaagccactaccactcaaactaggaagttctgatagcactgctaagcaaaacaagaagacatgtgttgtattactgaaactaacacaaggacaagtggggaagctcaaaaagaaggccaatgaccaacccatgaaagaagggtcaagagtaagaccttatagtagatttgaagctattgctgctcatatatggagatgtgcatctaaggctcgtgaacttgatgagaaacaaccaaccctagttcggttcaacagtgatattcgcagcagacaaattccacctcttcctaggacttactttgggaatgctttggcagcaacagttacacccgaatgttgtgttggagatatcttatcaaaatcattgagctatgctgcccaaaaagtaagagaagcaattgaaatgcttacaaatgagtacataaggtcacagttagatattgtattaggtgaggagcaattggattgcataaaggctttattctcgggacaaggagaacgtaggaatgcaccatttgcagggaatccgaatcttcaaatcacaagctggatgagcattccactttatgaagcagattttgggtggggaaagcctgattatgttgttatgggatatatagcacatatgcatctctttaagaaattcttctatgaggatgtatttacatcaaggttgtaa

SEQ ID NO: 66596 - DNA, 1371 bp, Glycine max
  Peptide Sequence Number=SeqID_183374
atgggtatccatggtaaggttgggtttgggattttttggacccaacttgctcatgaaagcagtagattggactgggtcaagttaagggtgcccaaaaaagtggtgaacaagttaacaaggttgcagaggaattttctatgggggggagtgtcggagcaaaacaaaatagcttggatccggtgggaaacggtgtgcttgccaaaagaagatggaggtttgggggtcaaagatattagctcgtttaatttatctttgttgggaaaatggaaatggaagctttttcagaatcagggggagttgtgggtcagggtaatagaatcaaagtatggcgggtggaggaatttgagtgaagcaaggtcagccaataatgaatctacatggtggagggacttgaagattgtagatcagcatcctcaacagggtcaattgctaaataattcgatagcgtggaaggttggacgtggggataaatttaaattttgggaggacacttggttaggggaagataacagattactagagaaataccctaggctctatagtatatctgttcagcaaaattatttcattcagcaaatgggagaattcaaggattcagggtgggaatgggacttcaaatggcggagaccgttgttcgacaatgagatagatatggcagtatcatttctacaagaacttgaggggaacagaattcggtcccacagggctgaccagtgggtttgggtggcagattctagtggccaatatacggttaggagtgcctacaatgtgcttagagaggacttattacaggaggaccaggacggagagttcaaggagctatggaaggtgaaggttccatctaaagtaattgtgtttgcatggaggttactcaaagataggctaccaacaagagacaatttgaggagaaagcatgtggagctacaagattttatgtgccctttctgcagaacaatagaggagagtgcaggtcatttgttttttcactgcagcaaagtgtttcctatatggtgtgaaatgctgtcctgggtaaatctggtgggtgtctttccacatcacccaagacatcattttcttcagcacatatatggagcatttgaaggaatacagctggacagatggaaggggtggtggctagcattaacatggactatttggaagcacagaaatagtatagttttctccaattctgccttcaacgcaaataaagtggtggatgatgcagtatttctgttatggacttggctcaaaaattttgagaaggatttcacaacccactataatcagtggtcatcaaatctatctgaaggattcttccgcagaagaggatttgaatctaggttcaataattgtattagtcttataatatga

SEQ ID NO: 66597 - DNA, 1350 bp, Glycine max
  Peptide Sequence Number=SeqID_183375
atggtaaccattgtgggttcttacaatgtcactccaaatcaaccaactccaaaggatcctttatggctatccaatagtgacctaatcgggttccaaggttatgtacccactctttacgtttacaaagcaaaacccaattatagcaacaacataattgagaggttgagaaactctcttagcaagcttttggtgtactactatcctgttgctggcagattgagcttgacaaaaagtggtcgaatggaagtggattgtaacgctaagggagtgacattgattgaagcagaaaccacaaacacatttgctgattatggagactttactacaccttcagagtccacagatgaacttgttccaaaaattgattctactcaacctatagaggagactccaatactggtagtgcaattaacaaggttccgtggtggtgatgaaggccttgccgttggatttggtatgtttcattctttgactgatgcaaccggcatcattcacttcatgaacagatgggcaaagctggctagaggggaagaactaaaccctaatgaaattccgtttctcgatcgaacaatactccaattattttcatcatcatcgcaacacgtggatcaaccggagtggaagcctataacacaagcacaaggagtagagcaaaagcaaagaagttgttctttgttaaaactcacatcaagccaagtggagaggctaaagaagaagactaatgatgaaagtccaaaagaattaggggtaagaccttatagcagatttgaagctattgctgctcatatatggagatgtgcatctaaggctcgtgctgaatattcaaattcaaatcacccaactatagttcggtttagtgttaatattcgtaataggttattgactccacctatccctgagagttattttgggaatgctttggcaagaacaacgacacctaaatgctatgagggagatatcatatcgaaccctttaagttttgctgctcaaaagttaagggaagcagtaaatccgattacgggtgagtatataaagtcacaattaagtgttggtttagggcaagagcaattggatcacataagggcttttttcatgagacaagaacacggtatgaaaacaccctatattgctggggaacataacaacgttattctccttacaagcttgatgaccatgccagtgtatgaagcagattttggttggggaaagcctatgcaatttggtttaccacgtgggtctctagatgatagggtaggaattcttccaagcccagatggagatggtgttgttgtcaacgtgtttttccaggaagcaattctgcagcgtttcaaaaagttgttctacgaggat

SEQ ID NO: 66598 - DNA, 1359 bp, Glycine max
  Peptide Sequence Number=SeqID_183376
atggtagtaaccattgtagcttctcattgtgttgttccaaaccaagaaacacccaaggttcgtttatggttatcagatagtgaccaagtagtgcgtttaggtcatacacccactatatatgtttacaaagcaaaacacaacaccaaaaccatagagagaatgaaaacctcacttggcaagattttggtgtactactatccagttgctggaagattgaacttatcagatagtggtcgaatggaattggattgcaacgcaaagggagtgacacttcttgaagctgaaaccacaaagtcattgggtgattatggagatttttcaccttctgagtccatcaaggaagagcttgttccacaaattgattatactcaacccttagaggagcttcctttgttgtttgtgcaattgacaagattcaaagatggtgaaagctttgccattggagttgcctgctcccatacgttggctgatggtcttagtgcaattcaattcatcaattcatgggcaaaggtagctcgaggagagacactagagccacatgaagtgccatttcttgatagaacagttctcaaactccaacactctccatcagcaccatgctttgatcacccagaactgaagccactaccactcaaactaggaagttctgatagcattgctgaggaaaacaagaagacatgtgctgtattactgaaactaacaccagagcaagtggggaagctgaaaaagaaggccaatgaccaacccatgaaagaagggtcaagagtaagaccttatagcagatttgaagctattgctgctcatatatggagatgtgcatgtaaggctcgtgaacttgatgagaaacaaccaaccctagttcggttcaacggtgacattcgcagcagactaattccacctcttcctaggacttactttgggaatgctttggcagcaacagttacacccagatgttatgttggagaaaccttgtcaaaaccattgagctatgctgcccaaaaagtaagagaagcaattgaaatgcttacgaatgagtacataaggtcacagctagacattgtattaggtgaggagcaattggattgcataaaggctttattctcgggacaaggagaacgtaggaatgcaccatttgcagggaatccgaatcttcaaatcacaagctggatgagcatgccagtgtatgaagcagattttggttggggaaagcctatgtattttggtttggcatatgtgtctgcacaagatagggcagtgattcttctaagtcctcatggggatggatccgttattgtgtccatgcacttccaaatagcacatatgcaactcttcaagaaatacttctacgagaatatatga

SEQ ID NO: 66599 - DNA, 234 bp, Glycine max
  Peptide Sequence Number=SeqID_183377
atggatttgggctcatactttagaattcttgacattaccgaacacagtagtgacattcgaatccaaagagttgtaatcttgatgattagagactgggcacgtgttggtgccatcgacaaatcccatcaagttgtagtctacaaggagagcattgatttgcactctccaggtcgggtaattcgacccagtcagcttgatagaggattgagtatattgaggacaactattgattga

SEQ ID NO: 66600 - DNA, 795 bp, Glycine max
  Peptide Sequence Number=SeqID_183378
atggaaaaccaagaagcatttcgaggagacaatttagaatctcgtgaacaccgcactaaatccattgctgtgcttatgtcaagtaacccagtgactgccaatgcttcttatgcccatgaggtttctgccaacccagaactagaagcttttgagactttgaatcgaaatgatgaaaaacatgaaacacccaaatccttaattggaaacttgaagaaatatggagcaaatgatgtgacaagttcaaaaggcgaggtgcaactaaatgatcaaacaaaggtgagggtcatttcattggtgggtaaaggacagggacaatttaagtcaaacctgaccggtaaatggatacttgtagaaaacaaggatgaagatgaccctaaggattcacaaagactaaagaaaccgattcaacttgttcataggtcgaatcccaatgatgatcccttcgttgatttggttaaggtttccatccttcttgaccgtgagccgtttcaattgtcatgggatgcgactatgtttggggtgaataataatgatttccccttgttcatacacaatagtgatgtacaagaaataatttcaggcaatcaatgtttaaacatcactgttatacaattgtggatcacgtttctaaatgagttgactatgaaatctggccttgactctatgtacggattccttgagccccagtccatacaaaaatcagggaataagcgtgatgaaactcaatgttacattgagagatggctgaagcaatcccaaagagagatatacctaggagcttacttgaatgagtaa

SEQ ID NO: 66601 - DNA, 327 bp, Glycine max
  Peptide Sequence Number=SeqID_183379
atgggaaagttggatgatctacaggaaaggctcagggccattgaaggaggtgaagattatgcctttgctaacctagaagagttgttcatagtgctggactttggcaagtacaaggggactacttgccccaagaaccatctaaagatgtattgtcggaagatgggggcatacgcaaaagatgaggaattgctgatacattccttccaagaaagtcttactggggtagttgttacctggtacactaacttggaaccttcccgagtccattctttgaaggacctaatagttgccttcgttaggcagtgtcagtataatggttccggatag

SEQ ID NO: 66602 - DNA, 697 bp, Glycine max
  Peptide Sequence Number=SeqID_183380
tgttggatccgacaaactttattctggcagcactgaggggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtctgagtttactcttgatggacccaaaggccgagtccgtgctatgactgttggcaacaatacactctttgctggtggagaggatggtgtcatttttgcttggagaggaagctctaaagccgattctccttttgaactggttgcgtcactcactggccacactaaagcagtggtttgtctggtggttggatgcaagatgctgtactccgggtccatggaccaaagcataaaggtctgggacatggatacattacagtgtacaatgacactaaatgatcatactgacgtagtcacatcccttatctgttgggatcaatatctgttgtctagttcatctgaccgcacaattaaagtctgggcttgcattgaagcaggatctttggaagtgatatatacacacaccgaagaaaatggtgttgtttcactttttgggatgcctgatgcagagggaaagccaatattattttcctcgtgcagagacaattcagttcacatgtatgaattgccatcgtaa

SEQ ID NO: 66603 - DNA, 417 bp, Glycine max
  Peptide Sequence Number=SeqID_183381
atgccgatctcccccgcggaagtatcagttggtctgtgccgtcccgacataggtagggatcgcgtccgcaagacacccagtggacccgaaaaagtccaacagagccctggggtttccagctctggttacgggcctctatcagtcctacagggtgcccatacacccccagcaaggtcatgccatcccgacatagggatcgcacccgcaggacacccggtggacctaaagaagtccaaccgggtcctggggtttccagctctgattacgggcctctgtcagttctacggagtgcccgtcgccccaacaaggtcattaggccccgcattaaccgggctttcatcaagaagtactgtgcccccagacgggcgtagggcgagacaccacagtagcattgggatggccggtagcgggcaatag

SEQ ID NO: 66604 - DNA, 468 bp, Glycine max
  Peptide Sequence Number=SeqID_183382
atgcaaagcttgcaggaactagctcagcaaaggccaattatgagtgtagatcagttcattgagaaggtggcctggcctggagcccgaccttcttttgtgggggataatgaaagttttacagcccaggcacctcaacagcatgagctagagccagaaaacgatcactcatttgaagccatcatccttggagctgttgatttttcaaaaagaagattagagacgagatccaatgaagctgctaatcttggaccagagccagtatcaacggatgtaccatttccaagagtggatccatcttcacctcaggacgcagcagactcttccactcctgtcttagagatacctgagggccaaaccataccagtcctggctttggacacttctcctccagctactccagtattgcatcagacatataaggaggatattcagacacaggatatccaggaccagtcacaggaattttga

SEQ ID NO: 66605 - DNA, 564 bp, Glycine max
  Peptide Sequence Number=SeqID_183383
atgtctcctatagtagtcacaactcttacaagagttttagtgaagaacttagtgactattatagagggcaccataggtcacatactaaacatcactcccaaagaagagaaaaaggatagcaagcctcaagaggttaacattagcctcccatatttccatggaaaatataatgttgaggcctacctagatagggaaatgaaggttgaacaactctttccttgccatcatattagtgaagagagaaaagttccattggctaccctttgctttcatgggtatgccctctgttggtggacttcccttgttatggaacaaaggatttatggggatcctccaatagagtattggaatgatcttatgagtgcccttaggaagaggcacatttcctcctactatgaaaggaagcatatggacaagttccaaaggcttagacaagggagtatgagtgttgaagaatatagacaacaaatggaactactccttttaagagctggacttagggaagaggagagaacaagcatagtgttcgtgattgtcggcaagtgtactaattcgcacaagtag

SEQ ID NO: 66606 - DNA, 240 bp, Glycine max
  Peptide Sequence Number=SeqID_183384
atgacaaaagacaacagtagagacctcaaagccctacactggagcaatgagaggcattgtgcatgggactcgagaaggcctaggggcagatcaaaatttctcacccgtcaaaggactgaagaagatttgcttcgagagttggtcgatgccacaccaagtccaaggccaaaggagaattataagcaattgggcttggacttgaagagagcagataattttatcaaatcttatcttacctag

SEQ ID NO: 66607 - DNA, 415 bp, Glycine max
  misc_feature (232)..(232): n is a, c, g, or t
  misc_feature (276)..(276): n is a, c, g, or t
  Peptide Sequence Number=SeqID_183385
atggggaggaggggcttggtcgtccgtccgcccgggcacacacctaggtttgttggtgatttggaggggagggacgaatcaaagcgacaagggctgaatctcagtggatcgtggcagcaaggccactctgccacttacaatacccctgtcgcgtatttaagtcgtctgcaaaggattctacccgccgctcgatgggaattgcgcttcaaggcgtctcgtagggctaatccgnctcacgagggtcaccaacggcacgtgcctttggggggccgaggncccctactgctggtcggcaaacggacggcgggcgcacgcgtcgcttctagcccggattctgacttagaggcgttcagtcataatccaacgcacggtagcttcgcgccactggcttttcaagcaagcgcgatgacccatt

SEQ ID NO: 66608 - DNA, 315 bp, Glycine max
  Peptide Sequence Number=SeqID_183386
atgggccctactaaagcaaagttgaatatccatgttaatgtagagcatccaaatgttgaccgagggcatgttcaagatgaaaataatatggaaaaccaacattctaagcaaaggaatgttgcagatgaaaacaatatggaacctgaagatgttgagcaaggccatgttgcaaatgaaaagaatatcatggagtgtaaaacaaacttgaatattcataccaatgaaaataatgtgaggcaattgccggtggttttctacttagctccagaattgattatggccaatgaatttgagcagactggatttgtttcctga

SEQ ID NO: 66609 - DNA, 315 bp, Glycine max
  Peptide Sequence Number=SeqID_183387
atgatgatcgtcgcagatgaaacagagatgagtgacgcacgtgaatctcggtctcagtctgaggccagatttgaatggagggaattcctttgcgcgttgaaatcgagactgagtgtgcgaagctgggttagatttgtcgaatctatcaacgtggatttcactggagagggagaagctggagagaatgatgtggtcttgctcacattggacccccgcgtagttgtagggttaagagggtttggtcatgttgtagcttcttgtgtttttggccgcacgttgtacttgctctttgttgccaatgttgcttctaggtaa

SEQ ID NO: 66610 - DNA, 189 bp, Glycine max
  Peptide Sequence Number=SeqID_183388
atggtgccaaaatacttgtttcgctctctgggatactacttatttgtgtggatgcgaaatctactggcaagtgcaccgggtcgtcaagcattgggtcctcttactgagaaaattgatgcaattaaggatgtttctctaattaaagatgtttctgtgttctatgctgaaggctcaagtactaaacactga

SEQ ID NO: 66611 - DNA, 153 bp, Glycine max
  Peptide Sequence Number=SeqID_183389
atggcacccctctggcgacggtgtcattggaaagcacggaccaaaggtgacgcggaggtagctgaaggcgtcgccggtgtcgggcatgtcgacgacaaactcagtgtatcagaaggcggagaggaaggtgcagaagccgacaatggcaattaa

SEQ ID NO: 66612 - DNA, 432 bp, Glycine max
  Peptide Sequence Number=SeqID_183390
atggcttctacaagtggagatgctactccaccatctccaaaaactgcaaggctcatggcagagatgactaaacttggtgatcgaatgagaagaatgagttatgaaaatgaagaaaggttagggaaaatgagaaaggagaataaggagagtttgagaagaatacacaagagtagtgaagctttaagtatgggggttatgaagaagatgagggatgaaggaggaatgagaggtataaggagagaagaaatcatagaagatatgaaggtaggcaaacagaggaagagattgagggctcaaattgaggagtctaaaaaggccaccatcgcaaggtttttgcatggtctcaatagggagatccaagacattgtagagttacaccattatgtccctttggaggatctcattcatctagctatcaaggtggagcagtaa

SEQ ID NO: 66613 - DNA, 207 bp, Glycine max
  Peptide Sequence Number=SeqID_183391
atgaagctaaaggcagaagaaggaacaaaaacgaaattgcaattagaagcagaaaatggaaaatgcattcacgtgaacagtaatacaaagctaaaacgtaaaaccctaaaactccatgcactcagcttagagattccagagcacaccacaatgcctattttgggaaaagagctttggaggcagcaagaggagcagcttatgcagtga

SEQ ID NO: 66614 - DNA, 510 bp, Glycine max
  Peptide Sequence Number=SeqID_183392
atgtgtcacctaactgcatatgtttgtgtttactacgacggccaaatttgcaatactaatgagggcaccaccttcgttagtaacaacacaaaaactttcatggtcgacaaggtcataacctttacacaattgcttgaacttgttcaccaaaaactaaacattgacccagaacaccatatccaacatctccattttcggtgccctatatttgagtcaggacaacgttatatgtacacatcttttattctgcgagatgatgctgatgttcgacaaatgttcaacattttttacaacaatccatcactaccatttgtggagttatttgccataatctgtcacaataatgacccaccaggcgaccaacatggctcaacctctaatcttgaggacttaggtgaatacgagacttgttggctcagacaccatgatagtgatacggactcctcttccgggcccgaaggaagtaacctgtctccatcccacaaacctatattcaaacggaattggtaa

SEQ ID NO: 66615 - DNA, 330 bp, Glycine max
  Peptide Sequence Number=SeqID_183393
atgatggtttcagattttgtgaagagattcaataagtttctgagaaacaaaagaaataaaaggaaatcaaacatcaatccaaagaagaaaggaggagattcctccttagccccaaaatgcaatgaatgcgatcaacttgagcacttgagattcgattgtccagtccttaaaagaagaatggaaaaatccgacaagacaaatttcaaagaaaagaaagaaaagaaagtatacatcacttgggaagataatgacttggattcttcaagtgatttagaaaatgaaatcataaatctaggtctcatggcgaaagactatgaaagcggagaagag

SEQ ID NO: 66616 - DNA, 384 bp, Glycine max
  Peptide Sequence Number=SeqID_183394
atgaccgtgaagctctgtgaactagaaaggtatcgggagtggctacaaaagggcagcgggttgttgggaaacatgcttaacttgttggcaggtgtacccctcaaatctcccaaacacgccaatgggggtgctatgaaattcgaggagcagcgctttgatataacgatttttagaaatcacccagatgctatccttaaaacagaaggagtaaatggttgtccattggagcttccatgcaagataacgtgtatgcgacaacatttgcagagcccgaatgatattggatcttgtagtcatacccaagtaatttcaacagataatattattgttttggagtctgaatcacctgggagattaaatctttcagactatggtggtcagtaa

SEQ ID NO: 66617 - DNA, 357 bp, Glycine max
  Peptide Sequence Number=SeqID_183395
atgaaagagtttgaatctgtgccctttctcattagtaatggctaccgcgaaatagtgaccctagagttggaggacgatggcagggcaaatctggcgacaatcaaccatagagtcgttgccaaccttaacacacaacaaagttgtcgtttgggtggggagattcaaaaaacgaactaccttgggcttaacaaaattatgggtacttctgctatcaatcaacactgtcaaacgagcatggtgaatgaagccgtaaatgcggaaagtctcgggggctgtgagtctggaaagggcattttggctaatgtgagggataagagtgggtggggggggggggtcaggggaaggttgttcaagtga

SEQ ID NO: 66618 - DNA, 1241 bp, Glycine max
  Peptide Sequence Number=SeqID_183396
atggtggatagtgagccgcaatatagcatcctcaagatggttaatagtggtcttgcgggtggcatggtcggccattacaagtcggaccaaatgctaggaattgcactaggtactgaaatccttcatataattgggtcttgctgtattccttttgggcctcccttgctcgatgatgtcgctatccttgctgtagctggtttgggtaattgtgctattgctaacatttggttgcaaggcatcaaaagtggttgcatgtgtagccgcgcagccggcgaatgtgttcgtcacctgtggatcacgggggtggggctctgtgagaggcttcaaaccattggagaagaactctccatttatgcaaaaaatttgggcatcaacttggagttctcggtggtggagaagaatttggaaaatctgaaaccagaggacataaaagtgagggaaaaagaggttcttgtggtgaatagcattctacagctgcattgcatggtgaaggaaagcggtggggctttgaatttggtgctgcaaatgattcacgggctaggaattttggttgttcttatccgtagttttctctcacagccgcagacagagatggaagctgaacaagttgaccagacttacataatggtcaagcccgacggcgtgcaacgtggcctcgtgggagaaattatttctaggtttgagaagaaggggtttaagttaaccggcttgaagctcttcgagtgctcaaaggaattagttgaggagcattacaaggatctaaaacaaaagttattcttccccaagctaattgactatattacttcaggtcctgttatgtgtatgggtgttggggtagtcgcatcggcccgtaaacttataggtgctacatatcctcttcaagctgaaccaggcacaataagaggagaccttgctgttcagacacgaaggaatgttgttcatggcagtgacaatcctgagaatggcaagcatgaaataggtgcagctcctgaagtgggtgccgacaatttatgtgaagttttgatgattgatgataaagacaatagtttttcaacgccgtcattccggattagatatgcaaggcaggatgtaattcttgctatcatgatctcattttatgtatcttatggcagatacgaggtcacaaatatctttgctaatgattatttttatccacagggaaaatcttctgctgttatcttgaactttgagctctttcacactccaacacttgaaatgcg

SEQ ID NO: 66619 - DNA, 1272 bp, Glycine max
  Peptide Sequence Number=SeqID_183397
atgacaaacagccgcgaaaggcacgacgttgttcggcaagtttctcctcctagagttgcgcgaggacaaccgcctgaactagtgtcaagggttggagggcctgaacctccctttgaatatctagagccaacccagagacaaaacaactcaagaggaacaacgccgggaaccagtggggtcttcatactgggaaggggaaaagcgggctttaagggcatgaaggaggcctatccaggaggaaatctggccattctgggtcagccattgaaaccaggccagtgcagggccctccatggcgaaggaagcaataacaagtctttcgggttcaggggtaatatgatactcgaagaattgattgattttgaaagtccatccagagggatcagaaccatcaaaacaaggaacttcgagcttcatgcgagggaggatgggtgttgtgtgaggggaatgaggattagccgaagacgaagaagatatacttcttctgaacaaacctattccaccacgtataaagtctctagtggacaatttcttcccgaaaccatatcttcaagtgaaggaatcaggtcattttcctacaatagtctctttccatatcttctaaggattgcaaagtcacattggctaccactctctcaaaggtttagatattttatcattacaacagctgaattgccgcaactctgtcgctccttcaggtcaaaagtattttatgatccaggtccaagtgtaccacaaaatcgttgcaatagtggttctctggtgaattttcaggctttgagatcatatgcacgtgatgcacgcaaaggctataatctctttggccgtggaagaccaggggatgaagagttcaagaaaacttgggcaaaggaaatggatgaagataacaacactctatggacaggaagtgaggatgaaagtgatgaagacacgggtccaaagaccgatcttgataaggagataagaaaagcaagactggaagctaaaaaacatgcagacttgattgatgctgatgacagccatgagttaagaagtgtctggtctggcagtgatgaggagaagacactatggactggtgatgaaatggatagtgatgatgatattcctacagaagcttacccaagtgaaagtagtgaccaatacatagataattgtttgagtttgatgaaatgcccaaataccgaaccatctcagatgttgaaagctgaacaagaacctgaggagttgcaccaggaaagcaagctaggaagattgttgttgagaatgctttaa

SEQ ID NO: 66620 - DNA, 450 bp, Glycine max
  Peptide Sequence Number=SeqID_183398
atggagaagagcaaagttgatacattgatagcggttgctccaaacacatggcgagagatgcatcaaaaacaggtgacctataatcgattactagtaggctggagaaaaggctattctagtattctgaccctatctttatcttctcctcttcatagtgacgacgcaccaccattcccaaaccttcatatctccttcgtttcttcaccaaatcaagtcccacaaagcccaaacttcatctttttcattcctcttttgattccaccgattgaaatcttcaaaaacttcgtcaaatggatgaatcaacgaaaaagagaaagggctcttcctccaccactgccactgctggccattgtcgccacagaccatctgaagcacccacagcaccggttcctccttccgtgtcatccccatgatcatctattttattttcttcagatgatcaatgtctaa

SEQ ID NO: 66621 - DNA, 1524 bp, Glycine max
  Peptide Sequence Number=SeqID_183399
atgccattcacttactacccctcagaacccattaacattcgtccttatcgctacccttatttccaaaaacaagagattgaagttcagggatatcatcaaatcctgatgaaggaagaagatgtaagcaaaatgggttttcatactcaccatggccactatgaattttgcgtgatgttgtttggcttgtgcaacgcaccatcatccttccaagccactatgagcagcatcttcgggtcttacctacgcaagttcataatcgtcttcttcgatgatattctcatttatagtaaatccttcgcagagcatcttgatcatctggcaaaagattttgagctattactcgcagggcgcttcttcctcaaattctacaacatggcgtcaaacctgttcccaccaaagttgaagcaattcaaacgtggccaatctctcgatctatgcgggcactatgcggatatctggtttttatcgccgctttatcaagggatatgcatccatcgtggcccctttgatgcatctcttgttcaaggatcaattctgccatttgtcgttgaaacagatgcttcgggcgtaggcataggggctatcctcactcaacagaatcaccccattgccttcttcaacaaacccttttgctccaaactcctccattcatccacttatgttcaagaacttacagcgattacagttgccgttaagaagtggcgccagtacctgttgggccatccatttaccattttgaccgaccaccgaaaccttaaagaactcatgtcgcaggtgatacaaacaccagagcaacaagtatacttggcgtgccttttgggttatgattattccatccatactggtctgggaaatccaattccgttgttgatgccttatcacaggtccttcattcatcaacgaccttcatcatggggcaagttcctcgtgtgggcagagtggtcgtataacacatccgttcacttagcaatagggctcactccctatgaagtaaccgttggcaagaaacctccaagcattcctcagtacctcgtcgaagcttctaacatagacgttgtggatgacttccttatcaatcatgacaaagtttttgacgagattgggtgttggttaaactgcgccctcgccgtcaaatgtccatcatcggatcagccaactctaaattggcaaaatccaaaggataatgaccttgttgttgctcctctcgtaatccttaacacaaaatgggttacttcagacaatgggcccgagtttatggtcctggttcaatggaagggcctactccctaaagacacttcatgggaaccttgggccaagctgaaggaagactatcaccttgagaacaaggtgctttcggatgggcatagggatgttatgaatcagccgacacaagcacacatcacagaaatagggaaattgcaattagacaaggaggggacaagcactgctcagagaatcaaacggaaaaccactagaccccaatacttgaaggatttcgtaaccaactctgacccagggcactga

SEQ ID NO: 66622 - DNA, 4017 bp, Glycine max
  Peptide Sequence Number=SeqID_183400
atgtacggttcctgtgtgagtagcgtgaatgagattaccttttggaagctttaccgtgatcgagctgatggttccatagaaaggtataaagcacgcttggtcgccaagggttacactcaaatgaaggggttagactacctcgacacattctctccggtggcaaaactcactaccgttcgtgttcttctcgcattggctgcgcaaaatcaatggcacttgcgacaattggatgtcaacaatgcgttcctccatggagagcttgaagaggaagtgtatatgcaagttccacctggacttgcagttgaaaacccgaagcttcaatctaactcagaccaatctctcttcttaaaactcactaagtcagtcactaccatactcttggtgtacgtagatgatatcatactcacggggaacagtatactggaaatacaagatatcaccaccctcctggatcaggaattcaaaataaaagaccttggcgacttgaagttctttctgggactcgagattgcccgcaccactgatggaattcatttatgccaacgaaagtatgccttagacattttatttgattcaggtatgctaggttgcaagccacactcgacacccatggattattccatgaagttacaaatgaactcaggcaactctctttccgacgagtcctcatcctcctatcgaagactaataggaaaactcatatacctgaccaacactcgcccagatattgcgtacgctgttcaacaactcagccagtacatgtcgactcctaccaacattcatcttcaagctgcttttcgcatattgagatacctcaagggttcaccaagatccgggttgttctttgcagcaaccgggactccccaactccgagctttcagtgattcggattgggcggggtgtaaagattctcgaaaatccactacagggttccttgtctatctgggttcttcactcatttcatggcagtcaaagaaacaatccaccgtctcccgcagctcctccgaagccgagtatcgagctctcgcatctactgcctgtgagctgcaatggttaacgtatattctccaagacattggtgtagcatttattcagccagccaccttatattgtgacaaccaatctgcaattcagatagcaaccaatcccgttttccatgaacgcactaagcatatcgagatcgattgccatattatccgccacaaagtcactgcgggtctcgtaaagctcctttcggtctcatcctccatgcaactcgcggacatattcaccaaagctttaccaccagccacctttcagcacctttactcaaccaattacgattcatggagtaggtccatggttactgcgctgagtgccaagaacaaggtggaattcatagacggaagcgcacctgaaccgttaaagacagatagaacctatggagcttggcgtcggtgcaacaatatggtcgtatcgtggatagttcactcggtggccacctccatacggcagagtatactctggatggacaaagctgaggagatttggcgagatttgaagtcgcggtattcgcagggagatcttctgcgaatctccgacctccagcaagaggcatcaacgatgaaacaaggttcattttcagtcacggagtacttcactcgtctgcgtgtgatctgggacgagattgagaatttcagacctgattcagtctgcttgtgcaacatcaggtgctcatgcactgctttcaccatcatcgcacaacgcaagcttgaagatagagccatgcaattcttacgaggtttgaacgaacagtacactaacgttcgttctcacgtacttgtcatggatcctatacctgccatatccaaaatcttttcttatgtagctcagcaagaaagacaattgctagggcacgcaggaccaaacatcaacttcgaacccaaggacatctccataaacgcgacgaggaccacttgcgatttctgtgggcgcattggtcatgtagaaagtgcttgttataagaagcacgaggtacctgcaagttatgatggaagaaacaagaataacaatggaagaaagacgtgtacccactgcggcaagattgggcacacagtagatgtttgttaccggaaacatggatacccgccgggatacaaactctatagtggaagaaccaccgtaaacaacgtgatgataatggaagataaagctacaaatgatcaagctcagcaacacgagtcacaagaggttgttcacttctcccctgagcagtacaaggcattacttgccttaatccagcagccgccgacaggaagcacggcccagtccaaacaagttgcatcagtatcctcgtgcactgttaacacaccattgaacccaggcttgtgcgtgttgatactctgcgatccgcatcagcttgagttcgcagggttacaaccgaaaaatcaagtcaatctctccaagtcctccgccgtcgccgcgtcgtcactcgggtggtccgcggtgccggaggcgggtgaggccggagaagaattcgtcggagagccggcggctggtggccggcattatggcgcggcggagcctccggttcttcttcctgctgccgctggtgtacatctcggggctgctgatatcttccacaacctctggcacgatatcgagggtgataattcctctgccactgagttggcttctgtgtggaagtataaaaggaagttgagggagcagaagccatgtccgaatttgacggcattgcatcgtgaacattttgtgtcacctggactgaatgggtttttgattgtggaggccaatgggggtcttaaccagcaacgctctgcgatttgcaatgctgtggctgtggctggactcctgaatgcaatactagttatacctcagcttgagtttcacaatgtgtggaaagatccaagtgaatttggggatatatatgatgaagatcattttatatccacacttgatggttatgtgaaggtggtcaaagaactgcctgaggcactaatggagcggcataattacaatatgactaatatcactaacatcagagttcaagcttgggctcctgtcagttattaccttggagttgtttctcctatcttgcaaaaggaaggggtaattcgaatagctccatttgccaatcgtttggcaatgagtgtccctccacatattcaatttctaagatgtcttactaattataaagcattgaggttttcttcttcaatatctgtactaggcaagaaattagtttaccgaatgattgagaagagctcaaggacagatggaaaatacattgctgtgcatcttcgttttgaggaggtactgatcctcattcaattatgttggaactggtacttagtgtcaatatatgagactgtggtgaaagggtacaggattgaatcagctttatctaatgatgggctaaatcttctcaacatggcaaaatttaaaagaaaagaccgtatcattttacctgaccttaatcgggttaatggaaaatgcccactaacccctctagaggttggtatgatgctgcgtggcatgggatttgataacaatacttcaatatacttagcttctgggaaaatatatcatgcagagagatatttggctcctttgataaagatgttccccaatctgtatacaaaggagtctcttgcaacatcagatgagcttgctccttttatgggtggtaacttcccccattttttgatgggccatagaagattcatctatgatggccatgccaagacaattatcccagataagcgcaagcttgttgttcttttggatgacgtgagtattagttggagagctttcaaggatcagatggaagacatgctcactgaaagtgaccgcaaaggaatcatgtcatcagatttatatcgttaccaattccatagcatggtgcttcaacttctcattctgcggccttttgaagttgctttcttgtttggcaagtttctagcctccaatttaaaggttggacacactgcaccaacgtgttctatcaaagggatatag

SEQ ID NO: 66623 - DNA, 219 bp, Glycine max
  Peptide Sequence Number=SeqID_183401
atgataagcgcaagatgggaattatggtggagtttgttagagaggagcctagcggaatggacaggggacaacaaatcagtggtgaaaaaggagtgtggaaagtattgggagtggagggaatatgagctatcaaggttgagcgacatggtcaagaaacaaggccttgatatcacccctcatattctcattgtatgtcctagtatagttcgtaagacatag

SEQ ID NO: 66624 - DNA, 651 bp, Glycine max
  Peptide Sequence Number=SeqID_183402
atgttgctttcgaagatggttcacgtcgtcatagaagcctatttctgcactagtggtagaattaatgacaaacatgctaagcaatcggttggtttggtcggcttcgggcctaaaatgctcaacccgaccacgaagagtcttcgggttagtcggttttgggctcatcgggtggcagttgagtcgagtggtttgaggcagacccttgcacgcaagctcatttctacttctcgatacccctcctctctatcacaaaccctaagcctcactatcacccccaaagcctctcttcttcaacaattcttctttttcttctctgcattttctttttcaccctttctttctctcactgtcacccccaaagctgcttcagcaacagcggcaagcaactccatccgcaatgcagacttcggcaagagtgagggttctgacgacgttggtttggatggtctcgactttgtgggactcgcaccagttgacattggggcgacccatgatgctggcagcattgaagatgtgggtgggcttaagctaggctatgtcagcttcgagggaggcccggttctcgaggcaacccgagccgtactgggcccggcagagggagccgaggtggccgccaagacagcccgtgtggccatagatgagaaagtttag

SEQ ID NO: 66625 - DNA, 252 bp, Glycine max
  Peptide Sequence Number=SeqID_183403
atgagacctgaccgcaattggatgttacaaagaaaggatcattttggcctagtaactcaagaatttagaaatggaattgatggcttcattcaagttgctacaagagacccaagaattgcttatgcatcagagcacattccttgtacatgtgccaagtgtaggaatcattatagggagaagtcattttgggtggaaaaacatttgaatgaccacgaatgtggatggttaaataaattgaacccttcatggtga

SEQ ID NO: 66626 - DNA, 285 bp, Glycine max
  Peptide Sequence Number=SeqID_183404
atggccaacattctgtttggaagaccaggaagtgatgggcaaatgaaaattgttgttactaatgggagtaactatttcttctttgagtcattctcccatactaggtaccttttaactaacactcagtggtctatttggaaccaccaacatttgagatatcctgcagatgatacaaacaacattcctatggatgaagctcccaccttgtacttgacttgccacacacacttggtaccattgacaacgagactgaggagtttccttgaccatcttctgctccattga

SEQ ID NO: 66627 - DNA, 240 bp, Glycine max
  Peptide Sequence Number=SeqID_183405
atggaaattggtcaatgcactccaagtactatatgcatgatagtccctgtgagtgagatgccaacacccatcaacagggaacccaaaacatttattaaagggtttgtttcgtcaagaggaaaatctacggttggctcaccagttcctagagcagaggctcatcctggtgtttcgaaggtagccactagatgtcacatggcaactttcaactatcacatcatcactggaagtgcgatatag

SEQ ID NO: 66628 - DNA, 453 bp, Glycine max
  Peptide Sequence Number=SeqID_183406
atgaggaagaaaatcgtagatccctcctttgtctccgatgaatctcacacaggactagtcgaggacacaccgtcgaactcccccaatcacgtcatcctcatcagtgccccgctgccgctgccgacagtgaggcctccacggcttagggggcgctactcaaggtcttcgacctggatcaatggtgacaatgagagggtggagcaatggcttgaagtagtgtcgtgggagctgagagcttttgtttatcacaattttctggtagtgaagggaaggggaataaacttcaagatgctctgtattctatgtttatttacgttaatccaggggagagtgcctgaaacttccagaattgctccatattatgttgttgaagatatgatgaagatgggtaaagatgctgggtggagtttctttctcgagcttgacctggctttttcagtagttaacaattaa

SEQ ID NO: 66629 - DNA, 306 bp, Glycine max
  Peptide Sequence Number=SeqID_183407
atggagacaaatggacaactaattgttgcaacagctactgctggcgcattccttgctctttcagctccgtgtcgtcgccgtccttgcttcgatcctttcatggactggccccgtgaacgccgtgctgcgagctccacgatttcatttgcttctcctgctggcggtggaaatggcgatgctggaaccgacgacggttgcggttctggcagtgagtctggagatgctaatctcaaactggtaggagacgtggctcaagagctttttcgactttcgcctgatgttatcattctcgatgtttcgatgtga

SEQ ID NO: 66630 - DNA, 354 bp, Glycine max
  Peptide Sequence Number=SeqID_183408
cccacgaaggttctttcgttcttacaccgctctctcatccgtggtcgccctctccttcaactgcagtcttacgccgctgtttcgttcttacgccgccctctccttcaaccgcaatctcttggaaacaaaatcccccatcacacagtgtctcccaacgccacgaagaagaggaaaagccacaaagaaagtcatatcaaggacactgatgcttttccttttgggactgttacttcaaggaacccgatatttttttctcgactgcaggctgaagtgactcagcggttgactagtgcaaaagagtcatcaagtaaacctgcattgcagagtcatgaggatcttgcaaagaaactttag

SEQ ID NO: 66631 - DNA, 177 bp, Glycine max
  Peptide Sequence Number=SeqID_183409
atgaagtttcagtggatttcaatcggtggaagtgaaagaggagtgaaaaagcggaagattgggctttacgggacgtgttttggtgaagatttgagtaagatacgaaggagtaataagccttctggtaatcgattacaggatgttgtaatcgattacaggctgcctgttcttgtgtaa

SEQ ID NO: 66632 - DNA, 714 bp, Glycine max
  Peptide Sequence Number=SeqID_183410
gatgcgctcacccagcgccaggcgctcggtggtgctggacgagtccagcgcgcgcgattcggcgtacagcacggccaggattcgccgcttctcgtggtcgacttccgtcatctgcggccacgactgcgccacgcgctcgagcaggttccaggccgccttgggatcgcccgccgacaggatctcgcgggcgccgcggatggcgcgcggtcccagccttcccagctggcgttcggcttcctccttggcgctctggtcggccgagccatgggccagcaccatcttgtaggcgtcgatggcctcgccgaaccagccgccgttgaacgcgacccgcgcgaaatgcagctgcgtgctgaaaggcgcggactcgttggcggcggcctgctccaggtgccgcatggcggtctgcttgtcgcccagcgcgtcggccgcgcggccgcgcattgcatgcagttccgggaactcgacgccggtgtccagcgcgatgtcggtcaggtcgatcacttccttgtggttgcccgccaccagcgccgcccgcacgcccaggcgcatggcgcgctcgaaggcgcgctgcgcgcgcacgccggccagggcgtcggggttgagcaggcggtgcgcgcagatgcgctcggcggcatcgcgcaggcggccttcttccagcgcctgcgcgccctcttccgcccaggccgtggactgcgcgcgcagccaggccgaaat

SEQ ID NO: 66633 - DNA, 129 bp, Glycine max
  Peptide Sequence Number=SeqID_183411
atgatgaagaagaattacctatgcggagtcttaaaaattgatggtaatgtcttccttaagcatggttcagagctacgtctgattcctcgtgatagggtcggtgcatatgagatgtttcgagatatctga

SEQ ID NO: 66634 - DNA, 373 bp, Glycine max
  Peptide Sequence Number=SeqID_183412
atggatccaaacatcaattttgatacactttgggatcaaatcaaagataaggaacttgaagacaacaccaacgaggaagtcataaggctgatacttcagagccaacaagcccttgacaatcatgatgagtatttccaaatgggggtagatgcaacgcgtagaaaaggcctatcatcgttgcagaagtgcattgttgctttttgtatatttgcttatggctcatttgttgacagtgtggacgagtatattcggattgttgaaaccattgtagtggaatgcttacagagatttgtatcaagcatttgtgcaatatttggggatgagtatctagggaggccaaataacgaaaacaccggaagactacaacaaatgg

SEQ ID NO: 66635 - DNA, 195 bp, Glycine max
  Peptide Sequence Number=SeqID_183413
atggaggtgcattggcaaggaaggtgcaacaacgatggaggtgcgatgacaagggaggtgcaacgaaaatggaggtgtgatggcgacgaagttggttcggcgtggcgcaacggcaaggcgaggtttgctccaacgatgaagaaattggtagatacagtttcttcacccacaaaacaatctttggagatgctgtaa

SEQ ID NO: 66636 - DNA, 1676 bp, Glycine max
  Peptide Sequence Number=SeqID_183414
gtgcgacgcaatcccataacgtgaggccgaagcgcgccacggtggctctgcgaaatgccgcgaacaagtttgaggaggaaacgccgtcaatttcggacaccggcgaaggctgtaaaaacgagtcctctttgcaggtgaaatctctgagtgttggtgcacacaagaaggtgcagtttttaactgagatcaacaatgccactgcacagccgcaggggctcagtgttgtgaaagccactgagttggagaacatatcatctcatatgggttcacttgcattgacagatgaagcatcgattggattcaatcaacatgtgaagcaccaaaatacacagcaggcagaatccgaaactagtttggtatatgagggaggcaagagttctccgctgccaaagagaacaatagttactcaagatcatctgcagcaattcaaaaactttttgaggcaaccagctacacaatcttccgtagtgggattgccatgtcctacaacgacatcagtccattcaacttcagctccaatgctgaattctataactcattgttctaattcctgtatagatagtggttcacatgtggctgcagaaccttatgggaacctgaatgttaatcctcatcctataactcaaggggatgttaaatcaccaaataattccctgaaagacaccaatagaatatcaattgatcaggtggcaagtgcagtccaagattgtaattcactaattgatgcagagttgacgcttaagcaaagtgacccatctaaggagcagcaaggatgtatgttaaaggatacaagtatttcaaaatgtacctcttgtcgtgatgacatgttaagtaaaggggaagtgtctgcagctgttaccaacatacagcctcaggttcctacttcatcttcagaagtgaaattggagtcttctaagttggaaaagcaagagaaaaatacaagttctaaagcatcatcaggccttcgaaagagggcctatgaccctgaattgtttttcaaagtcaatggcaagctttatcaaaggcttggcaagataggtagtggtggaagcagtgaggtacacaaggtgatttcatcagactgtacaatctatgcacttaaaaggataaaattaaagggtcgtgattatgccactgcatatggcttttgtcaagagatcgagtatctaaataggctgaaaggaaagaataatattatccagcttatagattatgaggtgactgacaaggctttgtttgagggagtcataaatggctccttcagtaataaggatggtagagtcaaggatgatggatatatatacatggtacttgaatacggggaaattgatttggctcatatgttgtctcaaaagtggaaggaactggatggaagcaaccagaccatagatgagaactggcttcggttttattggcagcaaattcttcaagctgtcaacacaattcatgaagaacgtattgtgcattctgacttgaagccagctaacttcctccttgtcaaaggttccttaaaactgattgattttggaatagccaaagcaataatgagtgatacaacaaacatccaacgtgattcacaggtattgcatacttctatccatagttatcaatctcaggtagcggtgtgtagcaggaagcaggatggctgctgtttcaaatattgtaatactatctaa

SEQ ID NO: 66637 - DNA, 483 bp, Glycine max
  Peptide Sequence Number=SeqID_183415
atgaaggccgacatggaggtcatgaaagagcaaatgaccataatgatggaagccatgatgagtatgagaaaaatgatggaggtcaacacggctacagtcgttaccgcaagtaccaccactgaggtggacccgactcatctgtctggcctcaatcaagtaaatcgttcagtctcagatatagtaggtcagggaggcgaagcgttgggaaatacgggcagcccccatgttgtgcaggtccagagcaagcattccttcccaccatatggcttgcctcctaactttacaccacccaatgttgcacactctcccgatgagaatgtagataacttcgctcccatacccattgagagccaacaaacccaatttggtcatgcacaggtctctcaacccatgagaaagacacatgaagtaccctgggaccatactctagctgactttaagcttcatctcggatatgccactgaggagcaagcatttggtggc

SEQ ID NO: 66638 - DNA, 456 bp, Glycine max
  Peptide Sequence Number=SeqID_183416
atgatgcgaaggcatgaagatggaggaggatttacaggatcaaacataatctttgcattgattcacaaaaaaagagttgttgtctacaaaagagagagagagagagatgagatcccgagaatcactgagaaagagaaggaaaaggaaagagatggaaaggttcaagaatgggaaaatggagacggggtacggtttcaaatagaaaacaaaagcacaacaatcctctcaaaagtttctctctctagcttatctattgagttggagctagattgcaggaaaagccttgagttcataaaaggtggcgctaaatcggcgagggagaaagagagagacagacagagatgtaaacctcctccgatccacccaccagcaactgatagtgacgacaaaagaataatttgcccggcccggagaatcaggattgtgttactgtgtcttatcaaccagttaccataa

SEQ ID NO: 66639 - DNA, 1068 bp, Glycine max
  Peptide Sequence Number=SeqID_183417
atgaatactttttcacatgttcctcctggctttcgcttccatcccaccgatgaagaacttgttgattactatcttaggaaaaaggtagcttctaaaaggattgatctagatatcataaaagatgtcgatctctataaaatcgagccatgggatcttcaaggaagcgatgaagaaaatgaatggtatttctttagtcataaagacaagaagtaccccactgggactcgtaccaatagagctacaaaggcagggttctggaaggctacaggaagggacaaggcaattcactctagccctaggcatttccttattggcatgagaaagactctcgtcttttacaaaggacgagcccccaatggacagaaatctgactggatcatgcatgaataccgcctagaaactaatcaaaatggaactactcaggaagaaggctgggttgtatgtagagtgttcaaaaaacgaatgacaacagtgaggaaaatgggggagtatgagtcaccatgttggtatgatgacccagctgtctcattcatgcaagagcttgaatccccaagcagaatttctaacccttatgcatcataccaccagcactaccctttcaagaaggagttggaattgcaattcaatataccccatgatgctttcctccaacttccacagctagagagtcccaaagttcctcaatcttcaaccagtttgaattgtagccaagttatcccatatggctatggtagcaataataatggcaatgctttgcagtcattgtcactcacgcaagaggaacacataaaacaacattgccagcaacaaagtctgcaatttccgtatggtagcaatgatcaagcagtggaccctgctacggattggagagtacttgacaaatttgtggcttctcagctcagtcacgatcaacatttttccaaggaaacaagttattccaaagtggccgaacaaattaagttgctagcaaacggatgcacaaaaacggagattggccaggagatggcttcaacttccacccttccacctccagttgccagattgacctgtggaaatgaaagtttatag

SEQ ID NO: 66640 - DNA, 564 bp, Glycine max
  Peptide Sequence Number=SeqID_183418
atggctatcaatgtaccagtagcatctatagatgacgttccttgtatatacttgggaatggatggcggaggtttgccatatgtgacctcaaaaggagtcaatcctggcaccaaaatgggcacttttggagaccctgttgacaacaatgaggatagtggtaaagccattagatggcgctgctccaaacacgtgacatttgacaaggataaggagagaaacaaagtgttcccgactgccggaattctagacaatgtgtctgcgacagtgttgctggagttggatttgtatttgatgggtggtccaacaacatttgcggatcacagacatgatcgcgtggagcttgtgaagataagtggaggcccattgtattcgagagtagaatgctttgctgtaataagcaataggcttattgtgaagttggtgacaaggcatattgatctttatggaggagcaacttcaaagcatcgccagctaccatctttcttcttgacgtggagtatgggagatgagaaagggctatggcttggctgtattgagcctgcatcaagcatggtggctacttga

SEQ ID NO: 66641 - DNA, 408 bp, Glycine max
  Peptide Sequence Number=SeqID_183419
atggctatgaagattgtcactgatatacatcatcaagatgtccaattgacaataggtgactgggtgtatgcaaaactttgtccataccgccaaacatcccttgcacttgaatataccaaactatccaaaagggaccacccccaggtcttttggatcacctttccccccccccatgaacttggacaactatcctatcatagaaccactctcaatgttggattggaagtgggatacttcatcctcgtcaccaaccaaactcatcttggttcaatggtcgggcttgtcccccgaagacaccatgtgggagaatgggaacagttacgagaatcttacaaccttgaggacaaggttgttttcccagatgaggggaatgataacaactccaacatcacgatatccactagctga

SEQ ID NO: 66642 - DNA, 1378 bp, Glycine max
  Peptide Sequence Number=SeqID_183420
atggaagagcactcatcagcagcacctcacatattggctttaacctttccagcagaaggccacatcaaacccatgtttaacctaaccaaacttctctcccaaaaaggccacagaatcaccttcgtcaacacacgccacaaccacaatcgcctcctccaattcacagacttaccctcattccacacccaattccccaatttcaacttcgcaaccgtcaacgatggagtgcccgacggccatcctccgaacgattttagcgtaatggtgtctccggccagcaggtccaaggttgccctagagttccgggagttgttgtcgagcctcgtcgagaaacgttgtctgtggggcccaccttcttgcatgattgtcgatggaatgatgtcaacgattgctatggatgctgctgaagagttcgggattccggtgctaactttccgcacgtacagtgccacttgcacgtgggttacgattcacataagcaaagttattcgggaggaagcggtggatatgcaggatccagaagatatagataaggtgctatcaagcatcccaggattagagaatttattgagagatcgtgatcttccatctgtcttcagattgaaacctggaagcaatggccttgaattctacatcaaagaaaccctagccatgactcgagcttctggtcttatactcaatacctttgaccagctagaagcccccatcatcactatgctaagtactatatttcccaaagtctacaccattggccctctccacactctcatcaagactcaaatcacaaacaatagttcatcatcccttcatttgagaaaagaagacaaaatttgcataacatggcttaaccatcaaaaggaaaagtcagttttgtatgttagctttggcactgtagtgaagctgtcacatgagcagttattagaattttggcatggtttggtgaatagtatgaagcctttcttgtgggttatgagaagagacttgatcaatagagaaggtattatggaaaacattaatgtacctatagaacttgagttagggactaaagagaggggtcttttagtggattgggccccacaagaggaggttctggcccacccttcagtaggagggtttttgacacattgtggttggaattctatattggagtgtattgttgaaggtgtgcctatgctatgttggccgttgatggctgatcaaacggtcaacaataggtgtgtgagtgagcaatgggggattggaattgatatagatggaacctatgataggttggttattgagaacatggtgaagaatgtgctggagaatcagatagaaggactcaaaaggtccgtggatgagattgcgaaaaaagcccgtgatagtatcaaagaaactg

SEQ ID NO: 66643 - DNA, 393 bp, Glycine max
  Peptide Sequence Number=SeqID_183421
atggacgcccaacccttagtagtcgggctccctaatcgacagctagaggcttgtgtcagatgccctcagggcgacgagcacttcgctcacacattgcctgagtgcacccaaggggaatcacaccctcgacgcacaatcaatactcaagatgatctaagtctttcccacatgcaccgtccaacagggcagactactcattggcacccctttgttgaccgcatcatggaagctaacatacccttaggttggaaatcacttaatctggagcagtatgatgggatcaccgatctagatgaacatctggatgctttcctgactcaggtaaatctttataccaatggtgatgtgatcctgtgtcgtgttttcccaatgtccctcaaggggaagcattga

SEQ ID NO: 66644 - DNA, 300 bp, Glycine max
  Peptide Sequence Number=SeqID_183422
atggattacttcttgcagctccaggaaatgagatatggggcaaagtgtcaccaacccaatctgcataacaaaaggtatggagacattgatccaaagatgatcgcagttgagtccaatatctattattcctctgagatacctgagaactcacttagttgcatgttgattttagtaggggtgtatgtactgagagatcttgttcacatggaatgctatatatgggcttgcgagggaaaggtactgcgtggagccgacaagctagcagtaggaaatggcatcacaggacgagacattatttga

SEQ ID NO: 66645 - DNA, 918 bp, Glycine max
  Peptide Sequence Number=SeqID_183423
atggataaagtgctcaggagcatcccaggattggagaatctattgagagaatgtgatcttccatctattttaaaattgaagcctggaagtctttacattgatttctacatcaaagaaaccttgaccatgactcaagcttctggtcttatagtcaatacctttgaccagctagaagcctccattatcactaagctaactactatattccccaaggtatacaccattggtcctctccacactctcaccaagacccaattcatcacaaacaatagttcatcatcccttcatttgagaaaagaagacaaaagttgcataacttggcttgaccaacaaaaggcaaggtcagttttatatgttagttttggcaccttggcaaaggtgtcacatgagcaactagtagagatttggcatggtttggtgggtagtttgaagcctttcttgtgggttattagacaagggcttatcattggagaaggtggtttgggacataatgtgcctatggagcttgaattgaagaccaaagaaagagggctcatggtgaattgggcccctcaagaagaggttctggcccacccttcagtgggtggattttttactcatagtggttggaattccacattggaatgtattactgaaggcgtgcctatgctttgttggccactgatagctgatcaaacggttaatagtaggtgtgtgagtgagcaatgggggattgggcttgatatgaatggaatatgtgataggctaattgtggagaagatggtgaagaatttgatggagaatcaaatagaaagactcacaagctctacaaatgagattgcagaaaaagctcatgatagtgttaacgaaaatggttcatcttttcataatatagagaatttaatcaaagacatagggacgatgaaggtaaggaaataa

SEQ ID NO: 66646 - DNA, 345 bp, Glycine max
  misc_feature (342)..(342): n is a, c, g, or t
  Peptide Sequence Number=SeqID_183424
atgggggcagttttgtgtgttgggggagcattaacaactagtctatacaaggggaaggaattctatattggtcaaagtagtcatcagactcacagtacagttgaggcatcaaaaaccaacatgcttcgtggcactctctttttgcttggaagctgcttgtcatacacagcttggttcattgtgcaagttaagttgcttgaaatatttccgttcaaatattggggaacaatgctcacgtgcattatagcatcaattcaagcaaccatagtaggaatatgcttagatggcagaaaggttacttggagtttaaagtggaatctacaactagtgactataataacntcg

SEQ ID NO: 66647 - DNA, 1032 bp, Glycine max
  Peptide Sequence Number=SeqID_183425
atgacatgcggagacaaattatggtcattccgcaaatctttctgccattcagacagagtcttgttcgatggcacgcagagactaacatcgtcttctgcgccttttgtcatccagaggcggcgggccgatgacatgcggaaacaaattatggtcatttcgcacaccttttcgccattcagacacagttgtgtccgatggcacccagagactaacgtcgtcttctacactcttttgtcatccagaggcggcgggcccgatgacatacagagacaaattatggtcatttcgcacaccatttcgccatttagacacagttgtgtccgatggcacgcacagactaacgtcatcttctacacccttttgtcatctagaggcggtgggcccgatgacatatggagacaaattatggtcattccacacaccttttcgccattcagacacagtcatgtccgatggcacgcagagactaacgtcgtcttctgcacctttttgtcatccagaggcggcgggcccgatgacatgcggagacaaattatggtcattccgcacatctttttgccattcagacacagtcatgttcgatggcacgcagagactaatgtcgtcttctgcgccttttgtcatccagaggcggcgggcccgatgacatgcagagacaaattatggtcatttcgcacaccttttcgccattcagacacagttgtgtccgatggcacgcagagactaacgtcgtcttctacacccttttgtcatccagaggcggcgggcccgatgacatgtggagacaaattatggtcattccacacaccttttcgccattcagacacagtcatgtccgatggcacgcagagactaacgtcgtcttctgcacctttttgtcatccaaaggcggcgggcccgatgacatgcggagacaaattatggtcatgctgcacatctttttgccattcagacacaatcgtgttcgatggcacgcagagactaacatcatcttctgcgccttttgtcatccagaggcggcgggcccgatga

SEQ ID NO: 66648 - DNA, 464 bp, Glycine max
  Peptide Sequence Number=SeqID_183426
acaaggcaactttggatatggatagaattgatgtagcaaggctcttagttaagaagctccaactcaggttcaaaaatgtggttgttggaggtggtgcgaaagaagcactcgaaagaagcagtgcttctggagaagactcattggaaagcgtgataggtctagaaataaactcttctaattctgataatggagaggtagacaatgactctacgaaagatgaattggaaggagaaaaagctcaagtagcaaaccacgatgagcgtcgaatgacaacgataatagaggcttccgaatggtgctttaaggagaaaagccatcaggtatttcaaaatattagtgggcaaaaggagtgtccagtggaaaaggagaacatcgtaatcaacacacaaactcctgaaaaagatcagaatgatcaagtggataaacatgtgtttcttgtggagtggggaggcacagggtcgtag

SEQ ID NO: 66649 - DNA, 198 bp, Glycine max
  Peptide Sequence Number=SeqID_183427
atggagtcgccaactgtcgcaacctaccctttgatgggagggcgagaaaaagagaccgttaaggcgttggaccttgagcgatctcaaatgatttacgacactaatgattggtttaaatttagttttcaagaagataagagattactgatgataggagaaggagatgaagatgcacaaaacaacaaagaggacccctaa

SEQ ID NO: 66650 - DNA, 216 bp, Glycine max
  Peptide Sequence Number=SeqID_183428
atgagggtagaactcgagacaacaaacgaagtccaagacatagccatgattagggaagaaactaccaaacttcgagcagtgaggagtacaatacaaaggttcaaccatgagtcttttaacttggtgacctcgtatggagagtttgaggtgaagtcagaaaaaatccccgagtgggaaagcttgatcccatttgggaaggctcatttagggtcatag

SEQ ID NO: 66651 - DNA, 150 bp, Glycine max
  Peptide Sequence Number=SeqID_183429
atgggtttgaagaacaacatggtggtgttaaagcttgtgatcgctgtgcgtgcacacgctcgatgccaggccagtgtcgttgccttgacaccaccgacttctgctacaaaccttgcaagtccagtgatgaagatgatgactaggaattaa

SEQ ID NO: 66652 - DNA, 315 bp, Glycine max
  Peptide Sequence Number=SeqID_183430
atgcagattactggcgcgataggtggaacggcaaatgctggtatccagtatcttatgaatggagaagttaatccaacggatgtgctcattgcgacgtatgttggagcatttactgcaaatacgggagcctggggaaccgtgggctggaatgcggcaggtggtgcaacatccagctatctgaacggtgatgatccatttaaaggtggcgtaataagtggtgccgcttcgggtatcggttatggaatagaagcaacaggacaaggtggctctaaaactactaataatttgtggaagagaactgaaaatgaaaaatga

SEQ ID NO: 66653 - DNA, 795 bp, Glycine max
  Peptide Sequence Number=SeqID_183431
atggggaggcaaccttgctgtgacaaacttggggtgaagaaaggtccatggacagccgaggaagacaaaaaactcataaacttcattttcaccaatggccagtgctgttggcgtgctgttcccaagcttgctgggcttcggcgttgtggtaagagttgtcgtcttcgttggactaattatctaaggcctgacttgaagagagggctcctcacacaggctgaagagcagcttgttatcgatctccatgcccgtcttggcaacaggtggtccaagattgctgccaggttaccaggaaggacagacaacgagattaaaaatcactggaacacccacattaagaaaaagctccttaagatgggtattgatcctcttactcacgaacctcttaacaaacaagtctcatccaaagatagttcatcctctgaagagaatttgccacaagctgacaacactcatcaggttaaggaaagtgatagggttctcaactcagaagaaaattctagctcatcagcagctgaaaattcttctggtgaagaatcccttttagtggaaagcgatgtgtctctaatgaacaccatgtggctggatgaaactcctctaatggacacattatgggacaatacacctaaactagagaatgcaaatagtaacatgggcttgccaatatgggaggataattgtgcttggttgttggactgccaggactttggtattcatgattttggtttcaattgtttcagcgagatcgaatcaaatgtactgcaatctataggcatggacagaaaagggctttag

SEQ ID NO: 66654 - DNA, 834 bp, Glycine max
  Peptide Sequence Number=SeqID_183432
atggccacgcttagcttcggcatcgccacgacatgtctgagtgctgccgctgattatcgtagaagaagcaactggaaatggagcagacccagaattgtgaaggacccggaaggcgtgcttggtccaccccaaactgggcacctcgccaggttcgagtttaagaggcgcctcgagagagacgcagatgcccgcgaagccttccaacgtcaagtccgtgaagagaaagaacgccgtcaatcccttcgacaatctcgtcctcttcccgatactccgcaagacctcattgaatacttccttgacactgaagctcaggagattgagtttgagattgcaagaatgagaccaagattgaatgaggaattctttgcgcaactcaaattcgagttaggacagcttcgattcgctgttaacaaaacacagctcatggaggacagacagattgagctggaggctctagagaaagccatactagaaggattagaagcctatgataagatgcaaggtgaactcgtaaaagccagggcaagcctaaccaaaatcttgacatcaaaggatgccaaagcaactttgctggagatggttgaaaagaatgaaattaatagatctttattggcacttctagatgaaaacatagcaagtgcacaaaagggcaaccaggttcgtaattggaaatgcgttttccttgtggtagtggaacctgagactaaacaggctgcagaatatatggagaagctccgcggggctgttcttcgaaagacaatactaaagaactgggatgttgtggtagcagatttctccactgtaatatcagaagtatcaaattgtacattttga

SEQ ID NO: 66655 - DNA, 294 bp, Glycine max
  Peptide Sequence Number=SeqID_183433
atgcaaaagaccacgctgcgcctcaaggaaacctatttgaaccgttcccatcactcaatccatgctagctgcatccaacttccaccctctgccacacaatgtctaatccactatagtgaccacatgacaatccttagaagatttgaacctccactacaatggaatgtcatcgtgcttcacaatgagattggtgataagtatgtcgttcagccttggtataaattccttcaagaaagcgatttcagccacggagacgaagtgtcattctactataggcgtgatgaaaaaatctag

SEQ ID NO: 66656 - DNA, 2070 bp, Glycine max
  Peptide Sequence Number=SeqID_183434
atgaaagttcaccactccgtccaactccttctttctctatttctactgcttgcatttcacgttcctcatatggctgttggcactgcggagcttagagctctgatggagttgaagtcctctctggatccagagggcaagatccttgggtcatggataagtgatggtgatccatgcagtggcttcttcgaaggggttgcgtgcaacgaccaccgcaaagtggccaacatctccttgcagggaaagggtctttctggttggttatctccagcactggctgaactcaaatgcttgtcgggtttatacttgcactacaacaacctttctggtgagatacccccacacatttcaaatctcactgaactgcttgatctctatcttgacgttaatactttatctggaactattcctcctgagatcgccaacatggctagtctccaagtgttgcagttgggagataaccagttggtggggaccatacctacacagatgagttccttaaagcagcttagtactcttgctttgcaatataacaagttaactggtcaaattcctcttagcttggggaacttggagaagctaagcaggcttaatttgagcttcaacaactttagtggtactgttccagcaacactagcacatattgaacatttggaagttctagatattcagaacaattctttgtcgggaattgttccttcggcattgaagagacttggggaaggattccaaggtgcaaacaacccgggtttgtgtggagttgggttttctactttgagagcctgcaacaaagatcaagatttaaatgttaaccatattgatacctcagacggagaccaacccaaaaatagtaattcttcaaaggcgctcccggagcctgcttatgttcagttgcattgtggccagacccattgttcgaaatcaagaaggtttcctcaaactgtcatcacagcaggtgttgtaatcgttactcttacattcatatgtgctggatttttgacattcttcagataccgccgtcaaaagcagaggattagtaatacattaagttcttcttcagaaggaaaagttagtcttgaccagcctaaagagttctacacaaaaagtccatctgcacttgttaatattgactattatagtggatgggatcaattgtctaatggtcaaaatgctgatgctggtggactatccaatgagtatctaaatcagttcaggtttaatgtggatgaggttgaatctgcaacacattacttctcggaagccaatttacttaataggagcaaattcgcagcaggttataaaggagttctcagagatggttctcttgtggctattagaagcattagtgtgacatgctgcaaaacagaggaagctgaatttgtaaagggcttgaacttattaacctctctgagacatgaaaaccttgttaggctgagaggtttttgttgctcaaggagtagaggtgaatgtttccttatctatgactttgccaccatgggtaacctgtctcaatatctcgacatagaagatggaagtagccatgtgctcgagtggtccaaaagagtctctatcatcaagggcattgcaaacggcattggatatcttcatagcaatgaagaaagcaaacctacaatagttcaccagaatatttcagtggaaaatgttctcctagattatcagtttaacccattgatcagggatgctggactacctatgcttcttgcagatgatgttgttttctcagctctaaaagttagtgccgcaatgggatacttagctcctgaatacatcactacaggccgctttactgagaaaagtgacatatacgcatttggagtaatcattcttcaagttctatctggcaagaccacaataggtagttcaatacggacagcagttgagtctttcagatttgatgattctgttgacacaaatctcaagggaatatattctaaatctgaagcagcaacactttcaaagcttgcaatacagtgcactaatgagcttcctgacgaaagaccaaccatggtggatgtgattcaggagctgagtgtgttatctgctcatttataa

SEQ ID NO: 66657 - DNA, 276 bp, Glycine max
  Peptide Sequence Number=SeqID_183435
atggaagatgaagccggagaagcctcgcagagaagaagaccaccaaggaatttcgcagaagagagaagagaggagaaaagctttttcgcggaagagagaaaacggaatgcttccgaaagagggaaaaaccgccgctcgcggtggtgccaccgttgcactctccgctgctctctattcgatctccctctcaccgatactaagaaggtaaagtcgttaacgatggacgaagtctctggtagtaagagttgtggcactttggctctttctggaggttga

SEQ ID NO: 66658 - DNA, 612 bp, Glycine max
  Peptide Sequence Number=SeqID_183436
atgaggaagaaagcagcgagaaaaggagtgtcaggttttccgcgaatcaggagcggcggagtttatttcggccatggcggcgggtggaactcgcagctcatcgtggagacgtggtcgcagggaggagttattgccaccagcgtgggattagccgtggcgaggtctcacacgtgcggacgacacgtgtgcgtagtttccgacgagcgggcgaggtcggagtacgtggagagaatgggcgaggcgggcgtaacggcggagatcgtggttggggaaccggaggatgtgatggagggtttggtcggcgtagatttcttggtggttgattctcgaaggaaggattttacgcgtgtgctgaggcttgcaaagttgagtaacaaaggtgccgtgttgctctgtaagaacgcgaattcaaactccaagggttttatatggcggagcctcgtggcgaaaggttcttcgcggcgtcttgttcgttcggcgtttcttcctgtggggaagggacttgacatggcacacgtgtctgcctctggaggtaataatagcagctcggggcatagatggattaagcatgttgatcaacattcaggggacgtgcatcttattcgaagatga

SEQ ID NO: 66659 - DNA, 453 bp, Glycine max
  Peptide Sequence Number=SeqID_183437
atgtcatcaaacttaaggataatgaagggtagaagaaagattgaaatgaaaaagatgacaaacaaaagcaacctccaagtggccttctcgaagcgacgtagtggggtattcaaaaaagctatggtacaccgctaccttatagaggttgcaccacatgtcacacagttcatgggagtgaacctgcatgaattcaatgcacaactcaccaagttcaccacccaacttgaaactgagaagaaacgtgctagtgagctgaaacgattgcataaggtcgttcaaactcaatggtggcgggcaactcctactaatgagatgaccattttgcaattgaacgagtttaagggggcattacaacaaatgaagatcaacaccactcgcaaatctgaaatgattctcattcataatgctattaaccccactttatttttcgcaaacgataactttctagcctag

SEQ ID NO: 66660 - DNA, 543 bp, Glycine max
  Peptide Sequence Number=SeqID_183438
atgaccaacactgatagtggtacccctactccaaattttggtgtgggtatgggattgagagattgcaataggaattatgtcaaggcaatgaccagcattgttagtggtacccctaccccaaatgaggtagaagcttgtgctttacactcaaccattatttggataaagagactaggtctttcaaatgttgttatagagacggattgcaaaacacctgtagattgttttcaagctgacactaagaattcgattgattttcatgttgcagggatcttctttcaccaatttcaaactttagaacatgcctcactccccttctccatttcaacttcccagcgcctagtttgccataattttgacgggatatatgatcctcttctggaatccctctccaatctgaagaggttccttggtgtaaccggcaacttcaaatacaatgaaatttgggcaatgttgggagagttgcgcaacctctggcccgttgatctcaactacaaccagctcattggtgggatacttgccagagctaaccaacctttgtga

SEQ ID NO: 66661 - DNA, 1204 bp, Glycine max
  Peptide Sequence Number=SeqID_183439
atgaaggagatgacgggagagtcacaaaactgcgtgtatttgtatccactgcatatgattgttgtgattaggattaaggtcattgcacaagggggatactgtgccttaagttgcgtggctgatcgggcaaatgagatatataagagggttgaagatcaaaagtctagtagaggaagaaatcaagatgctttattggctgcttgtctctacatcgcttgccgacaagaagacaaacctcgtactgtaaaggaaatttgctctgttgccaatggggccacaaagaaggaaattggccgagcaaaagaatacatagtaaaacaactgggtttggagaatggtaatgctgtggagatgggtacaatacatgcaggggactttatgaggcgattctgttctaatctttgtatgaataatcaagctgttaaagctgctcaggaagctgtgcagaaatcagaagaatttgatataaggaggagtcccatatcaattgctgcagcagttatatacatcataactcagctttctgatgataagaagcctctcaaagatatatcacttgccacaggcgttgcagaaggaacaattaggaactcctacaaggatctttatcctcatgtagctgcaactgttgttgaggatgttaagcatatgaatcatgcagctgacgaggtccatgacctgcctcaggaggttgttgttgatgataaacgttttgagttgaagttgtcctcccatggaaggaagatagagaaatttggaaggcttgcttcagagtttgaaagcatagtggctgtcacagaattaagtcctctgattgcatgttccttggacattggtgagaggggacttatatatgcttttgtagagaggtggcataaggaaacgagtagttttcatcttccgatagaaaatgtgactatcaccctcgatgatgtggcatcattgcttcatctgcccattacaggcgccttccatagctttgaggctcttcatgtagaccaagttgtggacctgttagttgacttgcttgaatgttggatctacgaacattttcttactgttgcttcttccattgctactgaagattatcatgagaggaaaccacatgcttgtcgttcaaagtctaggaaggcattactagtgtcgacgtatcgtaagcggttggatagattgacatctgatgttgtgtgttggattccttatg

SEQ ID NO: 66662 - DNA, 177 bp, Glycine max
  Peptide Sequence Number=SeqID_183440
atggctatttttaagctttgtcataccctgcgtgaagggaaccagtgtgctgatttaatcgctaagcttggtgcaaatgaagatgccaactttactgtcactcatgaagtcccgcatggcatgctgaatccgttgttaggggatgagatggaaacttgcttccctcgtgctgtttag

SEQ ID NO: 66663 - DNA, 2196 bp, Glycine max
  Peptide Sequence Number=SeqID_183441
atggcgagcaccacaccctctgctgactcagcttcagcagatgaagttaccgcaaaagccgttaacaagcgctacgaagggctggtcacggttcgaaccaaagctataaagggcaaaggggcttggtattggccgcacctggaacccatgttgctgcacaacaccgaaacggggctccccaaagcggtcaaactcaggtgctccctatgcgacgccgttttctccgcttccaatccttcacgcactgcttctgagcatctaaagcgcggaacctgccccaatttcaattccgccgccaaaccaatctcctccgtgtctccctcctccgccgtcgccgccatggccttgtcgcctccatcctctccgaccaaccacaaccaccgcaagagaatttcttcttcctacgacgcgccgtcgcagcaacaacagccgaatttggtgttatccggtggaaaggacgatttgggagctttggctatgttggaagacagtgtgaagaaattaaagagtccgaaaacttcagccggtccaactctaaccaaaagtcaagtcgatagcgcctttgattatctcgctgattgggtctacgagtcttgtggctctgtctctttttccgctcttgagcaccccaagttcagagcgtttctcaaccaggtcgggttgccaacagtttctatcagagagttcactggaagtagattggatgccaagtttgaagaagctaaagcatattcagaagcgcgaatcagagatgctttgttctttcaagtagcgtcggagggatggaaatggaaggggaagaagtattgtgaggagaagttggttaacatgagcgtgaatctccccaatgggaccagtttgcacagaaggaccttgtttgtcaccggctctgctccttccaattatgcacaagaggttatgtgggagacactaaccggcatttgtgggaatgtcgtgcaacaatgtgttggtattgttgcggacaagtttaagaacaaggccttgagaaacttggagaatcgaaacccttggatggttaacctttcttgtcagtaccaaggcttcaatagtttgatcaaggacttcaacaaggaactccccttttttaacaccgttacacacaattgtctcaggctcgccagtttcatcaatttcaagtctcaggtgaggagtagttttgacatgtaccaacagcaggagtacgggcacacctggttgctccgaatgccattgccctctcgccagttcgagtattttgacactgtgtatgcaatgatggaggatgtgttgagttcggttcgtgccttgcagttgctgctgttgaatgagaacttcaaaatggcgtcaattgaaaacccgaatgcgagggaagttggggacatgattcgagatgtggggttttggaatgatttggaggctgtgcattcgttggttaaattggtgaaggagatggttaaagagattgagacagagaggcctcttgtaggacaatgccttcccctttggggagagttaagggcaagagtgaaggattggtgctccaaattccatgttgcagaagcggcagtagagaaagtcattgaaaaacggttcaagaaaaactaccaccctgcttgggctgctgcttacattcttgaccctctttatttggttagggacacgagtggcaagtaccttccaccgtttaattacttgacgccggaacaggagaaagacgtggacaagctcataacaaggcttgtgtcaagggatgaggctcatattgtgttaatggagctaatgaaatggagaacgcaagggcttgatcctgtgtatgctcgtgctgtgcagatgaaggaaagagatcctgttactgggaaaatgaggcttgtgaatccacaaagtagtagacttgtgtgggaaacttatctcaccgagtttaagtccctgggaagagttgcagttaggctgattttccttcatgcaacctcgcgtggtttcaaatgtaattggtcttcgtggagatgggtgtgtagccaaggaaactccagagcagcactcgatagggcgcacaagttgatatttattgcagctcattccaaattcgaaagaaaggatttttccactgatgaagagaagaatgcggagttgtttagcttggcaaatggtgaggatgatgtgctgaacgaggtttttgtggagacatcctcagcgtga

SEQ ID NO: 66664 - DNA, 1149 bp, Glycine max
  Peptide Sequence Number=SeqID_183442
atgctgaggtcatcaaaaacaggggattccaaatcaacttggaaggtattaataatggataaacttactgtgaagataatgtctcactcatgcaagatgactgatatcactgatgaaggtgtttcattggttgaagacatatacaagagaaggcagccattgcccaccatggatgctatatatttcatccagccaaccagagaaaatgtaattatgtttttgtcagacatgtctggaaggacacccttatacaggaaggcatttgttttcttcagttcagctatttccaaagaattagttatggacattaagaaagatacgaaggtgttgactcgattaggtgcattgagagagatgaatttggagtattttcccatagacagccagggtttcatcacaaataatgagagggcattagaggagctatttggggatgaagagaataatcataaaggtgttacgtgtttgaatgtgatggcaaaacggattgctacagtttttgcttctttaagagaatttccttctgttcgctttcgtgctgccaagtccctagatgcaaccacaatgactactttccgtgatcttattcctacaaagcttgctgctggagtctgggactgtcttatgaaatataaaaaaagtatacctaattttcctcagacagagacctgtgaattgctcattgttgacagatctattgatcagattgctcctgtgatacatgaatggacttatgatgccatgtgtcatgatttgctgaatatggagggaaataaatatgttcatgaagttcctggcaaatccggtggtccagcagagagaaaagaggttcttttggaggatcatgatcctatatggctcgaacttcgccatgctcatattgcatatgctagtgaacagctgcatgagaagatgaccaacttcatttcgaagaacaaagctgcacaaatacaacatggttcaaagtgggttaacccggccaccataggttcagcccgggtggagcgggtcatagggggacagatccattttttaagaagtagcagtgaaatgtcaacaagggacatacaaaagatggttcaagcacttccacagtacagtgaacaaattgacaagctctccctccatgtagaggtccttactgtttaa

SEQ ID NO: 66665 - DNA, 741 bp, Glycine max
  Peptide Sequence Number=SeqID_183443
atgtctccacggagaagttcgccggtggttgccgcccggaaaaataaggcgccgcacccctcgccgtctccccgtcgtaggacccagagcaagtcgaggcctatcaagatcctgaagcgctgttcgtcggctcctctgctttcaagccatgataacgccgatgctgacgttgacggccattattcgaggaggagcggaggagggtcgtttttccgccccaaaaccttttcagatgcctttctgtcttccccttcccccttttcctctccacggattcacactaaacagctgtatcgtaagaggtacgagaaagaagctaaggtggtagttaatgtgaccgttgagggaagtcctgggccagtccgaaccatggttaaactggggtccagtgtggaggatactatcaagcgtgtggtcgataaatatacagaagaaggcaggagcccccagatcgatcctaatatggcttcttcattccaattgcatcactcctatttcagtctccagagtttggataaatcacaagtcattgcggatgtgggtagtagaagtttttatctgcggaagaataatgatgcatcttcatttcgttggggaagtgctcccgaaatattcacacgtggctccactccatccatcgcaaatcctccattgctgatcccttctttcattgcccgcaagattagcaaaattgtaagaagagctcaccgcctttggaacattgtgctttgctcacagtga

SEQ ID NO: 66666 - DNA, 1326 bp, Glycine max
  Peptide Sequence Number=SeqID_183444
atggagtggcctgcgtctacggacgaatacgaaaagctcataatacggatgagcactcccagggttgtcattgataattccgtttgctcctcagctacgctagtcaaggttgacagcgccagaaggcatggtattctattggatgcagtacaagtgctaactgacctcaacctttcaattaagaaagcctatatttcagctgatggcaagtggttcatggatgtttttcatgtcactgatcaaaatggaaacaagataatggacgagagtgttttaaaatatattgaacagtcacttgggaacattcactatgggagaaccaaccgctctaacggtctcactgcgctggaattaacaggatctgatcgagttggtcttttatcggaggtgtttgctgtactggctgatctccaatgcgatgtggctgatgccaaggtttggacacacaatggccgtattgcctccttaatctatgtaaaagattgtagttctgggtctgctattgaggactctcagaaaattaataagattgaattgcgcttaagaaatgttttgaagggagacaatgacattagaagtgcaaaaatgtctgtctctatggccgtgatgcacactgaaagaaggctacaccaattgatgtttgttgaccgtgattatgagaggactccaattcttaaattgacttctgataacccattggtgactgtccagaattgggaaggaaggggttattcagttgtgaatgttcagtgcaaagatcgaaccaagctgttatttgacattgtatgcaatttgacagacatggaatatgttgtattccatgcaactattaacactagtggtgaccgagcttacctggaattttatataagacacaaggatgggactccaattagttcagaaccagaacgtcaacgtgtaattcaatgcttaaaagctgctgtagagagaagggcatctgagggtgttcgattagagttatgcacagaagacaggcaggggcttctagcggaagtaatgagaactttccgagagaatggactcaatgtgaccagggctgagatatctaccatagggaatatggctacaaatatattctatgtaacggatgcgattggaattccagctgattcgaaaattatcgaatctgttaggcagaaaattgggttaagcaatttagaagtgaaggagttgccattgataaatcaccaggaggcagagggagaggatcaagcggttggaattggtggggcagtgctgttgtccattgggagccttttgagaaggaatctgtaccatttgggactaatcaaatcatgttcttaa

SEQ ID NO: 66667 - DNA, 1509 bp, Glycine max
  Peptide Sequence Number=SeqID_183445
atggcatccacagcgtcgccgatgacggttcaggcgggtcgggttcggaccctgaaagaaggttctcgcggagaatcgggtttgggtccggtcgtgtactggatgttcagagaccaacgtgtgacagacaattgggctctgatccacgctgttgctgaggccaacaaagccaacgttcccgttgccgttgttttcaatctcttccacacctttcttggcgccaaatcccgtcatttagggttcatgctcaggggcttgcgccaattgtgccaccgtatgcaacactctcttcaaatcccctttttcttgttccagggagaggcagaggagacagtgccaaagtttcttagagaatgtggagcttcacttttggtgacggatttctcacctttgcgggaagtacggaggtgtaaagaagagatatgcaagagggtaagcgattcggttgctgtgcatgaagtggatgctcacaacgttgtgcccctttgggttgcctctgataaattggagtacagtgctaggaccatcagggcgaagataaccaaaaggctttctgactatctcgttgatttccctgacattgaagttgagccaccagctgggaagtgggtggctactgagaaccattccattgactgggatgatctcattgctgatgtgttaaggagaggagcagaggttcctgaagttgattggtgtgagccaggggaaattgccgcaagtgaagtattaatgggaagtaaaaatggattcttgactaaaaggttgaaaggttattccctggaccgcaacaacccgtgccaccccaatgcgctttctggcttatctccctatttgcactttggacagatatctgctcagcgatgtgctttagaagcacgtaagcggcgaaattcacatcctcaagcaattgatgctttcttggaggagttgattgtgcggagagagcttgctgataactattgcttctaccagcctcattatgattcattaaaaggagcatgggcatgggctcagaacaccttaactgaacatgccactgataagcgagaacatatttacacgaaggagcagttggagaaggcacagacagctgatcctctctggaatgcttctcagctggagatggttcactatgggaaaatgcatggttttatgagaatgtattgggcaaagaagatacttgagtggacacgaggacctgaagaagcccttgagatatctttgtatttaaatgacaagtatgaattagatgggagagatccaaatggttatgttggctgcatgtggtcaatatgtggggttcatgatcaggctgtgggttggaaagagcggcccatttttgggaaaattcgatacatgaactatgcaggctgcaaaagaaaatttgatgtcgataaatacattgcatatgtcaataaattagttcgtgagctcaaaaagaggaaggctgaaaacttgctatctcaaaaggagaaagtagttcgcagttgtgatcctgaagattga

SEQ ID NO: 66668 - DNA, 276 bp, Glycine max
  Peptide Sequence Number=SeqID_183446
atgtacgcgaatctaggtggattttatttcctggccctaccacttggtgttgtttctgccttcaagctccgtcttggtcttgttggactcttcattggacttcttactggtattgttacctgcctgacattgttattggtatttattgcgcggttaaattgggtggaagaagctgcccaggcacaaacactaacaggccaagagcagggcacgatgaaaaagacatggcttaaccgtgtgcacaaattgaaagcaggagggaggtcatacatataa

SEQ ID NO: 66669 - DNA, 740 bp, Glycine max
  Peptide Sequence Number=SeqID_183447
atgggcttccgatctggtttcgatgagctaagagttcaacgaggaatagcccttccaatggtggccatgaatttggcttggtttgccaagacagccatcacaacagcatttttaggccgtcttggggagcttagtttagcagcccatatatgtggacaggctcatggtgccaaaaacttcagactccttcacaagactcttctcatgacaatctcattgttgctattggtatcacttcccatcactttcttgtggcttaatgttgacaaaatcttgatcctttttggccaacaacaagacatctccactgtggccaggacctatgtttcatgtctcatacctgacttgtttgttgcctcactcttctgtcccttaaaagcctacttgagctctcaaaccataactcttcccaccatgtttagttctgctgtggcactagccttccacataccaattaacatagtgctctcaaggactatgggcctcagaggaatttcgatggcagtttggataactgatcttattgttgttgtcttgttagccatttatgttttaattcttgagaggaaaaaggaaagcatgtggaaggaaggagggtggtgggatcagagcattgaagattggataaggctgctcaagctttgtggatcatgctgcctcaacacatgccttgagtggtggtgctatgagattctagttttgcttactggccacctcacaaatgctaagcaagcagtgga

SEQ ID NO: 66670 - DNA, 171 bp, Glycine max
  Peptide Sequence Number=SeqID_183448
cttttctcgctcagcggatggaccgaagtggtgcgcttagcgggatggcccttcgctcagcgaatatgcacaactcatccttcttccaaattcttcctcgcgcttagccgaggaatgatatgctcagcggatagctcgctaagcgagaagattggcttagcaagagggtga

SEQ ID NO: 66671 - DNA, 156 bp, Glycine max
  Peptide Sequence Number=SeqID_183449
atggaggttagggttgccttttatagagagatagtggcattctggttggctgaggtaggtggcgggagtaaatgttggagtaatggaagttttgatgaggtgaagacgaagaaatgtagcggattacatgcaacagacacgcaagtgatcgattaa

SEQ ID NO: 66672 - DNA, 759 bp, Glycine max
  Peptide Sequence Number=SeqID_183450
atggacgtcagtgctcttgtgtcagggttgacgtgtgtcttggagtgccaggcgaggtctgacatgtcagatgaaggaagcctgcatgtgcgatgcacatgcagtacacttgcatatgtatcactcatggagtgggcacatactggagacgtggtacgtggtggacgtttgatttctgatcaccattactttgaatttttgccttctttctctcaaaatctctttgctttcatgcttgcttcttgtgattccctttcttcttcattcatcttcaatctacaaggtattccttctctaacgatgtcatcatttttgtctgacggtgaatcctcttcctcggaaaggttgagggtttcgcattgtgctggcggaggcatttctcgcccctgtgggagggcgcagcctttcgctgcttccccagcaagggagcctgtcccgattactatgattctccccccttctatttctggtggagcaagggacgatgtttcgaagtacaagtccttcatcacttttgtggcaagtgttgttgctctgcaacgccaggtaaaattggcaagccctgaggactcctgcaagatagtcgttcaggcttgtcttgagtctcattctccccttgatcgcattccaatgtgctatgcttgtgcacttgaacatggtcatttgccaactcctccccatgggccatggttgttagagatagagggaacaacattaacaacatgtagactaaagcttgaagcttggagaaaatcttga

SEQ ID NO: 66673 - DNA, 303 bp, Glycine max
  Peptide Sequence Number=SeqID_183451
gcccaagcagcagaggcattgaaatctaaggagaagaattttcaagaggcaaacagtttggccactgaatcccaaaatgctgctgaagctgaccagctggtaaatgattccaaaatgctgctgatgctgacaagctgttgtctggttgaacaaccaaaagtaatgctggattcaacaaaggaagaaaaagctgaggatgttaaagagcttgcttctgtgattgccaaagcctctgatggttgtgaggatattgtttttaatcctaatgtcttcactgaattcaaacttgctgggagtccagag

SEQ ID NO: 66674 - DNA, 210 bp, Glycine max
  Peptide Sequence Number=SeqID_183452
atgtgtttatcggggaaggggagtatgctgatgaaatcttctcatattacaaatgagattttggatgttagcatttcgtttttaaatgaccatttagaggaaacaccgggttcaacaaaaatagaagaaaatcactcaaagtgtattaatctcacacagagtgaggcgaacaagtcatcgacgcacaagattttggttggtaatcaaagg

SEQ ID NO: 66675 - DNA, 463 bp, Glycine max
  Peptide Sequence Number=SeqID_183453
gtctgagttcctcatgggaggatacgtaggagcaaaagcctcgcttttgtcgaccgcaccactttatgttaccatgacccaagagctggtagcccgcggagacaccttacggttatccgcacccttttgtcatccagaggcggcgggcccgatgacaagcagagacaaaatttggtcattatgcacccttgtgtcatccagaggcggcgggcccgatgatacgcggagataccttacggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggagataccttatggttatccacacccttttgtcatccagaggcggcgggcccgatgacaagcagagacaaaatttg

SEQ ID NO: 66676 - DNA, 897 bp, Glycine max
  Peptide Sequence Number=SeqID_183454
atggatcctattacagcacatggtcactctcttccacctcctttccacacagcaagagatctccacctccaccaccaacagcaacaacaccagttccactccttacaagaagacgagcaaagtggaagcagcggaggcctaaacctcgcagctcacaaaagggaacgcgaagaaaacaacaacagcgatggcaaagaaggtggtgctggctccgccgaaaccgaaatttcaagaagacctcgaggaagacccgccggatccaagaacaagcccaagccccccatcatcatcacgcgtgacagcgccaacgccctcaaaacgcacgtcatggaagtcgccgacggctgcgacatcgtcgagagcgtctccgccttcgcccgccgccgccagagaggggtttgcatcatgagcggcactggaaccgtcaccaacgtcaccctgaggcaacctgcttcttccggcgccgtcgtcactctccacggcaggttcgagatcttgtccctcgccggatccttcctcccacctccggcgcctcccgaagcctccggtttgaccatatacctagccggaggacaaggacaagtcgtcggaggaagcgtggttggcgcgctgattgcttcggggcctgtggttatcatgtcagcttcgtttagcaacgctgcgtatgagaggcttcctttggaagatgaggagccgtcgattgggcttcagggaggaggttcgattgggtcacctggcggtggcggtggcgttggtcaatcgcaggcacctcatcagcttatgggggattctactacagcgcctcttttccatggtttgaatccgaatcttctgaattcggttcagatgccgtcgacggagacgttctgggcaacgggtcgctctccttactgctga

SEQ ID NO: 66677 - DNA, 876 bp, Glycine max
  Peptide Sequence Number=SeqID_183455
atgggtggtcttaattctctcacttctcaagttaaacatcaacagcaagcttcaggaaatggagagaaaccctcaatagccaagctctttgagcaagtgggattgcagaaaattttgtctttgcttgaagcagaagatgctgatgtgcgaatccatgctgtgaaagttgtagcaaatctagctgctgaagaaacaaatcaagggaaaattgtggaagcaggagggctcacatccttgcttaacctgcttaagagctcccatgatgagaccatacatagagttgctgcaggtgcaattgcaaatttggcaatgaatgaaaccaaccaagaactcattatggcccaagggggcattagcttgctgtcaatgactgcagccaatgctgaagatcctcaaacccttcgaatggttgctggagccattgctaatctttgcggcaatgataaactacaaacaaaactaaggtccgaaggtggtatcaaggcactgctgggaatggtcagatgcagacatcctgatgtacatgcacaagttgctcgtggaatagcaaattttgcgaagtgcgagtcaagagcatctagtcaagggacaaagagtggaagatctttccttattgaggatggtgcccttccatggattgttcaaaatgcaaacaacgaagctgcatcagttaggcgtcatattgagcttgcactctgtcacttagcacaacatgaaataaatgcaagagacatgattagtgggggtgcattgtgggagctagttcgtatctcccgagattgttcaagagaagatataaagactcttgctcatcgaacactagtctccagccccactttccaagctgaaatgagacgtttgcgggtaaattactga

SEQ ID NO: 66678 - DNA, 399 bp, Glycine max
  Peptide Sequence Number=SeqID_183456
atggagtcaattaagaagcttgaagagcagttggtgatgaatcaacgaaagaatgaggaatctcatatgaaatcgagtggagagattcccagagtgtctgctgaggaactggctgatttgaaaaaaatgcttcagaaagagactcatctaagaaaagctgctgaaggggaagtaaacaatctgaagaatcaagtggctgaactaaaaaagtcagaggcatcaggaaaatcagagatcttaaaacttcataacatgttggaagataaggaaggtcaaaaagagaaacttgaaggagaaatagcaatattacaaagtcaattgttgcagttaaatcttcaagctgatgaggtaggctatatcaaaagtgtacaaatgcctcagtttatggattttatctag

SEQ ID NO: 66679 - DNA, 1170 bp, Glycine max
  Peptide Sequence Number=SeqID_183457
atggccacctctcagggtggtaacagttacagaaatgccagaacctctctcaaaccacacgtcaagtcaaagccttcccaacaacgccgtaatagcaccggctccgtcaacggcaaggaacacgctgctgctgttcccggaagagttagagtggctgttagattgcggccacggaatgcagaggaatcggtggcggatgctgactttgctgactgtgttgaattgcagccagagctcaagaggttgaaacttcggaaaaacaattgggatgcggatacttatgaatttgatgaggtgctcactgaattttcatcacaaaaacgcgtttatgaagttgtggcaaggcctgttgtggagagtgtactggatggctacaatgggacaattatggcgtatgggcagactggtactggtaagacttatactcttggacgacttggagaggaagacaatgctgcacgtggaataatggtgcgggccatggaggatattcttgcagatgtttctttggacactgattcagtctcagtctcttatttgcagctttatatggagactatacaagatctgcttgaccctgccaatgataacataaccatcgtagaagatcccaaaactggtgatgtttcattacctggagctagcctagttgacattagggacaagcagagttttgtagaactattaagattaggagaggctcaccgctttgctgcaaatacaaaactgaatacagaatcttctcgaagtcatgctattctgatggtgcatgtaaagagatccgtgaaaggaagagatgcggctctttcaagtgaaaatggcaatcattcacacgtggttaaatcaataaagccgcctcttgttcggaaaggcaagttggttgttgtagatcttgctggttcagagcgaattgacaagtcaggaagtgaaggacatacattagaggaagccaaatctatcaatctatccttgagtgcattggggaagtgtattaatgcacttgcagagaatagtgcacatgtgccatttcgtgactcaaagcttactagattgttacgtgattcatttggagcagtaagattctcaattatggcatggtatgtagcggatgctgacaggtacagcaagaacttcactagtcattactattgggccatctccacggcatag

SEQ ID NO: 66680 - DNA, 177 bp, Glycine max
  Peptide Sequence Number=SeqID_183458
atgtgggtgtcaaagagcttgcggaggaagcacatgagagagcaaaagattttgagaggagtcagggcgtgtggcgacaatgatcctcaacttggtgtgagagaggacaatgaggaggccaatgttgttttgtgtagagagtattctgataaaatatttgttttgatgacaaattag

SEQ ID NO: 66681 - DNA, 189 bp, Glycine max
  Peptide Sequence Number=SeqID_183459
atgattgcgatcatacccgcaaaatcattacagttgctccaaagttctccacaaacaaagggattgcggaagagatataaaaagaacaacacaaatcgctattgcttcaagggaacgagtcgaatgggagtcgagttaatccacatcgaccagatagagaagcgcattgaaaattggaaaaaagactaa

SEQ ID NO: 66682 - DNA, 1224 bp, Glycine max
  Peptide Sequence Number=SeqID_183460
atggagcaaaattcaatgtcaattctggagattcttaagcaatcaaattcatatctgcctcatgcactcattgcaagtatactgctagctctaatctacccacgttctttaacgtggtttaccagcagattctatgcacctgcactaggttttttgatgtttgctgttggggttaattcaaatgaaaatgacttccttgaggcattcaagaggccagcagaaattgtcactggttattttggccagtttgctgtgaagcctcttcttggatatctgttttgcatgattgcagtaactgttttaggcctaccaacaacagtaggcgcaggaattgtattggtggcttgtgttagtggtgctcagctttcaagttatgctactttcctgactgatccacaaatggcacctttaagcatagttatgacatcactgtccactgcttctgcagtttttgtcacgccactcttattactgttgctcattgggaagaaattgcctatagatgtaaaaggaatggtgtataacattacacagattgtggttgtgcctattgcagctggcctgcttctaaatcgattctttcctcgtatttgtaatgttattcgaccatttttgcctccgctatctgtactggtggcatctatctgtgccggagcgccacttgccttaaatgttgagactatgaaatcccccttgggagtcgctatcttgttgcttgttgttgcttttcatttgtcatcttttatagctggttatatcctcagtgggtttgtcttccgcgattctcttgatgtgaaggcactgcaacgaacaatttcctttgagacaggcatgcaaagtagcctgcttgccctggctcttgctaataagttcttcgaagatccaaaagtggctattcctccagcaatttctctctgcaaatggtgttcttctggttattctttcctttctggttcgccggataaggtgagagagactgatcatgagaagctgccttgtgagaagagtcgtgacaaagaagaaccggttcattcacagaacggttctaaggaacatccggacaggacaggcaaccggttgaaccggccgatccggtccggttttgaaaaccttgattttgagtgtgatccagagaggaggacttgcactgggggtgttgagtataacatatattattgcatgactagactacctagagaagtaggagggcgtagtgctgtttaa

SEQ ID NO: 66683 - DNA, 189 bp, Glycine max
  Peptide Sequence Number=SeqID_183461
atggggatgtgcggtcacggttgtcgcacccaactaatctgcggccacacccaactcttcagtttcgcgaccaggattcgcgtcagatccgcactccgttcagaaaacggtcttgatgttgacgtcgatttgcggaatgtcactgcacgagcgctgcgacgaaaagcaagacggatctacatgctataa

SEQ ID NO: 66684 - DNA, 2277 bp, Glycine max
  Peptide Sequence Number=SeqID_183462
atggaacttgcattgcctcttgctcttgctcttattttcgtgctaattagtatatacccaacttcagcacaccaaaatacagaattcgtgaatgcaaaagaggaactcgatgttccaagcagcttattgacttacattgttcgtgttaaaaagcctcaaagtcagggtgatgattctcttcagtataaggacttgcatagttggtaccattcacttctaccagctagtacaaaaactgatcagaaccaacaacgcattactttctcataccgcaacgtggtggatggattcgccgtgaaattgaacccagaagaagccaaagctcttcaagagaaagaggaggttgtgtcagcccgtcccgaaaggacattttctttgcacacaactcacactccaagcttcttggggttgcaacaaggactaggactatggaccaattccaattttggcaaaggcatcataattggaattctggacacaggcataacccctgaccacctttccttcaatgatgaaggaatgccacttccaccggcaaaatggagtggccactgtgaattcacaggggagaaaacttgcaacaacaagctcattggtgcaagaaatttcgtgaaaaacccaaactcaacccttccactggatgatgttggtcatgggacccacacagccagcacagccgcaggaagatttgtccagggtgctagtgtctttggcaatgctaagggtactgcagttggcatggcacctgatgcgcacttagcaatttacaaggtttgtgacctctttggttgttccgaaagtgcaatactagctggaatggacactgccattcaagatggtgtagatatactttctctctcacttggaggaccccctgctcctttctttgatgacccaattgcacttggtgcattcagtgcaattcaaaagggtatttttgttagttgttcagctgctaacgctggccctttttattcctctttgtctaatgaggctccgtggattctcactgttggtgccagcaccattgacagaagaatagtagcagcagcaaaacttggcaacggggaagcatttaacggggaatcggtgttccaacccaacaacttcacgtccacgttactaccacttgtctatgcaggtgcaaatggaaatgactcttctaccttttgtgccccgggatccttacagagcatggatgtgaagggaaaggtagtgttgtgtgagataggtggattcgttagaagagtagacaaaggacaagaagttaagagcgctggtggtgcagccatgatcctcatgaactcaccaattgaagacttcaatccctttgctgatgttcacgttcttcctgctacacacgtgagttacaaggctgggttagccatcaaaaattacataaactcaacatcaacgccaacagctacaattttgttccaaggaaccgttattggaaatccacatgcacccgcagttacttccttttcctcaagaggtccaagtttggaaagccccggaattctgaagccagacatcattggaccgggacagaacattctagctgcatggcctttgtcattggacaacaatcttcctccattcaacatcatttctggcacctcaatgtcttgtcctcatctcagtggcattgctgctttgctgaaaaactctcatccagattggtctccagctgcaataaaatcagcaatcatgacaagtgctaacactgtgaatcttggagggaagcctatattggaacaaaggcttctaccagctgatgtgtttgccactggtgctggacatgttaaccctttgaaggccaatgatccaggccttgtttatgatcttcaaccaactgattacattccttatttgtgtggtttgaactacacagacaaagaagttggattcatcttgaaccagaaagtgaagtgcttggaggtgaaaagcatagcggaagcacaactcaattatccctcgttttctattcggttggggtctagttcacagttctacaccagaacactcacaaatgttggacccgccaacataacctactctgtggaagttgatgcgccttcggctgtaagcataagcataagccctgcagagatagcattcacggaggtgaagcagaaggtttcatactcggttgggttttatcctgaagggaaaaacaatagaaggaaacacccgtttgctcagggatctatcaagtgggtatctagcaacggcaagtattctgttagcatccctatagctgtcatcttcctgtga

SEQ ID NO: 66685 - DNA, 204 bp, Glycine max
  Peptide Sequence Number=SeqID_183463
atgctaaacgaacacacatgtaccaccccgatcgaggaagacttggcaaaacagcaacacggaccttcacagaccacggagactcacgcaaacatccaccggcgtgaggatgaagaagcgatgccgcaacctttgatgaccaccggcaacaccaacgatgtccaccagaccaacaacaagaacatccacaagcagcaggagtaa

SEQ ID NO: 66686 - DNA, 1506 bp, Glycine max
  Peptide Sequence Number=SeqID_183464
atgagagtgatagtgcctctacaaggagttgtccaaggcacagggggtcttttctggggttctgtcattccttgtgctctattctactttcttcagctctacttcaaaaccaagacacctcaccaccctccaccttcccaaaacaaccacaaggacgatgactccaccaccttccaccgctctctctcttccaatcacaggcactccactaccactgcctccgcttacgtgtctcctcgtgccaattccataaccgctgctaactccccttacttcctaggcttgcacaagcttgcagatgatccctatcacgagactcataatcctgatggtgttattcagctttctttgcatcaaagcaccctgtctctcgacttgattcaagattggattcaccacaacggaagcactgctgtgttcgggacaccactcggcatttctaggattgttccttaccaacctctccatggattgatggagctcaaagtggctgtggctggtttcatgtctcaagttttggaaaacctgattttcttcaacacctcgagaatggtactaactgcaggtgccacttctgccatcgagattctaagcttctgtctagcagatcatggaaacgcattccttgttcccacgcctcttagccctggctttgacggggttgtaaaatggcgcactggcgtggagatagtacctgttccctgccgcagcactgatgacttcaatttaagtataacttcaatcgagagaaccttcaatcaagcaaagatgcgtggtcaaaaagttcgcggaattataataaacaacccctcaaatcctgctggcaaactattggatagggaaacactgttggatcttttggactttgctagagagaagaacattcacataatctctaatgaaatgtttgccagctcttcttatggaaacgaagagtttgtgagcatggcagaaatcatggaggcagaagatcatgaccgggacagagttcatgtagtgtttggtttgtcaaatgagctctcggttccaggtttaaaggtgggtgttatctactcttataatgacaatgtcgtggctgcttctagcaaattggcaaggttctccactgtttctgccccaacccaaagattgctcatctccatgctctcagatacaagttttgtgcaaaattttattgaggttaacagattgaggctgcggaaaatgtataatacatttgttgcagggctgaagcagttggggattgagtgcactaggagcagtggtggtttttgctgctgggctgacatgagcaggttgattcgctcttacagtgaaaagggggagcttgagctctgggatagattgttgaatgttgctaagatcaatgttaccccgggatcatcatgtcactgcattgaacctggatggtttcgtttttgttttgctacatccactgaaaaggctgtttctgtagtaatggagcggcttcggagaattgttgaggccacaaatggacatagttga

SEQ ID NO: 66687 - DNA, 204 bp, Glycine max
  Peptide Sequence Number=SeqID_183465
atggaaaatatgttgggcaggggaattttgatagaaacattggctaatgcttcacatcaaaatcacactctatccactccacaaattgccctcaatgtagttggtttctgcataagtggagctacaataatctttttcacagcctatgcaaagaggcagctcaaggagttacaacagaaagaggatggtttgctcttgcaataa

SEQ ID NO: 66688 - DNA, 2655 bp, Glycine max
  Peptide Sequence Number=SeqID_183466
atgagaagacaccgtgaaattcatctctctcatgctctgttgtgcaccgttttctgtttgcttgtggcagcttctgcagcgactgagaaggaaattttgctcgaattcaagggtaacatcacggaagatccacgcgccagtttgagttcgtgggtttcaagtggaaacctgtgtcatgattacaagggtgtttcttgtaattccgaagggtttgtggagagaattgtgctttggaacactagcttgggaggggtgttgtcctcatcactttcggggctgaagaggttgaggatattgacgttgttcgggaaccgtttctcaggtagtattccagaagcctatggtgatcttcactcgttgtggaagatcaatttgagttccaatgctttatctggttcgatccctgacttcattggtgatttgcctagcattcggtttctagatttgtccaagaatgacttcactggggagataccttcggctttgtttaggtactgctacaaaaccaagttcgtttctctttctcataacaaccttgctggttcaattcctgcctccttggtgaattgctccaaccttgaagggtttgatttttccttaaacaaccttagtggggctgtcccttcgcggctttgtgacattccaaggctgtcatatgtgtcgctgagaagcaatgccttgtcagggagcgtgcaggagctcatttccacatgccaaagtttggtacatttggattttggtagtaataggttcactgattttgctccattccgcgtccttcaaatgcaaaatcttacctatctcaatctatcgtataatgggtttggaggacacattcctgagatcagtgcctgtagtgggagattggaaatctttgatgcttcggggaattctttagatggggagattccctccagcataactaaatgcaagagcttgaagctcttggcattggagatgaataggttggaggggattatcccagtggatattcaggaattgcggggactaatagttatcaaattgggtaataattccattggtggaatgattcccaggggctttggcaacgttgagctgcttgaattgctggatttgcacaatctaaacctcgttggccaaattcctgatgatataagcaattgcaagtttcttcttgggctggatgtttctggtaataaattagaaggtgagattcctcagaccctttacaacttgacaaacctggaatctcttaacctacaccataaccagcttaatggaagcattcccccaagcctaggaaacctatcaaggatccagtatctagatctgtcacataattcactttctggcccaatccttccttcccttggaaatttaaataacttgacacattttgatctctcattcaataatctctctggtcgcattcctgatgttgcaaccatacagcattttggtgcatcttcattttccaataatccttttctctgtggtcctcctttggacaccccttgcaacggagctagatcgtcttcagctcctgggaaagctaaagttctaagcacctcagtaattgttgcaattgttgctgcagctgtaattctcactggggtttgtttggtgaccatcatgaatatgagggcacgtggtagaagaagaaaagatgatgatcagattatgattgttgagagcacacctcttggatcaacagaatcaaatgttataattggaaagctggttctcttcagcaaaagcttaccatcaaaatatgaagattgggaggcaggtaccaaagcattgcttgacaaagagtctttgataggtggtggatcaattggtacagtctaccgaactgattttgaaggcggcatctcaattgcagtgaagaagcttgagactctgggaaggatcagaaaccaagaggaatttgagcacgaaattggtcgactaggcaaccttcaacaccctcatttagttgcttttcaaggttactattggtcatcttcaatgcagttgattctatcagagtttgtcccaaatggaaatctgtatgataatctacatgggtttggctttcctggaaccagtactagtagaggcaatagggaattatattggtctagaaggttccaaatagcagtgggaaccgcgagagcccttgcttatctccaccatgactgtagacctccaattcttcatctcaacattaaatcctctaacattctcctagatgacaattatgaagccaagttgtctgattatggtttaggaaagttacttcccattttggataattatggtctgaccaaattccacaatgctgtgggatatgttgcaccagagttagctcaaggcctgaggcagagtgagaagtgcgatgtttacagttttggagtcattcttttggagctggttacaggaaggaggcctgtggaaagtccaaccacaaatgaggtggtggttctgtgtgaatatgtaacaggtttgttggagactggctcagcttcagattgctttgacagaaatttacttggctttgctgagaacgaattgattcaggttatgagattggggctaatttgtacttcggaggatcctttaaggagaccaagcatggctgaggttgtccaggtccttgagtccattagaaatggattggagtcccattag

SEQ ID NO: 66689 - DNA, 1104 bp, Glycine max
  Peptide Sequence Number=SeqID_183467
atgtcttctgatagtgcaaaggaaaatgcatcagtagttgattcatcagtcactgaatggaggaatgacattggaaattcagatgatccagatgatcatgacttcagcaatgatagtggagcaaggaataggagctcaggttacaagtttaaagaaaacattaatccaactagggcagataaagggggacattctcatggtcagatagggcatccagcaggaattggagtggaaaaatgtcacaatacaaaatactttgtcatcaagagtttgaaccatcaaaacatccatttgtcgattgagaaaggaatttgggctactcaaatcatgaatgaaccgattctacaagaagcttatcataattcaggcagtgtaatccttatattcagtgtcaacatgagtggttccttccaagggtatgcacaaatgatgacctccattggaagggggagagacaatgcttggagtgagggaactggtaaaagtaatccttggggtcgcagttttaaggtcaaatggctgtgtttgaatgatttgcctttccacaagactctacatctcaagaatccattgaatgattataagcctgtcaaaattagcagagattgccaggagttatctccagacattggtctagctctttgcaaacttcttgacggtaagaatgacacggatggcctgctgaccagtttatcaagggatgaattttctttgaaagggcattatgtgagtactccaagttcaatgggagatgaagactgtaactttcctccattgcatatgctaatcagtgggacaatgttcactgaaatattgccaactacttctgagtcatcacaagtgtcaggaattaagcgttctaaggatgtggcttctcaatctgatttttggggtctgtcttctgaaagccctttagctagtaccctaactgaggatgattttcttgacatggagcaactctcatgggaagatccatcattcatctttgccatggatataactgctcctccaatgagtgaacatgttaactttttgtcagctaaattttgcacttgtgttgtggtgtcatcatctgcaaggaggcccctttcctgttatgtatag

SEQ ID NO: 66690 - DNA, 996 bp, Glycine max
  Peptide Sequence Number=SeqID_183468
atgaattcatctacctcttctgggatagagtgtcaagctgccaaacggcagaaattagaaggtggcagcttgcacaaggttgctgatgtgaagcagcaagttaattttgtccacaaggcacctaaaaagaaattccgtccttattgttttcctgatacagcactgttgttatgggtggaaatatatcaaataatgtccaaggagagggttgcaactgttgatcaaaattctggacattccaagctgaagattactattcctagagagcctgacctagaaacagctcacagagcacaaaggattagacctaaacctgctgcagaggcagaagttgtgacagtggctgtccccagattcaaagcacgcccgttaaacagaaaaattctaaatgctccttcgtttccacttcccaagaggagcactccacgattgccagaatttctagaatttcatctcaggacacaagagagggccatgcagcatacatctgcgacttcatcgtcttcacttcattgcaatgattttgataaggatttggacaaacatacagctgtttctgctcaagaaaatagaatcagggatttgagaaggccatctgccctgggtgctccaaagcatgatggattggattttgctcattgttttaaagctcgtcctcttaataagaagattctttcaagtaaaggagatattgctgttttcctgaacagaaagcaggaaaccacggtgccaatggaatttaatttccatacggaaaagagggttcagcataacccaccaagcgaactctttagcaagatgtccctaacatccgaagtccagtcaaataatggatctcagttgaaactgcctcggcattccagagtgttcagagaggaaacacctttcgtatttgggggaaggcaaattcacagtgggagggaaggttgcgacggtgacgctggagcttgggaattcgatgatgacgatacagacaaaggccaatatgcaacatag

SEQ ID NO: 66691 - DNA, 2247 bp, Glycine max
  Peptide Sequence Number=SeqID_183469
atggacaaaagcaagtacgtgatggagcttgcttttcttctcggccttattttcatgcttagcgccaacccgacttcaatggctgaagagcatgacatcaacaacaacttgcaaacttacattgttcacgtcaaaaagcccgaaaccatatcttttcttcaatcagaagagttacataactggtattactcgttcctacctcaaaccacccacaagaaccgaatggttttctcttaccgcaacgttgcctctggatttgccgtgaagttaaccccagaagaagccaaagttcttcaagagaaagatgagattgtatcagctcgtcctgaaaggaccctctcattgcacacaacacacactccatctttcttggggctgcgacaaggtgttggattgtggaatagctccaaccttggcgaaggtgtcataattggagtcatagacacaggtatataccctttccatccatctttcaacgatgaagggatcccacctccaccagcaaaatggaacggacactgcgaattcacagggcaaaggacatgcaacaacaaactcatcggtgcaaggaacctgctaaaaaacgctattgaagagcctccttttgaaaacttcttccacggaactcacactgctgcagaagccgctggaagatttgtggagaacgctagcgttttcggcatggctcagggtactgcatctggcatcgcacctaattctcacgtggcaatgtacaaagtgtgcaatgacgaagttggttgcactgaaagtgccatcttagccgcaatggacatagccattgatgatggtgttgatgttctttctctttcccttggtttaggctctcttccgttcttcgaagaccctattgcgattggtgcatttgtggctattcagagtggagttttcgttagttgctcagccgcaaactctggtcctgactacagcactctatccaacgaagcaccgtggattctcaccgttggtgcaagcacaattgacagaaagatagcagcatcggcagtgcttggaaacggtgcagaatatgaaggggaatctttgttccaaccccaagattttagccctagtttgttgccactagtgtattctggtgcaaacggaaacaacaactccgagttctgtctcccaggttccttaaacaacgttgatgtcaagggaaaggttgttgtgtgcgacataggtggaggctttccaagtgttggaaaaggacaagaagttctgaaagctggtggtgcagccatgatcctcgccaacccagaacctcttggcttcagtactttcgctgttgcttatgttttgccaacagtggaagtgagttactttgctggcttggccataaagtcttacataaactcatcttactcaccaaccgcaacaatatccttcaaaggaaccgtgattggtgatgaacttgctcccacggttgtttcattttcttcaaggggtccaagccaagcaagtccagggattctaaaacctgacatcattggacccggagtgaacattctagctgcatgggctgtgtccgtagacaacaaaatcccagcgtataacgttgtttcaggaacatcaatgtcgtgtcctcaccttagtggcgttgctgcattgctcaagagtgcacaccctgattggtcccctgcggctataaagtcagcaattatgaccactgcttacacggtcaacctcggaggcacacccatagttgaccaaaggaatttacctgctgacatatttgccactggtgcaggccatgttaaccctaataaagcaaatgatccagggcttgtttatgatattcagccagaggattacgttccctatttgtgtggtttgggctatgaggacagagagattgaaattctagtgcaaaggagagtgagatgctctggtgggaaagccataccagaagcacaactcaattacccttcattttctattctgatggggtctagttcacagtactacaccagaacgttgaccaatgttggacctgcacagtcaacttacacggtgcaacttgatgtgcctttggccttggggataagtgtgaaccctagtcagataacgttcacggaggtgaaccagaaggttacattctctgtggagtttatcccagaaataaaagaaaatagaggcaaccatacttttgctcaaggttctctcacctgggttagggtatctgacaaacacgctgttaggatccccatctctgttattttcaagtga

SEQ ID NO: 66692 - DNA, 1101 bp, Glycine max
  Peptide Sequence Number=SeqID_183470
gcagagtcctgtgcggatcatgagcttaacctccagtcaactgagcttgagaagctaggcacagttgaaagcttggcgagcagtgggataaagtgtatcccgaaggaatacgtgaggcctgaaaaagagttgaagagcatagggaacgtgttcgaggaggaaaagaaggaagggccagaggttcccacaattgacttgagagagatagattcggaggacgaggttgtccgaggcaagtgtcgccagaagctgaagaaagcggcggaggaatggggtgtgatgaacttggtgaaccatgggatccaggatgagctgatagagcgagtgaagaaagcaggggaagagttctttggtctggcggttgaggaaaaggagaagtacgccaatgatcaggagtctggtaagattcaaggctatggaagcaagctggccaacaatgccagtggccaactcgagtgggaagactacttcttccaccttgttttccctgaggacaagcgtgacctctccatctggcccaagaaacccgatgattatattgaggttacaagcgagtatgcaaagagactgagggggcttgccaccaagatgttggaggccctctctattggattgggtctggaaggagggaggttggagaaggaagttggtgggatggaagagcttctacttcaattgaagatcaactactaccctatttgtccccagccagaacttgctcttggagttgaagcccacaccgatgtcagttcactcactttcctccttcataacatggtgccaggtctgcagctattctaccaaggccaatggttcacagcaaaatgtgtccccaattccattctcatgcacattggtgacaccattgagatcctgagcaacggcaagtacaagagcattcttcatcggggtttggtcaacaaggaaaaggttagaatatcgtgggcaatgttctgtgaaccccccaaggagaagatcatcctgcagccacttcccgagcttgtcactgagacagagccagcacgctttccacctcgcacttttgctcagcatattcaccacaaactattcaggaaggatcaggaaggtctcccaaattga

SEQ ID NO: 66693 - DNA, 2211 bp, Glycine max
  Peptide Sequence Number=SeqID_183471
atggatgattcattagacatcactccttcacaagctgagtcaaattctcagtctacaaaaaaaagggttagaggtcccacatgcttgaagaagttaagactcaaacgtgttagagatcagaagatatcagttgagtttgatcaatcgactggcaatgctaaagggccaaacaggagagagttcaacaattatgtggctttccttgctcgaagcaaggttagtattctacatgaggattgggatcatgtagaggagagcgagaagaatatgatttggcaaactatcatgcacaattatgacgttccaaattccaagttcctcaagaagaaactaatttcatatgctggtcaacgttggaggggatttaagacacagctctctagcttttacatatatgggaagtacaaagacaaatctccttgtgataagtatacattcctcaagaaggatacgtggcaaagatttgttgagagtcgattggaccccgcctttcaggagaaaaggaaaaaggcacaagaggtccaagcaaataatctctaccctcacacattgtcttgtgggggctatcagaagcttgaggagaacatgatgcaagaaaaggcaaaaaaagttcaagaagcatcccagttagatcattcgttagttattgttgaacctccatctccactcaaacgccatgaaaaatggaagagagcccgacaaaagaaatcgggagattatattaatgaagaatcacgcattattgctgaaaagattgattctctcgttgaacagagcacgcaaggatcttttcttccacttggacgtgaagatattttgactgttgccattggacaaccagagcatcctggtcgtgtacgtggtgctggtcgaggtgtgggcattaggcaatacttcggaccaccttcccgcaatcctcttagcatggaagatttggaggtcattacacagaagatacaagagcaggttactaagcagcttagtgagcagttagagcacaagctcaaagcagatctttcacaacagttccaacaacaagtgagacaagagttggcatctctaggtcttcttcaacaaaatacaaatatcgagccagctcctcattctcctatacatgtgagcacaaagggaaatgatgctactcctgatccattggtggaggacaatcacactaatatccgtgatcagtgtgagttgtatgttgatgttgatcctccacgtttagtggcaattggcaaagtgtacaatttggggtcaaccatacaccacaagacaatagaggatgacaatgtgagggtggtggttgaagaggttcgagatgcagaggctcgagttcctctacccactgatgaggttcatacagtgggacaagcccccaatcaattcattcagtggccaagaagacttgtgaagtctatgtcagccaaggctgttgtcgaatctagcaaagatgctccacacaaaaggttggaacctcaacttgatccgctcgaacgcttgttgataatagtaagcaaaattaggaaggatcatgtacaactaccttgggatccggatgtactaagcaagccctctaccatgccattttatatctatcggagggatattttcagattatgtatgggtagcgagatgccaaacatctcaattatgcaattgtggttgatgtatctgcataacttatgtactgataaggggaatgcacatatctatggattcatggacccgcaatccattcaaagtgttgggaataatgcaacagaagttcagggctacttgcagagtaggttacatgaaagcaaaaaacaatgttacctagcaccttacttgcattcggaccactggcaattgcttattatttgtcctaagcaaaatgttgtggtgttattgtgttcattgcacaagaagacgatcaacagagaaatgaaaactacagttgatttagctatggacgaatatcaaaggttggtgggttcacagtcaagatctagaaggaagaagcctacatggattttgccccgttgtcaaacacaaactgagggttatgagtgtgggtattatgtcatgaagcaaatgctcactgttgtcacagtagatattgttgattcatggaagaagatcttcaacagttcgggtccattccctgaggaggatattgcagacattcaacaacgttgggcagcatttttacttcaaattagtaatttgtaa

SEQ ID NO: 66694 - DNA, 705 bp, Glycine max
  Peptide Sequence Number=SeqID_183472
atgcggacgaaaatagaagacagaggggtccgggtccgggtccgggtccgggtccgggtccggaatattatatatagcgtaggcgccattgataggttttcccgcgaaaagttcattcctagcagatccggttccaattttgatttcttcaatctacctccgtcgtcctcgtcagaggacagttgcagttgcagtccctacagcaccgcgctgcgaagtgccttgttcggaccagacactcccgataaatttgaaagccctaatatattccgttacaaaacggagactcgaaagtccttgtattctctctcacccaccccctttactttccaggatgaccttctccctggttatgaccacaatcaaaaacctcctaagcgtcctcgcaagattcctccttcgtcttttaaggttttggacgcccctgccctgcaagacgatttttatctgaatctcgtggattggtcctccaacaatgtcttggctgtggctctggagacctctgtttatttgtggaatgcttctagcagcaaggtaactaaattatgtgatttggggattgacaactcagtttgttcggttggctgggctccacttggtacctacctggctgttggatcaaacagtgtgagtcttccatacttagctgtgtactattattctcaaagaagcaaaggcatgcgttttttacaccttagggattag

SEQ ID NO: 66695 - DNA, 687 bp, Glycine max
  Peptide Sequence Number=SeqID_183473
atggagggtcatcgtttacgtgttggagctttggcctggagttcttctcttttgtcttctggtggccgggataaaagtatttatcaacgagatattcgtgcacaggaggatttcatcagtaaactgtctggacacaagtcagaggtctgtggactgaagtggtcttgtgataaccgtgagctagcatccggaggaaatgacaacaggttgcttgtttggaatcaaaagtcaacccagcccgtcctgaagttctgtgagcatacagcagctgttaaagctattgcgtggtctcctcatgtaagtggacttcttgcatctggaggaggaactgcggaccgaaacattcgattttggaatacaaccacaaacacacagttaaactgtatcgacactggtagtcaggtttgtaaccttgtttggtctaaaaatgtgaatgaacttgtaagcacacatggttactcccagaaccagataatagtttggaaataccccaccatgtcaaagctagcaactcttacaggccatacttacagagttctttatcttgccatatctcctgatggacagactatcgtcagtggggctggagacgaaactcttaggttttgggatgtattccctttgcagaaatcacggaataccgagagtgaaattggtgcatcttttgggagaactatcattagatga

SEQ ID NO: 66696 - DNA, 490 bp, Glycine max
  Peptide Sequence Number=SeqID_183474
atgggcatcggatctgggcatgggtgccctctactgggtcaggtgaagaaaataggctacgcgatcctgaataaaattgtgcgtactccctccgtcgacaaggatgatgactttgtggccctggacggaacttgtaacgcgcaggagcatagggattacggggtcaggcggaatgggttcatctgggaggggttcgtcaggaggagcgacgagaaggaagaatttgtctctacaccagtgattaggcccgcaacgctcatcatagttgtaacacaagcccttttcgcggcgagtggccatttcggacacggtgagccttttaaaggtgcttcgcgagtgccgccacctgaactagggacaagagttgtagtgcctagacctcacggcggatgtctgatacgtcacattggtcccatcgaagcgagggatgtcgatcttcatcttgggggtggaaggggagaggggacgaacaggggatctggatttgagg

SEQ ID NO: 66697 - DNA, 414 bp, Glycine max
  Peptide Sequence Number=SeqID_183475
atggcagcagcgtcgtcttcttctcctccaaaggacgaggatcgggaacaagaggaacaaaaccaacagcctcagcctcagcctcagccagtcaaagagtgcgtccacaaaaccaaaacgattcagtttctcggacgcaccactccgatcgttctccaaaacgacaatggaccctgccccctcctcgctatctgtaatttcatttcacatcctagggctatgaatggcggaaggtcaaaattccgtcgtataaacatgccatggcgggcctcccgtcacaaattgcctatgttggaggcatcaaaaacaccacgtgatagcgttatgacgggcactatatcggtgtataacggttatttatcccacattgatggaaacacggaaacagtcttgattccaaatatttgggtttag

SEQ ID NO: 66698 - DNA, 537 bp, Glycine max
  Peptide Sequence Number=SeqID_183476
atgctcagccagatcgaccagcgctatccggcgttgcgcttcgaatgcctgatcgcggaatacgaggacgtggtggcgctggtgcagcagggccgcgcccacctggggctgatggcggcgcaggaagactatccgcctgacatggctcacgcgacgctgcgcgaggcctcggaaatccacctacgagctggacgacaaggtccccgccccatcgcaatccacctggtcggcgccgggctacctgatgttgctggaaatggccacgctgggattcggctgggcggagctgccgcgctggatgctgcaccgtttcgggcgcggacaactggtggaactggcggtgccgggctggccgcgccagatccgggtcgacgcggtgtggtcgacgcgccgtccgctggggccggccggcgcctggcgcgagatgcgcacgccgttggcgagcatccagtcgcccagcttggggcaggccagcacgtcatattcggcgcggcgctggcgcgccatggcgctgccgccccgggcatccttggccgg

SEQ ID NO: 66699 - DNA, 117 bp, Glycine max
  Peptide Sequence Number=SeqID_183477
atggccccctctctctacagcgacgttctctgcttgtccagcgccgggaagggacgacgatcgggcagtcgtgaccctatcctccatttgcgtccattcctaagtacctacaagtag

SEQ ID NO: 66700 - DNA, 741 bp, Glycine max
  Peptide Sequence Number=SeqID_183478
atgaatgtggtcaatgctataaaggaattagcattgcaaatccaagttgcatgggtcacacttggcagagcacaacttaattttggtgagcctgataatgctattgaaagctttgaccgtgctttagctctcaagccagctgtgtctccagcaaaacctccagaaagcccggatgaagaggtcaatgatcccctgtacctgatgacattgaccatcccacaactatttttgaagtcgctccaggttatgtgggatgctaccatattcggggtgtttaatcaaaacttcccgttgtatataaagcacgaagatctctctgaaattgcacacggtggtcaatgtctcagcatatctgttatacagttgtggattctcggacactggcaaatggtcgtcattctgcctaaggaaaacctagttgtctggttttgttctttacataacaggccagacaactaccttaaggaaataattaacagtgctttgaaaggacttgatgatactccacaatcgaaatccaaggctgctgctaggtggattgttgttaagtgtaatagacaaaaaggaatcactgaatgtggctactacgtgatgcactggatgtccacgataatcttacgatctttcaggaataattgggagacgtattttaatgaagttagaacattggaagtagagagattcaaggcgcttcgcatacagtggacacattattatctaaaagttagaaatcaaacatag

SEQ ID NO: 66701 - DNA, 283 bp, Glycine max
  Peptide Sequence Number=SeqID_183479
atggaagacgctgacatctcaggggaaagtgcagatgacgattctcgaccgaaagatgctgacatctctggggaaggtgcagatgacaacccggaagatactaagatcttcggggaaggtgcagattacgattgtcgcaacctacccttcggcgggagggtgacgcgtgactcgcgggtgcgtgttccaagaaaggaatacgtgcgaagtctccaccaacgtttatttcaagaaaacgtcggaaaaactggaaaagacgtgatctacgaacttaaagtgaaag

SEQ ID NO: 66702 - DNA, 915 bp, Glycine max
  Peptide Sequence Number=SeqID_183480
atgttatttggctggaacaaggtcgggccaagcttgcactttatcgccacgctcatggtcgccatatgcacactggtatcggctacctggatattggcatccaacagctggatgcaaacaccgcaaggttttgaactggtcaacagcaaagtcatcccggttgattggctaaaaatcatcttcaatccttctttcccctaccgcttggtacacatggtgattgcggcctatctagccaccgcgctgtttgtatcggctgcagcggcctggcaactgttacgtggcaaaaataatccggcggtacgcaaaatgatgtctatgggtttatggctgatattgctgattgccccgttgcaagtggtgattggcgacatgcacggcctcaacaccttaaaacaccaaccggcaaaaattgccgcgatcgaagcgcactgggaaaacaaagggaatgaaccaacgcctttggtactgctcgcctggccagacatgcaacaggaaaagaatcattttgcgctagagattccggtcctgggcagcctgatcctgcgtcactcactgacggaacagattcccgcgcttaaagagtttgcagccgacgaaaggccgaatgcgaccatcgtgttctggaccttccgcatcatggtcggcctgggcatgctgatgatcttgctggccgtgacctctttgtggttacgctataaaaaccaactgtatcagcataagcccttcctccggtttgcagtcgccatgggaccggccggcgtgattgccatcctggcgggctggttgaccactgaaataggccgccagccttgggtcgtctatggcattttacgtacggcagatgccgtcacaccacatgcaaccactgaggtcgccgtcacgctggcactttttgtcgtcatctacctggcg

SEQ ID NO: 66703 - DNA, 252 bp, Glycine max
  Peptide Sequence Number=SeqID_183481
atggggatcgcacccacaaagacactcaatggacctaaagaagtccaacaggccctggggtttccagctctggttacgggtctctgtcggccctacagggcgcccgttccccccagcaaggagtgcctgtcgcccccagtaagggcatcaggccccctactaatcgagctttcatcaagaagtactgcgtctccaggcaggcgcagggcgaaacaccacagcagcattgggatggccggtagcgggcaatag

SEQ ID NO: 66704 - DNA, 141 bp, Glycine max
  Peptide Sequence Number=SeqID_183482
atgcagcagttcagaaaggcgcataacaaccatggtgctgatcttgatggcaacgatgatcttatcttggctgttgtggtttccacaaccgtggtaaagtaccacagtcattgtggagtgcaaagtcttcaatttctctag

SEQ ID NO: 66705 - DNA, 810 bp, Glycine max
  Peptide Sequence Number=SeqID_183483
atgcggcagcggcaaagaagcgatagcccgaaagcgggtgggataacgcgctaccagttccgcatattcatcattgatccggcgtgcggcatcaacggccgcctgttcgtcttccagatgcggcgacagcggcgtcgccgacaggatttgcatgtcgatgccggcgctgtccagcagggcgaagcgcgcgtcgagttcgcgctcggtgcggccggcgcccagttgccgataggcggcgacgtcgtgcacgccatgcgcttgcaaaagatccagatactctgtgctccacaggtgagcgtgtacgtcgagtcgcatcggtcgatctccggagttcgcggcgatgccgcgggttcaggagagtataggcaggcgacgcgacgcctcctgaagggagagcattttttctaccgacgggttagggtgagagcacgcattgatccgggaacggcgcgcgaacgggcgttcccggtattggggggctggagatcagaacacctgcttgaacggtttcaccgtcacgtcggcatagacaccggcggcgatatagggatcctgttgcgcccaggcctgggcttgcgccagcgactcgaattcggcgatcaccgtcgaaccggtaaagccggcggcgccgggatcgttgctgtcgatggccgggttagggccggcgaccaccaggcgaccggcgtcgcgcagcgcctgcaggcgcgccaggtgtgctggacgcaccgccagacgattttccagcgagttggggacgtcttgcgcgtagatcagataaagcatgtttcacctttaaaatcatggctataa

SEQ ID NO: 66706 - DNA, 330 bp, Glycine max
  Peptide Sequence Number=SeqID_183484
atgttgtgtatgttcgtgggggggaagtgcattgaccttgtcggatggctcattcgtggaggacaagcatggctaaagaatctaagaatttctgaggagatgtttcagtgctttaattggtccatggtcattggcacttgcttgtggccatgttcatacgtcgtatgttgtgtatgtccatggggggggagcattgaccttgtcggacgtcccttgtgtgggaaactaaagtggttaaagaatctaaccatttctgaggggatgcttaggagctttaattcatccatggagaattataagcaattgggcttggatccggaattggcctga

SEQ ID NO: 66707 - DNA, 422 bp, Glycine max
  Peptide Sequence Number=SeqID_183485
atgtatgatacattgcaaactgcttcaaagaagcctttgtatctagggtgcaagaattccttgacgttgttgtcagcggttttaagtctagttaatgtgaaggccagatatgggtggagtgacaaaagctttagttcactgcttgaagtcgtgcacaatatgcttccagaggaaaacacattgccaaaaaattactatcaggcacagaagatactgtgttcgatgggtatagagtatcagaagattaatgcttgccttaatgattgcatactgtacaaacatgagtttcaagaaatgtataagtgcctgagatgtgaggtatcacggtacaaagtgaaggatgatgacgagtgtagtagtgacaaaaactcaaagaagaggccccaaacaaaggtgttgtggtatcttcccatcattctaag

SEQ ID NO: 66708 - DNA, 948 bp, Glycine max
  Peptide Sequence Number=SeqID_183486
atgaccgagggcatcggccacggcggcaagcggctgtacggcgcgatgccgttcaccgcctacaccaaaatgtcggataaggatctgcaggatttgtgggcatggatgcagacgctgcagccgatacacaacccggtcgagaccaatcagctgcccttccctttcaacatccgcaccagcctgatggtgtggaactggatcaactttgaccggggcgcgttccagccggacgcccgtcaatccgcccagtggaatcgcggtgcgtatctggtgcagggcgcgggccactgcggcacctgccatacgccgaaaaatctgctcggcggcgataaaaacggcgcgttcctgcgtggcgaagtggttgaaggctggatggcgccggacatcaccgcgaacccgcacagcgggctgggcaaatggagccagcaggatatcgtcagctacctgcgtaccggcgtgaaccgtttcgatatcgcttccggtccaatggccgacgcggtgcgtcactccacgcagcactggcgcgatgaagatctgcaggcggtggcggtgtacctgaaaagcggggaatcacgtgatgagcaagcgcccgctgcacttgccgcgacggacgatcgcatgaagctgggcgcgcaaatctatgcggcgaagtgctcagcctgccacagcccgggcggtcgcggtgagaagaatatcttcccgcagcttgcggacaatccgttgctcaatcaggaggatgccacctcgctgattcgggtggtggccgccggcagtcgcggtgtcgataccgatgcccgccccacggcaccggcaatgccggcctttgccggcacgctgggtgatcaggagatcgcggcggtggtgagctacatccgcaacagctggggaaatgccgccgcaccggtcagcgctgacgacgtgaagaaagtgaaacagaagctggaatag

SEQ ID NO: 66709 - DNA, 114 bp, Glycine max
  Peptide Sequence Number=SeqID_183487
atgagtatgcaaggcgcgctcagcgcgacaccccctcgctcagcgcgtgtagatcgcgcgcttagcgcgcgtgttgcaggcttagcgcacgcttctgttagatcgcgggcttag

SEQ ID NO: 66710 - DNA, 246 bp, Glycine max
  Peptide Sequence Number=SeqID_183488
atggaagaagatctgggaggggaaggtgaagccttacacacagtgagtgagggcaagtgtgtgaatagtaacaatcaacgacagcgaataacagcaaaaggaacacaaaacaaaactaagatggcgcgtgagtcaaaactcaagacaagtgtacctatgccattgccgtttcaaaccgtgtcagaacttgcaacacacataaacataacaactgaaattttgatcgttgttagaaattttttttga

SEQ ID NO: 66711 - DNA, 309 bp, Glycine max
  Peptide Sequence Number=SeqID_183489
atgagtcagccagcaccttcaccatctacattgaagaggactagaaaagccacacagctcagatcattgtctgccaaacccgtgggggtggagagaccattggttcatgtggattctaccactaggaaagctgatgatgaatggccgcggaagggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 66712 - DNA, 564 bp, Glycine max
  Peptide Sequence Number=SeqID_183490
atgagtcaatctcttgctttctcaaaagggtggacccttggagggctgcacaccctcacctttagagggctgcacgccctcaccttcagaggactacatgtcctcgccttcagaggactacatgtcctcgccattagaggacaaaacgttctcgcctttagaggactacacgtcctcgccatcagaggactacacgtcctcaccatcagagggttgcacgccctcgccttcagagggctacacgtcctcacctttagagggctacatacacgccctcagaggactacgcgtcctcaccttcagagggctacatgccctcgccttcagagggctacacgcccttaccttaagagggctacgcgtccttaccttcagagggctacatgcaagccctcaaaggactacgcgtcctcaccttccgagggctacatgccctcgccttcagagggctacacgccctcaccttcagaggactacacatcctcacctttagaggactacacatcctcaccatcagaggactacatgtcctcaccttcagggggctacacgccctcaccttga

SEQ ID NO: 66713 - DNA, 141 bp, Glycine max
  Peptide Sequence Number=SeqID_183491
atgtatgtgtgtttaggtagtgaaaataccttagatatgcatttctacggagtgcttgtcatcatgcgtccagctcaagaagttaaagaagcgctactaggaggcaacctagtaccttttaaatctctgcttgttatttga

SEQ ID NO: 66714 - DNA, 765 bp, Glycine max
  Peptide Sequence Number=SeqID_183492
atggatctcaacaacacttggacaatcactcaattctcgcctaacaagaagcctatcagctgcaaatggttattcaaactgaaattgaactctgatggaactgtcgcaaaacacaaggcaaaactttcaaagtatgattacaccttgttcaccaaaggaaaaagttcatcattcatagccattttggtctatgttgatgacattgtcattgccagccctgataagatagcaattaattttgcaaagttcatgcttcagcactacttcaaattaaaatatttgggtgatctaaaattcttccttggcctagaactcccaagatctcaagtaggaatattcatgtgtcagagacattacactatgtctattttggaggatactagaatgcttgcttgtaagccatctacggtacctatggaggctgatctcaaattgaatgcagaatcaggatcacaacttgcagatccaggaacttacagaagactcataggaagacttctatacctaaccatctcaaggcccgatatttgttacactgttcacaaactaagtcagtttgtatttgatcctcgctcaggacacataaatgcagcaaacattctgctcagatacctcaagcacacagctggacaagggatcctttttaaagccacgttagacacatccctccatgcatatgtagatgcagattggggttcatgcattgacagtcggaaatcaacaactggatattgtatttgcttaggaaattcattgatttcctag

SEQ ID NO: 66715 - DNA, 933 bp, Glycine max
  Peptide Sequence Number=SeqID_183493
atgaaggtagctctctctatcaagaacaaaacgacgttcatcgacgacaccctctcaaagcttgaagaaaaagctcccacctacgttgcttggacacatgcaaacaatgttgtcatctcatggctctacaattcggtatctaaagaaatcatcaccaacatcttgtttgcaaacaccgcgaaagaaatttgggacgacttgaaaactaggttttcgaggaaaaatggccctagaatcttccaattgaagcaccaattaatgtctttgcaacaaggaactgacgatatcagcacgtattacacaaaacttaagtcaattagggaagaattgaccagttacaaaccaacctttccatgcacttgcgaaggtcttcaacaactccaaactcacaacgaatctgagtatgtaatgtcattcttgatgggtttgaatgattctttctctcaaatacgaggtcagatcctgatctctgatcctttgccttcaattggtaatgttttctccctaatccttcaagaaaaagctcaaagggagattgttgttactcacccacccaccaatactttagaaaatatagtattttctgttaattctgcatcaaagaaccaatgtgatatcaataaagggaaatacatcaagaaagaaagacccaaatgtgctcactgtgacatgttgggacacacaaaggacaaatgctacaagcttgtgggttaccctccaaattacttcaaaaatcgcactagcaactttgtgaatcaactaaatgacacacccgaaagttcaacttatgctcaggcaccaactttaactgctactcagtgtcaacaattgatctctttcttaaccaatcacatgaaaaccgaaaacaccattgatgtagtagccacaaatgttacaggacctcaagactttgaggaggattggcattgctaa

SEQ ID NO: 66716 - DNA, 186 bp, Glycine max
  Peptide Sequence Number=SeqID_183494
atggttatggtgcccaatacaccaaaatcaataaacaatttctcctctccacatctgaagagaaaacgaaggtcccataaggaagaaggtgatttggttgaggaagataaacctgatgaacttctagacaagcaactctcagagcacattatggcagtaagcaaatactgtcttcttactttgtga

SEQ ID NO: 66717 - DNA, 243 bp, Glycine max
  Peptide Sequence Number=SeqID_183495
atggaggttaagactaagatgtcggaagtgctaccattcatattgatggtgattatggaaggttggaccataggactcacaatctttgcaaaaactggaataactaagggaatgagtccatttgtgttcattgtttataccaatgctctggccactataatattgttcccttgttcctttttatcacaccaagaggataggtctctctcttcctcttttgcttctccttatgattctagctag

SEQ ID NO: 66718 - DNA, 531 bp, Glycine max
  Peptide Sequence Number=SeqID_183496
atgaggggctgggattggttgcggagaggctcacgaagatgggtctggtggaaggaagagttatggtggggcactattattttgacagctgggataacccttgcattatttggtggtgtacgaaagcatcctatggatcagaataatgttcctgtcaggggagatattcatgtcataattgttggtaatcctggtctaggtaagagccagttgctacaagcagcagctgctgtctctccacgtggtatctttgtctttggtaatgccacaaccaaagatggcctcacagtagctgtagtgaaggattccatgacaagtgactatgcttttgaggccggtgctatggtgctggctgacagtggattgtgttgtattgatgagttagataaaatgtcaatagagcatcaggatttgcttaaggcgatggagcaacagcgtgtttctattgcaaaggcaggattagtagcaagtttatcatccaggacttttgtcttagcagctgcaaaccccgcttgtggtcactataagtaa

SEQ ID NO: 66719 - DNA, 228 bp, Glycine max
  Peptide Sequence Number=SeqID_183497
atgttgtcagcttgttcacgtagtgctaagttacaccttagagatgctacagtggatccaaaacgacgttgttttttaaggggtgttaatttgttaagggatctttgtttaaccaggttcaatggcggggacgtcacttgctttgcaggaataattgggaacttgattgtatatctgataacgtggctaatggaagctcctctctatttcccattgttgcagcaataa

SEQ ID NO: 66720 - DNA, 195 bp, Glycine max
  Peptide Sequence Number=SeqID_183498
atgatctctggactgcaaagaggtcgtaggaattttaaaggcagcaagaagcagcattcaatgcccaatgctcatgtgcgttcagaactcagatatggatcaaattcgaaaggagaggtagacaaggccaacagggtttcttatataaagagcaagtcaacaaagggtaaaaggtttggtaaaaatggttcttaa

SEQ ID NO: 66721 - DNA, 222 bp, Glycine max
  Peptide Sequence Number=SeqID_183499
aaatgggtttatgatcccaacatggttggctcatggtacctaacacatgcaactaagaataggaaaacgcaaggatcatgcatgagcaaacatgaaaataaaagaggtatcatcccctttgaaaaacatattgcggcagtagggactaccagcaacaatatgttatcaaagagaaaaactctagatgagggttcactgttatcaagcaagtcggagacctag

SEQ ID NO: 66722 - DNA, 291 bp, Glycine max
  Peptide Sequence Number=SeqID_183500
gcatgcgcaaggcgagacaccacagcagcattgggatggccggtagcaggcaataagcgcgccgccaccacctccagagcccctcagctcatccacaaaagggttagagtattgcctacgacacatggccgaccaataggcgaccaagtccaaagccaaaggacgcacctagttgctcatgatcctatgaatttaaataaaacaagcacaagctcagaaggaaataatttgcaaaatcaagtcatggcatatctatggttcggaattaagatgaaacacttacctgtgtga

SEQ ID NO: 66723 - DNA, 315 bp, Glycine max
  Peptide Sequence Number=SeqID_183501
ggacaagtggatattgaattaaatgaaactggaagacaacaagcagttgctgtggctaatagactatccagggaaccaaagatctctgctatatattcttctgaccttcaacgggcttttgaaacagcacagataattgcagtcaaatgtggagggctagaggttgtcaaggatttggacctaagagaaagacacatgggggatcttcaaggccatccttatcgtgaattagcaacaactaatcccataggttacgaggctttggagtctaagaatgatgatcgagagctccctattaaaaatactcctaattaa

SEQ ID NO: 66724 - DNA, 300 bp, Glycine max
  Peptide Sequence Number=SeqID_183502
ggtggtggagaaagttttgttcaactgtttgaacgctgcaaatctgcgttgctgaaaattggaagaaaacataaaggggagcgagttgttgttgtcactcatggggcatccatcgaaactctttacaggtgggccaatgcaacaggaaggtataaagggaaaatagacaatgcatccatcgctgtttttcgcttgtacggtgaggataaatggaccttaaatatgaagggtgatgttagccatctgtgccataatggatttctgcaacctggttttgagggtgacacaactactacttag

SEQ ID NO: 66725 - DNA, 282 bp, Glycine max
  Peptide Sequence Number=SeqID_183503
atgcacaattctaactctaagaaatggattgatgccatgaaggatgagatgaagtttatgcaagacaatgatgtttggcatcttgtcgaattgcctgaaggcatcaagatacaaagatatctgatgagaatcctgaaactggccaaatacaggctaaaggcccaagtggagaaggacaaagtccccgagtggagaaggatgaaggcccaagtggagaaggatgagggcccagaggcagagacactatcaagactattaattgttgctgaaggcccagattaa

SEQ ID NO: 66726 - DNA, 309 bp, Glycine max
  Peptide Sequence Number=SeqID_183504
atggagaacaacctattcaatggtgatgcccatgaagatcctgtgcaacacctgaggaagttcaacaagttgacccacatgatcattgaagatatgtactccaaaccctataacaactcaagggatatgagaattatgaagagagacatcaacccagtagagaaagatgataaccaaactgaattggaaaaacagatgcaagctctaacactgaagattgagacactcatgagatctcaagcccaagtccccatcattacaccttcatttccaacctgggatagatgtgggattatgcatgggacatga

SEQ ID NO: 66727 - DNA, 456 bp, Glycine max
  Peptide Sequence Number=SeqID_183505
atgttttccgagaaggagggaatgatgagaatcctgaaactggccaaatacaggctaaaggcccaagtggagaaggacgaaggcccaaggggagaaggacaaagcccccgaacttatcaaggtaatccttgtggcgtctaccttgacttatcttccttcaccaaaagtggcgtctaccttgacttatcttccttaaccggaagtggcgtcatccaaatctttgtagcctgtatcaagcgatccgctcctagtcaggttcacatcagtatcctaaggttctcacaagagagctatatcaataaggacctagatatattcaacatgaaagatagtaaactaggagataccgcaatagcgaaagaagacaaattcaatcttaagcaatgccttaataatgaccttgaaagaactgtcatgcaaaagattccctatgtaggaagtttgatatacacttaa

SEQ ID NO: 66728 - DNA, 312 bp, Glycine max
  Peptide Sequence Number=SeqID_183506
atggcttttgttgtaagagttatgggcaaatacttgagtgatcctggactacaacactggaaggtagcaaaacacatgatgagtttacttgaagagaacaaaagggatctatctcttggaagtttgctaaacagattcacgaaccgatttgaccttgagaatccgagggtagattgcgttagtggtgcctttggcatgccccctctactgttcaatgaaaattgtgagatcgatgatgatagtggtgactcggagtttgctgacatgctgctgaagaagagccttgaagcaacaaatgagaatcaatggtag

SEQ ID NO: 66729 - DNA, 492 bp, Glycine max
  Peptide Sequence Number=SeqID_183507
atgaagttggtggagtctcaattgatcaacatacaatccctcttgtcacaaagacaactaggcaatctcccttcacaacctaaaccaaaacctaagaaagaggatgtcaatgctgtgatgaataaaagcaagaggattcaagaggactccgaggagaaggaaggttatttcccaaaagttgtaaatgacatccttactgaaaaggaacaagcacccaaggatgttgaggttcctactgatgggaagctaatgccaaagaaggaaggggatgcaaagaaggagatactaacatctcctcaaatgtttgattataggaaccactacaagaagacatgttgtgatcttattgactttgaatccattgtccaaattgatttttggataatgggcgaagaaacacctcttgagcttgatattgatgaacttgagaatgctttgtatcttgagaatgcaattccagttggtgtatcatcaacaaataatgaaggttaa

SEQ ID NO: 66730 - DNA, 381 bp, Glycine max
  Peptide Sequence Number=SeqID_183508
atggctagtccccagaaatttgctactccttctcatattctttatgtagatgacattataatttttagcaggggaactaagaagggtttggattctttgatgaaccttttaagactatatggggatgcatctggccaaataatcaaccttgaaaattgtcaattctttgatggttctctttccaaccgcaaggtttatgcttggcctaaatccctcctcaaggagaatgaagattgggttagaaattccctatggagtatagacattgttgttaggaagctggtcactgtgaattggaataaattttttgcccacttgatgaaggtggccttgacattcgctctatctcacttcattactaccttggatggaaatgtgtaa

SEQ ID NO: 66731 - DNA, 3275 bp, Glycine max
  Peptide Sequence Number=SeqID_183509
gtatttgatggagcacgtgcaagggagcgggaaagagaattgctttatcctgatgcctgtggtgggggaggccgtggttggataagccaaggaattgtgagttatggtagagggcatgggacaagggaaacctgtgccttgcacactgccagactttcatgtgatacgctggtggatttttggtcagcactgggagacgagacaaggcaatctcttctaaggatgaaggaagaagattttattgagagactcatgtacaggtttgatagcaagagattttgtagagattgtagaagaaatgttattcgagaattcaaggaactaaaagaactgaagcgcatgagaagagaacctcgttgcaccagctggttttgtgttgccgatactgcctttcagtatgaggtatccaatgactcaattcaagctgattggcgcctaacatttgcggatactgttggattgtatcatcactttgagtgggctgtgggaacaactgaaggaaaatctgacattttggaatttgaaaatgttggaatgaatggatgtgtacaagtcagtggcctagatcttggtggtttgagtgcatgcttcatcaccctccgagcttggaagctagatggacgctgtactgaactttctgttaaagctcatgcattaaagggtcaacggtgtgtacattgcaggctaattgtaggggatggttatgttacaataacaaaaggggaaagtatcagaagattctttgagaatgcggaagaggcagaagaagaagaggatgatggtttgatggatgaagatggaaatgagattgatggagaatgctcccgtcctcaaaagcatgcaaagagtcctgaacttgctcgagaatttcttctagatgctgctactgtcgagaaggctttcagagaaggaacagcacgccaaaatgcgcacagcatatttgtttgtcttgcactgaaactgctggaagaacgagttcatgtagcatgcaaagaaatcattacattagaaaagcagatgaaacttctagaagaagaagaaaaggaaaaacgtgaagaagaagaacggaaggagaggaaacgggcaaaagaaagggagaaaaaacttaggagaaaggaaagactaaaaggaaaggagaaagatacagaaagaaagtgttccgaatcaatggatgttcctggatctactgaaatctcaaaggatgaattgtctcctgcttctgatgtagaacaaaataattctattagaagcaggagttcagtcattgtaatagagggtgattatcctaaaatacaagatgaagacttcactagagagggtagtactttgagaacacaagactgctcttacgatgactgtgagggagacgttgcaaaagcgcaacatcacacttatgatgactgggatggagacattgcaaatgctcaagacaggaatagtacttctacagttgagcaatcaaaattttattgtcaaagacttagattcaggaaagaatttcaactggatgcgcccacaaagtggtctgacagaagccataatgcagttgcttcagaaaatggtgtggctgttggaagatcagagccaatacaccatgaagataattttgggatgccttccaggggaatcaatggattgaacaggcaatctagaataaatgttgcaaaatccaatggtcgaaacattagtcataagtgcagtgagaggctttatagttctaacagctggataaacgacagatacaatttccattcatgcagttgtagcctgaataatagaacgaatagagttagttgggagacaaaacctgctagtaagtctgaatccacagttgatacatctaagcaattttatggtggtagcaagtataatcatgtagacttcatgcatgagagtaatggaagaaccaaaggcagagtcatcccagggaactattccagcagggatttgcctcaaccaaagaaagtttgggagcctatgaagtcacacaagaagtatgctcgtagtaattcagactctgatgttacattggggtccacaagtcaagggtttcagtttgatacagtaaggtcttctgttgatgaatttggcagttcaggtgaaattgatgacgaggatagtaatttgaaaagaagcagaatggttgaaggctgtcagaataatcttgatgcagaaactggagcatcttgcagctccacagaaattgtgtctgaggctggaatgtgtctgatgggcagctctgccttgaataattcttctgatcccaatcaaggtagcacttctagttctgataactgctcatcatgcctaagtgagggtgataataatacaacatcttcaaaccgtgaaaatacagaatcctcgacatcagattcagaagatgctagccaacaatctgaagtaagagatagttcaacctgcattgacaatggcttatctgtttctcgtgaagctgggatgaagaaaatcaataatgcaaatgatgagggtttgactagcaggtcaccatttggtccatccttgggtgtaacaagaggtgatgtatcggggaatcctgtggtgaaaattacccataattttgataatgggttttcctccattaataagtgttctcaacctcaaagcatgcttcctccagtgccaaagcaaaatgttcaatttccagtgttccagcctccttcagcaatgggatattaccatcaaaatccagtttcatggccagctgctcccacaaatgggttgatgcctttcccacacccaaacccctacttatatgctggcctgtttggatatagcttaaatgaggatccgtgcttctgcttgcagtatggtggcttacagcaaccagcacccctatttaaccctgttgccgttccagtttatcagccagttgccagagctaaaggcttaaatgcagaagaaccgactctaatgtctaagccaacatccatggtgcaagagcattttagtagatttgcagtagaaaaggtttctctaaccggagctaatttgcaaaaagaagcattgcatggggaagttgaatgtggtaattctgcaaagtcccaaggcagtggtttttccctgtttcattttggtggccctgtagacctttcaactggtcataaatcggtaactgcatcttcaaatggcgacaatgttggagattttagttcaaagagttcagtagatcaagttgacaaagatcatgattgcaataaaaaagaggctactgtcattgaggagtacaacttgtttgcggcaagtaataccttaag

SEQ ID NO: 66732 - DNA, 111 bp, Glycine max
  Peptide Sequence Number=SeqID_183510
atggcaatgggcaccgacagtcctaccaatagaacagactacttctacaagaattttatgtctccacaattgcaaggtcaagaaacacatgcacattacgggatgaaatga

SEQ ID NO: 66733 - DNA, 144 bp, Glycine max
  Peptide Sequence Number=SeqID_183511
atgcctgcgttaccgcacgggaatcaccaattcggtagtagtaatggattctggtcgaagaatcgcgacgatgttggatacaatcagctccacaagatggcgctggatcactttgtattggttgtgacttggattggatcttga

SEQ ID NO: 66734 - DNA, 177 bp, Glycine max
  Peptide Sequence Number=SeqID_183512
atgtgtgaatgtgagagggagagagaacaaaaacacttggaagaggatgagaaaaacggtaatggttgtgcgatggaggatggcagggtggagcgcctccatgaggtcgactctagcatgttcaccgatgctgaagtgatcttcaacataacctctagaatgtcatatcttaattag

SEQ ID NO: 66735 - DNA, 889 bp, Glycine max
  Peptide Sequence Number=SeqID_183513
gaatgactccgccagcaacgtcaataccaagttccgcgaagctgtcgataactacctcagcttcatcgacaagcgcaccgacgagttcgcggcgcaggcagcggtcgaccacaacgtatcgcgcagcgtcaccatcgccttgctggtgatcgcattggtgctggcgatcggctgttggatattcatcaaccgcacggtgctcagacccctgcacgaggcgggtgatcatttcgagaagatttcgggcggcgacttcaccggccgtatcgaagtgcgcagcaccaatgaaatcggccaactgttcgcggccatcaagcgcatgcaggaaagcctgacccgtacggtggcgaccgtgcgtcgcggcgtggacgaaatcaacgtcggttcgcgcgagatcgcggcgggcaacaccgacctgtccagccgcaccgagcagcaagcggcctcgctggaggaaaccgcggcctcgatggaagagctggcctcgacggtcaagcagaacgcggacaacgcgcgccaggcgaaccagctggcggccagcgcgtcggacgtggccgagcgcggcggttcggcggtggccgaagtggtcaacacgatgcaaggcatctcggccagctcgcgcaagatctcggaaatcgtgtcggtgatcgacggcatcgcgttccagaccaacatcctggcgttgaacgcggcggtggaagcggcccgtgccggcgagcagggcaagggcttcgcggtggtggcgggcgaggtgcgctcgctggcgcagcgcagcgcgcaggcggccaaggagatcaagggcctgatcgaggactcggtgagcaaggtgggcgccggctcgcagcaggtcgagcgggcgggcgcgacgatgcaggagatcgtggcgtcg

SEQ ID NO: 66736 - DNA, 192 bp, Glycine max
  Peptide Sequence Number=SeqID_183514
gaagagagagagatggcccatgtgcgggaaaaaaccattaaacaaagagccgccaaacgatacaacggtcgactagtctcaagaagcttcaagaaaggcgatttaatactcaaaagattgttaaaagatgcctccaccaacaagttatcaccaaattgggagggtccttttaggatccaagaagagatttga

SEQ ID NO: 66737 - DNA, 405 bp, Glycine max
  Peptide Sequence Number=SeqID_183515
atgaaagaaaggattgatggatttttctccatcaaatcattaaggtggattctaaggattcaactccaattaaaatgttcctcttggtgtggtggttcggcggcaagcaacgacggctcgtggtggccatcagtggtcgtgggtggtggaggaggaggtgttaaggcttggggactagtcaccagagccatgagcaagaggctccaagaggactgggctagagctgctgaagaagtccctagggttctcataaacctcaagcttcctatccaaggccctttcttggtggtgaagcttctccttccatggcttattctctattggatggcgcctcctctcaccttttctcctttatcttctgctggaattccatggttgaaattcaccattaaaggaccttactaa

SEQ ID NO: 66738 - DNA, 844 bp, Glycine max
  Peptide Sequence Number=SeqID_183516
atggccgaatttgccatcaacaacaacaacaacggttcccattccagcccccatcctgattatgcggagattgttgtggtgcgtcatggcgaaacagcttggaatgctactgcaaaaatccaggttgtcaaggattctgacctacgggagagacacctaggggatcttcaaggccatgtttttcatgaaatagcaaaaactaatcccacagcttacaaggcttttgtgtctaagaacgaagatcaagaaataccattgtatcttggaatgacctttcatcacggatgttttcctgttcagatgtgtcatgaactaagttatgagttacaaatagagagaattgagattataaagggtggtggagaaagtcttgttcaactttatgatcgcagcacatctgcattgcttaaaattggcttaaagcataaaggggagcgagtaattgttgtctctcatggaggattcatcagagccctttacaagtgggcatgcccaaatggtaagcctgggaaggtactcaatacatgtgttagtgtttttcacttgtacggtgaggacaaatggaccttaaaagtgtggggtgatgtcagtcatctgaacgaaactggatttctagagtctggttttggaggtgatagaaattctgagaccatgcaaatcgcaggagggattggcgctttcgttctcgacgcgacagctggccatggtgtcgccagcttcaatggcgtgttgcaggagcttggactcgccagtttgactggcgagttgagggggtgtcgccagctccaatggcgttttggttggacaaaagcgccagcacgagcagcgatttgcgttgcttggg

SEQ ID NO: 66739 - DNA, 270 bp, Glycine max
  Peptide Sequence Number=SeqID_183517
atgctcccgggaacggaagcttctagcacactccagacatcttctaaaagatcgcaacgggtgttacagcaagcccccataagactaatcttcttcagttgttcttcatcactaacagtggtaaagtactcatctatcaccttttctcggggaaatttcatactggaaactaatttcatctcttccttgagtgacacttggtacaggacgtcaaacacctcaattagagatgacacaggtggaactgaagggaagaaaagttgggtttga

SEQ ID NO: 66740 - DNA, 192 bp, Glycine max
  Peptide Sequence Number=SeqID_183518
atgtcagctaataggtcgtgttggattgagaaagagtatagcccttgggacgaccaaaaaaggaaattggttggatttatggatcaagccaagaaagatgctagggagtacaacaaagaagtggaagcactaaaagccatgttggagaaatgggagtcggatattggtgtgatgacctttgagcagttttaa

SEQ ID NO: 66741 - DNA, 513 bp, Glycine max
  Peptide Sequence Number=SeqID_183519
atggaggttgttcacgtcaaagaacaccagggagagagggtgaaaagctctagctcaaagccaacatcaacgtttcccctagttttgtctaaccataaacctaaggagtcatgtcattttgagttaagaggggttgatcggctaggctcacttttcttgaacatgttaagtgtaccaatatgtcctgtcctagagtatgtcacatccttattgattacgtcgcctcacgatttgagttggcaacgaagtgcgcagcgtgctgctttgttatcttttgagtttaagttcaattctttctgttgctcaagagaatatgaagaagtcctctatagtcatgatgacgatgtcgacattgacaaagactgcattctgggagtcatgcattttggagatgaggacagtttgtctgacttggaagtcggggcaaatggtggggagaatgacgggggtgtgacgctggtcttggatggccatggttatagttgggttgacaagaaggttttaagggtttaa

SEQ ID NO: 66742 - DNA, 180 bp, Glycine max
  Peptide Sequence Number=SeqID_183520
gatgattacgacggatatgaggcgattgcacagaggttggagcgtgtgctcaaccttaggatggtcattgcaggcacagagttatatgagattatgcaggactacctgacgatcgccagagagggagccagtgctgatggaagtgtcagggctcgtcagagacaccgcacggaccattga

SEQ ID NO: 66743 - DNA, 435 bp, Glycine max
  Peptide Sequence Number=SeqID_183521
atgaggccaaagttaatgtacatgataaccatcacatcaagtgtacaaaactcacattatttttatgtgatcaatgcaggagcacacacaataggatatgctaggtgcttcacactcaagcaaaggctcttcaactgtaagggcactggaaaaccggatccatcattagatgcttcacttttacaacatttacagaaattatgtccagataacaacagttctaaccccaatttggctcccttggatcctgtcaccacatacacatttgatagcatgtattacaaaaacctagtgaagaacttaggattactaccaactgataaggctcttgtgagtgatggtacaactgcttcattggtgtacaagtatagccagtggaatgagaaggttgagaaccatatgagtgtggataagactcataaacctgagccttaa

SEQ ID NO: 66744 - DNA, 651 bp, Glycine max
  Peptide Sequence Number=SeqID_183522
atggatggtttaacctctcattgtcatgagaggtttactaatacaaaaaagggaacaagaggtgtggaagagaatgaaagaaaatggaggaaaggatcccaatgcactgctctagttcttcaaccctcttccaagcctcatgccgtctttgagggaagtagcaagggaaccaacaactgcaacaatatggttgaagctagaatcactctatatgacaaagtcaatgaggaaagaatgttgtcagatcaaattattgactttaacaagattcttgatgatcttgagaatcttgaagtgaagatggaggatgaagacaaagctctaatgttgctcaatggacttccaagcagctatgagcattttaaggatgctatgctgtttggaagggatcaaaccattacccttgaagaaatgtatcaaacaagcacagatcaaaacctagaagtcaatcttaaagctagttcaaatgttttcactatcacaaggagggacattacaagaaggattaccctgaaaggagaggcaaagattcaaagaaacctcaagaaccaggagatgtggacattgctcaagcagaatgctccaaccacatgggatcaacataagcttaaaggagcactcagaccgagtgtctttacccccaaggcctag

SEQ ID NO: 66745 - DNA, 1314 bp, Glycine max
  Peptide Sequence Number=SeqID_183523
atggttgacgagtccaagatcatcgtttttccgagacaagttttggtgtatgtggggaaaagaaagggttttgaaagagaaagaaggaaaaacgaaattgagagggagaggaagcgcatagacgtatcgtcaatgcgtgaatccctgattttgaatgaaggtggagtagtgatgctaggaaacaacaaaccatataaagtccaaggtatgggttcaatttgtctgaaaatgttcaatgataaagaaacactcttgacaggtctaagtcaaaaccaacatgataaaaccagtttatggcatatgaggttaggacatgttagcgaaaaaggaaaagctaaaaggaatagttttggaataggcttgcatgctacacatagacattttgaatatgtttgttctaatctttggggtcctgtaaggacaatgactcatggtggttgctcttattttctgtctatcattgatgattactccggaagagtttggatctttgttcttaaaaataaaagtgacacttttggaaaatttaaggaatggtatactcagatacaaactcaaatggaaaccaatgttaaatgtttgagaactaacaatggcttggagtttgtttcagagaaattcaatgagttttgtaggaaattaggaatccaaaggcataaaatagtggctgacacccttcaacaaaatggcttggcaaaaaggatgaatagaaccatcctggaaaaggtcagatgcatgttactgagtgcaagtttaccaaaacctttttggggagaagttgttgcaattgctgcctacctaatcaatagatgtctttcttctggattaggttttaaaacccctatggaactttggagtggaaaaccagaaaattactcaaatctaaaagtgtttggggccttggcttttgcacatatcaagcaagacaagcttggggttagagctatcagatgtgccattataggatatccacctggaatcaaggggtacaagcaaagtcctaggcaatggtataagaggttttatgatttcatgatgaggatgaattttcaaagatccaactatgataattgtgtgtacattctaaaaagagatgaagaggtgtttttgtatttgttgttgtatgttaatgatatcttattggcaagttcaagcatggatcaaatcgacagactcaaggctatgttgagctttgaatttgaaatgaaggatcttgggaaggctaagaggatactaggaatggacatcaacaaaaatagatcaaaaggagaacttttttttgtctcagcaaggttatatgaagaaagttgttga

SEQ ID NO: 66746 - DNA, 333 bp, Glycine max
  Peptide Sequence Number=SeqID_183524
atgccaaagcttagagttattggtgttggtggtggtggtggtgatattgttggtagatgggcttctatcctttccaactgtcaagtgaaaaaggccttccttcaagtcagtcaaaccaatcgtcttcaacgtgctcatgtcctgtatttcacaagaaattttagaaagatcactagaaaaagtaatacgacatgggaaatctctgagcttgcaccactaggtccagaggatttgctgagaagattcatcaattgttggtattgggcaattgtaggatcgtcctcaccagatgagctggaggtagccatagggagatggcggctggaagcttag

SEQ ID NO: 66747 - DNA, 321 bp, Glycine max
  Peptide Sequence Number=SeqID_183525
atgaccctcatttcaagctctttgtgccctgataaattggagagaatgcttcacacaaaaatatcacaaaagtacattaaagaatcattctgcaagttagaaaaaaacacatcaagaatatctatctcaagatatctatctatctatcagagctcctggtctgggggacttctgtttggcatgcatactcacatggaagcaagattgaacacaatacagagagcatctgaggtatggtggaaggagtacaaagaggaatggcggattgaagttaaaaggaactctaagaatcatattgcaaactacaagaagcctaaatga

SEQ ID NO: 66748 - DNA, 786 bp, Glycine max
  Peptide Sequence Number=SeqID_183526
atggccactgttagagttgttcttgctcttgcatcgattaatcgatggcacctccatcaattagatgttagcaacgctttcttacacggggacctcaaggaggacgtttacatggagatccctcctggcttgcttggttacacatcaactgtccgcattcttcgatatctcaaagggtgtctaggcaaaggcttattttttccaaggacttgctctcctcatctacttgggtttagtgatgctgattgggcaacgtgtattgactctaggcgctctattactggttattgcttctttataagcaattcgcttgtttcatggaaaaacaagaagcaaactacagtctcacattcatctttcgaggctgaatatcgagcacttgcttctgcaacttgtgaattacaatggctttcttaccttctaagagatctacagattctcctttccaagactttcgtacttttttgtgataatcatagtgctcttcacattgctgccaatccggtctttcatgaatgctccaaacacttggacattgattgtcatctagtccgtgaaaagtcccaagttggactcatgttactactcccagtcccttctttaaatcaacttgcggatatattcacaaaggctctccctcctcaatccttcagcaccaatctttccaagctctttatgaagaaggactcaagaacacttggtaaagcttggaagaagaatggaaatggtctctccttccctcttgaccagcttgtgaagaagaggaagaatgagcatgaatggtga

SEQ ID NO: 66749 - DNA, 378 bp, Glycine max
  Peptide Sequence Number=SeqID_183527
atgaggaaccgacaagtaccattagagagatatgtcattacaaagacattggctaaacctcctgaagcttatcctgatgccaagaaccagccacatgtggcacagagattgaagcaacaaggtcactcttctggttgctctgttggtgatacaatcccttatataatttgctatgagcagggtggtagtcaggcagtgcagattcatcctgtgttatcacgtctttgtgcatcaattcagggcaaaagcccaaaaagactggctaattgtctagggctccactcatctaagtttcatcataaatcaaatgaagctttaaataatgattctacaagctcattcttgtcggctgttgatgataacgagagatatttctga

SEQ ID NO: 66750 - DNA, 405 bp, Glycine max
  Peptide Sequence Number=SeqID_183528
atggacaacaatcgaatgagaagctttctcgacattgatgactcagacctcccatcctttcttcgcctaactaatcactcatcctccatttcaacaagacttattcttggtctgactggggttgtacaagatgtcatgatgaataaaaaatctaaagagtcactcccaactcaagaattcataatgcgtgcccaccaagatcctatggagactactgatgccaccatgaaacgaacaatcatagaaggtcaagattatagcccatatatgacgaacattcatgatgcaatcctccctagaaagggaccagtcaccagagtcatgagcaagaggctccaagaggattgggctagagctgctgaagaaggccctagggttctcatgaacctcatgatagatttttga

SEQ ID NO: 66751 - DNA, 285 bp, Glycine max
  Peptide Sequence Number=SeqID_183529
atggttacctcaaggaaatccacgaaggtcagaccaagcttcgttctcaaccgaaaccgcgaggcaagtttggaagattctgcttcggttgaagggctcctctcggtgaggggtttcaacggagaacaacggcgatttgtggtggctactggtggctctccataccaaatttcgagaagatccaacgaaggctgggtagtgtttttaccaagacagcttcatgtagcttccttgagaagcttcattaagaggcttcctcgagaagcttcttcgtggcttctttga

SEQ ID NO: 66752 - DNA, 216 bp, Glycine max
  Peptide Sequence Number=SeqID_183530
atgtaccacaaagcatggttggcaaggcaaacggatattgaagacatctacagcaattgggaaagatcgtaccttgatctaccgagattgttacaaactatgcagcaatttcttcctggtatggtggtggagaaggaaacattgccaatgccaccacaaacaggtcacaccaatatagggtttcgtcatgttccattgtcttttttggagttttag

SEQ ID NO: 66753 - DNA, 201 bp, Glycine max
  Peptide Sequence Number=SeqID_183531
atgcagcatacattatacttggagaacatagaggaaagggaaactgggggcacgcctccaataatccagatagcgagagcatgggacctgtttctaacgttgatgcattgcagagttcctaataaccctcaaccaaagattaaggaggtcaagaagaagatgaaagaaaaggtcaacacttcaagcatatctggaaactga

SEQ ID NO: 66754 - DNA, 987 bp, Glycine max
  Peptide Sequence Number=SeqID_183532
atgtcaaacgaggaaacatcagagagagtcatgtacaaagaaaaagaagtggaagggaaccaaagaattattctagaagctgcaaaagcagaactagacaaggtaaaggaagagctcaataaagctaaagagagttccatgcaatcatggctcgactccgagcctctcatagatgaacttgagaagcagaaatccaatcttgctaatgctcaacagagttcaaatgcatcaaaagctgtcattgaagagttggaatcccagctagagaccatccacaagagcatcaaatccaaaagagaggatcaactcaagacagaattgatgatccatgacatccaaaatgctttggattacacgcataagaacatggaaaggctcaaacttgagggaaagaaagaaaagcaagcactagcaaagctgaggcaaaccctgcatcaaaggaagcagacagttcaaaccttgcatctcactctccaagctttgctactggagtcggatgctgtggaagaatcttctgccaaagctcttcaacatatcaagttttcagaaaatcacagagatgttgtgcagcttactaatgaaaactactatgccctaagaagaagagccaaagcaaagatttcacaggcaaattcgcgtgtttctgtttccatggagcaaaaactcgcagctgaggctacccgtgagttggtgttatcaagattgaagaatatgtactccagtagatcatggagcatgaacaaaagaaacacaatggggcaaccgtacacagaaaggaacgcaaaaggccaagacataattgttgaagaggaagtgaaaactaaaatagcaagtgcttcacccaaatcctctgctgaagaatcattacccaagtccaaagggggaaaactacaacagtccagaaaatcaggaagtaataatatgaaaactataaagaaaaagtcatccattttgtataacatgagaaaatgtctttatggaagttaa

SEQ ID NO: 66755 - DNA, 384 bp, Glycine max
  Peptide Sequence Number=SeqID_183533
atggatggctcatccaatcagaatgaaagtggagctagtgtcatcttggaagggccgaacaatgtagctctgtcacaatcgctgcgtttcgaatttaaagccacttgcaaccaggccgagtatgaggcactgttaggagacttaagattggctagggagtattattacgcattccaaaatcttatagaggaatttaatgaagtccaagtggtgcacatccgtcaagacatcaatgacaaggtcgatgagttgctaaggaaggagatctcatctggagagcctgagttgaagcttgaaaatactcatcaaaacgtaaattggttgctaactagaaaggacctttcagggtttggtattgcctacagaacggagcctataggctag

SEQ ID NO: 66756 - DNA, 312 bp, Glycine max
  Peptide Sequence Number=SeqID_183534
atggagattattgggcacctttggatacaggtagatgcaatatatgtcagcaatgattaccattctagcttgatgcttaggccaaattgtgagaacaacattgttaatgttagttggagacaccctccttctgattctttcaagctaaactgtgacgcttctgtccaacctcaatgcaagaaagctttcattgagggcgttttccgcaaccatttcgggaatgtcatttttgcttattcttttgacattggatcttgttcggtgttaatagctgaaacttgggctattttgattggcattcaaacagcttag

SEQ ID NO: 66757 - DNA, 318 bp, Glycine max
  Peptide Sequence Number=SeqID_183535
atggtgcactacgaccgtgctaaaatccaccactgtcgtggttggaaacttgtgacactgaagctttggggcattgtatatagcccttattgtggggaccaccgtttaccacgaccatcgttggaaactgatgttgttcagaagggatgccatagcggtatttcttaccatggcagtgagaaatacttccttaagaaggcacttgtgcactggttccatgtagtgatgccactctcagttctatctcaccgtgttggtcaacttgatgaacttcctcaagtgctatgtaggatcttcatgggaagcaccactaaacgg

SEQ ID NO: 66758 - DNA, 690 bp, Glycine max
  Peptide Sequence Number=SeqID_183536
atgggtgcctttaaggcacctggcccttatggcttccaagttgtgttttaccagagccagtgggatatggtttttgttgagccttggttgattgggggacttaatgatacacttaaatctcttattcccaaggtggaaaatgtgaagatgaaagatttcagacctattaacctctgcaatgattcttataagagaaagattcatacagtggtttggaatcaaatttgtaagcctaagaatgtaggaggattgggattacggtcctctatgaaggttaactcagcctttatgatgaaagctggttgggatttgtgctcagaacatgatgatctttgggtgaggattttcagatcaaattgggagcaggttcataagaatgttagatggaatataggtaatggcgcttctgttgaattctggtatcactgttgggttccccatggaggaaacttgttggatagagctattaataatgttcctgaagaccaaagttctaacttggtgtgtcaatacattaatattaatggaaattgggacttgcggaaattacaaccttatctcagttcttataatattgattgtatcagagttattccacctcctaaagtttctaaagattctgacaagctggcgtggggaggagcaacaaatggaaaattaagtgttggtttagattacacgtgtgactag

SEQ ID NO: 66759 - DNA, 585 bp, Glycine max
  Peptide Sequence Number=SeqID_183537
atgaagcaacaaatgttggaattcctttcgtccaacccgctgtcgtcccttttggccttgacaaatcaaggattcttcatcaaggagtgtgctctgaatcctcttaatgatccatatcatggttgtcacgtgctaaataagaatgatgatgcaaccaattgggaaaatttctgggccttccagtcgagggcgatggcaattgctcaacaccttcatgggtcttctaatactgataagttgaaggccaacttggaaaaggccaagagctcccttgactcggctcttcaagccaacattattttggttggagacaattcaaacttgaagggacgcgtcttggatcttgaggttgagatgaaggcgttagagaaatgtgcccttgattctgctttggctacttttgagagggaaaaggatcctgaaagggggaggagaagcttcaaattgagtataaagcatataatggcatttgcgaagctcatgagtcctacttcagtcattgcctctgacaagtactattccattgcgaggtcctggatgaatccattttcgacatcaacaaagatgtctataatggagacttga

SEQ ID NO: 66760 - DNA, 378 bp, Glycine max
  Peptide Sequence Number=SeqID_183538
atgagattaccgatgacaaatggagaagatgaatgtgcaagtaataacaatgggggacccctaaggagaaaaggccacaatagggcggttggagctcgcccaagcaagctgaaccttaaccctaaagtaatgggctcgcccaagcgagctggttacttagccatgaagccatttcatggcccaggcaagccagatcctagcttggacgagctggggtctaggaaaatccataaaagatcctttttcccccttctttggtatccttttgtattcttgatcaaaacatcgagtgatccttggctttacgttgtaaccaacaccaaacaacataatgcaactagcaaggatcaaaaaatcatactgaatgatgttccctga

SEQ ID NO: 66761 - DNA, 171 bp, Glycine max
  Peptide Sequence Number=SeqID_183539
atggccaagatgacgaaggagttgcagcgccgcaaaagggaaaggtttaaaccgagagtgggagtgaccatgggtgcaagagaaggaagggtgttacagcttgcgctaaagaggtgtaatgggtgtaacgagattctcaaggtggctgatcctttcatcccttatccctga

SEQ ID NO: 66762 - DNA, 315 bp, Glycine max
  Peptide Sequence Number=SeqID_183540
atggttagtagtgtacaggttgacttaagtgatgtaaacatcaaagtgctcatttgggtcactgacaccatcgtacttctcgatagtcaagttcttccaattggaagggagggggtcgtcaagaccgactaccctcttgtagttgtgcattctcctagcgaagggtcattacctcttcagcgtgatgccgatgcatatccactacttgcactgataatctcttcaccattggggataggtcaatttggtcctccacgtgcgattcttcatgctgatgattcccaggttgttatgttgcagctgtgtttgttctag

SEQ ID NO: 66763 - DNA, 261 bp, Glycine max
  Peptide Sequence Number=SeqID_183541
atggacgaagaacagtggatgtatgatagtattatatatgaagaagttgatatgaatgttgaaaatgaggaagatgctggcatgaaattgtttgctagttgtgatgaagttttacattggactcgaccgatgactcatgacattggatttgttgtcgtgataatgacgtcagacaccaatactggtgttagaggcagagccttatttctgttaatagcttgcgaaaggagtggtgagtataggcctaagaagaatgatttg

SEQ ID NO: 66764 - DNA, 279 bp, Glycine max
  Peptide Sequence Number=SeqID_183542
atgccaatgcataaggtgggttcgaaatgcagggaaaagcttttgttagaaaccagactaagctacactatgctaaactacactaagcagaattgggtggggaggcaatggaatcttctgctgcttgtcccttacacgaaatccttgagatggttaggcctcttagtgatccttacgggtctgctagtgtgggtactgtggtattggagttgctatcagcttttgacggagaaggaagggttgagtttttttagtttagaaatcagagtcttgaggtga

SEQ ID NO: 66765 - DNA, 474 bp, Glycine max
  Peptide Sequence Number=SeqID_183543
atgacaaggagatcaagaggtagaggtagaggtcgggggaggcctcctaaactaaaagaagatccaatccaatatgaggagcagttacaagaagaagatcaacctcagcaaggtcgtcaaggtagaggccaggggaggccccgtaaactgattcaagatacaaacatatgtgaggcacaattaccagaagaagttcaagctaagcagcagggtgttcgagttccaggtagaggccgtgggaggcctcctaagccaaaggaaaatacaaaccaatgtgaggatgagtatttacaagaccacgctcaagggtttggagtggaaaaagctgaaggtacaaagaggggaagcatcaaagatcagagtcaagagaagcaaagtcaccagcggggtcaaggttggaatcagaatcaaaatatgggtcaagagaggtttcccaatcctaatgttgaagcaaaacagagccttggcggctag

SEQ ID NO: 66766 - DNA, 3888 bp, Glycine max
  Peptide Sequence Number=SeqID_183544
atggctgaagctacacgatcgaaaacaagcatggagcgttgggaagatgtgtttgcaaagctctcggcatccatgacttcaaagttcgatgaacttctcagtcgtatgaatcaattagaaaactcccacaccaacactcacgctccgtcgtcgtttgcggcccccgcggtaacggccaccgccaacacagcttatcgattgaaattggaggttccaagatttgacggcacggatccagagggatggatattcaaggtaactcagttttttgagtaccatgcgacaccggagcatgataggttgacgatagcatcgttttacatggagggcccaaccttagcatggtttcaatggatgtatcgaagtggccaactctcctcctggacagcctttcttcacgccatccatgcacggttctcgtcctcagcatacgaagatcctaccggagttttgtgtaagctcacacagcggaccaccgtctcggcgtacctctcagaattcgaaactcttgctaacagagtcatcggtctcccagcgccatttgtcttgagttgttttatatcaggacttaatcctgcaattcgaagggacgttcaggtgatgcaaccacattcattagctcaggcggtttccttcgcgtgcctccatgaagagaaacttctcgatggtcgccgtcagaccagcaaacctgcttcttccttaaccctgggaacgagtgtcacgcgtacatctccttccttgacctcatccatagcggattcgccactgcttccttctccgagtagaccccgtgcttcatccattcccttcaagaagctaacaccatcggaactcgccatacgtagggaacaaggcctatgttttaactacgacgaaaaatattcgagggggcataagtgcgcttcatctctattcttatttgttaccgaggataaggatgataaccgtgagatagacccaggaccatcgcagttgcctcctccattacaggaatccgtgccgactcagattagcctacatgccttgtccggtcacggtgcaccggagacactacatctcaccggattcatttgtgagcatcgagtccagattctgatcgatgggggcagcacccataatttcctacaacaggaattggttacattgcagcagctgcaaccgcaagagacctcaacattgcgggtcaccgtaggtaatggtgaggaattgcaatgcactcaggtatgccctaatctcgtcgtgaaaatacaaaagcatgaatttcaggttgaccttcatgttttgcccataaggggagccgatgttgtgctgggagtccagtggctcaaagccttaggcccagtccttacggattacacagcactcacgatgaaattcatatacaatggccaattgattgagttagtaggggatcgtgattcatctcttcaaatgatatcaccgtctcagttacgcaggttggtggatacaggtaacactagcaccttcttccacattaaaatggaaccttccatggaaacaccagtaacgatagcccacccaataccggccgtccaaagactcctctccaaacacgcctccctcttccaacctttatcaactctacccccatctcgaaccacagatcacagtattaccctccttcctaactcgaccccagtcaatgtaaaaccttaccgttaccctcacttccaaaaacaagagatagagacccaagtcgcagcaatgctcaggcaaggccatatccagtacagctcaagttcgttctcctctccggttctattagttaagaagcgcgatggaacatggcgcttttttgtggactatcgggctctcaatgccataacagtccgggatcgcttccccattccgatagttgatgagcttctcgacgagctcggaggcgctgtttggttctcaaagctcgacctgatgcagggataccatcagattctgatgagggagtccgatatcggcaaaacggcatttcgcactcaccatgggcattacgtattccgcgtaatgccctttggtctttgcaatgctccggcaacgtttcaggcgacgatgaacaggttgtttcagcctcacttacgaaggtatatcatcgtcttcttcgatgatatactgatatacagttgcagcctggaagagcatatcaatcacttggaaatcgcgttccaggtattagaacatggccagtttactcttaagctcaccaagtgttcgtttgcgcaaaagcaaatagagtacctaggccatatcatcaccggcaatggggtccaaccagtaccggagaagatacaagcaattcaggagtggccacaaccacgatccacacgagctttgcggggtttcctaggtttggtgggattttatcgcaggttcattaagggatacgcgatgatagcccatccgctttcgcagttactgactaagtcggagctggtttggtcaccggaagccgacaatgcgttccaaaagctcaaacaggtggtcacgacggcgccggtactcgctcttccagatttctccaagtcctttacggtagaaacggatgcttcgggcttgggaatgggtgctgtgctttcgcaggaaggacaccctatctccttcttcagcaagcaattttgccccagattactacaagcttccacctatgtcagggaacttgccgccatcaccgccgcggagtttaaaggagttgatgaatcaggcggttcaaacccagaacagcataaatacctagcacgactactgggttttgattatgtgattcagtatcgagcagggaagagcaatatcgttgcggacgcactttcttggtcaggagcatcaacaactgcttcattattcattatctcattccctcacttcgtcttcctcgaagatttgcgaagggagttgcaggcaaatcccgagtttagggaattaagaaggaagatgaccgctgaacctcacacatatcctaatcattcactagctcaggacctcattctttatttcggtcgtatatggttaccccagggctgctccttcatcaaggtcctactctcagagttccatcagtcgccgtcaggtgggcatatgggattccgcaaaaccctcaaccgcataacggagaattttacgtggaacacgagcactcgagacacgcgtgacttcgtctccaattgtttagactgccaactagtgaagtacgaaacagctaaacctcgaggccttctatgtccgcttccggtaccatcacggccatgggaggacctttcgatggatttcatcgtaggcctcccggcgtatcgcagttacacatgtatcttggtcattgtggaccgtttctctaaaagagtacacctaggaatgctcccctctcatcacacatcacagatggtagctcaatcattcatggagatggtgggcaaattgcatgggatgcctcgcagcatcacctcagatcgtgacccgcttttcatgagcaagttctggcaatccttgttctctttaagtggaaccaaactccgaatgagttctgcatatcatcctcaaacggatgggcagactgaagttgcaaatcgagtggtggagcagtatttacgagcgtttgtacatcggaaacccagctcgtgggggcgcttcttgctgtgggcggagtggtcgtataacacatccgtccactcctccacgggggtaacacccttcgaagtcacgttcggccgcaaacctccgagttttccacaatatcttaccgacacttccacggtacctgcagtggatgacttacttagtcagagggaggaaatgttcaatctacttcgccggaaattgcagaaggcacaagctcgcatgaaggacatcgcagatggacgtcgcagggaccatgagttttag

SEQ ID NO: 66767 - DNA, 981 bp, Glycine max
  Peptide Sequence Number=SeqID_183545
atgctggacaaatccaagttcttcttcctcggcgccgccttatgctccggcgtgtcatgcgcactctaccccatggtcgtgttgaagacgcgccagcaagtttcctcctcacgcttctcctgcctcaacatctcctgcgccattctccgccacgagggcctccgcggcttctacaagggcttcggaacctccctcatgggaaccatccccgcacgtgcgctctacatggtctccctcgagatcaccaagagcaacgtcgccaccgccttcctccaattcggcttctccgagaccaccgccgtggctgtggccaacgccgccgcgggcgtcacctccgccatggcggcccagctcgtgtggaccccaattgatgtcgtgagtcagcggctcatggttcaggggagtggcgggagtaaaaccacagtgctcgcgaatctcaattcggaaaattacagaagcgggtttgatgcttttaggaaaattatgtgtgctgatggagcgagagggttttatagaggctttgggatttctatattgacttatgcgccttccaatgcgactcatttggggtgcttttggtgtgcttttggttcttacatgggaaataacaatggtagaaagggaaatgaaaagaatgatagtaataagtatagcaggtctgattcgaaggcaatggtggcggttcaggggttgagtgttgttatggcaagtggggtatctgcgattgtgacaatgccgtttgatacgataaagacgaggttgcaggtgttggatcttcaagaggggaatgggagaaggaggcctttgacttttgttcagacggtgaggaatttggtgaaggaaggtgggttgcttgcttgttacagaggattgggtccgagatgggcttccatgtccatgtctgccacaactatgattactacttatgagtttttgaaaagaatgtctaccaagaatcaagaggatttgagtccaccatag

SEQ ID NO: 66768 - DNA, 1578 bp, Glycine max
  Peptide Sequence Number=SeqID_183546
atggctgataatgttgttatcaataacacagtctttgccaacctgttgaatccctattatactcatcccaatgagaatcctggtgttgctattgttgctcaggtccagtttgttgatggttatttgccttgtcctactcttaatgatcctaatttcactatttgggatcattgtaataccttggtggtttcatggcttcatcattcgcttgatccagaaatcctgcaaaccattatgtggatggagaatgcttcggatatttggaatactctcaagaaacgctattatcaaggtgatgtgtttcgcattagtgacttacaagaagagttgtatctgcttaaacaagtggaaaccagtcatggtccttatggcagaggtcaaatgcataccagtcaagcttcttatggcagaggccaaggtcgtggaagccattcattaggtggaagagggagtactatcaatcaatactctttggatgatcaagaaattgaagatgatttgcaatcccttggacagaaagaggtggctgcagatacttcatctacagcttttacaccagagcaacataaggctctcctttctttattgcagcaaacttcacaagcctcttcttctcacaccactaatcagctgattagttttcataagaatggcaattcaggtatattctgtgccactcttcatgcttatagttctaacataaattcttgggttcttgatagtggagctattgatcatccaattggctgcaagtgggttttcaaaaccaagttcaaagctgatggatccattgacaaccacaaggctagattagtagccaagggatttacccaaactactagtttggactacattgaaacctttagtccagttgtaaaaatgaccatagtcagacttgtattatccctagctgcttctcaaggttggcatcttcatcaacttgatgttaacactacctttttacatggtgatttacataaggaggcctatatgaaggtaccaccaggcctgatagttgctaatccagctttagtttgcaagctgcaaagatctctgtctcctactagcctcactattgtgcttgtttatgttgatgatttggtgcttactggcaccgatcttgctgaaatccagcaactcaagcagtccccggatgccaaatttagtattaaggatcttggaatactcaagtacttccttggttttaaagtagctcgatccacctcaagtattgtcttgcatcaaagaaaatattgtcttgatcttcttcaagacactggtttgcttgctaccaaaccttgctccttacctatggatcctaccctgaaattacacaaagcttctggtgttcctctttctgattccactgtttacaggaggcttatagggaacctcttgtatcttactcacacaaggcctgatatctgctatgttgttggcaaattgagccagtatttgcaatctcccataaacattcacatgcaagctgcccaccatgttctaagatatctcaaaggcactgctggcatagtgactcggattggggagcttgtcttgacactcgaaggtccatcttag

SEQ ID NO: 66769 - DNA, 294 bp, Glycine max
  Peptide Sequence Number=SeqID_183547
atgagttttgaaactgaaatcaagttaaaagtgaaagaaggaataaacaagacaaatttgagatccatcaggtgtctaccatatagcctgttttgttacagtaagaacaaatcttggatcctcttcctcgacctcttccacctaatgaatggcttccacgaccttggcctctgccataagaagcttgactggtatgcatttgacctctgccataaggaccatgactggtttccacttgagcaaaaacccgagaatcatcaaactaaacaacaagctgcctctcttgttgaatga

SEQ ID NO: 66770 - DNA, 261 bp, Glycine max
  Peptide Sequence Number=SeqID_183548
atggatcctataattaaagaagtagagttagatgttgaaactgaatcttcttccatggttggacaagcatatgatcctccacccttatgcgcacatgtttgtatgatcaaggttgaacttgttaaaacaaggattattttttataagaacatcactggatggaaacctcctcgtcctcctacacctccagactatcttattcatctctcatccgattctgattactctagtgatgagtttctacgaaatcttgatgaataa

SEQ ID NO: 66771 - DNA, 201 bp, Glycine max
  Peptide Sequence Number=SeqID_183549
atggccaccaccgattcccttcccagctatccccatccagattatgccgagattgttgtggtgcgtcacggtgaaacagcttggaattcccagggaagagttcagttttacattgactttcgagagccagtatccctcgaattacctgaaggctcaaataagaacttaacccaagtccttgattcgagcctgacatattga

SEQ ID NO: 66772 - DNA, 279 bp, Glycine max
  Peptide Sequence Number=SeqID_183550
atgacattgaatgatttgagtggcgtgttccacataactatgaaggctgcaaaggatgtcttagaaatgtctgttactttgctaccccttgcgaggaggttgaaagtgctcaaaagagcattagaatcttcacaagatccagtgataatacagacaactagcatggaggttcgaagaattaaacaagaaatgactcagttgtgtggtggagttaccccaacgggtatagaaattcctgaagttaattggttggagaggaacttgttctttattttgtaa

SEQ ID NO: 66773 - DNA, 364 bp, Glycine max
  Peptide Sequence Number=SeqID_183551
tgcgccaccgcaaaggaggccttggggttttcgaagcctttctctacgctctgagccgctggactattggggcggtctcaacctccctgacatgccggactggagatattgttacacgaccttaagcttacgatgcggtggtggcattgaaggacatgactctcaattggcgtctcgcaccgaagcttgcggcagaagcgacaccactgcaactgccctcaacaaaaaacgtgtggctgctgacgccgttagcgatgacggactcaccgtgaagtgtcaaaatgttctggcagcgacaacgttggtcttcaacatcagagagaagaaagaagggaagaaaaggagagagaataggaggaaaagg

SEQ ID NO: 66774 - DNA, 144 bp, Glycine max
  Peptide Sequence Number=SeqID_183552
atggaaaatgtgtgtgtggtgtggtgcagtggtggtggtagcggccgcgccaaagagacagcgccgccgcaacggggaatgtttcagacacgattcgttcgttggggactaagaggcaccagtgccagttataacggttcataa

SEQ ID NO: 66775 - DNA, 828 bp, Glycine max
  Peptide Sequence Number=SeqID_183553
atgggtgatgacgacgacaacaactcctcctcccggtttgttccgtacacgtgtcgagatccatttgtcagcccacttctcgataacttttttatcgaaccggaccctgcacccgaaccgaacctacaaaatgatgaacagcaatccctgcagggtggttatgtttcctccacgggttcaacgatccaagatcaatcccagcagcatttttgcaatgacaattttaccattggtggaggaggagttcctaactaccaagtagcggggtcttccaagaacaagcgtacatatcccttcactgatgtggatattgaacatcaatccttcaggtatgactttaaagcgggtccatccaatctgaatcagcctgaaagtgggattatggattggcctcctgtgccaaggccattcttttgcacttgctgccaagttctaagacagacaattcacaccaatggtaatgatcttgagagacttgaaatacatgggaggatagggttgatcaaccatataataattcagaatcagagtattacgccgggtgatcctccatgtgacaattatgatcaaatgattgatttcaccaacggaacccctgcagaagttaagggtttccttgaagattacattgcgcagaaggataaattagggtacattattgtggaagaagctttttctgcgttttatgaagccctctgcaccaaattagattgggttggaaaacgcactaataacgaagacgatgatttgattccaccaaatttggagaaagaaggacctgaggctgagcctgagaaaagaaggcataaacgtagtcgcaaagatcag

SEQ ID NO: 66776 - DNA, 372 bp, Glycine max
  Peptide Sequence Number=SeqID_183554
atgggaactcgtcgagcctgtgcgaaccccaacacgaacctcaatggcagcttgagtgaggaggacaaacaggaaggtattctaatctctttggttgctggaagaaacaattatatggtggagcatttgacatgtttacctaggaagcaagctttggttggtgatgcttcaggtgaagagcaacttttttcttctgaaaatagcttaatggatggcattggacgtgagcttgatgtctatcttgaaaagatcaagcgtaaaacagttaaaatagctagacttgtttctcttatgagcaagacttcagcacataataagaatcaaatgcatagaaagagcaagactagcggtaactggtatagccaaaaataa

SEQ ID NO: 66777 - DNA, 1107 bp, Glycine max
  Peptide Sequence Number=SeqID_183555
atgaatgaaaggtcaagagacgaggcatctcctcagctgttagatttgatctcaaacgagagagagtggcagatgaacaagagaaacgaaggaaagtcctcagaagaaagaaaactcgaactcaggcttggtccacctggtgaagactggtctctgggtggtaaaatgaagaacaacaacacagaaagagaagatcaatctcttctctctcttggttgcttctctcctaacattaacagtaatgcgttccaaagcaaggcctctcatccatggccaaactaccaccaccatggccagggtaacaacaaaaaagcctcttcttcatcatttcttcagttcccatcatcaacccaacctgtgatgatgggaaaagatgcttcttgccctaaggtggtggtagagttgcagcagaatggtggtgatggcaaagtgttctctccctcttctgcaaatacagctgtgtcccagcctaacacctctcagaaaagaactgctcctgctccagtggtggggtggcccccaattcgttcattcaggaagaacctttcaagcagcagcagtgcttctaagccaccaccacctcctgagtctcaggctgagcagcagcacaacaaggttgctggtaaaaaacctgttgacaactatgctaataataaaggtttgtttgtcaagatcaacatggatggtgttccaatagggagaaaagtggacctcaatgcttacgacagctatgaaaacctctcttctgctgtggacgagctattcagaggtcttcttgctgctcaaagagattcctctgctggtggggttcacaacaagcaggaggaagagaaagcaattacggggttattggatggaagtggagagtttactcttgtttatgaggataatgaaggagacaggatgcttgttggggatgtgccatggcacatgtttgtatcaacagtgaagaggctacgagtgttgaagagttctgagctttctgcttttacccaaagcgattttagggaaggaattcatggtccttgtcattgggaggtgcctaacttggatgcctgccaaaacacggaaattgaccctcacgtcgcacggattcataacacttga

SEQ ID NO: 66778 - DNA, 219 bp, Glycine max
  Peptide Sequence Number=SeqID_183556
atggagctgcgggaaattgggacattaaaatacgcaaccacaacatatttcattaccttggagctgaccaacccgccttcacccttaatttctctaaagttacaagatagcaatgcctacttcaaattcaacttaggttgctataaacaggaaggaaaaagaaatatcaacatccacttaataaatgaaatagcactatgcacaaaccaaattacttaa

SEQ ID NO: 66779 - DNA, 885 bp, Glycine max
  Peptide Sequence Number=SeqID_183557
atggcaagggacaaactacaatgttttgcggtttgtgacctgaaactaaaactcattagtgacagacaattagatgaaagattatataatttgccaaatgttgttgaagtggctgctttgattgttggtgacgagcatacatacaataacagagatatcatcattgagaagaaaacaagcttgctccaaagaataagtgaactacatcttgcatattttcctttgcaacatccccttttgtaccccaaaggtgaagatggctatagaccaaatattcttcataaggatcatccaaatatctatgttgcaaagaggaaaaaagttatcatgcgtgaatgcaatcaagggacaatgaagctcacacaatgctacattcaagaagattgtttcaacaatggattattaatgaatattgaactcagagttaacaagtacatgaatttaaatgcatgtaataatgagcccctaacccaaggcaatgaaaaaggattgcctcatgctcatattttaatatttttgcatccttcaaacaagtatccaaatccagaagagattgacaacataatttctgctgagataccaaataaaaacgaacatccaaatttgtatgaaattgtcaccaaccatatgatgcagggaccgtgtagactgtcaaatacaagggcaccatgtatggtcaatggaaagtgtattagatttttccctaagaagttccaccaagcaacaatcattgatcaagatggatttccagttgttaggagaagaaacaacggacatacgatgcaaaagcatggtatatgtcgccccctgaagcatgttggaagattttcgcattcccaatacatggacgtgcaccagcagttgaatgcctctatttccacctag

SEQ ID NO: 66780 - DNA, 381 bp, Glycine max
  Peptide Sequence Number=SeqID_183558
atggctacttctgatcaaacacttgtttgtgtgaaacaagtgaagcaagaggtggcggatgagtgggatgagagcatgccattaccaggggacgtcattgaaggattttctgagcgcgaggctgatgatgattcctttttaccggtcaaggccagttcagagtttagttctcagcttggaaagattaacccccgtggggaactcatatggatacaggttagaagaggtgatagcttgatgaaacttcaagtccgcattgtgcagcagaagggttccatacttcaaaggaagtatactatccaagctgcaacggatcacagacatgtagcggatttaggggatctgacattagagcggtgcaatgaactgcagggtacataa

SEQ ID NO: 66781 - DNA, 135 bp, Glycine max
  Peptide Sequence Number=SeqID_183559
atgaattggcactaccttcttaaacccactcgcaaggggtgccttccgcgatgtctccctcctgcgaaggctgctcccttcgtccttcgtcttgaagccacgcatcctcattcccttcctccattgtcatcgaag

SEQ ID NO: 66782 - DNA, 1233 bp, Glycine max
  Peptide Sequence Number=SeqID_183560
atggataataacaacaacaactactccgggtttgttcccaataatgatactgatgatgactgtacatttctccaaaccttgttggaattggacccccaacatttctatttacccactgaagaatttgtttcactgtccctacaacagcaacaacaaaatgatccttttggcgttgaaaagggtaataatgttcccttcctgcagggaaataataataacgattttcccattggagaaggagtagttcctgatgttgttgatgtggaggaagagggtccaccgaggaggacgggtaaggaaccgatccccgaaggccaaggtgatcgattcttcatacatggccatgacatttttttctttggagaaggaggagttggtaataacgttgaacccccgcaacagaatcaaactcagccaccaaataaccaagatgtgaggtcactttgttcttggcccccaccaccagagccattctcttgcagttgctgtgaagttcttagacaaataaattacaccaatggtgttaggtttgacaagcttgagattcatggagcagtcggggtgattaaccacgcaatatgcctcgttgaggataagacatcgaatcgtcctccaagggacacttatcaaataatcgatttctgcaataaaaacacagaagaaataaggaatttcctaaatgtttactgtaaagagaggactgaagcagggttcattcccatagaagatccgtcgatgtctgccttttatgatgccctctgcactggaatggattggactgaagtttccaatgacgtagacgatgatttggcaaatggcacggagcaagagtcggagtctgaacctgaggctgagaatggaagaagggcttcaacttctaggcctagacgacgtgatatggcagttcagaggcagagagtaccaaggatgacattgagtgatttgagcggtgtcttccatttgactattagtgctgcagcggtcaaactggacgtaggtgactctaccgtgaagagtatctgccgcagaggaaaattgaaaagatggccccaaagaaaggtgcaaagccttgccaagaaggtcagagtactcgaaagagcattgaattcgccagatccaggggtgaagcgaagaactctagatgaaattcgaagacttcagcaagaaataattgagaattgtggtggaattaccccaaccggaataccgatgctccaattcgatgaagaatga

SEQ ID NO: 66783 - DNA, 768 bp, Glycine max
  Peptide Sequence Number=SeqID_183561
atgagcatgagagtgaacaagcgaaggagagaattccgcagaagtgggatcaaatataactggaagatgaaaataggcacctatctgcctgaccaatgttgttcagtaataagctccattctatttatgcccctaattagtgagtactgcatcgatactaccacagctaggtgcatggcatggtttagtgcagcagtttcctctggggtccctcttgtttttgtcaatatccaaacagaacaaattccctccacggaggagactcatttcttgaaaagggaaatagctactagcaagcaaaaaatcaacaatgctaaccaaataatgcatggtataaggttgtggtttttgcctggactagcagaaatttcagttgtgttaatccctcaacctggcgaagctcgctttggcatggaaattaaacgaactgaagagggctttgtgtacatatattcagtgatgaggggttcaccagctgatcgtgctggggtgagagaaatgtatgaagagtcaagtgcaaataggttccttctggtgatatcaaggttgcaatgcaagagcataatgccaacgagtgcttgttctgctggccttgtgcattgttgtgaccaatctgaaatgaaggacattctcacttcagctatagaccaatatgagacaattcaggtgcatgtcatggcctggccgaaccaaactcgtccctctccaattcctgatgttggttgtttagcggccctgctacatccaaaaagcgattcatcattatga

SEQ ID NO: 66784 - DNA, 252 bp, Glycine max
  Peptide Sequence Number=SeqID_183562
atggttagtcatgggatgaagccagatgtgaaagcgtatcgggtcgtcgtcatcaatgagtattgcaagattagaaaaccaatgatatgtggtctttgtaaagtgaagggtaggatgcaacaagttgaagagctcatttcggatatgcttcagaatgggcataacctggatgccactatgcataattacttacttgcgggattttttgaagacggggatgaagaaatgacaccaaagacaattatgacataa

SEQ ID NO: 66785 - DNA, 1143 bp, Glycine max
  Peptide Sequence Number=SeqID_183563
atgggcaaagctacaaggtggttgaaggggttgttgggaaagaagaaagagaaggattactgtggctattcaggctcattggatcttgacaagagggaaaagaaacgatcggagaaggatgaagtgagtcactttactccaaccagtgttaccacctttgaccgtactaggttcagatcctttgttgcccaaaaagagaatgtgaagaacaagcactccattgatgtggctgttgtgagatcaaaaagctgtgacagaggcaccttgcttattggaagcatgcagggctgggctgctgtgttgattcaatccttttttagaggttatttggcgcgtaaggctcttagagcactcaaaggattggttaagatacaagctcttgttagagggtatctagttcgaaaaagggttgcagcaactcttcacagtgtgcaagctatgatcagagctcaagctgtagctcgatccgcgcgagctcgtcgttccatggacaaggagaatagatttcatcctcaaactccttccagaaaacacgtgcaacggtttgatgaagcaagaaattatcaattacccaatagaagggtacctatatgctgtaaggcaccctttaatagatttgatgggagtcaaaaagttgttgaggttgacactcacatgccacattcaagaagtaggagcattaacactgcaatgtcagaatgtggagaagacttgaactatgaagcaatgtcatcctctcttggttgtccagttcaaggtcgaatctcacttcatgagaggcaacaccctcaagagtttgaatggctcttcaacgttgatgaaggtaataacaagttctccacaacacacaacacgcctcgtttacaaaaatgtatgctaccaggtactccagtgaagagtgtttgtggagaaaccttcttcaggaattgctccaatttccctaactacatggctaatactcactcttctaaggccaaactaaggtctcacagtgctccaaagcaaaggcctgaactcaagaaaaggctttcaatcaatgaaatgatggcagcaagaaatagtgttagtggtgtgggaatgcagtggtcatcatccaacccgaaaactcaagaagattactttttttttgaaagggttatttag

SEQ ID NO: 66786 - DNA, 1236 bp, Glycine max
  Peptide Sequence Number=SeqID_183564
atggtgaaggttgcttttgttgtagctggctttttttgtttcattggcaatgggagaaccttgggagcctcaagaggtttattcaggtggcttactggggaatcttccaatcctcttcctcctcttgataccccacttagaggggtttccctgccaccttcactgccagattttgttgaaccaagcaacaccaagatcacaactctccccaatggtctaaaaatagcatcagaaacctcaccaaaccctgctgcctcaattgggttatatcttgactgtggttcactctatgagacgccattgtcaagcggggcgtctctcctgctagagaaaatgtccttcaagagcacggcaaaccgaagtcactttcgtgttgtgagggaagtagaagcaattggtggcaatgtaggagcctcagcctctcgcgagcagatgggctacacttttgatgctttaaaaacttatgttccacaaatgattgagttgttgattgactgtgtaaggaacccggccttcttggattgggaggtcaatgaagagcttcgaaaggtgaaagcagagcttggagaactatcaaacaatccccagggcttacttttggaggcagttcactctgctggttattctggggcattggctaatccacttttggcttctgaaacagcacttaacagattaaatagctcccttttagaggaatttgttgctgagaactatactgcatctaggatggtacttgcagcatctggggttgagcatgaagaacttttgtctgttgctgaaccacttctctctgatctaccaagtgttccccgtcctgaagaaccaaaatctaactatgttggtggagatttccgtcgtcaagaactgtcacaagggcaggttgcacgtgtagctattgcttttgaagtgcctggtggctggaaaaaagagaaagaagctattgctttgactattctacagatgcttatgggaggaggtgggtcgttctctgctggagggcctggaaaagggatgcattcaaggctgtttcttcgtgtcttgaatgaacatcaacagattcattctttttctgcattcaacagtctcttcaacaatacagggctatttggcatatatgcaagcacaggctctgattttgtggcaaaagctgtggatttagcagccagagaattaatagcaattgcatcaccgggacaaggtttaatctgccttgctttttgtctcttgctgtga

SEQ ID NO: 66787 - DNA, 393 bp, Glycine max
  Peptide Sequence Number=SeqID_183565
atggtgctcgtatatctgtcatcctacagaatgccgatgactttcttcgttgtgtttttgggtggtctacttactcaagctcaggatcaatcaggatttatcagcatagattgcggagctcctgcagatatccactatgttgagaagaaaacaggcataaattacatttcagatgccaatttcgtaaatacggatgtaagtaaagaaataatgactggattgaaaagttcctatcgagaaccgatgtggaatgtgagaagcttcccagaaggaacaagaaactgctacaaaataaatatctcaagaggttcattgtatcattacttaaactcttacggagtagttgaggactttatgattatataccagtctgtacaaggaggtggtctatga

SEQ ID NO: 66788 - DNA, 1527 bp, Glycine max
  Peptide Sequence Number=SeqID_183566
atgctggattgtgtcacttcccatgacaaaatcaccacagcagcttctggcttcgtacttgaggatgttcctcatctatctgattacatccctctcctccaaacatatcctgacccgttacaagacaatccttcctattctgttgttgcgcaatactacgtgaatgtggatgatacaattgcgcaacagatagttgtacacaaaaatagtccaagagggacccattttcgtcgtgctgggcctgctcagaaggtatattttgattcagaggaagtgcacgcttgtattgtcacgtgcggtggactttgtcctggtctaaatacagtgataagagaaatagtatgcggcttatatcatatgtatggggtgcacaaagttttgggaatacagggaggatatccaggtttttattctcgaaatacagtgcctttgacaccaaaggttgtgaacgacatacacaaacgtggtggaagcatccttggtacatcatatggaggacatgacacctcaaagattgttgatagcattcaggaccggggcattaatcaggtttatatacttggaggatatggaactcagtatgaagcagctatgatttttgaggaagttagaaggcgtggcttgaaagttgcagtggtcggaattccaaaaactattgacaatgatatcccagttattgacaagtcaattggtttcgacactgctgttgaagaggcacaacgagcaatcaattctgctcatgtggaagcagaaagcgctgagaatggaattggtgttgtaaaattaatggggcgttacagtgtttctgctgagcaaaacaagaagaaatctagctatcttgaattagttgtttacagtcaccaaatattgacatttcatgcaggatttatcgccatgtatgcaactcttgccagccgtgatgtggattgttgcctgattcccgaatcacccttttacctggagggtccaggaggcctgttggagttcgttgagaaaagactcaaagaacaagggcacatggttatagtgatagctgaaggtgcaggtcaggagcttctttctggcaacccatctattgttaataagcaggatgcttccgccgacaagttatttccagatgttggcctgtggttgtcccagaaaattaaggatcactttgaaaaacgtcaaaaaatggctataaatctgaagtacatagatcctacatacatgatccgtgctatcccaagtaatgcatctgataatgtatactgcaccctccttgcccaaagtgctgtccatggtgcaatggcaggatacacaggcttcaccgtaggcccagttaatggcagaaactgttacattccatttcatcttataaacgagggagagaagagggttgtgataactgatcggatgtgggcaaggttattatcttcaacccatcagcctagcttcttgaatccaaaagatatcacaggtgaaagagaggaaagaacggtaaaccaaaccacagatgggcagaaccattcagaaacagcagactaa

SEQ ID NO: 66789 - DNA, 1590 bp, Glycine max
  Peptide Sequence Number=SeqID_183567
atggcttatgggaacttggaagagtatctttcagtagatgcaaggagagaaccgttgagttggagacagaggattcagatagcagttgatgctgctcaaggtatcgagtacttgcatcacggctgcaagccgccaataatccatagagacattaagactgcaaacattttgctgaatgagaaaatgcaagcaaaagtagctgattttggtttctcaaaacttttctcagctgaaaatgaaagtcatgtatcaactgtagttattggcacatttggatatgttgatccagaaggagatatacaacaaattgttgatccaaggctgcggggagattttgactttggttctatgtggaaggccttggaggcagcaatagcttgtgtgccttcaatatctatccaaaggccatcaatgagttacattgtctctgaactgaaagagtccttagaaatggaagcagctcgtgaaaaagaaggcatcaactcgattgaaatgaatgttgttgatcttgaagctttccatacaaagatgaatctcaatagcacagaagcacttcttgtgctttttgcatttgtcttcttggcatggggcaatgcacaaaatacccttgtgccagcaatcataacatttggtgactcggctgtggatgttgggaacaatgattatctgcctacccttttcaaggctaactaccctccttatggaagggactttatcaaccatcaacccactgggaggttctgcaatgggaaactagctactgatattactgctgaaacactgggttttaagagttatgcacctgcgtaccttagccctcaggcatcagggaagaatcttcttattggagcaaactttgcttcagctgcctctggttatgatgaaaaggctgctattctgaatcatgcgattccattgtcccaacagttaaaatattacaaggaataccgaggcaagctggccaaggtagttggcagtaaaaaagcagcattgattattaagaatgcactctacatattgagtgctggcagcagtgactttgtgcaaaactattacgtcaatcctttgatcaacaaagccttcactcctgatcagtactctgcataccttgttggttcattttcaagctttgttaaggacttgtataaattgggagccaggaaagttggagtgacttcactcccacctctgggttgcctacctgctgcaagaactttatttagtttccatgagaaaggttgtgtctcgaggatcaacaatgacacccaaggatttaacaagaaaatcaagtcagctgcagcaaatctccaaaagcaacttcctggtcttaagattgtagtctttgatattttcaaacctctctatgaccttgttcagtccccttcaaaatttggttttgcggaggcaaggaaaggttgctgtggtactgggatagtggagacaacatctttattgtgcaatccaaaatcactaggaacttgctctaatgcaacccaatatgtgttttgggacagtgtccatccttcacaagctgctaaccaagttttagccgatgctttgattgtacaaggcatagcccttatcacttaa

SEQ ID NO: 66790 - DNA, 885 bp, Glycine max
  Peptide Sequence Number=SeqID_183568
atgagaagtcaacaactcaggtgtggagtacagaaaaatctgaatttggagctttacttaaataggattgacgttgtcttttggcaaatagcttgggttgcgttcgataacaacaaacgttggccactgattcttgtcgtgtgtagtaatggtgatggcaacgtggaaggctccttagaacgatcttcatcgcccagaagctccacctccgcaaccccaaatgcattttcccactactcctccgaagccaacaaaggaaaccagcagcagttggagcatgtacggaaacgtctacgaccgcccagttgcgcagcagtgacgaagataaagggaaaggggaaggtgaaaactcagtgggtgtgctgcaattgcgggcactcgacagggaaatggtgggggcagtgccccgagtgccaaatcgttggcacaatgaacgagtttcgtgagagcaaactcactggcaccaagtccagtggtgggttagcagtttccgaggatccagtgggctcatggctcccacaacgaccccaagagttgcgccccctcaaattggaagagatcaaccgtcgattcaattaccagcaatggagaatacctttgtcgggttcttttggaaatgaagtttctactgtgcttggtggaggtctcgtaccaggttctttaactttagttggtggtgatcctggtattgggaaaagtacactgctgttgcaggtacagattgcagcaatgatagcaaaagaatgcagtgatgatgaagaacctccagttgtatatgtctctggtgaagaggtggatactgtagttcagctttactacaagtctactctctggcagaaacctaaattaggaggaaataacttgtatgaagcatctaaggaatga

SEQ ID NO: 66791 - DNA, 444 bp, Glycine max
  Peptide Sequence Number=SeqID_183569
atgtcttcgctctctgatgaagaaattgatgatagatggatgcagttcagtgagtacattgcacatgtagggaaattatgtgcagcgcctgaccactgttcgtcatattacatggattggttttacatgatctcgcacccattcatgagtccggcacagccacgggatcctcctagagttctgctggttcagcaatatgacacatttgttgaaccagatgtgtatcagcaaccgatggtggcagtggcacctaatgaggcagacgttgatgtgcatcatgttcgacatgcaatattggaaagactactgaacttgaggatcctgactgtagtaacagaagcttacactgttgctgaagaatgtttgggcatcgcaagaagctacattggccaaccaactgtaggtcacagatcgaggcgtaggtggcgtatggacggtcattga

SEQ ID NO: 66792 - DNA, 444 bp, Glycine max
  Peptide Sequence Number=SeqID_183570
atgactgagataattggaagccttaaggaagggtggaggaatgagttggaagaagaaaataaatggagtctagagaaaatgaaacaagagttgaaggaggccatcaaaattgagttatgtcaaaggggatcacaatactcacccccgattgaggcggatatacaactattagatgcacgtgtgagcacaaaggggagcaatgctaaaattactgtcaaaccatcagggaaagaacatgttgttcatgtgatgccgactatggggttgtatatgcaagatgatgtgctaaaggtgagtgttgaaaaagtttatgacggtgatgctcaagtccatttgccaacgtcaaaaattcaatatgtcaggcatgcctttgacacattcgttgcatggccgacacatcttgtgaaacttgtatcgcatgagatgatcccttgggtgacttga

SEQ ID NO: 66793 - DNA, 457 bp, Glycine max
  Peptide Sequence Number=SeqID_183571
atggcggctgtgctatcagacaaaaatatcagcgaaggagaaacactcagcaatcgtctttttggtggactgggacttatcggtggtgtggcagaaatgttcggtgctggtgctatgtgcgtggttccagaacccacgatgttgaccaaagctggttgtattgttgtcggtacacatggacttgataccatacaggcctcattacgacaggtctggacaggtcgcaatgtcagcactgatacgtatcattcagccgtgaagctcgcagaaaccttaggggcggatagccaaaccgccctacatgtaggcatgacggtggatgttgcgattcccatgagtttcgcgtttgcggcaggagccgtgcgcgttgctgctgttcgctctggtcgcatcaacctggcggttcatgaagcgctagcgggcagcactggcggacacacgcttgaacgccatattg

SEQ ID NO: 66794 - DNA, 1317 bp, Glycine max
  Peptide Sequence Number=SeqID_183572
atgctgttgagttcattttgtgtcacatggccatatttgtggtgttgggattccaccaacttgcatccaattctaaccattctagtcacactgatcagtgtgctatgcttgctaagatggttcaagaattcaagcaatgaagccaccttttcatctcctttgcctccagttccactaggcttgccacttcttgggtaccttcccttcctaggaaccaatccccacctcaaatttcacaagcttgcacaaacaccgtgttcaccaaccgtgaccctcccatctctgttgatagcgtctttgcctcatggtctgcggtggaagaaggcttgcaagatattggtgcgtgagatgctcagcaacaccaacatcagtaactctttctcccatagaaaggtggaggttatgaaatcaattaaagatgtttatgagaagaaaatagggtgtaaaataagtgttggtgaattggcctttctaacagctacaaatgcaataaggagtatgatttggggtgagactttgcaaggagaaggggatgctattggggctaagtttagagaatttgtgtcagaacttatggtgttactagggaagccgaatatttcggatctttaccccgtgctagcctgcttagatttgcaaggaattgagagaagaacaagaaatgtctcccacgggattgataggctctttgattctgccatcgaaaagcgaatgaatgtgacagggaagggagaaagtaagtcaaagaagaaagatgtcctgcaatatctgttggagcttaccaagagtgatagtgattcagcatcaatgaccatgagcgagatcaaggatatagtgctgagtggaaccgagaccacatcaacaacattagaatgggtggtagcaaggttgctgcagcatcctgaggcaatgaagagagttcaagaggagttggatgaggaaacactttgtttgcatcctcctctcccctttctgataccccgtggcccgagtcaaactagcactgttggtggatacaccattccaaagggtgcacaagtaatattaaatgtgtggactatacacagggaccctgacatttggaaagatgcattggaatttcgaccggagaggtttctgagtgatgctggcaagttggactactcgggggtcaacaaatttgagtatattccttttggttccggaagaagaatctgtgcagggctacctcttgctgagaagatgatgatgtttatgctagcttccttcttgcattcttttgagtggagattacctagtggtgaaattcttgaattttcaggcaaatttggtgctgtt

SEQ ID NO: 66795 - DNA, 207 bp, Glycine max
  Peptide Sequence Number=SeqID_183573
atggcgatggtggtggtggtgccaatggcggcagcaatagtagagatggcagcaacaattttgatggttgtggaggtggcaatttcggtggttgtggtgtcgatgatggtgatgacaacaatgacattaggaaaggcacaagatggcatgcttatgtgtgttgaaaacatgctaactattgagttttgcacttctttatatatataa

SEQ ID NO: 66796 - DNA, 282 bp, Glycine max
  Peptide Sequence Number=SeqID_183574
atggcagaagatgcatcagagtttattcatatttctccccaaaatagtgaatacgaatggaatcaattggactatctttttggtgaactccccaaatgtccagttttggatagatggacaaaaaaagctaaggaagaaatcaaagatgactataatgtagttgtgaatgtgctaagtggagaattgttcagactaaaggccaagcatggtaatagtgagccccaagatattccagcttcagaactagcaaataaaagaattcttgatcctcctatcatttga

SEQ ID NO: 66797 - DNA, 348 bp, Glycine max
  Peptide Sequence Number=SeqID_183575
atggagtggagaattggtgagaatctagaattgttggatgaagccacccatttatctatgagttgggagagtgaaaaccttatgcaacagatggagctagagttcttgttagacgaaatcaaaaagtttaaagtggggattcatcaagttcttgcaactcttcaaattgattcaggtggggggcatggcaaagggatcaagcaagaggaaatgtctatattgcatattttgaataatattgaaggcttcaaaggctctcttgtgaaaacccaggagaagctgcaactacttgtagagaattctatcctcctaattgtacttttgacacatcactgcagtattttttaa

SEQ ID NO: 66798 - DNA, 177 bp, Glycine max
  Peptide Sequence Number=SeqID_183576
atggagaagaaagaaagcacggaggaaacctcgtgtagcaaacagaaaatggaaaacctcagcagggggaaaactcaatggcaagtgaagctggaagaaacggaccacaaaaatgaagaaaaaaagcaaacaggagaagggggacacatgtcaccacctagagcatggaaacaatag

SEQ ID NO: 66799 - DNA, 345 bp, Glycine max
  Peptide Sequence Number=SeqID_183577
atggcaaatatatatcaggttgctgttatgacttatactacacatttgtgttttggcgacgtggtcaatgtggaatatgttgtgtcagtagattccatacaagaaacggacgacgactatagacttcctcagattgtgattgcggcgaccggagggacaaaacaaaacaaaagcaataccttggattctttgtttccagcgtcatacaaattgatgcaagctccattggagcttgtaggcctaggatcttcttcatcaatggattcctttgcttcttggaagattaatggcagcggaatggaaaaaggaagagcgagaggagacgccacttcaagaagaagatga

SEQ ID NO: 66800 - DNA, 1353 bp, Glycine max
  Peptide Sequence Number=SeqID_183578
atgtgttcccattttagagatttgtcaaacaacaatttgactggggccgtgcctgaattcctatcccaactgcgcttcttaagagttctgaacctagaaggaaatcagctatcaggaacaattccaatgcaactcattgtaaattccgagaatggtttgcttgaattcatttttggtggaaatccaagtctttgctcaccaggttcatcatgcaacaacaagaatgggaataaggttgtagttccactggtggcatcacttggtggagctttcatgatactagtaataacagtgatttctttctgcatatacaaaaggagacaaccagtttcccatcatctcagcaagcagaatgcttattacaaaataagggaggaactagagtcaaataaacaagaattcacctatgccgaagtcttgagcatgaccagaaattttgaaagggttgttgggaaaggaggatttgctacagtgtaccatggctggatagatgatactgaggtagctgtcaaaatgctctctccctcagctcaaggatatctgcaatttcaggcagaggccaaacttcttgctgtagttcatcataaattcttgactgctctgataggatattgtgatgatggcgaaaatatggctctcatctatgagtatatggctaatggagacttagcaaagcatttatcaggcaaaagcaaaaatatattgagttggaaccaacgaattcaaattgcagtggatgctgcagaaggattggagtacctgcatcatggctgcaatatgccgattgttcacagagatgttaagtctaaaaacatcttactgaatgaaaaattccggggtaaactagctgattttgggttgtcaaagatctactcagatgaagatgacacccatatgaccacagtggtagctggcacccttggatatcttgacccagagtacaatagatcacacaaattgagggaaaaaagtgatgttttcagttttgggatagttttgtttgagataattacaggtcaacctgctataaccaaaaccgaagagagaactcacataattcaatgggttgattctatactgcttgaaagggggatcaatgatattgtggattcaagattgcagggagaatttgatattcatcatgtgaagaaggccttagacactgcaaaggcttgtgtagcaaccacttccattaataggccaaccatgacccatgtagttaatgaattgaaacaatgtttctcaaaaatgatgacaactccgtctaattctgacgatcatgagagttcacccaacagctttatcactgtctcctttgatggaattagtggacagagctctctacaaagatag

SEQ ID NO: 66801 - DNA, 1137 bp, Glycine max
  Peptide Sequence Number=SeqID_183579
atgggcaaagctacaaggtggttgaaggggttgttgggaaagaagaaagagaaggactaccgtggctattcgggctcattggatcttgacaagagggaaaaaaaacaatcggagaaggatgaagtgagtcacattactccaaccaatgttaccacctttgatcgaactaggttcagatcctatgctgccccaaaagagaagaacaagcactccattgatgtggctgttgtgagatcaaaaagctgtgacagaggcaacttacttattggaagcagggagggctgggctgctgtgttgattcaatcctttttcagaggttatttggcgcgaaaggctcttagagcactcaaaggattggttaagatacaagctcttgttagagggtatctggttcgaaaaagggttgctgcaactcttcacagtgttcaagctatgttaagagctcaagctgttgctcgatctgtgcgagctcgtcgttccatggacaaggagaatagatttcatccacaaactccttccagaaaatatatgcaacggtttgatgaagcaagaaattatcaattacacaatagaagagtacctatatactgtaaggcaccctttaatggatttgatgagagtcaaaaagttgttgaggttgacactcacatgccacattcaagtagtaggagcattaacactgcaatgtcagaatgtggagaagacttgcactatcaagcaatgtcatcctctcttggttgtccaattcaaggtcgaatctcacttcatgagaggcaacaccctcaagagtttgaatggcttttcaatgttgatgaaggtaataacaagttctccacagcacacaacacgcctcgtttaccaaaatgcatgccaccaggtactccagtgaagagtatttgtggaaaaaccttctttaggccttgctccaatttccctaactacatggccaacactcactcttctaaggccaaactaaggtctcacagtgctccaaagcaaaggcctgaactcaagaaaaggctttcaatcaatgaaatgatagcagcaagaaatagttttagtggtgttagaatgcagtggtcgtcatccaacccgaaaactcaagaagattgctgcttttttgaaagggttatttag

SEQ ID NO: 66802 - DNA, 2016 bp, Glycine max
  Peptide Sequence Number=SeqID_183580
atgacgacgaggctccttagaacgatcttcatcgcccacaagctccacctccgcaaccccaaatgtattttcccacctctcctttcccgccactcctccacggccacaaattcctccgaggcccgcgaaccagcaaaggaaaccaccaccaccaccaccaccaccagttggagcatgtacggaaacgtctacgaccgcccaattgcgcagcgcgagctaaacgaccacagcgacggagacgaaaaccctagcagcgggagagcagcaaagagtgtagcagtagtgacgaagataaagggaaaggggaaggtgaaaactcagtgggtgtgctgcagttgcggccactcaacaggaaaatggtgggggcaatgccccgaatgcgaaatggttggcacaatgaacgagtttcatgagagcaaattgactgacagcaagtccagaggtgggttagaagtttccgaggatgcagtgggcttgtggctcccgcaacgacccgaagacttgcgccccgtcaaattggaagaggtgaaccgtggattcaattaccagcaatggagaatacctttgtctggttcttttggaaatgaagtttctacagtgcttggtggaggtcttgtaccaggttctttaactttagttggtggtgatcctggtattgggaaaagtacactgctgttgcagattgcagcaatgatagcaaatgaatgcagtgactatgaaggacctccagttgtatatgtctctggtgaagagagccttcagcaaattggtattagagcagatcgccttgggattaagtccaatatttatttatattcaagtactgatatagaggacatattgacgaagactcatggtctatcccctcgtgctctggtggttgattcaatacaaactgtttacctgaaaactataataggaagtgctggagggattatgcaggtgaaggaatgtactgcagctttgatgcgatttgcaaaaacaactaacatctcagtttttttgattggacatgtgactaagtctggagacatagcaggacctcgtgtcttggagcatattgttgatgttgttttatatatggaagttgggagcaatgttaatgtatttggatttgactcatctaatgcgaagggacacactttagaagatgaagtgctgtcacaaccatggattagaaaatcaatgattgaaattttaacaacttcagagttttttatgcatggcgagaagtactctccatatcgaatgcttcgagctgtgaaaaatcggtttggatccactgatgagcttgcagttcttgagatgtcgcagtcaggactccaggttgtttcaaatgccagtgaaatgtttctcactcaacaacactccgattcaaatgttttagctgggcttgctattgctgtaataatggatggttcaagaacttttttaattgaaattcaggcactttgccttacacattgcccagtttcgagttcactatctaatgggatcaatgccaacaaagctaatattattaaatgtgtacttataaagcaaacaggcctccatcttcaagataataacagtgctgttaacttgttggcaagtgtaccaaatttgtcacaagtagtaaaaacttgccaacaagtagtaaagtactcagaagtccgagtgtcgaatccagagactttgtttgcacaggccgtgtttttgaatgttgttagtggaatgacagtgacagagactgctggagatcttgcaatagcagctgcaatttgcagcagtttcttggagttcccaattccagaggggactgcattcattggtgaaattggccttggtggagagcttcgcatggttcctagaattgaaaaaagggttaacacattggtgaagttgggttacagaatgtgtgtagtaccaaagcaggctgaaaaacttttagaaaccgaaggtctaggaaagatgaaagttgtaggttgcaaggatctgaaagaggttattaacgctgtattcagtagaaataattaa

SEQ ID NO: 66803 - DNA, 2631 bp, Glycine max
  Peptide Sequence Number=SeqID_183581
atgacaggtattaatcatagggtgtctatagtcaccaatgcacaagaatttactggaaagtccatagttatggccacagggaagaactctatgcatcacaaacaaggaagaaggaaactagatgatgtaactggttctatttgcattgactgtgggatagcagaaggccttgactatactgatgacaaaactcagattcattacacttcagatgcacagttcattggcactggaacaagcaaaagcatatcccacaagttcatttctgacacaccccaaagaactttcacaaatgtaagaagcttccctgaggggaaaaagaattgctacacgctacgacatccagaaggcagaaatactatttacttgataagagcttcgttcatgtatgggaactatgatgacttgaataagctgccacaatttgatctctatattggggttaatttatgggacactgtgatgtttgaaaatgccactcatgtggtaatcaaggagattctacatgtgccatccttggatgaattatatgtttgtttattgaacactgataaaggaactccttttatatcagcactggaggtgaggcactttgatcattccagttacagaacaaaatctgaactcttatccctctatagacgttttgacattggatcaacaaccaatgaaatagtgaggtatgacaaagatgtttacgatcgaatgtggtatccgtacaacttacctgattctacaccactcaatacttccttcaccgtcgactccttgaaccatactgcatatcacttgccatcagcagtaatgaaaactgctgtgaggccgacaaatgaaaatgattccctggaatttgaatttgacactgggcaacctacttcagagtcttatgtttacatgcactttgctgaaatcgaagtgcttaatgaaaatgaatgcagggcatttgacattacattgaatggaaaattatgggctgaatatgtaactcccacgtatttgcagtcaaatacaatagatggtaatcagtccattaggggaagtaagctcaagttctctatgcacaagaaaccaaattccacccatccacccattctaaatgcaatggagatttacattgttaaagaattcttgcattctcctacaaaccaagatgatgttaaggctatcatcgacatcaaatcgcattacaagttgacatcatcggtgggtaaatcctggcaaggagatccttgcgcaccatcgaaatactcttggaatggactcaactgcagcaataatggatataatccacccacaataactgcattatatctggcctccagtggattaggtggcacaataattgcatcatttttggagctcaaattcttagaatccttggatttatcaaacaatagcttaacaggacctctacctgatttttcacaactgcaacacttaaaggctctcaatttatcagggaatagactctcaggtgaaattccttcacttctcaaggaaagatcaaataatggttcacttttgctgagtgtggatggaaatctggatctctgccgggagggcccatgtgaagaggataaaatgaatattgccccacttgttgcaggcattctttcagttgtagtctttttcattgtattgggtattgtactgaatatcatttggagaaggagatgcaacagaaaaccagcatcaaagcaagctgtgagattaaatgaagaggttgtgctgaagacaaacaatacacagttcacatactctcagatatcgactattaccaataacttcgacaaaatgattgggaagggaggatgtggaattgtttatcttggttccttacaggatggcacacaggctcaactcttaatgcgtgtgcatcacaagaacttagcttcctttgtcggatactgtaatgaagttggacacacaggcatcatctacgaatatatggcttatgggaacttggaagagtatctatcagatgcaaggagagaaccattaagttggagacagaggattcagatagcagttgatgctgctcaaggtatcgagtacttgcatcatggctgcaagccgccaataattcatagagacattaagactgcaaacattttgctgaatgagaaaatgcaagcaaaagtagctgattttggtttctcaaaacttttctcagctgaaaatgaaagtcatgtatcgactgtagttattggcacattaggatatcttgatccagaatactacacatccagcaggctaaccgagaaaagcgacgtttatagttttggcattgtgcttttggagctaattactgggcagccagcaataataaaaggtcatcagaacactcacattgcgcaatgggttaacaactttcttgcaaaaggagatatacaacaaattgttgatccaaggttgcggggagattttgactttggctctgtgtggaaggccttggaggcagcaatagcttgtgtgccttcaatttctatccaaaggccatcaatgagttacattgtcggcgaactcaaagagtccttagaaatggaagcagctcgtgaaaaagaaggcatcaactcgattgaaatcaatgttgttgatcttgaagctttgtgtggcccagatgcaagatag

SEQ ID NO: 66804 - DNA, 1899 bp, Glycine max
  Peptide Sequence Number=SeqID_183582
atgatgatcagagaggaaaagggtgtgaagcctgttctactaaaatttggtttggctttggctctttcatttgctggatttatctactcacgcctcagaaccagaagaatcaagccctccaagtcacgcaaggggtgttctttcggtataggggcagcattaagtacttgcaacgccatttccgagggaaattttctatgttctgaagaaacatgcatcaacaaggtgataagtgataaatctcccatttctctctctcctgacagtacacaaaatggagatgaagatgagttcctcctacctgaatttaatgatcttgttaaggacgtagactttgaagccactgttgtcagaaattcttttaaagaagatatgggagcaccatggttaaaagtaggatcttctatagcatattctggtcccgagaaggatgactatgagcaagaggtacgtcaactcaggaacatgattagaatgcttcaagacagggaacaaagtcttgaggttcaactgcttgagttctgtggtcttagagagcaagaaacagcagtgatggagctccaaaatagattgaaagcaagtaccatggaggtaaagatcttcaatctaaaggttaagaccttacagtctgagaattggagattaaaggaacaggttgctgatcatgaaaaagtgctgactgagcttgagaatgcaaaagcgcaagtcgaattgctcaataagaaaattaggcatgaaactgaacagaatagggagaaaatcataactcttaaacagaaagtttcaaggttgcaagaccaagaatgcaaagatgctgcttatgatcaagatattcaaataaagatgcaaaagctaaagtatcttgagtctgaagcagaagagttgaggaaatctaatttaagattgcagatagaaaattctgacttagctcgaagattggattctacccagatccttgcaaatgcatttctggaagacccagaggcaggtgctgtgaagcaagaaagtgagtgtcttaaacaagaaaatgtgcgcttgatgaaggaaattgagcaatttcagtctgatcgatgttcagatcttgaagaattggtatatctgcggtggataaatgcttgcttgcgatatgaactaagaaattatcaagccccacctggtaaaacagttgcaaaggacttaagcagaagcttaagccctatgtctgagaagaaagccaagcagcttatacttgaatatgcaaatgctaatggaccagggaacattgtggactttgatatagaccaatggtcctcctcacaggcttcttctatcactgactttggagagtgtgatgatttttcttctgctgataattcatctgctgccagaactaacacaaacccgaccaaactttttggcaagctcaggcaactgatacaaggtaaaggtagtagtcatcaccatagtcatgcttcatcacaagaaaaatctggatatcaagatagcaatcctctttgtttgagcacatcaaccagaagtgagggtcttaggagtgagtttgcaacccccattgccacctctagaacttcccttgatttctctagtttgacgagtgtgaaggaaggcttggagaaaaataatttggagaaatatgcagaagctttaaaagattctagcgtgagtgctacacatcaaagacgtagaagatcagcatcattgataagggctatgccttgtaaaatcaatgcatcggctaaaacttggttagcagcttgtgaaggatggacactgtcccaaaacacatattgggttgcattagaacaagttcctaatgattttggattgcacaataaagatgttgtctccactatcccagtaccacagcaacctttccttgcctccacaaaacatattgattga

SEQ ID NO: 66805 - DNA, 225 bp, Glycine max
  Peptide Sequence Number=SeqID_183583
atggctatgctgatgtttagtagtacagcagaagaggttaacccagcgttgaagggtttgaaccagaaaaccatcatggttttgtcagttgtaagagagaggaaaaaagctagaaaacttttcagtggtagtaggaaaatacaagcaactgggaacttaattggcagtgtctattgttgtaggttaatagtgaccattattggagtgagtgactggaagagataa

SEQ ID NO: 66806 - DNA, 759 bp, Glycine max
  Peptide Sequence Number=SeqID_183584
atgactatcaatagcacagaagcacttcttgtgctcttagcatttgtcttcttggcatggggcaatgcacaaaatacccttgtgccagcaatcataacatttggtgactcagctgtggatattgggaacaatgattatctgcctacccttttcaaggctaactaccctccttatggaagggactttagcaaccatcaacccactgggaggttctgcaatgggaaactagctaccgatattactgctgaaacactgggttttaagagttttgcacctgcatatcttagccctcaggcatcagggaagaatcttcttattggaggaaactttgcttcagctgcctctggtaatgatgaaaaggctgctattttgaatcatgcgattccattgtcccaacagttaaaatattacaaggaataccaaggcaagctggccaagaatgcactctacatattgagtgctggcagcagtgactttgtgcaaaactattacgtcaatcctttgatcaacaaagtcttcactcctgatcattattctgcataccttgtgggtgcattttcaagctttgttaaggcaaggaaaggttgctgtggtactgggatagtggagacaacatctttattgtgcaatccaaaatcattaggaacttgttctaatgcaacccaatatgtgttttgggacagtgtccatccttcacaagctgctaaccaagttttagccgatgcattgattttacaaggcatagcccttatcacttaa

SEQ ID NO: 66807 - DNA, 141 bp, Glycine max
  Peptide Sequence Number=SeqID_183585
atgtttgagaatttgcttgtggaggaaccagcttggttagagcgtcgtgctaataacgcgaaagttgcaggttcgagacctgcatgggccaaaagagttcttgagcctaacaccgggagccaatatacaccttattattag

SEQ ID NO: 66808 - DNA, 1458 bp, Glycine max
  Peptide Sequence Number=SeqID_183586
atggcatctgaagttactgactcaagcaaggattcttctcatcctgctggctcttgggttagtgttctagttttggaagcacctggatctagcattgtgactgttatggatggtctaagttgggatgcctcatcagtacaacttgttgctaacacaccgatcttgtggagcactcagcctcaagaccttgaaggaggctatcttcattccatgccccacctatgttcaagtgctctcaatcaaacaggctacccatatccatgttctgaaaaagtgaggggcatggttcactcatccactacttgtgagatgatgagtatgatgccaaacacaaatctgccacaaagaattacagcaaccatgcctgtgaaatcagtagtagcagctggagccagttgggaagaaactttaacatcccaatcacgcccgtccctttcagcgaatatgaaccaaactagcaattatgtagcagatttcaacatggcccaccagcaacaacaccaacaccttatcaatggcacacaaaatggcaaggctactacctgctctcttgatcagtcacttgattgcttgctttcagctactaataatagcaacacagacatgtctgtccaagatgatgggatttccatgattttatctgactgcagaaacctatggaataacttcagttatggcagtgtagctaattcctctggtgaatctgagagcaatgcttccattaatgctagaaacagtgacatgaggtatccctcagtcagtgaactggatgaatcagtgtctcaaagtttctctgatcaatatctcagtcaaggaagagtaatagattcatctgaagttatttgcacaaaaaggagcagtagttcgggcttcagcattgctcagaattcttctgccactgaattaggtggtttcacgcttatctcagagacttcaccaaagtccaagagacccagatgggatcataagtatcctggttcatcaaatatcaacttccagcagccaaattcatctgtgacaccttcctttgaagaacctgatccagaagccatagcacaaatgaaggaaatgatatatagggctgcagcttttaggccagtgaacttgggcctggaagcagtggaaaagcctaaaaggaagaatgttaggatatcttctgatccacagactgtggctgccaggcaaagaagggagagaataagtgagaggattagggttttgcagaagattgtgcctggaggaagcaagatggacactgcatcaatgcttgatgaagctgcaaactacctcaagtttctcagatcacaagtcaaagcactagaaaatcttggtaacaagcttgacacaatgaattgtcctcctactaacatagccttctctttcaacccttcttttcccatacaaacacatttccccatccaaaaccctagcagccacatccaatactccaagggttga

SEQ ID NO: 66809 - DNA, 291 bp, Glycine max
  Peptide Sequence Number=SeqID_183587
atgagattcacccacattttagtgatatgtgtggatggggtacgacagcaatgctgcgaattgcttcaccatgggagaataacatatgttcgccgaggcatatctttatgtagatcggataaggtcttgctacttctcaatgattgtaaggatttttctcccaagactctagggttctgggttctgggttctcagtatgtgcgataccttgacgatccagcaattgttgatccgttatgtctttcggtgatggagcgggagaaacgtggagtttacggaagagggagatga

SEQ ID NO: 66810 - DNA, 1305 bp, Glycine max
  Peptide Sequence Number=SeqID_183588
atgcaaatacggaaatcggtgttgcacatgacctcctttgacttattagaagataccccatgtctggaactttggctaactattgctttctacagaaacatcaaagaactagatctccatgttggcatcaagaatggtgagtgctatactttaccacaaactgtcttgtcttccaaaacattgactggcataaggttaagtggttgcaaactgggaacttgcaataatataatgctcccttatcttcagaagctttatctgcgcaaaattcccttggttgagaactttattcaaaatcttatttccagatgtcattcaattgaggatttaagaatcataaagtgctccggtttgaagcatttgcatgtttcaaatctcattcgactcaaaagggcagaaatccactactgctatcaattgaagaaggttgagatcagtgctccaaatcttgacacattttggtattgtggcaagaaaacaagtccctgcaagaatattgttattcatgaagatttgaacaatgtcacattgcctcaagtgcctgacctcggccgtgaaattatcaattcatcagcatgtattgatgatgctctgaatagtttgttatggaaattgcacccactagtgtatgaaatgataaagaacaaaggcgaggacccaatctgttgcatatatagttcttccaaaaataaatgttggcggcactttctgaaggatgtcaagtttgaagacctaaatgatgtgaagtttgaagacattgaagaaggaaaaagtaggaagaagaatgtaatagtgggaccatggggaggcaacggtggaaatagctgggatgatggaatcttcacaggggtgagagaaatcaaacttgtttatggccattgcatagactcaattcaggtggtttatgataggaatggcaagcctttcacagctgaaaaacatggaggagttggaggtaacaaaacagctgagattaagctgcaattcccagatgagttcttggtcagtgtgagcggccactactgtccagttgttcgcggaggcacccccgtgattcggtcattgacattcaagagcaaccacagaacctttggaccatatggagttgaagaagggactctattcactttttcgatagatggaggctgtgttgtgggttttaaggggcgaggtgattggtatttggatgcaattgctttcactttgtgtaatacacgatcaaagtcgctgtttcagaaagtgcagaggagcttgctgtggttaacaaccactgctccaaaatctacatcctccaaggatggctag

SEQ ID NO: 66811 - DNA, 147 bp, Glycine max
  Peptide Sequence Number=SeqID_183589
atgactagagtcacagcagaaccggcaagtggaagcaaacaaacacaaaaatccatgaggaaacttgcggatatagcaagttttggattagattacccagatgagattctaaccaattctccaaatcccaatcaagaaactcactag

SEQ ID NO: 66812 - DNA, 243 bp, Glycine max
  Peptide Sequence Number=SeqID_183590
atgttgttactttttagcagaatttatatgaaaaaggtggatcacgagggcgtaagccccgttctgttagtcaggaaagaccatgtgaatgactgtgacattggccaatgtcttcggcgggactcgcaaaggctccacacgtgtctcagcccctcgcttcaaaggaaacgagacaagtcccagctcgaagttacccgtttccgagtctgcatctctgcagtcgtggcccggggactttcctga

SEQ ID NO: 66813 - DNA, 150 bp, Glycine max
  Peptide Sequence Number=SeqID_183591
atggcagttcctttgggaaagctgattttggaggtatttttcgagatcatatgggcgactgggtattgggtttttcaggatcactttgcaaaacgtcaaaaaatggctataaatctgaagtacatagctgaactctctctctctctctaa

SEQ ID NO: 66814 - DNA, 186 bp, Glycine max
  Peptide Sequence Number=SeqID_183592
atggcatatggatctatactgtgtaagaagtcatacaattgtttaagtaaggactcagtttcaaatagcattaagaatgaatgtggtcatgagcagcatagttattggtgcgcaccttctttagctattcttcaaactggtctccacctgtcaagatgttatctttctgaatgtggatgtagatga

SEQ ID NO: 66815 - DNA, 204 bp, Glycine max
  Peptide Sequence Number=SeqID_183593
atgaccataggaacatatatttccgttggaagttcattggaaagtgagaaatgggaatggaggctcagactcttggtatcagagtcgatggttcgatttggtgatcgtctcaagttagtggtcagaatgactatactcatggatgataaagacttccactcgaggaaaagactcacacttgaggtgaagttccacatcggatag

SEQ ID NO: 66816 - DNA, 369 bp, Glycine max
  Peptide Sequence Number=SeqID_183594
atggctggaattgtggtgattttttacttcgacaagaccattgtcgactgtgacagtgataattgggttgttgacgagttgggtttcaatgaattgttcaatcggctccttcccacgatgccttggaacactctcatggataagatgatgatggagcttcattcccatgaaaaaatcattgagggcattgtccaagttcttcagaggattcctatacaccccagaataaccggtgccattaaagcagcacatgttttagggtgtgatttaaggattgtaagcgatgcaaatatgttcttcatcaagacaattttaaagcacttaaaaataagggaatgcttctcagagatcaacaccaacccagattaa

SEQ ID NO: 66817 - DNA, 1713 bp, Glycine max
  Peptide Sequence Number=SeqID_183595
atgaacggtggcgatgaggtcgtggcagctccggcgggtccgccgcaccctctggagtggaaattttcgcaggtcttcggagaacgcacggcaggggaagaggttcaggaagtggacataatttcagctattgaatttgacaagtccggtgatcatcttgctactggtgatcggggtggtcgagtggttctctttgagagaacagatacaaaagatcatggtggatcaagtagggatttggagagggtggactattctattggtaggcatcctgagttccgttacaaaacagagtttcagagtcacgaaccagagtttgactatcttaagagtttggaaattgaagagaaaatcaacaaaatcagatggtgccaaatagctaatggtgccctcttccttctttctacaaatgataaaacaatcaaattttggaagtctgtcatggtgtcagtctttggccactgtagaaatcttcttgttgagtactatttttacttgcagctctcaccctctactgttagagaaatcatgatgaataatctgatttatccatcatcccctaggtcattcattcgtatttttcctcatctgagaattgcacaggttcaagaaaagaaggtcaagaaaatttctgagatgaatgttgacccttcaaaatcaatggggaatggatctattgctagttcaagcaattcaagtagttctaggccatatcttgcaaatggaggatctccagatagatacaattatataagcaatgacttttcatttccaccaggaggcataccatcactaagattacccatggtaagtagccatgaaaccagcttagttgcccgatgccgtagagtgtatgcgcatgctcatgattatcacatcaattctatttcaaataacagcgatggcgaaactttcatatcagccgatgatctgcgaataaatctttggaacctggaaattagcaatcaaagttttaatattgttgatgtaaagcctgcaaatatggaggatctgacagaggttataacatcagcagaatttcaccctacacattgtaatacattggcatatagcagttcaaagggttcaatccgtcttgttgacttgcggcaatcagcattatgtgattctcatgccaaactatttgaggaacaggaagctccagggtccagatcatttttcacggagattattgcttctatctcggacataaaatttgggaaggatggtagatacatacttagtcgtgattacatgactttaaagttgtgggacattaatatggattcaggccccgttgcaactttccaggttcatgagtatttaagacccaagctttgcgatttatatgaaaatgactcaatctttgataagttcgaatgttgtctaagtggtgatggattgcgcttagcaactggttcttacagcaatctatttcgtgtgtttggttgtgctcctggaagtgctgaggctacaactctagaagccagtaaaaatccaatgagacggctagttccaaccccttcaaggccttcgagatcactgggaaatagtataacacgtgttgtaagacggggagcagaaacccctggagtggatgctaatgggaattcttttgatttcacaacaaagttgctgcacttagcatggcatccaagtgagaattcaattgcttgtgctgctgcaaatagcttgtacatgtactatgcgtaa

SEQ ID NO: 66818 - DNA, 750 bp, Glycine max
  Peptide Sequence Number=SeqID_183596
atggctgggattgtggtgatttttgacttcgactcgacaatcatcgagtgtgatagtgataattgggttcttgacgagtttggtttaacagaaaagttctatcagcttcttcctaacatgctttggaaccctctgatggataagatgatgaatgaacttcattcacaaggaaaaaccattgaagacattgtacaagttctgaacaggactccaatgcatcctcgcattgtcccagccattaaggcagcatattcccttgggtgtgagctgaagattgtgagcgacgcaaatattttcttcattgaaacaattttgaagcatcatggggtgtggaattgtttctcggaggagcctgtcattggaggaattatagctctgggaatgatcacagagagaatccaaaattcggttgatgctgcaggaaagaagttcatctatcttggagatggaagtggagacttttgcccaagtttgaagctcaaagatagggattatttgatgccaagaaagaatttcccattgtgtgatttagtatctgagaactctaagcacataaaggcagaggtgcatgcttggagggatggggaagagctttatgatgttctgctccattttatcgacaaagctattggtgaaggaaacaagaatatcattagttctactccaatagtatcagttgattgcaagttggggtcaatttcaattgaggctcataaacctttacctaaagcaatcccagttcctcaataa

SEQ ID NO: 66819 - DNA, 282 bp, Glycine max
  Peptide Sequence Number=SeqID_183597
atggcggaagaattatcaatagcgattccgcaatcgcaagcaagcaccacgaagaaacgcgcttcaaagaacgaaaagctgtgcctcgaggactaccttcacctcgttcactctcgccaaacgcttcacctcaccataaatcaactcaatcagtgcgcagaaagtgctggtgcaagcggtggagtcgctggaactggtggatctgccgcggtcaacggtgagcgagagcgtatcggcgttcgcggcggtggtgctggaggatgtggttgcggatctcggtga

SEQ ID NO: 66820 - DNA, 462 bp, Glycine max
  Peptide Sequence Number=SeqID_183598
atggatgaaaggtcaagaaacgaggcatctcctcagctgttagatttgatctcaaacgagagagagtggcagatgaacaagagaaacgaaggaaaatcctcagaagaaagaaagcttgaactgaggcttggtccacctggtgaagactggtctctgggcggtaaaatgaagaacacagaaagagaagaatctcttctctctcttggttgcttctctcctaacaatgggttccagagcaaggcttctccatggccaaactaccaccaccaccaccagggtaacaacaacaaagcctcttcttcatcatttcttcagtgccctaaggttgtggtagagttgcagaatggtggtgatggcaaagtattctctccctcttctgcaaatacagctgtgtcccagcccaacacctctcagaaaagagagaaagaaagaaagaaggaagggacaatttttaagctttga

SEQ ID NO: 66821 - DNA, 339 bp, Glycine max
  Peptide Sequence Number=SeqID_183599
atgaattatcctgatcatatgctgagagacactgcaaagtatcgtcctttgatgaaaacaaatttggtcagccattcgctcaattatgatatccaatccggcactcatgacccttatgaagattgtatttctgtcatgagactatacaagagaatacgatctcaacttcatccggaggaagaccatggaacaatgactctgagtaacaacattgttggcatgcctgatagctggatatctagggaacttgacaacctcacaccagatgaactttatgccatgtcaagatcagattataagtgttggtgcttggatttgataccaagattgtcagcctga

SEQ ID NO: 66822 - DNA, 105 bp, Glycine max
  Peptide Sequence Number=SeqID_183600
atggataaatatgatcttcaggcaatcggaattccacaggagcaggcaaaacaacttctgcaaagcataaatgacttgctcttttatagattagaagccttcaag

SEQ ID NO: 66823 - DNA, 966 bp, Glycine max
  Peptide Sequence Number=SeqID_183601
atggttatgtgcttgaagctgaagctcataatgtggaatgtggcactgcttctggctttttctctcattggttctgctaaggcctcagtgtcctatgactctaaggctatcaccattaatggccagagaaggatcctcatttctggatccattcattacccaaggagcacccctgagatgtggccagatcttattcaaaaggccaaggacggaggcttggatgtgattcagacttatgttttctggaatggacacgaaccttcacctggcaagtattattttgaggggaactatgatctggtgaagttcataaagctggtgcagcaagcaggcctttatgttcatctcaggattggtccttatgtctgtgctgagtggaactttggtggtttccctgtttggctaaagtacattccaggaatcagtttcagaacagacaatgaaccatttaaggttcaaatgcaaaaatttaccacgaagattgttgatttgatgaaagcggagaggttatatgaatctcagggaggtccaataattatgtcccagattgaaaatgaatatggacctatggagtatgaaattggtgctgccggtaaagcttacactaagtgggcagcagaaatggctatggaacttggtactggggttccatggatcatgtgcaagcaagatgacactcctgatcctcttattaacacttgcaatggcttctattgtgattatttctctccaaataaggcttacaagccaaagatgtggacagaagcttggactggctggtttaccgagtttggaggtcctgttcctcatcgacctgctgaagacttggcattttcagttgcaagtatcatggaggaacaaatttcggtcgaactgctggtggtccctttattgctacaagctatgattatgatgcaccacttgatgaatatggattgctcaggcaaccaaagtggggtcatctga

SEQ ID NO: 66824 - DNA, 1584 bp, Glycine max
  Peptide Sequence Number=SeqID_183602
atgtctggagcctgtgccgcattcctggcaaactacaaccccaaatcttatgcaacagtggcatttggaaacatgcattacaacttgcctccttggtctataagcattcttcctaattgcaagaacaccgtttataacactgctagggttggttctcagagtgcccagatgaagatgactcgtgttcctattcatggtggtctctcttggctatcattcaacgaagaaacaaccacaactgatgatagttccttcacaatgactggcctgttggagcagttaaatacaacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactaacatttaacgagggagtgaagctcagaaccggtgttaacaagatctctcttctaagtgttgcagttggactcccgaatgttggtcctcattttgaaacatggaatgctggtgttcttggcccgatttcattaagtggtctcaacgaagggagaagggacttgtcttggcagaaatggtcttataaggttggtcttaaaggtgaaaccttgagtcttcactctcttggtggaagttcgtcagtggagtggattcagggatctttagtttctcaaaggcagccattgacttggtacaaatactctttcgttattattattataaatagtattataataatcatagaggaagcagagaatgttccttatggaaaaaggacatgtttcactttctttttattcctcaaccccacactatcctttgtttttagcatgggaactcctaatgtcatgccatgcacttaccagacaacatttgacgcgccagatgggactgcaccattggctttagacatgaacagcatgggcaaaggtcaagtgtggttaaatggacagaatcttggccgctactggcctgcttataaagcatctggtacttgtgattactgtgactatgctggaacttataacgagaataaatgcagaagtaactgtggcgaggcttctcaaagatggtatcacgttcctcaatcatggctaaagccaacaggaaatttattggttgtgtttgaagagctaggtggagacctcaatggaatctctttggttagaagggatatagatagtgtatgtgcagatatttatgagtggcagccaaatcttataagctatcagatgcaaacttctggcaaagcacctgttagaccaaaagttcatttatcttgtagccctggacagaaaatctcatcaatcaaatttgctagctttggtactccagtaggttcttgtggaaacttccatgaaggaagctgccatgctcacatgtcttatgatgcctttgaaaggaattgtgttggacagaacttgtgcacagtagctgtgtcacctgaaaattttggaggagatccatgtccaaatgtcttgaagaaactctcagtggaagctatttgttcctga

SEQ ID NO: 66825 - DNA, 2157 bp, Glycine max
  Peptide Sequence Number=SeqID_183603
atggctagatgtgttggcatagagccttgtacacttgtgatggatttggagggtactgatggaagagaacgtggagaggatgatactacatttgaaaagcaaagtgctttatttgctttggctatctctgatatagtgctaataaacatgtggtgccatgacattggtcgcgaacaagctgcaaataagccgctgttaaaaactgtgtttcaggtcatgatgagattgtttagtccacgcaaaacaacaatgttgtttgtcatacgtgataagacaaagacaccgcttgaaaatttagagcctgttttgcgcgaagatattcagaagatatgggactctgttcctaaaccagatgctcataaagaaaccccattaagtgaatttttcattgttgaagttgttgctctttctagtttcgaagaaaaggaagaacaatttaaggagcaggttgccaacttgaggcaacgattctatcattctatcgctccaggtgggcttgcaggggatcggcgtggagtagttcctgcttcaggcttttcttttagtgctcaagaaatctggaaaatcataaaggagaacaaggatctcgaccttcctgcccacaaggtaatggttgctactgtacgatgtgaagaaattgctaacgagaaatatgacctttttgctacaaataaggattggtgtgagttggaagaggctgtgcaatctggccctatttctggatttggcaaaaagctcaattcactcattaccacttgtctttcagagtatgatgctgaagccaactattttgacgaaggtgtgagatctgcaaaacaaaagcaacttcaagaaaaattgtttcaacttgtccaaccaacattccaaattgcgctgggacatataaggtccggaattttggataagttcaaggaagcatttgacaaggcattgaatggaggggaagggttttcatctgctgccaataagtgcatagagttttatatggctcagtttgatgaaggatgtgcagatgttgttattgaaatagcaaactgggatacatctaaagggagggagaagctacaacgtgaaattgatgcacatgttgcatccgtgcgagcatctaagatgtcagaacttgtttcatcatatgaggaaaaactaaaggaggccttgtctgcacctgttgaaactctattggatggagctaatagtgatacttggccatcaataaggaaacttcttaatcgtgagactcaatcagctgtttctgggttctctgttgaacttatcagatttgatgtggatgaacaacaaaaaaagagcatgattgtgagtttagaggattatgctaagggtgtgatagaagccaaggctagggaagaagctggcagagttctaataagtatgaaggacaggtttatgacattgtttagtcatgattctgattcaatgcctcgtatttggacgggaaaagaagatgttcgagccatcaccaagtctgcccgctcttcctgcttgaagttgttgtctgtaatggctgtaattcgcttggatgatggtgatgacatttatgacatcgagaaaacattaatagttgcattggcagattcatcaagcagttatgctaaagataagagcaccatggcagttgaaccactagcttcaagcacttgggatcaggtaccaccctctaaaacattgatcacacctgtccaatgcaaatccttgtggaggcaattcaagatggagacagaatatagtgtctctcaggccatttctgcacaggaagccaacaatcgtagcaggcactggttacctccaccatgggcgattgtggctttgcttattcttggatttaatgaatttatgacacttttaagaaatcccttgtatttaggtgtcatcttcgttggctatcttctcattaaagccctatgggcgcagcttgacattacgggtgaatttcgccatggagctcttcccggaatcatctccttgtctagcaagtttgttccaactatcatgaaccttatcagaaaactagcagaggagggacatgggcgccatgcagctaaggttcccgctggtagagttacgtcatctagtgcttcatctagtgtaacttcatcgggcaatggagccgagtatacgagttcatcaaaatatgagtag

SEQ ID NO: 66826 - DNA, 897 bp, Glycine max
  Peptide Sequence Number=SeqID_183604
atggcaattccattcaagacaaaagatgtcaacgaggaagtaacctctaaagacatcaagagcctaatggaacaggcgaattataccaataaatatttacaagctttaggagaaaccataaaaactaaggtagttcctaaacaaaaatcaattgaggaagcttcgccaagtatccctattgaaaaacctttattcaaacctttcaaagttagtgagaaggctaaacgaaaatttagggaacttagaaaaactagatccttaattgaaggcgtaggtgataaccatagtgaattacttaacaagattggtagtttacttaaggtcattccagatactcctcaagcctcggaaaatacttccaaaatggtaacaagaagtacctccaaattaattaatgttattaatgaagatagtgaccaaaactcagataacacaactgagataggatcagtgtcagaaaagaatataaatccaattaattccaaacactggaaaacaccctccaagttatattatcaacgtccaactgcccttgacctactattagaggaaagaggtgaaaacaattttcagagttttagtgcaaacaacatctatgaatgcaacatagatgcacaaatggagtataacatcatgaatatactccaacatatgaccatggtagccacggcataccaaacctcctatgaatgttcagaagaaaccattatagatatcttagtggtaggattttctggacaactgaaaggatgtgcagttaagacggatatcaatggaaaagtcattactaatgacgatgataaagagattcctgacgctgttaacacattaatttttataatagcccaacatttcattggagacccatccttgtggaaagataggtctgcagaatag

SEQ ID NO: 66827 - DNA, 1158 bp, Glycine max
  Peptide Sequence Number=SeqID_183605
agaagctggccggcgagagtgcccgcctgcatcactatcagaatgcggtgtggtgctggacccgcgcggtgctcaacgagcgctatcaggatttcgacgccaccgccgccgccatgaagcgcgccgcgtgcagaacctgccgcactgcaccgtcgagcttatctgatgaaagtgcgtgcgcagcagtacgacacggtggacgcgctctgctggcgccactacgggcgcacgcagggcataaccgagcaggttttacaggcgaatccggggctggcggagcacggcccaatcctgccgcacgggctggaggtggagttgccggacgtgacaacggcggcaaccgtgcaggccgtccagctttgggactgaactatgtgggagagaatctgcacttttatcacctggtgcatcgcggtggtaatggcgtggctgggtggcatgaacctgaaagacgcgtcaacggtggccggcgttctgatcggcctgctgatggcgctgatcagctggcgctgcacacctcgccggagggactgaagcttatcgcggattacgaggggtgccggctcaagccgtacctgtgcgatgcgggcaggtggacagacggcatcggcaacacagtgggcgtcattcccggcaagacgatcaccgagcggcaggcggcgggcaacttcatcaccaacgtgttacgcgtcgaggcggcactggcgcgctgcgtggcggtttccatgccgcagcaggtttacgacgcgctggtgtcgctggcgttcaacgtcggcaccggcaacgcctgcggctcaaccatggtgacgttgctgaaaaaagggaaatggcgcgaggcgtgttatcagctgccgcgctgggtgtacgtgaagggcgtttttaatatcggactggataaccggcgccagcggtctggtggtgtggggcgtgctgctgacgcttgtgatgatgtcgctgatgagccacaacggcgcagcaatgcatatcgtggtcgcccttgtctggctgcgcctgaaggcggcgctgaagaagtttctggctggcagcgacaagcaggccgtgccgaaatatgcgggctggctgctgaagctgctgatcgttatgtcgctggccttttcgggctgggtgatcacgctggtctgctacctgctggccgtg

SEQ ID NO: 66828 - DNA, 306 bp, Glycine max
  Peptide Sequence Number=SeqID_183606
atggaggctaaacagaattttgcacaagtgcagaaaaatgcttgtgtgtggttggctgtggaaagtctagtgcagaatgagttctggatgtttgctagtatatcccaacggtcaaaatgcaggcttatacactatagacttccacttgagaggattgatggggacccggtgttgagagaaacgaggagatgggctacgtgggagtacgtgagctcagttggaggtgggcaacaggggatggtgggtttatgcgcgcattgtggatgtggaaagcttgttgtgcaccatcgcccgaccgccacctag

SEQ ID NO: 66829 - DNA, 435 bp, Glycine max
  Peptide Sequence Number=SeqID_183607
atggaagaaaagggaaaattagatcatatagaggaaaggttcagggacattgaaggaggcggagatcatgcttttgctaacatgacagagttgtgcctagtgcttgatgtcattatccctctgaaattcaaggtgcccgatttaaataagtacaaggggattgcttgccctaagaaccacctgaagatgtactgtcagaagatgggggcatactcggaagatgaaaaattgttgatgcacttcttccaagaaagtcttactggggcagccgtcacttggtatactaacttggaaccttcccgagtccattcttggaaggacctaatggttgtctttgttaggcagtatcagtacaattctaatatggctccggatagaacacaactacagaaaatgtgtaaaaaagagcatgaatctttcaaagaatacgcctaa

SEQ ID NO: 66830 - DNA, 201 bp, Glycine max
  Peptide Sequence Number=SeqID_183608
atgagattagctaacggcgtgagaaatggcatgccccaacccctggatatcttcgccaaaaccgcgagcggtattgcatccagtaagcaacgcgccgctgagcagcagcaaggcaagaagtttgagcgtctggttcatgttagtcccggcgtgaaactgaaggcgcagcaaccaggctgcgcccaccgtctcaaagcatga

SEQ ID NO: 66831 - DNA, 177 bp, Glycine max
  Peptide Sequence Number=SeqID_183609
atgctgataaaaattaaggaagcagaggagaaaactgagggtgggattttgcttccatcaactgctcaaacgaagcctcaagggggtgaggtggttgctgttgggaagaacaatgtagagattagtactgaggtgtacttcaatggtacaaagcatcttattgtgaagaatccttga

SEQ ID NO: 66832 - DNA, 459 bp, Glycine max
  Peptide Sequence Number=SeqID_183610
atgagtcttcattcttcatctagtgttaatggtgagggttctactcctaaggaccccttagggggtcatagttcacatattaaacaccattcccaaagaagagaaaaggatagaaggcctcaagaggttaacattaccctcccatatttccatggaaaagataatgttgaggcctacttagattgggaaatgaaggttgaacaactctttgcttgccatcatattagcaaagagagaaaagttccattggctacccttttctttcaagggtatgccctctattggtggacttcccttgttagggaacgaaggattcagggggatcctcccgtagagtattggaatgttcttaagagtgcccttaggaagaggcacatttcctcttactatgaaagggagcttatggccaagctccaaagacttagccaagggagtataggtgttgaagaatatagataa

SEQ ID NO: 66833 - DNA, 284 bp, Glycine max
  misc_feature (45)..(45): n is a, c, g, or t
  Peptide Sequence Number=SeqID_183611
ggatcgcgccactagacacccagtggaccggaggagccaacaggncctggggttccagctctggttacgggcctctgttagtcctacagggtgctcgttccccccagcaagggatcgcacccgcaagacacctagtggacccggagaagtccaacagggtcctggtgtttccagctttgatgacgggcctctgtcagttctacggagtgcctgtcgcccccaacaaggtcatcaggctccctactaatcgagctttcatcaagaagtactgcgcccctaggtag

SEQ ID NO: 66834 - DNA, 192 bp, Glycine max
  Peptide Sequence Number=SeqID_183612
atggttgaagaaggatatgcaacctctttacgaggcctccgcacctatgttggtgagcgctttgattccttagatggtcgtatcgatgccattgatgctcgctttgcaggcatggatacccacatcactcagcttgaggaggatataagttatgttcgtcagtgcttcgatcttcctccaccatcttcatag

SEQ ID NO: 66835 - DNA, 612 bp, Glycine max
  Peptide Sequence Number=SeqID_183613
atggcatttttaggagaaactagcagtcagacgactgtcaactcaaggttgactttcatttttccaaatggattgattattcacaatgatactggggtttacttccaaacttcaactccggtgcccattcgagtaccaaatagctgtgattttgcaagcctaaaaaccagaatacacaatacccttcagctatccgacaaacaatttttggatgaaattcactaccggaagccattcaccgatacaggtaaccaaattctctttgagtgtatgaaattgataaatgatgacgatgtcaacacaatgttaatgtgtaatgatcaattttcttgtgttggtatgattgagttattatgcaccgttggaagaacaccagatggaataataaacttacttgaacgcactatgccccgtactcatgacgcgatcttgtattacaacgggaaatggaacatgcccccgcaaaacaaatttgttggatgcgcgttcacaggaaaaaatcctaagaaatttcaaattccttcaacatgtaccatcgatgaactgaagaatttaatcaagcaagttgcacctaaagggattccccctcatggaattcacgaatcacaaacg

SEQ ID NO: 66836 - DNA, 429 bp, Glycine max
  Peptide Sequence Number=SeqID_183614
atggatgaagttcaaggtcagtcttttagcaaggtatatgggaaaatctgggatctggaaatgatagaagtgttagttgaagtcattgcatctctcactcaatactatgaccaatcgctcagatgcttcacttttggggactttcaattagcaccaaccattgaggatttcaaagggatcttaggatgcccgataggaggaaggaagccatacctcttttctaggtactatctttttgtggcgagagtagcaagagtggtcaagatctcagaacaagaattagatcgagtgaagcaaagtaggaatggagtagcgagaataccaagaaagtgcttggaggagaaggcggaaactctggcaagccaaggagggtgggtatcattcatggatgtattagcactgttggttctagatttcaaccatttgtga

SEQ ID NO: 66837 - DNA, 243 bp, Glycine max
  Peptide Sequence Number=SeqID_183615
atgcctacaagctcaaatggagcttacatcacagtggggatgtctcctccacctctagaacctcacaatcactcacaaactgatctcaagctctcaggacgacttcctcttcaagctccggtctctgcaggtcttcgcagagtaaaatctctcaactctctggattcagacccttctctctctagaatctctcacatgaagaagctcctcaagaaaatggccaaaatcccttccaaaatctga

SEQ ID NO: 66838 - DNA, 615 bp, Glycine max
  Peptide Sequence Number=SeqID_183616
atgccactggtaatcgattaccagttatgtgtaatcgattacacagtgcatttttgcaggtttcatgtcctgaggctgtggaattcgagtttagcctctggtaatcgattaccaaggttgtgtaatcgattaccagagatgaagaacctagagataccccttttacttgcatgtagtgttatggtcgcatcgtgttgctacgtagttagatatcacgtgaaagagtttacccctttctcttctttcttgcagatcgtgatggcggtgcagctaatccatgatcgagtgcagatggagtgcctagagggagcttgggagaccctcgagggcaatgcgaggtgccgatttcggggcacgattcgattcacggctacttcattagtgcatccagatgaacccgcgcgtacgcttcagcgcactgtggagtggatattacccacgcctacaccataccgtctagtggagctagtccaagtgattgagagggtgatgaggacctactccctaaggtggattctcccgaggacgtcatgtcggcatccgaggcagactctacggaggatagtggccctggagagatggcgatcagtggaggctcttcatcatagtagatag

SEQ ID NO: 66839 - DNA, 603 bp, Glycine max
  Peptide Sequence Number=SeqID_183617
atggggctacacaccctcgcctttagaggtgtacacaccctcgccttcagagggctacacgtccttgccttcagagcgctagacgccctcaccttcagaggactacacgtcctccccttcagaggactacacgtccttgccttcagagggctacacgccctcgccttcagaggactacacgtccttcccttcagaggactacaagtcctcaccttcagagggctacatgtcctcgctttcataggactacatgtcctccccttcaaaggactacacgtcctcaccatccgaggactacacatcctcgccatcacaggactacacgtcctcgccttcagagggttacacgtccttgccttcagagggctacacgccctcaccttcagaggacgacacgtgctcgccttcagaggagtacatgagcttaccttcagagggctccatgccctcaccttaaaaggactacaagtcctcgcctccagagggctacatgtcctcgccttcagaggactacacgtgcttaccttcagagggctacatgccctcaccttaaaaagaatacaggtcctcccctttagaggagtcacacaccctcgcctttag

SEQ ID NO: 66840 - DNA, 426 bp, Glycine max
  Peptide Sequence Number=SeqID_183618
atgagtgtggatcgtgcgcaccaacatgaccactcttacacagggatcgcgcgcacaagacacccagtggactcggaggagtccaacagggccctggggtttccagctctggttatgagcctctatcagtcctactgggtgcccgtccccccagcaaggacacgcctttgtgacacggtaaggatcgtgcccgcaagacacccagtggacccgaagaagtccaacagggtcttggagttgccaaatctgattacgggtctctgtcagttctacgaagtgcttgtcgcccccagtaaggtcattagtccccttactaatcgagctttcatcaagaagtattgcgcccccggcaggtgcagggcgaaacaccacaacagcctggggatgatcggcagcgggcaacagacgcaccgtcaccacctctaa

SEQ ID NO: 66841 - DNA, 186 bp, Glycine max
  Peptide Sequence Number=SeqID_183619
atgtgtcgccctttgaaggtgaggccatgcagccctctgaaggcgtgggcgtgcagccatctgaaggtgaggatgcgtagccctctcaaggcgagggcgtgtagccctctgaaggagatgaaatgtagtcctctaaaggtgagggcgtgtagccctatgaaggcaaatgcgtgcagccctctaaag

SEQ ID NO: 66842 - DNA, 2016 bp, Glycine max
  Peptide Sequence Number=SeqID_183620
atgaagttaaataaagaactcaaaggcatcactgtatgtaacgttctgctgttgagaaacaacttaaatttgagtccagatattgctgaagtctcacaggagaaattgctttcattggttgctgaaagattaattgattcaaatagtagtgtgaatgacaaagatgcaggctatgttgaaaatcaacaacagaacattgctgatgcaattgacttactccctagccttgctactggaattgatgtaaatataaaatttaggagaatagctgattttgaattcactcgagagtgtgccatatttgatctgctggacattcctttgtatcatggctggattgttgatcctcaggattatgacactgtgaatgcaattggatcaaagtcctataatgcccttatgggagagcttgtctctcttgaaacactaatcatgaatgtccatcatgaaaataatccggaagattgtgttgattttgtggctgcaacaactgctactcttggagttccttctcccagtctttcaaaagccaggtcgtttgatgattcttctcattctatttctgatcatatgcaaagaaaaggtgatctagaagaagaggcagagttgttgagagtcttgaaaatgtccgaggctgaaagtgatcctgttgtaggtcacataaatggaggagaaatttctgtcagtatggatagaaatatgtgtgatgaggaggttataaatacggattctggagataaattaggaaatagcactggtgctggtaacagtaactttcatgagcatggcccagagccttccttatcagatgattgtgctacttctggcaaagaccacaacgaacagatatcttctacttctacactgggagaggcagctaattcatccttaaagactgatgccataaatgaccttcatcaatcaacttatatgggacctgaagaatcttttgacctgaataatgtgattgagaacagccttgatgcattggttcagaatgagagtgaagatatcccatctcctgaaaaacactctgtctctttgtttgagtgccgtgcagatgtttctggaggagatggaaaagtccatgatcaatccactcctacaactatagatcatgaagttgtagatgagtctcatggacctgatgccacagtattatcattctcatcccctggccatacaaattcagattcatctagtgtcagatatcatcaaactgatgtttctggagcattgacttcatgtgttcaagggagtgagcccatatatgaaggagaggaatgcgtgttggatacaagaactggaaattttgaggatcgtgaacctgtttatgaaggtgaggtggtacttgcagaacagtctgacaaaagcaccttagctgctcctgatctaagagctaaggatgaacttactccagaacaaggtgaattgatcaagagtttcttgaggaataacgccagccagttgacattttatggtcttttctgtttacaagatgggcttaaagagcgtgaactgtgtgtttttttccgtaacaatcatttcagcaccatgttcaagtttgagggtgagctctatcttctagccacggaccaaggttacataaatcaacctgatctggtctgggaaaaactgaatgaggtcaatggtgatacattgtttatgaccagtaatttcaaggaattcaaggtagaaaaccatgaaagtagcacttgggatgagaacaatgctctgaccagcactgctgactatcttgccagcatagatagtgcaacacatgcaagcttagatatcaattctgatctgcaattagcaatagccttgcaacaacaagagtttgagcagcagccaccacgccagaataattcacagcagcaatcatccattagtggtagctctagactggtcacaggtccccaggtggcaagaaacactggaagacattcatcttcatcaacatctgcatctcccaagtctgatacaaaatccaaagataaatgtatagtgatgtga

SEQ ID NO: 66843 - DNA, 465 bp, Glycine max
  Peptide Sequence Number=SeqID_183621
atgtatcgtgtaatgaagttttcttcttgctcccggtcctggttgcccatgccttttttccttttctattcgcaggttggatggcatccaaaatacaaggatagccggtgcttccatatagtaagaattgatgggacggttgaagatttttcataccgcaaatgcattcttggtgctcttgatatcgttgatccaaaaaagtcaaagatccaggagaaaaaatggtcaggacatgtcacagactataaaaatagagtcggaagggtaatagtagtgccacaactctacaatcacaaaaagcaacgttgtttttctacctttgatttagaaggatgtccggaatcagtggtagagagcactgttctcttttgcgagtttagagttatgttattggcattactccagctaattggtggaaatagtttgcagccttcttttgttgtattttactatcttcaaggctag

SEQ ID NO: 66844 - DNA, 1743 bp, Glycine max
  Peptide Sequence Number=SeqID_183622
ctgtgctgtggtgtgacagtaatgggaatatggtggtggaggctgatactggtttctcttgctgggattctcttctctcctaaacatggtgcttcacagagaggtatgaaatatacgtttatgaagaatgcaagctcagctccaagcgtgtcatactacgagtacgagtacatcgtaattggtggggggacggcggggtgccctttagcagcgacactgtccgaaaaacacaaggttttggtgcttgaacgaggtccttcaccttatggcaaccccaacatcaccaatttggatgcttttggcgctgcactctctgacacctcccctaactctccctctcaacgcttcatctcccaagacggagtcatcaactccagagctcgcgtcttaggtggcggaagctgtttgaacgccggcttctacactcgcgctagcccttactacgtaagggaagctggttgggatggaaagttggtgaagaagtcttatgaatgggtggagcgagtggtggcatttgagccgattgtgcggcagtggcaatcagcagtgcggggtggattgttggaagtaggagtgcttccttacaatggcttcactttcgatcatattagaggcactaaggttgggggcaccatcttcgaccaacacggtcacaggcacaccgccgcggatcttctggaatatgctaaccccactcaacttactgtactcttgcaagccaccgtctctaagatcttgtttacaaacaaaggtagtagatcaaggccagtggcgagtggagtgatattcatggatgcattggggagagaacacagggtatacctgaagcagggtcccaagagcgagataattgtctcagctggtgcactgggaagcccacagcttctaatgttgagtggaataggagcagaacgtgagcttaggaaacacaacattgatgtggtgttgaatcagcccttggttggacagggaatgtcggataacccgatgaacgctatctttgtcccgtcccctgtccccgttgaggtatccctcatagaggtggtcggcatcaccaacgttggcagctacattgaagccgccagtggtcaaatgttcacctctcgttctcctagagattacggcatgttttctcccaagttgcctccaaagcagaggagcccagaggcggtggcaaaagcaatagagaagatggggatgctggagccggcagcgttcaggggcggattcattcttgagaagataatgggtccaatttcaacgggtgagttgcagctagaaacaagtgatccaaacgacaacccatcggtgagcttcaactacttcaaagaccctcgagacttaaggagatgcgtgcagggcatcaggaccatcgagaaagtaatagaatcgaaggcattctctcggttcaggtaccacaacatgtcggcgtcggtgctgctcaacatgacagcgaattcccccgtgaatttgttgccaaaacacagcaacactgcaacgtcgctggagcagttctgcagagacactgtgatgaccatatggcattaccacggagggtgccaagttgggagagtcgttgatgctcgttataaggttattggcgtcgacgctctccgcgttatcgatggttctaccttcaattgttctcccggaactaatccccaagccactgttatgatgcttggaaggtatatgggagtcaaaattttgagagagagacttgctggcgctgaaaccgagtaa

SEQ ID NO: 66845 - DNA, 1869 bp, Glycine max
  Peptide Sequence Number=SeqID_183623
atgcatctaccttgcgcagggaaagcatcacaaccctgctacaatggttgttttccatcttcttttcttgcatccatctctgacaagtctcataacgctcccaattctagccatgacttggaggcagccacatctaccactcttcatccacacacccaattcaccaaccatgaatccctcccttctttggaagagtcacatattaacttcaccaaagcatacccttcatttggcaacaacacttgtcaattagttgatcgaattcgtgcccaagaatatcaccacttgaacccctccaacatttgttttgactacactggatatggccttttctcccacgctcaggaccaaaagcaaacagcttcttcagttgcttcttcttcatcttcttgtcctcctccatcatccttgcctgaaccacccttctttgttatctcctacaagcctgtaagtttgcattctcagatacactacggcggccaggaatcggaactagaatccaaaatcagagaaagaatcatggcgtttatgaacatctctgaagctgattacagccttgttttcattgccaacgaggtatctgccttcaaacttgtagcggactctttccaatttcatcctgatggagagcttcttacagtgtatgaccacaagagtgaggcagtggatgtgatgattgagacctgcaaggagcaaggagttcatgtctcgtcagctaagttctgctggccaagtctcagaatcatgagcagcaaactgaagaagatgataatgagaagaagagggaagaggaagagaggtttatttgttttcccaccttattcaaatgttactggaacaccctattcgtatatttggatgtccttggcacaggaaaatgggtggcatgtcttgcttgatgcacgtgcattgggacctaaggagatggagacattgggtctcgctatgtttaagcctgagtttatggtatgttccttttacaaagtctttggtgaaaacccatcaggttttgggtgcttattcatcaagaaatcaagtatctctgccctaaaagaatcagacaatgctacaagcatgggaattgtaggactgtttccagcatttagacaagaaactgaaggaaaggaagagtttgtcatggataatgaagaaactgaaacaaaagcaagacaagatgatggatcagtgtcagcacatgggactgaagaagtgttttcatcagaaattgtggagttaagcttaagcacatgcacatccctggagtcaggtcaatgtagagaaagatttggcagagtgaggggaggaggcttagaggttgagtgtagaggattggaccatgctgactcggtggggctaatagcaattagtattaggggtaagtatcttatcaattggctcgttaatgcactaataagtcttcaacatccacatgctccaactgggcgttctctaattaggatatatggacctaagataaattcacaccgtggaactgttgtggcatttaatgtgtttgattggaaaggagaaaaggtagatcccgcaattgtacaaaaactagcagataggaacaatatctctttaagtagtgcatttttgcaaaacatatggttctcggacaagagtgatgaagagggacaaaggactttggaaagcaaagtgcatagagtgaaagtgttgggccattcaaacaagacacatagcagtggttttgggataaccgtggtgaaagcttcacttggtttgttgacaaactttgaagatgtatacaggctatgggcttttctttccaggttcctagatgcagactttgtggagaaagagaaatggagatacttggctctaaatcaaaaaaccattcatatatga

SEQ ID NO: 66846 - DNA, 2784 bp, Glycine max
  Peptide Sequence Number=SeqID_183624
atgcagccgggcaggtcactgggtcaagtttgggtttcccaaatgcatctgatgagtgtgccacatgtggctctaaagacaaaaggttctgtgaagggtgttcgattgatctatggaaccaagcggtctaatgattgcaattattgttctgcgtatccatcaatgaaattcagagtttcttccaacgatctctttagaagaactgcaattattgttgaagtaaaggcttcaaagaaaactttggggacagaaatacctgctgattattggaattttattccttgtgatgctcaacaagaagaaaactatgtaaatagaagggttttatctcctgcacaggttcttaatttgttgaatggtgttgatccagactttattgaaaaatatattccaagaaagaatttgctgtatcttaattgcttcccggtgactccaaattgtcatcgtgtgacagaagttccttatgcaatttctagtggaagccgattgagttttctaaatcccgataaaacaccaaatagtatttttgctgatatccagcaaagaaagattggagaaaatgcttgcaattcttctggtttaagatggataaaagatgtggttcttggaaaacgcaatgatagttcattacgtactgtggttgttggtgatccagaccttgagcttagtgaagttggtataccttgtcatattgctgaaagtttgcaggtttctgagtatgtgaataggcagaatagggagaagctgctttattgttgtgagctacgcttgttagagaaggggaaaatagatgtctgcagaaatggtagtaaagttcatctgtataaaaaggaagatctacaaataggtgacaaaatttataggcctcttgctgatggggataaagtgctgataaataggcccccttccatacatcaacattctatgattgctctcacagttagggtccttccaatatcttctgtagtgtgtattaacccactctgttgttccccattacgtggggattttgatggtgattgccttcacgggtatattccacaatcagttactgcaagaattgagcttaatgagctggttgctttagataggcaattgattaacgggcaaagtggtagaaatctgctttcactttcccaggatagtttgactgctgcttatttgctaatggaagatggggtccttttgaatgtttatcaaatgcagcagcttcaaatgctttctatttctgacaaaagattaatacctcctgcagttgttaaagctccttcaagtaatagctcactttggagtgggaagcaaatattcagcatgctcttgccttatgattttgactattcttttccttcagatggtgttgttgttagtgatggggagcttgtatcttcttctgaggcttctggttggttacgcgattctgactacaatgttttccagagtcttgtggaacattatcaagggaagactctaaactttttgtatacagcgcaaaaagttctgtgtgagtggctgtctatgacaggttttagtgtttcactctcagatttgtacctttcttctgattcctatgcacggaaaaacatgatagaggaaatcttttatggcttacaagatgcagagcaggcttgtaatttcaagcagctattgttggattgttattgtgattttctgtcaggaagtatccaagagagtgaaaatgctatcactgttgatgctgatcgtctgaattatgaaagacaaatatctgctgctctcagtcaagcgtcagttgatgcttttaggcaagtttttcgcaatattcaaagtttagctgacaaatatgcatgtaaggacaatgctttccttgcaatgtttaaggctggaagcaagggtaatttgttgaaattagttcaacattccatgtgccttggcatgcaaaattctctggtccgcttgtcatacagattaccccgtcatctttcatgtgctgcttggaatagtcaaaagtggcttgattcaatccagatgtcttctggtacccttgaatctgttcagtcttacattccatatgctgtggttgaaagctcatttttaactgggttgaatccacttgaatgttttgttcattcagtgacaaatcgtgatagctctttcagtgaccatgcagaccttcctggaacactgacacgtagacttatgttcttcatgcgtgatttgcatgatgcatatgatggaactgtgagaaatttatatggtaatcaacttattcagttttcttatgatattgaagaggactcttcatgtgataaaggtttccaagagtatgctataggtggtgaaccagttggggcaatttctgcttgtgcaatttctgaagctgcatacagtgctttgggtcaaccagttagtctactcgaaacatcacctttgctgaatttgaaaaatgttttggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctacagtgatgataatattcaccccacatgacggcagcagccaagaaaaatacagtccttgggtctgccactttcatttagacaaggaaattgtaactagaagaaaattgaaagtgcattctatcattgactctctctaccagagatattactcacagagaaaagactcaaaagtctgttttaccaatttgaaaatttcaagcaagtaa

SEQ ID NO: 66847 - DNA, 273 bp, Glycine max
  Peptide Sequence Number=SeqID_183625
atggaaaaattgaaggtggggatccagtattcgattactttaaatggctcaaggtggcacaataataatgactcttgtactctcaagacaccggagcatattcttggatggttgaagccagtttatttcgatcatcttctgttttcatccggatcaagaatgtacgtgcaacaacactatcgttatctccaccacttccgtcaatattaccctacaatattctcaagtttcacaaacgatttccatacgcacgaagcacgctcaaataaataa

SEQ ID NO: 66848 - DNA, 813 bp, Glycine max
  Peptide Sequence Number=SeqID_183626
atgcaggctgtcccccagcgaaacaaagaagtttcagacggtggaccaggtggtaggcgccctgatatttcacttcaagttccccctagacctacagggtttggcagcactagtggtgtaagggttctggatcattctcaaagtttcggtaaagggatttcatcatcaagaggcttcttgcgggccttgagcttcaaaagaaaaggaaatgtagcagatggcgaaagaagttccctccttaattcagaccccaagacagctgcagacagtcctaatatggcctccatatctgaaattgcatggaaaagatgtacttctcttcctgttacacctgcatcaaatctgtctccttcagtttctacgcccatttctgcaagggcatataatgaacagactaagcctcataaagatgttgattgttctaaggtttcaaggtccctttctgtacccgggcgaaatgttgttattgagctttctatacttggccaatcagatcaaataactcctgtgccagtagaagttactgccgatgaagaaattcctgaagaggaagcagtgtgcaggatatgttttgatgtatgtgatgaaaggaatacctttaaaatggaatgcagttgcaaaggtgacctgagattggtgcatgaagaatgtttagttaaatggtttagcacaaaaggagataagaaatgtgatgtatgtaggctagaggttcagaatttacctgtaactttgcttcgtgtgactagctctgttcaaagagaaaacagacagctgcaaggtcagcagaacctacatccagagtcaataaggtaa

SEQ ID NO: 66849 - DNA, 108 bp, Glycine max
  Peptide Sequence Number=SeqID_183627
atggtccaaaacgacaaaagcaattgcgttaactgtcacacttacccccgtttcgttgatgcagaagcacaaaatccagcgtatgaaggagacactggaattgggtga

SEQ ID NO: 66850 - DNA, 162 bp, Glycine max
  Peptide Sequence Number=SeqID_183628
atgaatgcaaatgggaaggcaggaagtttgcatttgacggccatatatgccatactactttcatcagttttgggttttggagttgctatgggcatcaactatgcgtatatccagtttgttacttggaggcttcaggtttctcatgttgataacccagtatga

SEQ ID NO: 66851 - DNA, 918 bp, Glycine max
  Peptide Sequence Number=SeqID_183629
atggaaggatccctcttcgatatccatagggccgaaccatctcaacaaccaattgtggcagcaccaccattggatatgaaacgggcggagtcatcacagcagcatgtgagagctttaaatacccagtttgcaagttgggttcaaacacaactaaagaatcatcctgatgagctttgggaagatggtgtcagagattacttagatcatgcttcaagcattatggaaaagtttagtgatgttgtcaactggctcaaagcaaatgccactaaggcagaaaatttggctgctgatgctggtgttgccttttctgggaaaaagctcttgcctgaagtaataaacaaagaaaataaaccttttggagaaaaaactgggtctactcctgttagtactgctacaaattttactagttcttggagccctggattattttcaaacagtcaaggcatttttggatttggaaatcaaagttcggctatctctaatcagagtttgcccccctctaatcaaagtttggctccctctaaccacaatgcttcagatgatgtagacggtgaaaatgaattggagcagcctagcagcccatcagttaagaagtcagaagagaaaggtgtagcagttgtacatgaagtaaagtgcaagctttatgtgaagtcaagtgatccagcagataaagatgtatggaaagataaaggaatgggccaactgtctattaaatgcaaagagggtgtcagcaaggctaccaaagagtccaaacctacaattgttgttcgaaatgaggtaggaaaaattcttctcaatgccctgttgtatccaggaatcaagacaaatctgcagaaaaactctcttgtcacaatattccatacttcgaaaggaaacgtgaaagggatgactagcatgcagtttttctacaataactga

SEQ ID NO: 66852 - DNA, 510 bp, Glycine max
  Peptide Sequence Number=SeqID_183630
atggctgagatggacgttgaaagtttgtttaactatgcggtgaaggggcagtggagagaggcattagatgcctacaacaaaaacccgggagcattggaagctaagatcacaaaagtggaagacacagtgctacacgttgctgtgcatgtaggccaaacttgctttgtgaagagtgtgttagataacatcgacaaagaggtgtctctcaacatcttatgcatgcaaaactcaaagggtaacactcccttgcacctttcagcacagctcgggaacgtggaattgtgccacaacatggcccaaagggaccccaaactcgtttgttttcgcaacgttgaaggtgagacccctcttttcttggcagctgttcatggcaagagagaggctttcttttgtctccatgaaaaccaacaaagaagacgtgatgatgaggaggatggctcgttgttggttaggaaaagcaacggggataccattcttcattctaccatcgctagtgaatactttggttag

SEQ ID NO: 66853 - DNA, 1335 bp, Glycine max
  Peptide Sequence Number=SeqID_183631
atgcatctatatcttttacgccgtgttacagcaattggaaaagatgacaacgctgcaagcaatgatgaagagaataatgtctcccgaaaatctgaggaagaacaagcaaagaaattggaaaagaaacgctacctgttccctcccaattggggagcaacgatccgattcctaacccatatgatgaagatcttgctaatcatttgcggttttggagcatcttggatagggaaaatccaacgaaagaaggtgaaacacattctagccaagcaagtgatgaatgaactaattcagcgaacttgttcttcttccctgtacaagcatgaccacactggaacaagtaacataaatagtagtactagtagtaataatcaaagtaaggagaaaggaggttttcagaaaataagaagaacagattcacctattttgattgcagcaaagatgggagtggcagagatggttgagaagattcttgagacagacccagtggcaatccatgacgtggacgctgataacaagaatgttgttcttctggccatagagaacaggcaacctcatgtttacagcttgttgaatgagaggagcatgattaaagagactgcatttcgtcaagtggataaccaagggaacagtgctttgcatcttgctgccacctataggagttataagccatggcgtgtccctggtgctgcattgcaaatgcagtgggaatacaagtggtataagctagttaagaactccatgccaccaaatttctatgaacgttacaacgagaacgggcaaacagcgaagcaggtattcataagtacacacgagagactcacaaaggaaggtggtaaatggctgtccaaaacctcagaatcatgctcgttggtagcagcacttgttgcaaccgttgcattcacaacctcaacagctgtaccaggcggtccgaatcaaaacacaggttatccattgtttcaaggaagactggctttcaacatcttcgccgtagcatcacttgttgcactttgttcctctgtcactgcccttgttttgttcctctcaatactcacatctcggttccaagaaaaggatttcgctatggacttgccgagaaagcttcttctgggattgaccacactcttcacatctatagcatctgtcttggtctcattctgtgcaggacatttcttcatcgttgaagacgagctgaagtttgcagtttatcccatatatgttgctacgtgtttgcctgtgtcattttttgcatttgttcaacttcctctctactttgatctgtccttggctatgataaggaaggttcctcagcgcagctataaatcacatcatcattag

SEQ ID NO: 66854 - DNA, 984 bp, Glycine max
  Peptide Sequence Number=SeqID_183632
atgagttccaaagagagttgcagaagtgaacttcgcattgcgatccgccaactcagtgatcgatgtctctactctgcttctaaatgggctgcagaacagttggtgggtattgagcaagaccctgccaagttcactccctcgaacacgagatttcagcgtgggagttcgagcattcgcaggaagtacaagactcacgagatcacgggaaccccaatcgcgggtgtttcgtatgttgccacgcctgcgatggaggaagatgagcttgtagatggtgatttctaccttctggcaaagtcctattttgattgccgtgagtataagagagctgctcatgttcttcgtgatcagaacggaaggaaatcggtgttcctgcgctgccatgctctctatctggctggtgaaaagcggaaagaggaagagatgatagaacttgaggggcctctgggtaagagtgacgctgtcaatcatgaattggtttctttggagagagagttgtcaacttttcgcaagaatggcaaagttgatcctttttgtttgtacttatatggtcttgtgctcaaacagaaaggcagtgagaatcttgcacgtgcagttcttgtagaatctgtgaatagctacccttggaactggaatgcctggactgagttgcaatccttatgcaaaacagtggatatattgaatagtcttaatctcaatagccattggatgaaggactttttccttgccagtgtttaccaagaattaaggatgcacaatgactctctgtcaaaatatgaatacctactaggaacctttagtaatagtaattatgtacaagcacaaattgcaaaagcccagtacagtttgagggaatttgaccaagttgaagcaatatttgaagaactgctgagtaatgatccttacagagtggaagacatggacatgtactccaatgtgctttatgctaaggaatgcttttctgctttgagttatcttgcccataga

SEQ ID NO: 66855 - DNA, 475 bp, Glycine max
  Peptide Sequence Number=SeqID_183633
atggattcttcaggtgattttgaaaatgaaatcataaatttgggtctcatggcgaatgactatgaaagcggagaaaagctaatgtcttttaactatgacttatctatttcttttgatgaacttcaagatgcattcaatgacttgcataaagaatctatcaaacttgccaaattagtttcatattctaagaaaaccatttcaagtttagaaaaggaaattttgaagttaaatgtagagttagaaaatcttaaatctgaagttaaaacattaaaattagtagataaagaccaattgtcgcaacctgccattcggcgggagggcgacgcgagggctcacaggtgcgtctaccaagaaaggaaaatgtgcggagtcgccaccaacgtttattcgaggaaaacgtcggagaaaccggaaagacgtggtctacgaactttaagtgtgaaaggttcgggagttgtttttacgcacggggaag

SEQ ID NO: 66856 - DNA, 2163 bp, Glycine max
  Peptide Sequence Number=SeqID_183634
atggctgagattgacgttgaaagtttgtttaactatgcggtgaaggggcagtggagagaggcattagatgcctacaacaaaaacccggaaacattggaagctaagatcacaaaagtggaagacacagtgctacacgttgctgtgcatgtaggccaaacttgctttgtgaagagtgtgttagataacatcgacaaagaggtgtctctcaacatcttatgcatgcaaaactcaaagggtaacactcccttgcacctttcagcacagcttgggaacgtggaattgtgccacaacatggccaaaagggaccccaaactcgtttgttttcgcaacgttgaaggtgagacccctcttttcttggcagctgttcatggcaagagagaggctttcttttgtctccatgaaaaccaacaaagaagacgtgatgatgaggaggatggctcgttgttggttaggaaaagcaacggggataccattcttcattctaccgtcgttagtgaatactttggtttggcgcttcaaataatagagttgtacccaaaccttgtgaattctgtaaaccaggacgggttatcacctctgcagattcttgcagcgaagcctaattgtttcaaaagcagcacgcggatggagttacttcagagtattatttacaagtgttcgattgttgatgagattgaggaaacatatgatatacgttgtaatgaagcagacacaactcatcactaccctatgaactatgaaacatgcgccaccttcttatcattgttgaagagtacttcaattcgaaaagatgacaacgctgcaagcaatgatgaagagaataatgtctcccgaaaatctgctgctggtggaagtacttactcatggtcaactttaagaagaggaagaacaagcaaagaaattggaaaagaaacgctacctgttccctcccaattggggagcaacgatccaattcctaacccatatgatgaagatcttgctaatcatttgcggttttgcttagtggctttgatctcggatgcaggagcatcttggatagggaaaatccaacgaaagaaggtgaaacacattctagccaagcaagtgatgaatgaactaattcagcgaacttgttcttcttccctgtacaagcatgaccacactggaacaagtaacataaatagtagtcctagtagtaataatcaaagtaaggagaaaggatgttatcagaaaataagaagaacagattcacctattttgattgcagcaaagatgggagtggcagagatggttgagaagattcttgagacagacccagtggcaatccatgacgtggacgctgataacaagaatgttgttcttctggccatagagaacaggcaacctcatgtttacagcctgttgaatgagaggagcatgattaaagagactgcatttcgtcaagtggataaccaagggaacagtgctttgcatcttgctgccacctataggagttataagccatggcgtatccctggtgctgcaatgcaaatgcagtgggaatacaagtggtataagctagttaagaactccatgccaccaaatttctatgaacgttacaacgagaacgggcaaacagcgaagcaggtattcataagtacacacgagagactcgcaaaagaaggtggtaaatggctgtccaaaacctcagaatcatgctcgttggtagcagcacttgttgcaaccgttgcattcacaacctcaacagctgtaccaggcggtccgaatcaaaacacaggttatccattgtttcaaggaagactggctttcaacatcttcgccgtagcatcacttgttgcactttgttcctctgtcactgcccttgttttgttcctctcaatactcacatctcggttccaagaaaaggatttcgctatggacttgccgagaaagcttcttctgggattgaccacactcttcacatctatagcatctgtcttggtctcattctgtgcaggacatttcttcatagttgaagacgagctgaagtttgcagtttatcccatatatgctgctacgtgtttgcctgtgtcactttttgcatttgttcaacttcctctctactttgatctctccttggctatgataaggaaggttcctcagcgcagctataaagtgctctctcacgaatcacatcatcattag

SEQ ID NO: 66857 - DNA, 540 bp, Glycine max
  Peptide Sequence Number=SeqID_183635
atggcacttgatcgaaaccatgtgccaccacctaaattgattacatgcaaacctgacatattagttggaagcaaaagaaatcttacattttcatctaaacgagggttccagctatatacgcaaagagaaagcttgaaatgcaaaaagactcttaaaaagttcaatcatgggcctctgattggaaaaggggcattggaagaaagtggcgatccaaatggtgagaaagcagaaagaggtcctggagcaataatgtcatctgggtttggagggcttggattggaaggaatagtgggaatgtcagagccagcagcaggagttggcaacacaccaccaggagaaggcaacagtggagcaatgtctggggacaactcttggaaaggagagagtgaagatagatgtggagatggaggagggtctgttaatgttgctggtgaagatgagagtgtgggaactttgggaataggttgttgtgaatatgatgaaagaagaggtgagggcatgaaagcaatgatgatgatgatcatcatgagtgttagatga

SEQ ID NO: 66858 - DNA, 4077 bp, Glycine max
  Peptide Sequence Number=SeqID_183636
atgaaccagtaccacatctacgaagccatcggtcgcggcagatactctaccgtttacaaaggcaggaagaagaagacaatcgagtatttcgccatcaaaagcgtcgataaatcacagaaaaccaaggtccttgaagaagtcaggattcttcacacattgggccatgtaaatgtgctgaaattttacgattggtatgaaacttctgctcacctatggttggttttggagtactgtgttggaggggatctgctttccatattacgacaggatagtcaacttcctgaagactcggtttatgattttgcttatgatatagtcaaagctttgcagtttttacattcaaatggaataatctattgtgacctgaaaccatccaatatcctactagatgaaaatggatgtgcaaagctatgtgattttggattggctaggaagttgaaagatatatcaaaagctccttcttcctcgttaccgcgagcaaaacgtggaacaccctcttacatggctccggagctttttgaggacagtggagtccattcttatgcttctgatttctgggcactaggctgtgtactatatgaatgctatgctgggaggccaccctttgtgggaagagaattcacccagcttgtaaaatccatcatttcggatccgactccacctctccctggtaatccaagtcggccttttgtcaatttaattaattccctgttggtaaaagatccagctgaaagaatacagtggcctgagctttgtggacatgccttttggagaaccaaatttactctggtgtctctgcctgctcaacctgcatttgatgatatgatagggctacatgctaaaccatgcttatcagaacgtaatggagataaatcttcccataacaggacccctaccaaatatcgtgaaaaagatgtcaaagggtttttgagaaaggatgagaactctgttttaggatctagaggcattgagacaccaacaagggcaacaccaattggccacagaactcagacaaagggttctggcagaatacatgaggtaaagcaaaaagataattccaatattagcaagggtgtgaatcttttgagactgtcaagaatagcaaaaacaaatctacagagagaaaatgagaaggaaaactatcgacgccccttgcctaataactctgagaatgattctgaagttaaaattgagaacactgacatggaacttgattttaatgagaatgctgaagatgatgcgcatgaagaaactgatggtgccgaacagacaactcctgtgcctgatgagaaaatggtcaatcattttctgaaccagggaaaagcagaggaggttgaaaataatacacaccagttggacaccccatctgttcaccctccagtctcagatgatccaaggtcatttgatcatgaatcaactcctgaccatcctgacatatctgctatttctcccagtgtgagccctcaggtgaagaaacatagaactaaagaagactcaggatctggccttgactctgattcttcgaggttgtctaacaacctttcccaggttctttggcatgcatctgatctctcagtcagacctgtaatgcctagcagaaaagttgataaagtctcagaagtcattccttcactcccttttgaggcattgcaagcatctgattttgtcaagatgcctaaagagcaattggaggcagtccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgatcggtttgttgattaggcactccacctttgttgatgacagtttggctagttctggaattttaggtgcactgactgatggccttagagacagacaggaaaaagtaaggaggttctccatggctgctttggactgcagggataacaatcaacttgaatctccatcaaaggacaataggaatgcgcatggctggcaggttccaaattcattaatatcacttgtgtcatcaatattgcggaagggagaggatgatataactcaattatatgcattgagaacaattgagaatatttgcagtcaaggaggttcatgggtggggcgtttgtccagtcaagatgtaattagtaatctctgctatatctatagggcctcagggaaacaagagagtatgagactcactgcaggatcatgcttggtgcgcttagttcgttttaatcctcctagcattcagtcggtgatagagaaactctcattcaaggacctatcttctgctcttgtcaagggcagtccacgagagcaacaaatcagcttaaatcttcttaacatggcaatgcttggaagccacatgttcacaaatattggaagataccttgtttcacttgctgaggataaaaatctgatcccaagtcttttgggtcttgttgagcaaggtagtgaagttttaagaggaaaggcactagtccttgtggctctcctctgtaagcatggcaggaggtggcttccacacttcttttgtagccaaaagttactctctgtagtggataggctgggaaaagagaaggatgcttatgtgaggcagtgtttggatgcatttgtgcatattgtggcatccagtattccaggtttacttgatataataacaggggatatccagcaaatgatgggaggaaggcgccatggacacatctctgcccttaccagcagatctgccccaaaacccaacattcatttgtttcctgttgtccttcatcttcttggaacttcaacttttaagcacaaagtagttacaccacaagtcttacggcagttggcgaatctaattaaactcgtggagacatcgtttcagggaagagatgacttccaaataacccttcttcgaattttcgagtctctcacagaggaatctcctgtgattattggcaatcctgacattttcatacgtgaaatcctccctagtctgacagttctgtacaagggtaacaaggacggtgatgccagatttttgtgccttaaaattctttttgatgtgatgatcattcttttgagtgaaccaattgaagaagagcaaagattgacggatctgaaattcgtatccaatacccgttttcttcctctctacccaaccttgattgaagatgaagatcctattcctatctatgcgcagaagcttcttgtcatgctaatggagttcagttttattacaattccagacattctacatctgaagacaatttcacaatgcttcgagttcttgcttggcgatctctcaaatgcaaatgtgaacaatgttaagctgtgtcttgctctggcttctgctcctgagatggagtccaaattactctctcagttaaaggtggttaggaggattggcaactttcttgagtttgtatatgcaaagggtatggaagatttgctggaaccaactcttgggttgtgtaaggcttttctagcacgttcagttagctgcacaaaaggcttcagctacacaacagaactaattctcttaggtgactgtcctcccgagttgagtggtggcgctgtcgatccccaacaatgcataaaagatatagcggactttggaagcaatgtcggtgtcttgctagagttgagtgcctctgcagaaaccagtattgctgatatagcttctgaatgtgttgtcttactgctcaaggcagctcctagagaagccaccactggtatactaaccaatctccccaaggtgactgtgatcctagagagctggagtagaggcattcctcacttgatcatccagcgaatgcttcacgctttaggctatgcttgcaagcaatacttactgcatgcaatgatattatcaatatccaaacctgagatttcaagaactgaagtcatagtttctgaactcaaaaattcaggtgtaccagctttagccaaaacagctgggctggcagccttggaattgcagcggttgcctcgttgcatttga

SEQ ID NO: 66859 - DNA, 2907 bp, Glycine max
  Peptide Sequence Number=SeqID_183637
atggagtgcaataaagaagaagccataagggccaaggaacttgctgaaaagaaaatgcaaaataaagatttcaacggggctcgaaaatttgctattaaggctcagcagctatatcctgacttggagaatatcactcaaatgcttattgtttgtgatgtgcattgctctgctgagcagaaattgtttagcaatgagatggactggtataaaattcttcaaattgagctgacggctaatgatacaacaattaagaagcaatacaggaagtttgccctccaacttcatcctgacaaaaacaagtttgctggtgcagaagctgcatttaagctgattggggaagctcaaagagttcttttggatagagaaaaacgatctagacttgacatgaatttgcgcagggttccaatgaacagaactactatgccatctcatcatcagcagaatgttcagatgaattttaatcctgtgatgcaaaccagtgtcaggcccaattttacaaacttaaatcctcagcagccacaaccgtctaggcaggcatctcagcaggtgcctaatggtggctgccctactttttggaccgtgtgctcattttgttctgttagatatgagtattatagggaggttttaaacagatctcttcgctgtcaacattgcagtaggcccttcattgcatatgatgtgaatatgcaaggcacaacaccagcaactaattcaagtcagcaagcttttggtgtgcagaaccatagtcagaatcatggtgctttcaacgttggtgctggatctcaaggtaatttgcatactcgcaggtccaatacagaatcacataagaaaaaaggtcccactgctgatgtctctgtaaagccaaatggaaagaggaagagaaagcaagtagcagagtccagtgaaagtgccgaatctgttggcagcactgattctgaatctgaagaggatatactttatgataaggatggcttttctactcttagagaagagaatccacgtagatctacgcggcaaaagcatcaggtttcctacaatgagaatgtgagtgatgatgatgaagggggtggatctccttctggtgctggagaaaatactggggagccatctaaaatgaataatcagaatggtttggctgctgatctgaaaggcaataaacaaggggaaaagcggaagcagaacttttattctgaagagagcttacaaaatatagatgaagaaattaaggaggtgagagaaaaagaggcagttggcagctcaaagatagacaaagcttcagagcattcaccctcgaaatcaacaaatcgaccagatgattttgtttacccagacgcagagttcagtgactttgacaaagacaagaaagaggggtcttttgctgttgggcagatttgggctatttatgatactatagatggtatgcctagattctatgctgtaatcagaaaagttttctctcctggattcaagttgcggataacatggtttgaaccagatccagatgagcaagatcaggttcactgggtagaagaggaattgccaattgcttgcgggaaacataaacttggcatcactgataccactgaagatcgtctgatgttctctcatctgattgtttgtgaaaagattgggcgctgtacttataaagtatatcctagaaagggagaaacttgggctctttttaaaaattgggatatcaaatggcatatggatgcagaatctcatcgtgagtatgattttgaatttgttgaaatcttgtcagattatgttgaaggtgtgggagtagttgtttcgtacttggctaaattgaaaggctttgtatgtctcttctctcgaatggagggaggtaatcgcacatttcaaattccatctagcgagttattcagattctctcacagggttccatcttttaaaatgactggtcaggaaagagctggtgttcctgtaggatcttatgaacttgatccggtatccttgccaatgaatcttgaagagattgctgttcctgaacatttggaagtaaaggatggtcattgtccatctagtggggtgggcacaagatcttcagatatgtggaaattcacgatgaactcggagggagatgcttctactgcaaaggttaagttgcaaagaaacaattcagcagaggagaacaaggatcctgttaatcatattggtaatgatagtgatccttcagcttcagctgcagatgcttttgaaattccggatcctgagttctgcaattttgatgctaagaggtcccttgaaatgtttcaggttggtcagatttgggcattttatggtgatgaggatggactgccaaaatactatggtcatattaagaaggttaggactagtccagatcttgagttgcaagttacttatcttactaactgctggctaccggagaaatgtgttaaatgggaagataaggatatgcttatttctattggaagatttaaaatcaaagcaggtgctcatccctgcacatatgcaaacacctattatgtttcgcatcaggtgcaggttattaacgatggtaagaagaaggaatatgaaatttttccaaggaaaggcgaaatctgggcattgtataggaattggacgactaaaataaaacgttctgacttgttaaacctggaatatgacatagttgaagttgttggagaacaagatttgtggatggatgttttacctttggagttggtaagcggttataattcagttttcaagcgcaagtccaatgcaggatcagctagggccacgaaaatatactggaaagatttgctcaggttctcccaccaaatccctgccttcgaactgacagaagaacaagatggcaatctgagaggcttctgggaacttgatccgggagcagtaccccttcattattttaacagcaaataa

SEQ ID NO: 66860 - DNA, 3327 bp, Glycine max
  Peptide Sequence Number=SeqID_183638
atgagtccgattgattctacgggtaacggtgatcgcaaaatccaccaagatttcgacttcgtcgacactcaaccattcgacgccgatggtgaggaggacgatgtttgcggattcttcgaggacacggtgcctttcggcgacgacggtgttttggagaccgaagcggtgaaccttgccggtgaaactcaggcattggatgatggtgatgctttcgacgacgacgacggcgttttggagaccgaagcgctaaaccttgccggggaaactcaggcgttggatgacggtgacacgcagttgctggaggaagagtcggattcggatagaacgcaagttttggagaatgtggatgatgacgacgttgatgaggtatctgtcggcaatgtcaatggtgaagccgtggatagcaagaagggtgaatcgtcacaacaaaacagttctggttctatgccaccacggtttactgttctccgtgcagaatccttgcggcaagctgctctagcctgcaacatggatttgaaagaaacccaggatgtgaccaattctgttgagggtacgagtcagttttgtcaggtaccacaggctgtaaaggataatggggggtcctttcttagatgttctgagaaggatgatggagttgatcaggaaaacaagcacaggaaatacagtgtggaagttggggggtttaagagcaaaagtatgtgcaaggttgctaactcgacagtgagaaaacttttcaatgatgttttacctgttgaaacaaaccaaccttctcttagaagcaatgattttaatgaaggagatgacttggacaagttgcctatttaccatgatgaattgacagggttaagttacgtggaatctcaagaacctggagttttgtcacaggacaatgctctcgattttgttgataggtttctcaaagataatacattggagtttgatcaagaaactaattctgttaagaaaattgaggaaaagtcaaaatccattcccagtacaaaaagacagcacagtttggccaagacagtaaatgatagaggcaaatctggaagaactgggatttatgactgggatgataaccgtgaggatgaaggtgggggagatatattcctaaggagaaaagaagatttttttaagggtgaaatgcataggccaaggtcgttgccaggattccagaagagcaaagtatgcagactaaatgatgataaggaagacaagaaacaattaagtattcctaatagaagaaagactgcagttcactctgattcaaaactagggatgcatattctcaaagcaagggacaatattataccagaagcaacaatgttaaaacggaatcttgctaatgaattggatgaacaatttaacactgattgctctagaggagagatggagcccaatgctaatgcatgcgcaccagagatgttggatgtaggtttagatactcaaatggctgctgaggctatggaagctttatgcaatgtcggggatattgttgatcatgttgctaatgatgccactcatgttactagaagtggtttaatgtataaagttaataactcttctactggaaaagtggggtcgggttcgtcaaaggaacgtttgggacaatatgacaagaaaaggaaagttgatgttaaatctaagttacaaacttcaggtttatcaaagaaaagtactaaagaagtcaggcagtggacaaaggacaatatgatgacaagatcaaagaggagcaagttaaatgcagaaggcaaccaaacctccagtgctaatgaaaatggtagagtatccttgtctccactaattgcacaaagaaagtcagctggagctttgaaaagacatcagcttgatgagttgaataatcctggtggcaataatggagaaggtagagggagttcagtcggcaaaaggcatttgcaggatgatgttttgctttttacaccaattgcccgcagaactagacggtccttagcagtaaacccattgattaatgtcagtgatgatgctgaaatggatacattagattgtcctaaaggaaggagatctcttaggattaggaagctgtctaatgatgacaaacgatccgagacattagttggttcatctaaaccatctgcacaacctgaagatattgggaaacatactgctgggaagagaaaaatgagaacggattctgttgtcaaatcacatgtgaattgccaagctcggtcatctttatctttgtatgatggttcagcgatatcttctgttgatcgaaaacaaggtaaaatatcagagctaaattcagataaagcaaacccaggggacaatatcaataattctgaagtcaccactttagatgaatcaccaagagagaggtataagtcatctgacttggcatctgcaactccggcaaagtgtaagacacccgcgaatgatgcatcacctgtttgtatgggtgatgaatattacaaacaatcatgcaatagaaatctttcaagatcatgtaaggagctccatagagaacttcaaagcttgagggacatcagatctgaattacttactccgtctaaagattcaagaaagaggagggacatgactgatgttcgaattctttacagccaccacttggatgaagatattgttaagcatcagaagaagattttagcacggcttggagtttctgtggcttcctccattgcagatgcaacccatttcatagctaatcaatttgtgcgtacaaggaatatgttagaagctattgcttttggtaaaccggtggtcacacacttatggattgaaagctgtggtcaagctagctgttttattgatgagagaaattacatattgagggatgtgaaaaaggaaaaggagttaggtttcagcatgccagtttcactagcacatgcaatccagcatcctcttttaaagggtcgaagagtattggtcaccacaaatactaaacccagtaaagagattgtttcaaatttaacgagagctgttcagggccaggtagtggagaaagtaggaagatctgttttcaagggagatacaatttccgatgatctactgatcttatcttgtgaagaagattatgcctcttgtgtgccttttcttgaaaagggtcagaaactgtttcattcagctttgaaaacttgctatctgctcaaaattaagaatactatgttttgcatctgcaggggcaatggtgtacagttcagaactgttgctgaatggcatcgttactcagaagctggagtatcagaggtcattttttgttccattgctcgtattactaatgagtttgaagaatataagcttttattatacacagatcttgttccttag

SEQ ID NO: 66861 - DNA, 134 bp, Glycine max
  Peptide Sequence Number=SeqID_183639
atgttgcaacatcaaagcacttacaaaagtttccacatgatgaaggcatccgccgctggggcccacatggacaacatatttggctacattaaagacggaaaaagagatgtgttaaacctgatcagcagtgaaag

SEQ ID NO: 66862 - DNA, 396 bp, Glycine max
  Peptide Sequence Number=SeqID_183640
atggcattgcgtttcgctatcaccctaatgatcatcttcatactttcttcctttcatgttgttggaattcaaatcatctccaaatcgaagctggagaagtgcgagaagaactccaactccgatgacaatctcaattgtactaccaaaatcttactcaacatgattgttcccagtggctcgagtggcggagaggcatcgattgttgcggaattggtggaagtggaggaaaattcaagcaggaaaatgcagacattgcgtattcctcctgtcataacggatgttccttataaacctgaagagtattatgttaagacacgcaaatgcgagccagatgctggtgcaaatgtcgtgaagatatgtgaaaggcaaaccatgtttattgctattttattatga

SEQ ID NO: 66863 - DNA, 537 bp, Glycine max
  Peptide Sequence Number=SeqID_183641
atgtggataagtcactcgccgttgccgccgctagaggtgtcgtcaccagaggcgaaaagcggcaaatacagtgggagctcattgtcgcgactaggatctcgttcgttgccagcggtcaagatgaccgagcctccttgcggttgttctttgtggcaaaacgttaatgccgttctttgcggtgaaggcgaggcacgcggcaacgtcgaaggtgggaatggcggcggtggaggattgacgaaaccgatggagcttcgccggaggagatggaggcttgccagaagcggtggaactttgagcatcaagcgatggccgtttaatgtaagcgacgaaaacaaaagagatgactcagaaccaggacctttgatttggcccacgatgcaagtgttacccccatggctacctaacccatccaccaaatggacctccaagacctctccacaagttaacgatggactctcccatattgggtcttttaaacaacagtctgtgcttttggcccacgatgcaacagaacttaattttactagttatttataa

SEQ ID NO: 66864 - DNA, 255 bp, Glycine max
  Peptide Sequence Number=SeqID_183642
atggttcaggagcaatttttaataatgaagccaaatgaggttacaacccaatcatgcaaaatctacccaaccactgatcaggcttcaaaatatttttgtgcggccgtactaaaggattctgattataatgaagttgatagagctgaatgtcaatttgctactacggcaactgttcttgacaacgacacacaggacgacaaagaagattttacagcagttcttttatctgcagtatcactacataaatacatttaa

SEQ ID NO: 66865 - DNA, 1416 bp, Glycine max
  Peptide Sequence Number=SeqID_183643
atgtgggctctttgtcttggagcattggttattataggcataacacattgggtttatagatggagaaatcctagttgcaatggaaaactccctccaggttcaatgggtttcccccttctgggtgagtcccttcagtttttctcccctaacaccacttctggtattcctcctttcataaagcagagaatgaaaaggtatggaccaattttcaagaccaacttggttggacgaccagttgtagtatcaacagaccctgatcttaatcacttcatcttccaacaagaggggaaagtgttccaaagctggtacccagacacattcacagaaatctttgggaaacaaaatgttggctccttacatgggtttatgtataagtaccttaagaacatggtgctcaatctgtttggtcatgaaagccttaaaaagatgctcccagaacttgaacaaacaacatgcagaacattagagcagtggtcatgtgaggacagtgttgaactgaaggaagcaacagcaaggatgatatttgatttgaccgcgaaaaaactcatcagttatgattcaactaagtcctcggagaatttaagggacaactttgttgcatttatacaaggactcatctccttccccttagacattcaaggaacagcttatcacaaatgtctgcagggtaggaaaagggcaatgaagatgctgaagaacatgctgcaggaaagacggagaatgcaaaggaaacagcaaacagatttctttgactatattgttgaagaacttaagaaagagggaacaatcctcactgaagcgatcgctctggacctcatgtttgtgctcctctttgcaagctttgaaaccacttctctcgctctcacttatgccataaaattactctcggacaatcccttagtgctcaagcgattacaagaggaacatgaagccatcctcaaacaacgtgaagatcctaactccggaatcacatggaaagaatacaagtcaatgacattcacatttcagttcataaatgaaaccgtgagactcgccaatattgttccaggaatcttccgaaaggcactgagggaaattaattttaagggttgggcagttatggtgtgtcccccggctgtgcacttgaacccagacaaatatcaggatcctcttgccttcaacccatggagatgggagggagtggaactacaaggtgccagcaaacatttcatggctttcggcggaggcatgagattttgtgttggaacggacttcactaaggttcagatggctatgtttattcatagcttggtaaccaagtacaggtggcgacccatcaaaggaggaaacatccttcgaactccgggtttacagtttccaaatggctttcacgtccagatcatgaaaaaagatcaaaggaaacagcaggaaccataa

SEQ ID NO: 66866 - DNA, 1260 bp, Glycine max
  Peptide Sequence Number=SeqID_183644
atggcattgtgttctgctatcaccctaatgatcatcttcatactttcttccttccatgttgttggaattcaaatcatctccaaatcgaagctggagaagtgcgagaagaactccaactccgacgacaatctcaattgtactaccaaaatcgtactcaacatggctgttcccagtggctcgagtggtggagaggcgtcgattgttgcggaattggtggaagtggaggaaaattcaagcaggaaaatgcagacattgcgtattactcctgtcataacggtcaacaaaacttctgcatatgccttgtatcagttaacatacatacgagatgttccttataaacctgaagagtattatgttaagacacgcaaatgcgagccagatgctggtgcaaatgtcgtgaagatatgtgaaaggcaagccatactgcgagatgaagagggtcatattatcgagtacactcagccaatatgttgtccatgtgggccccagaggtggatgccttcatcatgtggaaacttctttgacaaattgacaaaaggaaaggccaacactgcacattgtgtgcatttccctggtgattggtttcatgtttttggcattgggcagcgaacattgggatttagtgttcaaatacaggtgaagagtggaactaaagtttcggaagtggttgtgggtcctcaaaacagaacagtgatctctgatgataaattttttagggttaatcttataggagattttgttgggtatacaaatataccatcttttgaggatttctatctggtcgtaccaaggcagggcagccctgggcaaccacaggatttggggagaaacatttctatgtggatgctgcttgagagagtgagatttaccttagatggtattgaatgtaacaaaattggtgtcaactatgaagcttttaatcaacaaccaaacttttgcccttctcccttttggacctgcttgcataatcaattgtggaattttcgggagagtgctgggagttattctttctccataggaattacagaggttcttaatacaaaccttgtgctagaattaagtgcgaatgatgtagagtatgtttatcaaaggagcccaggaaagataataagtgttagtgtccctacatttgcagccctaactcaatttggtgttgctacaatcacaactaagaataccggtgaggtggaagcgtcatatagtttgacgatatgcattatattaatttctatacttgtggcacagttctttaaggcttga

SEQ ID NO: 66867 - DNA, 486 bp, Glycine max
  Peptide Sequence Number=SeqID_183645
atgagcgttcctccaccccttgcggcagtgatgtggatgtcattcatggtggcacagtggccttggctggagcaccaggccctcatcttcaagtacctcaaggcaggtctctcggttccccttgacctccttctccccatttacaagagcctccaattgatgtcatctcacccgtcgagtaatggggtattatgggaagaactcgtggaagaggttaccaatctagatactacctttggaacctatgaagaatccatcacccagtccactgagagggaggctactacattgaaaactacaaagactgaagaagaacagagcgagacaagtgctagtcccaggaagaacaagagctcgacctctcactggttcaagggagggccaatgagggtgggggaactcatggaagagtggggtagcgacggaagaagcgaaggacgaggaaaaaggaagaaagagatggattttctgaggaaaaagaaataa

SEQ ID NO: 66868 - DNA, 693 bp, Glycine max
  Peptide Sequence Number=SeqID_183646
atggccaccacaaggtcatcgtccgaggacatcgtcgattccacgccgcttctcgccaattccgccggctcctccgacgacctcacctccggccgtcgattcgcgcggcgtcagcggctccggcaggcggctcagttcctcaggcaagcgagcgggcgccggatgatgcgcgaaccgtcgatgctggtccgggaggccgcggcggagcaactggaggagcggcagagcgattgggcgtactcgaagccggtggtggttcttgacatcgtgtggaacttggcgttcgtggttgtggcggggaccgtgctggttttgagcgcgagcgaggcgcctggcatgcctctgaggttgtggattgtagggtacgctatgcaatgcgtccttcacatggttttcgtttgcgtcgaatataggaggcggaggaggcagcaacccgctgccgcctcgtcagtgcaagacagggttgggagcagcagtgggaatttgagtgtgtcttcaagagagggttctgcttctgcctctgcctctgcgcagaatgtgttgttgggccaactcgatgacgagagtactagggcaaacgttagcacagtgataaggttgttgccttttgacttggaggttaatatggacttaaatcctggaagtagcctctccgcttgtgaggatatggttgtgtataacgaccatccatag

SEQ ID NO: 66869 - DNA, 576 bp, Glycine max
  Peptide Sequence Number=SeqID_183647
atggtaacaaaaactcctctttatgaggatggtgagcttgttggtgttataactgtttcaagtgacgcggctatattaaacactacaaattcagataatcaaagagcttaccaatctggtaacaatggccaacctggagtacagaggttaaacttaaaaagaattcagtggcctccacgaccaatgattgcaccgatgccacatattgcttcatgtgtttccaatctggcatcaaagcttctcccagtgctgaatagtacagataacacagtttccaagaatacttcaacagatgcaaatgatgaaaaactagagaagcgtggcatatatgcagccagagtccttgccaagcttcaaactggggcacctgcaaaatctgatagttcaggaagcaatagagtgaataaggaaaatgattcatttggaggtttattgccattaaatcaacaccaggacgttgctattggagcagataaagaagaagatcttaataaatgcaattctttatttgcaatgaagagagcagatacaaatgtttgtgcatgtagagcttccaatgttgtcaaagatagttaa

SEQ ID NO: 66870 - DNA, 426 bp, Glycine max
  Peptide Sequence Number=SeqID_183648
atggggagtgagttaggacagttcttgatagattgtgagagcaagttaggggacagtcgatgtctctcatatacctggaataggagtgaaggggcatcaaaggaagacattgagcagttgtcaaaatttaaattccgaagaattgaaagcaatgagaaacttaccggtactatacaaggacctgttggaggaataatgaccgaatgccaggctgattcacctattgaacatgctcttgctgaggaggatgcggaatgttgcatctgcctttcttcttatgatgatggggttgagctaagagaacttccttgcggtcaccattttcactgtgtctgtgtggataaatggctgtatattaatgctacatgccccctctgcaagtataacatcttaaaaagtagcaacctcagtcaagaggaagtgtag

SEQ ID NO: 66871 - DNA, 362 bp, Glycine max
  Peptide Sequence Number=SeqID_183649
gtcttccttgtgcatgtgagctacaaaggtatgatggtggcaacatcctactcgatgcagttcatatgtactggaggagacttagtttttcagaccaggggttatgtgaggccgaagtcagcatcaaggaagagatggatagaatatataaaagatttgagaaactttatgtctgtggcaaggttaacaccaaaggtgcactaaagaaactgatgaaaagaagccaaagatcgacaaagtgtgagctgtcatattgggagtatgttgatgcttatcattcagttcaaaacagcaacacttcaatcagacgtactacatcatcttctgaaccaccgaagccagcaaggatgatctcgatgtag

SEQ ID NO: 66872 - DNA, 267 bp, Glycine max
  Peptide Sequence Number=SeqID_183650
atggatgatttacacggtacacttgggtatagtaggcggaaaggttcgaagaacctaagggaattagcgagtggtgactacctgacatttggtgcactcatttggcgtgggaaacttacaggcctcactttactactcttgacaggttccgagactatagtttttggagttgggagcttgggggaacggaggactcacgcatataaccaacaacttttagggttaggagatgtcaagggagtcgcacccactacgagcttggcatag

SEQ ID NO: 66873 - DNA, 804 bp, Glycine max
  Peptide Sequence Number=SeqID_183651
atgtcaaccgtcactgcttcttacaatgtcactcccaatgagccaactccaaacgtttctatggggctgtccgagagtgaccaagtggtacgttggactcacgccccaaccatttacatttacaaagaaaaccaaacccaaaacgcccttgaaagaatgagagattctctaagcagaattctagtgcactactaccctttggccggtcgattgacttggatagagggtggtagagtagcactgaattgcaatacaaagggagtgacactgatcgaagccgaatctccaaaaacaatggatgattatggcgatattaccacgaacgaaaaactgatgagtgaactcattcctatggttgattattctcaacccattgaggagcttcccttgttgcttgttcaattgacaaggctcaaaggaagcagcaaccaaggccttgcaattggagtggctattagccatgttttgtgtgatggggtagcagccattacattcatcaatgcatgggcaaagcttactagaggggaagctttggactcaattgaaatgtttccatttcttgatagaacaatcatcaattccacatacccaccaaggactccacgttttgatcaccctgcgttgaagcctctacctctcaaactaggcagcactgacaccaaagaagaacaggaaaaggagaaaacttctatgatgttgagactcacatcacagcaagttgagaaattgaagaagaaagccaatgatgaacgacctaaaaaagatggtattacgagtaaacatacagaaattgattatttctaa

SEQ ID NO: 66874 - DNA, 402 bp, Glycine max
  misc_feature (196)..(196): n is a, c, g, or t
  Peptide Sequence Number=SeqID_183652
atggacctagaaaagagagttgatacttggaatgggcgtataacaaaaattcttggcattccttggggattcttgattggtgctgagctaacgattagcgcaaagtcgtatttctttgccgaacgagcagggcgttccttagaagaggcgatttgctatcgagttctattattggggataacaaaaacatctctgnatactcaaagtttcatatctgaagcaagttttcaagaaactgctagagttttatcaaaagccgctctccgggggcgcatagattggttgaaaggtctgaaagagaacgttgttttagggggaatgatacctgttggtaccggattcaaaagaataatgaaccgttcaaagcaaaggcaatataacaagatgacctcggaaacataa

SEQ ID NO: 66875 - DNA, 712 bp, Glycine max
  Peptide Sequence Number=SeqID_183653
gaccggcgcctgcagccaagccagcttgcgttcgcggggctgctgcttgagctgccactcggcgcgggaggcggcggcccggtccgggtattcgcgcacggccagcacgcgcagcggcggccgggcccgggtgtagcgcgcgcccttgccggcctggtgggcggcgaaacgcgcctccacatcggtgctgatgccggcgtaatagctgccatcgcggcattcgagcaggagagaggcgccgcgctggtgcccgccgaaggcgcaggctcccatgatcgctcaggccggtgggctggaatcccaccaaccatgcattcgactcgccgagctggagagaggcaaaaggacagcgggagcggcaccggtcatcgtcatcccgtcattgcgcaggcagtggcggtagtcgcgcatggccggccccaccgcgcccggagcctgtcccatgctgctgtccatcatctacctgattgccatttccgccgaggccatgaccggcgcactgtccgcaggccgccgccgcatggacctgttcggcgtggtcatgatcgcctgcgtcaccgccctcggcggcggatcactgcgcgacatcctgctcggccactatccgctgggctgggtgaagcatcccgagtacctgggcttcaccgtatgcgcggcgctgatcgccacctgggtcgcacgttggatgcaccacttccgccggaccttcctg

SEQ ID NO: 66876 - DNA, 285 bp, Glycine max
  Peptide Sequence Number=SeqID_183654
atgacagcctttttcgtttcagaaaatgtaatactggatgtcacaccttccaatacatgtgctgatattgtgtcctccttgaaatggaggttgaagttggaagggaaatttggagcaaaagcttcaagtgtgcaaggaaatgcattaaagatagttgctaagcctgaatttcaggctaagctaaaattcagacagagagcaaaagattcaagcctggctaagcaagaactggtggctgaggaagagttctgttgtgttcatttgagatctgtgtactttggctaa

SEQ ID NO: 66877 - DNA, 636 bp, Glycine max
  Peptide Sequence Number=SeqID_183655
atgaacaccctgaatggttacctgatgactggaatgtggacttcagaactcgaaaaagtggtgcaaatatgggtcatgggtataaggcagtccaagggacctttagctaaatgctcaatacttcggttgttcatggcaggaacatcacagggtcacccacaaatatgtatagaatattgttacattgctccaagtggacacaaattctactccaaaccagaggtgttacgatatctcgatactgtaaacataaacagcaacagccacacttccaagaaggaaaagatatgcaaaagcaatcttccattttttttcttgttgtcacttgtcatccattatactagcaaggatacagttgagaagtccaccatagaggatttaccacctggtcagattaaagaagtcaagattaggaagggcagtaacgacaacagggatgtggttgagaagtctccagtggaggatttaccacctgggtggataacagaagccaaggttaggaagggtgatactggcaataggaaagatatgttttatatagatccagtgagtggatatgtatttcgctccaagaaggatgcactgcgctatgttaagtctggagatataatggtagcttttattaagtatgtttaa

SEQ ID NO: 66878 - DNA, 381 bp, Glycine max
  Peptide Sequence Number=SeqID_183656
atgggagaagaagtgtcctacaaaaccgaaccagagtcagagctacactctgttccccaagagcataattcctctgctcaggaaaaagaattggagaaacctgaacctccaaacgacaaggtcactcctccttctccagttgctgctcaagaggttgcagatcatgctagtaaaaaggatacagaggagtcagtcgacaaaggtcattctctgataaataagttaaagttattgaaagttcaagagaaacgtaacattttccatattgttttaccagatgctatgcttgcaaaagttttaacggagaaaagattggctttaatcaaagcatgggaagaaagtgaaaagacaaaagcagagaacaggcaagtgctcatatga

SEQ ID NO: 66879 - DNA, 2226 bp, Glycine max
  Peptide Sequence Number=SeqID_183657
atggaggagtcctttgggcttgccttgcaaaaaaagagacatcaaaatggaggacaacttgatgctcttcgtgttgagttgaagaacaacttgaaagataaaaagtttttgcttgtgctcgatgacctttggaatgagaagtataatgattggcatcacctaatagcaccttttagcagtgggaaaaagggaagtaagattattgtgacaactcgacaacagaaagttgcacaaatgacacatacatatcccatttatgagctgaaacatctaacagatgaaaattgttggtgtatacttgctgaacatgcttttggaaatgaaggttacaatgaatatccaatcctagaagaaactggtaagaaaattgcaaaaaaatgcaatggcctacctttagctgctaaaacattgggaggtcttttgcgatcaaatgttgatgaaaaggaatgggatcgaattctgaacagcaacttatgggcacatgaagaggttttaccagctttacacataagctatcttcatctcccagcacatttgaaaagatgctttgcttattgctcaattttccctaaacaacatttattggataggaaggaattgattctgttatggatggctgaaggctttcttcaacaaatccacggagagaaagcaatggaatcagtaggtgatgaatactttaatgaattattatcaagatctttaattgaaaaagacaatactaaagcagaggaaaagtttcgaatgcatgacctcatctatgatttagctaaactgatatatggaaaaagttgttgctgctttgaaagtggtgaaatctcaggaactgttcgccatttagcatttcattcaaatctgtatgatgtctctaaaaggtttgagggcttgtatgagcaaaagtttttgcgcacctttttagcagcacgtaattatttatacggtgaatattgtgttacaaaaaaggtgtcacatgattggctgcaaaaactaagatatttgcgaacattgtccttgcttaaatatgaaaatatcactgagctgccggaatcagtaagcattctggtacttttgcggtatcttgacctttcctatacttccatcaaaaggttgcctgatgcaacctgtaggctttacaatttgctgacattaaaattatcacattgtgaatttcttactcagcttcctgaacagattggaaatttggtcaatttaccccaccttgatattagagacacaaatttgttggcgatgccagcacaaataagcaagctacaagatcttcgtgtgttgacttctttcattgtaggcagagaagatggagtaactattggagagttaagaaaattcccttacttgcagggtatgctttccattttgaagctacaaaatgttgttgatcccaaggatgcatttctagctgccttaaagaaaaaggagcatattgaggagcttacactggagtggggcagtgaaccacaagattcatcaattgagaaatttgtacttaagaacctgcaaccatcaacaaatttaaagaagctcaacatcagatcctacagtggcacaagctttcctaaatggttgggtgactcttcgtattctaatgttatagtcctttgcattagtgattgcaactattgtttttcacttccaccatttggacaactaccatctcttaaggagcttgtgattaaaagcatgaaaatggtgaagacagttggtgaagaattctactgcaacgatggaggctctctttcatttcagccatttcaattgttggagagtatcgagtttgaagagatgtcagaatgggaggagtggctacaatttgaaggtgaaggcagcaaattcccttttccttgccttaagcgtttgagtttatcaaagtgccccaagttgagaggaaacttgcccaagcatctaccttcgttgacagagattagtataaaagagtgcaaccagctggcaattgaatcatgccatctgcactggaacacatcaattgaatcagtaaaagtttctgaagtgggagaaggcttgttgtccttgcttgacaacttttcttatagggaactatctattgaaaagtgtgacagcttgtcatgtttgccaagaatgatactagctgccaattgtcttcaaaagttaactcttggaaatatccccactttgatttccttcccagctgaaggctttccaacgtcattaaaaactgtgagaacttag

SEQ ID NO: 66880 - DNA, 495 bp, Glycine max
  Peptide Sequence Number=SeqID_183658
atgaatttattgcctagcgctgttcatgtgtcctccaccttcgagtctggagcccggagaattcattgcttggcgaagttcgccaattctccattctccagttttattcggagccccatgaattcattgcctagcgctgttcatgtgtcctccaccttcgagtctggagccccgcgaattgatcgcctagcgctattcgccaattctccattctccacttttattcggagccccatgaattcattaactagcgttgttcatgcatactccaccaacgagtctggagccccgcgaattgattgcctggcgctattcgccaattctccattctccacttttattcggagccccatgaattcattgcctagcgctgttcatgtgtcctccaccaacgagtctggagccccgcgaattcattgccaagcgaagttcgccagttctccattctccacttttattcggagccccatgaatttcttgcctagcgttgttcat

SEQ ID NO: 66881 - DNA, 260 bp, Glycine max
  Peptide Sequence Number=SeqID_183659
agtttgatgagttcaggatagagctagtcaaaagaaacagtcataggacgctgaccaacctcatggaggggagcatagatgtggctctcgtgaaggaattttatgctaatctttatgtcccgggggataaacctccaaagcatgttagggtcagagggcatttaattaagtttgatgtggattcccttaaaacttttctggagactccgattgttctagagccaggggagactgatcgaggccgtacacgaatcaagtaa

SEQ ID NO: 66882 - DNA, 411 bp, Glycine max
  Peptide Sequence Number=SeqID_183660
atgggggaatctgaaagacttagctatatcagaaacaaccaaaagaagcttagagttgataagtattctagcttacaaacttcattggatactagaacagctaaaggcttaaccaagggaaaaagggtcatcttaccctcaatgcttgttgggagcccacgttatatggatcaactttactttgacggtatggcaatatgcagtcatgttggttttccaaatctttttattactctaatctgtaatccaaattggcctgaaattcgtagattactttcacctttgaatctcaaaccgacagacaggccagatattgtatcacgaattttcagattaaaatataaacacatgctgccagacttaacaaagggtcaattactgggaaaagtggttgcatatattcatggctaa

SEQ ID NO: 66883 - DNA, 153 bp, Glycine max
  Peptide Sequence Number=SeqID_183661
atgaggacgcgtagccctctaaaggcgaaggcgtgcagccctctacaggcgaggatgtgcagtcctctgatggcgaggacatatagtcctctaaaggtgatagctgggaacctattgggtgaaaacttctcatctgcccctaggttcgcttga

SEQ ID NO: 66884 - DNA, 247 bp, Glycine max
  Peptide Sequence Number=SeqID_183662
atggaaataaattacgagccttggggaactccgagataccattcttctaagggcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagg

SEQ ID NO: 66885 - DNA, 213 bp, Glycine max
  Peptide Sequence Number=SeqID_183663
atgactcatcaggattttcaagtgcaagccattggtcagtttgctcaagcgacctgtgctcctgagtttggacttccaagaccattcaatcagagattactcgtcttgcacgttggtggggttgccgtaaaacaacgagtaaaaaagtttgtcttcttagagaagcgagttgtcaagaataggatgttggacaaatggcctcagttatcttaa

SEQ ID NO: 66886 - DNA, 273 bp, Glycine max
  Peptide Sequence Number=SeqID_183664
atgggttttccttcgccggcagtcacttaccctgccgaaaatttatctgcattctattcgctctcccttgaggtgattccgctgtcctttgcttcgggggaaagaatgaggattccttttttacaggccaaggttcaaaaaggtctaaggttgtgtttcaatggggtcttttatcgcgggaacccaatcttgatatctggggcgaaacaaatttgggtgtcaaggtgtcggtgtcgggccgaactcccctatcactccataaggcacgcgtga

SEQ ID NO: 66887 - DNA, 613 bp, Glycine max
  Peptide Sequence Number=SeqID_183665
atgaattcctccatttatattcttgtctttgtccaccttttgttgttaagcttaccatgcagagagagtgtgtgcatcccaagtgagcgtgagacacttttgaagtttaagaataatctcatagatccttccaataggctttggtcttggaatcctaatcataccaactgttgccactggtatggagtcctctgccacaaccttacttcccatcttcttcagcttcacctcaacactacagttcctgctttcgagtttgatggctaccctcacttcgatgaggaagcttataggagatggagctttggtggagagataagtccttgtttggctgatttaaagcatttgaattacttggacttgagcggcaatgtattccttagagaaggtatgtcaattccttctttccttgggacaatgacctccttgactcaccttaacctctctgctactggattctatgggaagattcctcctcagattgggaatctctcaaatttggtgtatcttgacctgagttatgtttttgccaacggaagagtaccctctccgatcgggaatctctctaagcttcgatatcttgacttgagccacaattatttccttggagaag

SEQ ID NO: 66888 - DNA, 204 bp, Glycine max
  Peptide Sequence Number=SeqID_183666
cttgggaggattgatggggacccggtgttgagaaaaacgaggatatgggctacgtgggagtacgtgagctcagttggaggtgggcaacaggggatgagtggtacctggagatatgtcgcgggggtcaggagaccttggggacgtcaggtggggtgctattgcccaaaaccaagcttgaccaatcccgacccaacccgggcatag

SEQ ID NO: 66889 - DNA, 1338 bp, Glycine max
  Peptide Sequence Number=SeqID_183667
atggccgggatctatggcagcacggtgctgcgcgacatgcatcagcgcgaactgcataacgccaccctgaccagccagctgctgtttctcaatcgcgccagtttagtgatggcatcgggaaccacggcggcgaaagcggctgtagcgaccgatgccccggccgatagcgactgggcgccgctgcgtaccgccctcaccgcatcgccggctgactttgcggtgcctgcggctgagcgcctgcatttcctgcagcgcgacatcgcagcgaataaccatgccgaccagtccgatcgccagcgtctgcaaatggcctttggcattgctgcactgctgatgctcgcgctgctgctgttctgtgaccgttttctggtcacgcatctggtacggccgctgggggcgctgcgggaacatttccgcggcatcgccgctggcgatcttacgcgggaaccgcaggattttggccgcaactgtgtgggtcagctgattccgctggtcaggctgatgcagcagagcctgctgaccacggtgcgtgccgtgcatgacaacaccgacgtgctacgcaaggagtctgcggatatcgccagcggcaatgccgatctgtccgaccgcaccacccgccaggcggctgcgctcgagcagacctcggccagcatggagcagcttagcgccaccgtagagaaaaatgcccacagcgcgggcgaagcgcgcgagctggctgaggatgcggcgcgcaccacgcgcgacggcgaagcgctggtgaaaagcgtgtcagcgatgatggccgatatcgccgccgaggccgataaaatccgtcagttcaccgccacggttaacagcatcgcatttcagaccaatattctggcactgaacgcggctgttgaagccgctcgcgccggtgagcagggacgcggctttgccgtggtggcagctgaagtgcgcacgctggcacaacgcagcgccagcgccgcgaaggagatcgaagggctgattaatggcaccgtgacgcgcgttggcgagggagcgcagaccgcgcagcgcgccggcgccatcatggacagcgccacgcaaagcgtttccgccgtcacgtcgctgattggccagattgcgctggcgtcagacgaacagagcaaaggcattgcccaggttacgctggccgtgaccgatctggatcgcgttacccagcagaatgccgctctggtgaaagagatcgccacctcggccggcagcctgaatggccgtaccggaacgctggctgcgcccaccgcccggggctcaatccgggttacaacatccggcaccggcaccgctgctgttgcggccagccttgccagcctctga

SEQ ID NO: 66890 - DNA, 908 bp, Glycine max
  Peptide Sequence Number=SeqID_183668
atggcggccatgcacgccgattcggtgatggtaggcggcgcggcaatgtatccacaaaaaaacattattgaaaacgccctgaactcgaaggatcacactacgctggtcgccgccgttaaagccgcgggtctggtcgataccttacagggcaaaggcccgtttacggtgtttgcgccgactaacgccgcctttgccaaactgcctgccggcaccgttgatgcactactcaaaccagaaaacaaagccaaactcaccagcgtgctgacctaccatgtggtcgccggtaaatatgatatgaaagcgctggagcaaaaaattaaacagggtggcggtaaagccgaattgaaaacggtgaatggtcagccgctgtggattatgagcaacgggccacacaatattcagctgaaagatggtcagggtaatgtggcaaatatcagcacttatgatgtaaaccagaaaaatggcgtcattgacgctgagcaacaaatagccttaatacaggcggtcgcgaagcgcgatcgcctggcttttgaacagctgtaccggctgacttccccgcatctgtttgcggtagcgctgcgcatgttacgccagcgggcgtgggcggaagagattctgcatgaatgctacatcacggtctggcacaacgccgccggctatgccagacaattccatgccgacgaggcctggctcgacgatttaagcagcacgccggtgaacagcgccagtcgattgcgctggcctattatcagggcttatcacatagcgacattgccgggtggctgcagcagccggtcggctcggttaaaagctggattcgacgtggcctggaccatctgcgggacgcagactgcaggccgagccggtgctggcggcgcaggtcgcccgctggcagacgctgctggcgg

SEQ ID NO: 66891 - DNA, 786 bp, Glycine max
  Peptide Sequence Number=SeqID_183669
accatcacgctggataagctcgacgccagcatcaacggtcaggaaggcctgacgctggagaagctggacgggaagtcctcgttcgacaacaaagacggcaagattggcggccagattgattatcaggttgatagcatcagcctgcaaaaacagccgttcggcgaagccaaactggcgatgaaatttgcgcagtttgatgctcaggcggtgaaaaccttctctgaccagtacaatgcgcagatgcaggatctgctgaaccagcctggcgtggtggacgatcctatccgctaccaggccagcgtgcagaccattctgagaaataacctgccgaccctgctgaaaggttcaccgaccgtgagcgtggcaccgctgagctggaaaaatgacaaaggcgagagcacgttcaaccttaacgtcggttttaacgatccggcgaccgtcaccggtgaaccgcagagtctgggtgccgccgtggatcgcgtgctgaaaacgctcgacggcaagctgagcatcaatatgccgatggcgaccgaagtgatgcgtcacgtcgggctggcggaaggttatcagggtgatgacgcgcagaagctggccgatcagcaggtgaaaggtctggcggcgatgggtcagatgttccgtctgacgcagcagcaggacgataacatcactaccagcctgcaatacgctaacggtcaggtcaccatgaatggcgacaaaatgacgctggagcagttcctgtcgcgctacatgttaggcgcgccaaccagcgaaggcatgccagagtaa

SEQ ID NO: 66892 - DNA, 206 bp, Glycine max
  Peptide Sequence Number=SeqID_183670
gtggccttgttggtgcttgtgcgcttagcacaactctagactgcttagcgcgcattagtgaatttcgtcttaacgcgtgtcttttcgctcagcagatggacttaagcggtgcgcttagcgggattagccttcgctcagtgaacatgcacagctcatccttcttccagattcttcctcgcgctcagccaaaggagtggtgcacttag

SEQ ID NO: 66893 - DNA, 358 bp, Glycine max
  Peptide Sequence Number=SeqID_183671
gaacgaggataagggctacgtgggagtacgtgagctcatttggaggtgggcaacaagggatggtgggttatacgtgatttgtggatgtggagaattgttgtgcaccattgcccgaccgccacctagtaccacatgtgatggaatggtacctggagatatgtcgcaggggtcaggagaccttggggacgtcaggcgagctcctgacagtcaacagataaaaggaacaaagaccacaaagcaaggaggcttgtgtggtggctggccagctgtgaattttgtgcttgaaaacgaggtcaggaagctaggagagcttctggtaatcgattaccaacggggtgtaatcgattaccaggcttag

SEQ ID NO: 66894 - DNA, 315 bp, Glycine max
  Peptide Sequence Number=SeqID_183672
atgggggtgcaaatagcaaccaggcccacttgggccatccagaagattcctccagaaggcggttgcttctggaggaagccaccttgctcgcctgggcgagctagggggagaagtgaagtagaaaagggttcagccctccgggtaattcagaatcacttaaaattgctgagaaaaattatttccgtgaagaaaatccaagccgaggcacttccgaaacgtttccgtaacatttccgtgagtaattacgcgaagattctcgaccgttcttcaacattcatcgttcgttcttcgttttcttcagtcttcaacgggtaa

SEQ ID NO: 66895 - DNA, 196 bp, Glycine max
  Peptide Sequence Number=SeqID_183673
gttccgctggcagggaggttcactggtcgaatggtgtttcgctcgaatgaaattagtgtcttatctttacttcccttttatctccaataaaagtaaagaggggcaactgtcataccctaatttcgtccggggaccaaccattgttgggatgcgaccctcgtttgaccacttcgaggtatttggcacccatcgttag

SEQ ID NO: 66896 - DNA, 872 bp, Glycine max
  Peptide Sequence Number=SeqID_183674
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccacgcgtggttagagaggagaaatacggtggctagaatacataattacaccgttaattttggacctcaacatcccgctgcgcacggcgtgttgccttattttggagctagaaggcgaaagaattttacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 66897 - DNA, 504 bp, Glycine max
  Peptide Sequence Number=SeqID_183675
atggatgatgaagttccactacaagcacctccttcacccatccaccttgatcacttcattcatcaaggaccacctgccattgaccccaatctctccaaagaagaccttgcacggttatggtttcctatggcctttctctctgagaatgcttataacattcaaaagaggattgaagtccttcctccaccaatttggaagcatcttcaccctatgatatccaagcctacatctgcagcagccctgcacaaaagtgtgtacaagatttcatccagggcctatagagaaatagtgcaatatgataaagatatcattggcttgtgtagaaagattaatgctcaacagattgacccatcttttgatgactttgtaccaccattcttgcatccaaagaacatacaacttttcactcccatgtctcaattcgttcctttagtctatgaccatcaagccattccactgactaaggaagacatcttcaatattgggatgattctgatgcaatga

SEQ ID NO: 66898 - DNA, 342 bp, Glycine max
  Peptide Sequence Number=SeqID_183676
atgccaaatagagttgctctaaggttgcctccattggatctccaaaaaaggaagggaaatgtgctccctcacagcaaaccgatgcctcattctggtcctaaggataacttagccttgcatccaattccctatgattgggacaagtattttactagggatgctgcaaccaagaccttcactctaaagccagacattgagttaaaccagaataatgccttgctcttttatttcaaagacatgtatgaaaaactcacatcttgcatccacttcaaagtacgacaaggaagacacctccaatcacatgcatatggtgcagatcctacgtccaacaaagatctatag

SEQ ID NO: 66899 - DNA, 237 bp, Glycine max
  Peptide Sequence Number=SeqID_183677
atgcggggttacattatggttacccgcacctttcgtcaaccaggggaaaacgagcccgttgatgctcgaagactaacatcgtcttctgcaccttttgtcgtcctgacccgtgaagtcagtgacatgcggggtgactttatggttactcgcacctttcgtcaaccaggggcaaacgaacccgttgacgcaaggagattaacatcgtcttcggcaccttttgtcgtcctgacccgtgaa

SEQ ID NO: 66900 - DNA, 760 bp, Glycine max
  Peptide Sequence Number=SeqID_183678
atgacgaatttcagaatccgtcttaaagtatttatgtccagagagaatattgaggtagactctcttacagatctatatgccggagcgaactggatggaaagggaaacctatgatttctttggaatcaaattcaagggacatccggatctgagacctattttaaatatggaagatcttggttaccacccgatgctgaaggaatatcgtcttgaggatgataactcattatctaatatacttaaccaatacgaaagtaaggagcagattgacggtcagttgtataccctcaatttaggtccgactcaccctgctactcacgggatcttccagaacgttttaacgatggatggggaaagaattcttcatgctgagcaaaccgtaggttacatccaccgggcatttgaaaaaatttctgaaagaagaaattatacccagattaccacccttaccgaccgtatgaattattgttctgctccgattaacaatctgggctggcatatgacggttgagaaactgataggaattgaagttccaaagcgtgtggattatatccgggtaattcttatggaattagcaaggatcggggatcacctgatctgtaacggagtaactggtatggactctggagcaattaccggacttacttatatgttcatcgaaagagaacgtatttatgatatttacgaacagatctgtggtgcgagaatgacaaccaatatgggaagaatcggaggtttcgaaagagatcttacaccgaaat

SEQ ID NO: 66901 - DNA, 841 bp, Glycine max
  Peptide Sequence Number=SeqID_183679
atgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtgatgtgtttcggttagatctttcaagcaattcattctctgaatccatgaatgactttttatgtaacgatcaggacgagccaatgcaattagaatttctgaatcttgcatcaaataatttgtcaggagagatacctgattgctggatgaattggacacttctggtggatgtaaatttacaaagcaaccattttgttgggaacttaccccaatccatgggttccttggcagagctgcagtctttacaaattcgtaacaacacactctctggaatatttccaaccagtttgaagaagaataaccaattgatatccttggaccttggggaaaataatctttcaggaactattccaacatgggttggagaaaacctcttaaatgtgaaaatcctccgccttcgatcaaacagttttgccggccacattccaagtgaaatatgtcagatgagtcatcttcaggttttagaccttgcacaaaacaatctgtctggcaatatacggagctgtttcagtaacttgagtgccatgacactaatgaaccaaagtacagatcctcgtatctattctcaagcacaatctagtatgccttactcttcgatgcaaagtatagttagtgctctactatggctgaaaggaagaggagatgagtacagaaactttctgggtttggtaacaagcattgatctgtcaa

SEQ ID NO: 66902 - DNA, 266 bp, Glycine max
  Peptide Sequence Number=SeqID_183680
caatttcttcctggtatggtagtggagaaggaaacactgtcaatgtcaccacaagaaggtcaaacaataaagggtttcgtcttttttggagtttcaaaccgtgtatcgatgggtttcaatattgcaaacctatggttaaggtcgatggaacatcgttgtacaataagtacaaggggaccctccttgtgaaagttacacaagatgacaacaataaaatccttcgaattgcctttgctgttgtcgatagtgaaacaacgggagcatga

SEQ ID NO: 66903 - DNA, 294 bp, Glycine max
  Peptide Sequence Number=SeqID_183681
atgacggacatcactgacgacatagcggaggaaatctccttccagggcttcgaagatgactgtaaattgctagggaaccttctcaacgacattctccagagggaggctggctccaccttcgttgacaagctcgaaaaaattcgagtcctttcacagtctttggttttgttcggttgtggaggaaatgggcgaaggttgaaacatgacatgcgtaatgcgcatgcatgtggggttcttgttttatgcaaagactcaaataatgacggagctaaacctcttatgctggaaatttaa

SEQ ID NO: 66904 - DNA, 378 bp, Glycine max
  Peptide Sequence Number=SeqID_183682
atgcttgctttccccttccagaatgttgcgaaactttatcgattacgcaacaaagcttgtttggacttccggaatgttgcaaaactttatggattatgcaacaatgcttgctttgactttcagattgttgcagaacttcacggattatgcaacaatgcttggtttgacttctggagtgttacgaaactttacggattatgcaacaaagcttattttgactttcggagagaccagacaaagttcgcaagccgaccgccagtgtccccggacgaaattaggaaagagcagaaaggcagcaggaaagtcagtacaaacctcagtgccttggaagcggtaaaaccggatgtccaagatgtccccgcatgccatcaaacttga

SEQ ID NO: 66905 - DNA, 597 bp, Glycine max
  Peptide Sequence Number=SeqID_183683
atgaaaacatcatcaccttcaactcttgccctagttttattctatctttgcaacatcttttacttagaggctttcaatggtggctttagtgtggagatgatccaccgtgactcatcaagatcaccattctttagtcccacagaaactcaattccaacgagttgctaatgccgtgcatcgttccattaaccgtgccaatcatttgaaccaatcttttgtctctccaaactcacctgagaccactgttatatcagctctaggtgaatacctcattagttattcagtaggaaccccatcactccaggtctttggaattcttgatacgggtagtgacatcatttggctgcaatgccaaccatgtaaaaaatgctacgaacaaaccactcctatatttgattcttcaaaatcccaaacatacaaaaccctaccttgcccttctaatacatgtcaatctgttcaaggtaccttttgctcctctaggaaacattgtttatatagcattcattatgtggatgggtcacagtcactaggagatcttagtgtggagaccctcactttaggctccaccaatggctctcctgtccaatttcctggaact

SEQ ID NO: 66906 - DNA, 1281 bp, Glycine max
  Peptide Sequence Number=SeqID_183684
atgaagagagagtgggcaagagaaagtgaatgggaggaaaggaaacgagcaaggagaacatgtaatcgtggcaaaaacaatgaacacctagatcgtagagggaaaggggagagcgagaaagataatgggaatgtggagatgatccaccgtgactcatcaagatcaccattctttcgtcccacagaaactcaattccaacgagttgctaatgccgtccatcgttccgtcaatcgtgccaatcatttccacaaagctcataaggccgctaaggccactataacacaaaatgatggtagtgacatgatttggttgcagtgtaaaccttgtgaaaaatgttacaaccaaaccactcgtatatttgatccttcaaaatctaacacatacaaaatccttcccttttcttctactacatgtcaatctgttgaagatacctcttgttcctctgataataggaaaatgtgtgaatatactatttactatggggatggatcatactcacaaggagaccttagtgtggaaaccctaactttaggctccaccaatggctcttctgtcaaatttcgtagaaccgtgataggttgtggacgtaacaatactgtctcctttgaaggcaaaagctcgggcatagttggcctaggaaatggacctgtgtcgctaataaatcaattgagacgtcgttcttcttcaataggtagaaagttttcctattgtttggcttcaatgtctaacatatctagcaaactcaattttggagatgctgcagtggtttctggggatgggactgtctcaactccaatagtcacacatgacccaaaagtattttactacctaaccttggaagcattcagtgtgggaaacaatagaatagagtttacaagctcctcatttagatttggtgaaaagggaaatatcataattgactcaggtacaacactcactcttttgccaaatgatatttactcaaagttggaatcagcagtagcagatctggttgaattagaccgtgttaaggatccacttaaacagttgagcctttgctacagaagtacttttgatgaactaaatgcaccagtgatcatggcacattttagtggtgcagatgtcaagttaaatgctgtcaacacctttatcgaagtggaacaaggggtaacatgcttggctttcatttctagtaaaattggtcccatctttgggaacatggctcagcaaaacttcttggttggctatgatcttcaaaagaaaattgtctcctttaagcccacagattgcagcaagcagtga

SEQ ID NO: 66907 - DNA, 182 bp, Glycine max
  Peptide Sequence Number=SeqID_183685
atgtcactttaaatgctatcaacacctttgttcaagtggccgatgatgtagtgtgctttgctttccagccaactgaaactggtgccgtctttgggaacttggctcagcaaaacctcttggttggttatgatctccaaatgaacaccgtgtcctttaagcacacagattgcactaagcaatga

SEQ ID NO: 66908 - DNA, 213 bp, Glycine max
  Peptide Sequence Number=SeqID_183686
atggcaatcaacaacacaagacacccgattggaaaagacatgggatacaatgatggagatgggagtagaatgtggtggtgttgggtggttctaggttttgtgagagggaagttgccgcctctggcgtgctactgcactatgttgagcatgtcatcaagtggggtagtatcaggatggtacggtgtgttgggtaatcaatactcctacaaataa

SEQ ID NO: 66909 - DNA, 1158 bp, Glycine max
  Peptide Sequence Number=SeqID_183687
atggtcatgcgccgcaaggaaataaaagattatggcacttctaaagctattgaaggagatttcaagcatggccaaagttgcttgataattgaggatctagttactagtggcacatcagttttggaaactgctgcaccactgcgtgccacagggttgaaggtcagtgatactgtggttttgattgatagagagcaaggtgggagagagaatttggagagtaatggaatcaagctgcatgcaattctcaaattgactgaaatggtgaaaattttgagggaaaaaggaaagcttgataagcagatgctaggggttgttatgagattcttagaagagaatcaaaaggtcgctgctttggcaactacagctaaggtcaaggccttcacatttatggagagggctaagttgtccaagaatccaacaggaaagaggttgtttgagataatggccaagaaggagagtaatctgtgtttggctgcagatgttggaactgcagctgaattgcttgaaattgctgacaaggttgggcctgagatatgcttgctgaaaactcacgttgatattttacctgattttactcctgatttcggttctaagcttcgcttgattgcagaaaaacataacttcttaatctttgaggatcgtaagtttgctgacattggtaacacggtgaccatgcaatatgaaggaggaatctttcatatattggaatgggctgatatagtaaatgctcacattatatctggtcctggaattgtggaaggactgaagttgaagggtttgcctcgtggaaggggtctattgctgcttgctgaaatgagttcagctggtaaccttgccaagggagattacaccactgctgcggtgaaaattgctgaggatcactctgactttgttattggcttcatctcagtcaatcctgcatcatggcctggagcacccataaatccctcttttgttcatgcaactcctggagttcaaatggtgactggtggtgatgctttaggacaacaatatagtacaccgcattctgttgtctatgatgggggtagtgacattatcatagtaggtcgtggcatcatcaaggcagcaaatccagctcaggcagctcgcgaataccgtcttcaaggatggaatgcgtatttggctaagtgcagctga

SEQ ID NO: 66910 - DNA, 1062 bp, Glycine max
  Peptide Sequence Number=SeqID_183688
atggcatcaagcaatctattctttgatgatatacggagcaaagtcgatgttgatcctcctcaaaatgaagagtcaacagatgttggtgaattattaaatgatcctgcccaaactgctcttaaacctaatgggactgtttcaagcagtgttcgtgagcttttagagtgccctgtatgcctgaatgccatgtaccctccaatccatcagtgttcaaatggtcacactatatgctcaggttgcaaacccagggtccataaccggtgccctacttgtaggcacgagcttggcaatatcagatgcctggcactggagaaagtggctgcgtctttggaacttccctgtaaatatcaaggttttgggtgcatcggtatatatccatattacagcaagctaaaacatgaatcgcaatgtgcacatagaccttacaactgtccatatgctggttcggaatgctctattatgggtgacataccctacctggtggcccatctgaaagatgaccataaagtggacatgcacaatggtagcacttttaatcatcgctacgtcaaatcaaatccacaagaagttgaaaatgccacatggatgttgacggtcttcagctgctttggtcagtatttttgtctacattttgaagcttttcaactaggaatggctcctgtctacatagcctttttgcggtttatgggtgatgatgatgaggcaaagaattatagctacagtttagaggtaggtggaaatgggaggaagatgatttggcagggggtgcctagaagcatcagggacagccaccgcaaggttcgtgacagttttgatggtctcatcattcagaggaatatggccctctttttttccggtggtgaccggaaggaattgaagctaagggttactgttgctagaaaatgggagcttcatcaaatggatgttcataatggcttcttgcatatggaccttgaagaggagaagtgttcttggttgacagttgtgaaaataagggatttcaaccaggtagtacctgactttggaaagctggcaacaaggacatcactttctttcccttga

SEQ ID NO: 66911 - DNA, 177 bp, Glycine max
  Peptide Sequence Number=SeqID_183689
atggatatgccattgcaatttgcaacctcttggccaccattgacgtttattcattttgagaagcaactgacatatggctggtcacagattgtagcaccatattttcctttgggtttcagatattggaggcccgttgggttccaaatattagaggccagatatgtctatacaacatga

SEQ ID NO: 66912 - DNA, 726 bp, Glycine max
  Peptide Sequence Number=SeqID_183690
atgcagcaatttgtcgactgtgatgacaatttgtcatgccccattatcccatctcaaggaagaagcatatcacttgctcttgctcagagtagcacttcatactacaattcttttatggacaagaaaccatctgaaaaacaacaaagcaaacatcgtattgggaacgcattccgaaacagctggggaagaaaagattctgagcacaaggctgcaaagaagagtacctctttggcaggtatggttgaatttgttgggctgattaaggttaatgtggttaaaggcactcacctagccattcgagatgtaatgactagtgacccttatgtcatcctttctttgggtcaccaatcagtaaaaacacgtgtcataaagagcaatttgaatccggtttggaatgagagcctaatgctatcaattccagagaacattcctcctctaaaagtgcttgtgtatgacaaggatacattttcaactgatgattttatgggggaggctgaaatagacattcaacctctagttattgccgcaaaggcctacgagaaatcgaatattaatgagtccatgcaacttgggaaatttgtagcaagcaacgacaacacccttgttagagatggtatcatatctcttgatgaagggaaaatcaaacaggaaatctcagttaggctacaaaatattgagaggggtgagttggagcttgagcttgagtgtgttccccttactcaatag

SEQ ID NO: 66913 - DNA, 549 bp, Glycine max
  Peptide Sequence Number=SeqID_183691
atgaccatcccagagcttttcttgaggccttaccaggttacatgggatgccaccatttttggggtctttaatccaaacttcccgctctacataaagcacgaagacctctccaaaattgcacacggttgtcaatgtctcagcatattagtgcatctgacggaaagaagtatgcgagtggggaattctgatatctatggattcctcgagccacagtccattcagaggtttgggcaatcgcagtttgagactaaaagttacataaagagttggatgcagagttcaaaatgcgatgtctaccttggagcctacctgaatggtggacactggcagatggtggtcatcttgcccaaggaacacctagttgtctggttttgttcattgcataacaggccaaacaactaccttaaggggatcaataacagacaaaaaggaagtactgagtgcggcttttatgtcatgcactggatgtccatcatcattttaggaagtttcaggaataactggaagcgtattttaacgatcctagaccattggagtcagagagattaa

SEQ ID NO: 66914 - DNA, 873 bp, Glycine max
  Peptide Sequence Number=SeqID_183692
atggctgaattcggaaacaacaacaacaacggcgccaacacgacgtcgtcgaggttctccttcttcaaccgttccctcacgacgctccgcaacgaaaaaccgccgcagctggaccgttctgtcacgaagctcgtcgaatcttcgcgcggcggcggcggcggcggcagcgtcgtcaagcgcctttgcagcttcttcgaatccgcaaaatcttcctcttctgaacatcaaaaactcaaaccctcgaaatcgatcgaaaactcggatccctcggtaaaatcgctcgattcgccggcgaaatcaatcgattcctcgccggcgattcgattacctggaaccgaggatcggatcgtgttgtatttcactagcttgcgtggaattcgaagaacctacgaagattgctacgcggttcggatgatatttcggggatttagggtttgggttgacgagcgcgacatttcgatggacgcaaattaccgtaaggagttgatgagcgtgttgtttggagagaataacaacaacaacaacaaaaagaagggacacgtggcgcttccgcaggtttttataagggggcggcacgtggggggtgctgacgtcatcaagcacatgtgggaggtgggggagctggagaaggttctggaagggttgcccagaacgaagggtgggttcgtttgtgagagttgtggtgatgtgaggtttgtgccgtgtgggaactgcagtgggagtaggaaggtgtttgatgaggatgaaggggtgttgaagagatgcggttccttacatgattctggtgttgttgtccggtcagtgttggagtttcaaatcaacttggattaccgtagtgaagctcagaattggggtttcatgtgtgtaatagag

SEQ ID NO: 66915 - DNA, 987 bp, Glycine max
  Peptide Sequence Number=SeqID_183693
atgacttcaatgggtggaatacaagagaatgaagatgaaaaactaattctctcccttcccaaagagaaaccatgggcacaaccttatgatctttatctattccaaaatttttggtgcccaggaattcatattcaagcagtaaaccgttttcaaaaatactttgaagcagtaaaagatagcgatgttgtggttgctagctttccaaaatcaggcactatatggataaaagcccttactttttccattgccaaccaccatcgtttttcccccttagagaatcatccattactcactacaaatcctcatgaacttgtgcctttccttgaattttcatttggtggtaatattcaagaccaaattcttcacctatccaacatgactgagccaagaatttttggtacgcatactccattcacttcattacccaaatcaatcaaggagtctaattgcaagctagtttatatttgtagggatccctttgacaattttgtttctgcatggaattactttaataaggttaagccaatgtctcttcctgcattgacaatggaagaagcttttgaaaagtattgcaatgggataatggattatggtccatggtggagtcatatgttaggttattggaatgagagcatagccaacccaaacaaagttttgttcttgaagtatgaggatctcaaagaggacacacacttccatgtcaaaagaattgcaaagttcttgggttgtcctttcactcaagaagaagagagtaatggagtaattcaaagcataatcaagctatgtagttttgagaatatgaagagtttggaagtgaataagtcaggaaaaataggcagaggaaacattgagaaaaaagactttttccgcaagggagagaaaggagattgggtaaactattttaccccttctatgcaagaaaagttatcagcaattgtggaagaaaaattaagtggatcaggtctatcatttaaaaagtgtttttag

SEQ ID NO: 66916 - DNA, 397 bp, Glycine max
  Peptide Sequence Number=SeqID_183694
atggcttcaatgggtgggatacaagaaaatgaagatgaaaaactaattctctcccttcccaaagagaaaccttgggcacaaccctatgatctttatctattccaaaatttttggtgcccgggaattcatattcaagcagtaaatcgttttcaaaaatactttgaagcagtaaaagatagcgatgttgtggttgctagctttccaaaatcaggcactatatggataaaagcccttactttttccattgccaaccaccatcgtttcccctctttagagaaccatccattactcactacaaatcctcatgaacttgtgcctttccttgaattttcatttggtggtaatattcaagaccaaattcttcacctatccaacatgactgagccaagaatttttg

SEQ ID NO: 66917 - DNA, 780 bp, Glycine max
  Peptide Sequence Number=SeqID_183695
atgactgttatgcatgatggcgggagggaaatctttggcagtaaagtagttacaagactagaagacaagtgcagcagtgatgagaaattgagcatgctgaggtggtcgattcactggagagaaagattagaggagatgatgattgagctcacagtgatattcatggtgcaaaaagaatacggaagcttactcaaaggaaagcggttgattatacaagcacagttgtgcgttatatgcagcgggattcaagggataggacagtactgcaacccacgtcggcagcagcaattgatgtcaatgttgccagcagttggctatccagacaatccatccacaagctttgctgctaaatttgttcatacatctctaaataaaaatcgttgcccaattaatcgtgttctttggactccaacaggccggcgacttattaccggttcacagactggggaattcactctttggaatggacaatcttttaattttgaaatgattcttcaggcacatgatcaagcaatcagatccatggtctggagtcataatgacaactggatggtctctggtgatgatggaggcgcaataaagtattggcagaacaacatgaacaatgttaaagccaacaaatctgctcataaagaatcagtccgtgacttaagtttctgtaggacagatttgaagttctgctcgtgctctgatgataccacagttaaagtttgggattttgcacgctgtcaagaagagtgttcattaaccggtaatgtgctttggatggaccatatctga

SEQ ID NO: 66918 - DNA, 468 bp, Glycine max
  Peptide Sequence Number=SeqID_183696
atgtctcttcctgcattgacaatggaagaagcttttgaaaagtattgcaatgggataatggattatggtccatggtggagtcatatgttaggttattggaatgagagcatagccaacccaaacaaagttttgtttttgaagtatgaggatctcaaagaggacacaaacttccatgtcaaaagaattgcagagttcttgggttgtcctttcactcaaaaagaggagagtagtggagtaattcaaagcataatcaagctctgtagttttgagaatatgaaggatttggaagtgaataagtcaggaaaaatagggagaggaggcattgagaaaaaagactttttccgcaagggagagaaaggagattgggtaaactactttaccccttctatgcaagaaaagttatctgcaatcgtggaagaaaaattaagtggatcaggtgccattctagagatatggggctacctttag

SEQ ID NO: 66919 - DNA, 141 bp, Glycine max
  Peptide Sequence Number=SeqID_183697
atggactggtggcagcattggaatggagatggggatgagagaatcatggaaaaggaggagagggagaatggttatttggaggagggagtaactgaagagggaggttaccccactgatttagctataattcagtatcaataa

SEQ ID NO: 66920 - DNA, 318 bp, Glycine max
  Peptide Sequence Number=SeqID_183698
ccaggccatggttgggatgtgaagagtgttgactggcatcctacaaaatctctattagtatcaggtgggaaggacaatctagtgaagctttgggatgctaaaacagggagagagctttgttcattttttatacttgtgtcatgcagtcatggccacaaaaacactgtgctgtgtgtcaaatggaatcaaaatggcaactgggtgctaacagcttcaaaggatcaaataataaagctttatgacataagagcaatgaaggaacttgaatcgttccgtgggcatcgcaaggatgttactatggttaactgcggtggttag

SEQ ID NO: 66921 - DNA, 628 bp, Glycine max
  Peptide Sequence Number=SeqID_183699
tggcagcagtgatcatacaacaaagttttggtgcagaaataggccaggagaccctgctcgtgatagatttaacactggcatgcaaggatatgctgagcaaagtcctgttgctggtcggacaggtggtaattttccaatagctgaaggcccaacaactccaggaccatttgcccctgggttgactcgaaatgagggtaccattccaggtgttggagttgcaatgcccttatctattccttctcttgacatgcctcaaggggagcagaagcagccccatcctgtttcaatgggtgctcctcctcttcccccaggtccacatccctccctaattaatgccaaccaacagcaaccataccaacagaatcctcagcagatgccacaacatcaacaccaggctctaccacagcagatgggttctttgcctatgcctccaaatatgcaacaactacagcacccttcccattcacccttcccaaatatgcctcgccctccaccccaaatgcctattggcatgccaggatctataccagggatttcatcagtgcctacatcacatccaatgccaatgccaggtccaatgaagatatgtatcgaaaatagtggaaacttaggaagcccagatacatag

SEQ ID NO: 66922 - DNA, 348 bp, Glycine max
  Peptide Sequence Number=SeqID_183700
atgaggagggaaaaggttggctgtgatgaagtagttctaaaaggaaggataagaagaagaaggttactttccgcaaggaaatctttgtcgttacaacaagagcataagaataagcattataagactagagggaaagttgccaacgaggaggaagttaccagcttcaaaactacgagtttggggcagcaaccacagagaatgaagcagagttcactggctgcaaagcgtaagagattactttggacagcagaagaagaaaaagttctcaagctaaaattcaaccagggctatggtgggagtgggatggaagttttaattatatctgcacaagaaaacagaccagagtag

SEQ ID NO: 66923 - DNA, 282 bp, Glycine max
  Peptide Sequence Number=SeqID_183701
atgctgtggttgatgaagcagaacaaaatcagaaatcgatatctgaaagcttggctagatgatgtcaaagatgctgtgtttgaagcagaggacctcttggacgaaatagacatcaaagtcaacaaacgtgatatgagagtaacagtagttagatcaagtactattgtaaaaaccaccagcagaattgtcttcgtaggcaagatagaccttgtttcctttctcatcaggggtatactgttatgtgagtatgaagattgcaatgagcagccagcccaatgttaa

SEQ ID NO: 66924 - DNA, 633 bp, Glycine max
  Peptide Sequence Number=SeqID_183702
ggtggacccttgggtactagtacccacaccttcagagggctacacaccctcgcctttagagggctacacgccctcgcctttagagggctacacgccctcgccttcagagggctacacgcccttgcctttacagggctgcacgccctcgcctttacagggctgcacgccctcgccttcagagggctacaggtcatcgccttcagaggactgcacgtcctcgcctttagaggactgcacatcctatccttcagaggactacaggtcctcgccttcagaggactacatgtcctcgccttcagaggactacacatcctcaccttcagaggactacacgtccacaccttcagagggctacacgctctcaccttcagaggactacacgtccttgccttcaaagggttgcacgccctcacctttagaggattgcacgtccttgccatcagagggctacgcgccctcaccttcagagggctacacgctcccacctcaccttcagaggactacacatcctcactttcagagggctgcatgtcctcgcctttgttaggctacacgccctcaccttcagaggactacacatcatcgccttcagagggctacacattgttagacaagtggcctcagatatcttaa

SEQ ID NO: 66925 - DNA, 179 bp, Glycine max
  Peptide Sequence Number=SeqID_183703
ggactgaagctggaagtggagtcgctcaaatacggcgtcaacggcacgctgcggctgggcgtgatgccgcagtgcagcgtggcgctgccggcgttattgaaagcggtggaagcgcgctatccgcaactcgactatcgcgtttccgccatgagcgccgatcaactgctggaagcgcttaa

SEQ ID NO: 66926 - DNA, 687 bp, Glycine max
  Peptide Sequence Number=SeqID_183704
atggccggactcgacgacgctgtctggctgttggtgcacgatgcccaggcgctatatggctgggcgacgctgcgtcagcggcttgaggcttatggtggggaagaggaacagctggcgcaggcagtcagcgcgcgcgtgctgggctgccgacgccagttcgcgcagctggcgaacggctggcgcacgcgtttgctgcacgatgtggatcaggccagcgatgacaacctgacgcagcaggtgatcgcgctgagcgcccagcttacccggctgccggagcgcttcagtgctgcccatctgcagccgctgttaaacgcgggctggggcagcgagcgcctaagtgctgcgacagcggcgacgccctgcccggctcggcaatcaccagcgccgcctggcgtcccatcggcgcgatatcaatcggccggcgcgccagatggtgcagcatttccgctgcatcaccgaggcgctttctacaatcacccgcggcagcacgccggtttcacgcagctgtccgtcaaggtaacgccggaaatagcgcgtgggctcggccaggcacagcggctggctcgccagcgtgtgcagcgacagccgctcatgctgcagcagcgccgggaaatgatcgggatggaaaatggcttcgacgccgcgatcgttgagcagcgcggtctggaaatgcagttcccgcagtga

SEQ ID NO: 66927 - DNA, 289 bp, Glycine max
  Peptide Sequence Number=SeqID_183705
atggagaaatctgaaaagaagctgaagaaggcctacatcacatgggatgacaatgatatggaatcatctgaggattcagaaaatgaagtgataaacctgtgtctaatggctaaaagttatgaaagtgatgaagaggtatctttgaagaagaaatggtacatagatagcggatgttcaaaacatatgacgggagatgcatcaaagttcacacatatctctcccaagaaaagcaaacatgtaacttatggtgacaaaaacaaaggtagaattcttggagttggaaaaatag

SEQ ID NO: 66928 - DNA, 274 bp, Glycine max
  Peptide Sequence Number=SeqID_183706
agtggtacctggagatatgtcgcgggggtcaggagaccttggggacgtcaggcaagctcctggcagtcaactaataaaagaacaaagtccacaaagcaaggaggcttgtgtggcggctggccaactacgaatcttgagtggtatctggaaattggcctctggtaatcgattaccaagggatgttaagatggcctctggtaatcgattaccaaggagtaacagggcactggtaatcgattaccagttgggtgtaattgattacatagggagatag

SEQ ID NO: 66929 - DNA, 657 bp, Glycine max
  Peptide Sequence Number=SeqID_183707
atgataaaaatcgcgctatttgatgaaaaccgttacttcagcgctggttggcaggaggccctggcgctgcacttcagcacttacggcaagcgcacgctgttactggatgcgcagcaggttcacgaagccgatctggtgttctgctattttcctcccggcgtgcaaagctgtttttgtcacttctttgaggcgcaggctgcggggcgccaaacgctgtatttctcgttgcgaacaccggaggggcggcataaacgcaccgccggcacccgctgcgcgctggaggccggcgtcgtctaccacgatacgccgctggtatcggcgctgtatcaggtgaacgccgagttggagcggcgcagcaaatggccgggcaggccgagttgtggcatgaactgcgtatgccagcaccgaggcctgacgctgcgcgaacaggagatcatgcgctgcatgacgcgggagatgggagtgacgcaaatcgcacggatgctggacatcagcgtgaaaaccgtcagcaatcacaagatgagcgttatgcgcaagatggggttccggcgtaatgccgaactttacggctggctgcggcacagcgcccgtcccggcgccgtgggggcgcgagccggcattcagcctggcattgcggcagggaaggcgcagtactga

SEQ ID NO: 66930 - DNA, 201 bp, Glycine max
  Peptide Sequence Number=SeqID_183708
atggttacgttctcttcgcttggagaagattttggacgtctctgcaaacagtcgtttcatactgataagtacatgaacctcgaagctagattaggtagacgaagagcggggaggtgcctccaagtagtcggagtcggccttggggaacggatggcgtctcagggcccctgctcacctatccggaattgggtcatagactag

SEQ ID NO: 66931 - DNA, 129 bp, Glycine max
  Peptide Sequence Number=SeqID_183709
atggaagtgacaaaacctagggcaaacacgtccttggtccaaggctcgacaaacccaagattcacccttgatgggccctttccattactaagttccatcttcataggaactcaagattatgcttcatga

SEQ ID NO: 66932 - DNA, 708 bp, Glycine max
  Peptide Sequence Number=SeqID_183710
atgcgtagtgattgcttagtgcaattctccatgtgctcaaccctttttcggagccccatgaattgcgttttcgatcaggtgtcctccaccatcgagtttggagctatgcgtactgattgcttagtgcagttctccattctcaaccttttttggagccccatgaattgcgttttcgttcatgtgtcctccacgttcaagtttggagctatgcgtagtgattgcttagtgcaattctccattctcaacctttttcggagacccatgaattgcgttttcgttaatgtgtcatccaccttcgagtttggatctatgcgtagtgattgcttagcacaattctccattctcaacctttttcggagccccatgaattgcgttttcgttcatgtgacctccaccttcaagtttggagctatgcgtagtgattgcttagtgcaattctccattctcaacctttttcggagccccatgaattgcgttttcattcatgtgtcctccaccttcgagtttggagctatgcatagtgattgcttagttcaattctccatcctcaaactttttcggagccccatgaattgcgttttcgttcacgtgtcctccaccttcgagtttggagttatgcgtactgattgcttagtgcaattctccattcgcaacctttttcggagccaccatgaattgcgtttttgttcatgtgacctccaccttcaa

SEQ ID NO: 66933 - DNA, 629 bp, Glycine max
  Peptide Sequence Number=SeqID_183711
atggatatctctaaagatattgacatcccggtaatcttgggaaggtcgttcatgttgattgcaagctgcatagttgacatcgggaatagaaagccggagttaggttttgaagaccagaaaattgatttcgacttgtttgtggaagacaagcctgctctagaacacaatgtttgcttgcagataatgggagaaggtcaagaggttctgaagcgcctcaccaatttcgctgacagtagttttgacctagcattggtgaaggagctctatgccaacctctacagtcctgagggaccttcaccaaaacaagtcagaatacgaggccacttgataaggattggtgcagatagcctcaatgcctttttagaaacacctgtggtgcttgctgaggggttcattctaaatgctgaaggtcacttggggaagatcctcagaaaagatctaaccacccttgctcaggtttggagtgttctatcctactccaacctggctccgacctcccacacatcggatctgactgtggatcgagctaggttaatctttggcctagttactcagctggacatgaatgtcggagccctcatttctgggcagattacttctatggcccagtctaactcctcaagactcgg

SEQ ID NO: 66934 - DNA, 276 bp, Glycine max
  Peptide Sequence Number=SeqID_183712
atggggtttagaataggtagcaaaatacctttggcaatttacactttgggtatgatagcaaaatacttggatgtattagaaataccaagaggtgcacatgtgcaatttttggtaccccaaaatgctttgagtatgcatgtatgtgaatttagccaaggagatgtgtgtgatgaaatggccccgaggaagcttgcctcaaagaggtccaggaaggacaaggcagcagaaggaactagttccgctccggagtatgatagtcaccgctttaggagcgcg

SEQ ID NO: 66935 - DNA, 255 bp, Glycine max
  Peptide Sequence Number=SeqID_183713
atgcaccagctgcagaccctgaggagtatatacagccgcccagcccccaggtcccagtggcatttgaccccctccacatgtgatgattacgacgaatatgaggcgattgcacagaggttggagcgtgtgctcaaccttaggatggtcaacacagagttatatgagattatgcaggactgcctaatgatcgccagagggggagccagtgctgatggaagtgtcagggctcgtcagagacgccgcacagagcattga

SEQ ID NO: 66936 - DNA, 702 bp, Glycine max
  Peptide Sequence Number=SeqID_183714
atgaagggttttggaaaatcccgcatgccctccgagaagggtggtatgaaattccttcaagaggagctcgatgaatgggctatcagggggaagccaaatcttcttgttgaagaaaatgaggtcgcaatccactgtgaagccattgtggtcctcaagatctttcaaactcttatgatccgttcgaatgatgaagtgattgccaagcaagtagtggcgccacttccggactgtcgtcgtgatggcatgagcacaactcccatggcggacccagaagcatttgtttccaatataatagggatggtgaagtctggcgaagctagtactagagcctgtgtcatcaactttttcagggaccactcccttggcagatactatgtgaacaaggtattgaagctagctcctagcgaacaagcacttggaacgacaaagttcgttcatggttgcccgaaatatggatggcatgatgcaaaattcatagtgcccctggtgtgtgcgaaacgcggtcttaggaatgtcttcctcggcaatgcatatttattggaatccctggtggagcctgataatccatgcaacaacgccatatgccatccttcttcttcaccagaagaacatggaccagtcactagagtcatgagcaagaggctccaagaggatttggctagagctgttgaagaaggccctagggttctcatggacctcagg

SEQ ID NO: 66937 - DNA, 672 bp, Glycine max
  Peptide Sequence Number=SeqID_183715
atgtatgtgttgcaattcttgtggactccttatgacacacctgaaataagatttgaatcacagtattatcctggtcatcaccaacatcaatcatatgtagaacccaatgtacctccagtgcatgttcttggatttatgtcccaacatcatccatcacaagcacaatatcaatcaacaagtttttctagtcatgcgtctcaaggatgtcaacaaagttttcaaccactggggttcttatcatgtatacctcaatactcatttcaagtcccttctacctcaaatgttttttatggctcctcacaaatgtttgccaccactttcaacactccaccatctacatataatcttgcatcatcgagttcttgttatcgtccatcattacctactcaaatatgttacatgagtcacgaagatgaggacgagggtgaggataacaacaataacaacgatgacgatgacgatggtgatggtgatgatgatgatgatgatgacaatgatggttatcatgttcctcaacaacaacggataattacacgtgagcatcgtagaacaagaggaggtaaagactgtagaccaagcaaacaacaaacacagacaaatccagtccaacaagataagagacccagacgcatatctagaagaactcgttgtgggacatcgtctcattattag

SEQ ID NO: 66938 - DNA, 402 bp, Glycine max
  Peptide Sequence Number=SeqID_183716
atgaaagttacaggatcttggaagatctcgcggcatagtgcaagcttagcacgagcacgtcatctcgatagatctggtcttggaggcgttgacggcaagcttcttgtcgcggaaagtgagaagaacaaaaagtgcttgctagaggccggggtgccaagggccatgatcatgtttgttgtgaattgttatgaaaagggtcaaatccaaaagggtatcgaagaagctcttagcatattgcaatttgccaagatccccagggaggaatgtgcactactcctaaaggacaatgaccaaatactagattctctaacatggcttctaacccttgatgaaatggaaaactccatggtcataaaatcacatgcggttcaagtgctaaaaaataatcatcaacaaggatga

SEQ ID NO: 66939 - DNA, 264 bp, Glycine max
  Peptide Sequence Number=SeqID_183717
atggatctaggaatcaccgacatagagatccacttcatccatgtgaaattctattcaatcaaggtttatttggagtctgaagtagtaggccacttggagcagttcaaaggaaaatctacaaaggagctggaagataatgatgagttcttcaatgctctcatttctgtaagagggaaatgggagaacagtatgagaagacatacaacttgggctctgcctcagctccttctttgggaaatccttggactgacgttgagattatga

SEQ ID NO: 66940 - DNA, 621 bp, Glycine max
  Peptide Sequence Number=SeqID_183718
atgcgtcgggacatacgcgattttatttccaaatgtcccacctgtcaacagaccaaatacgagacgaaaaagttgacgggtctccttcagactttacccatcccaacaacaccatgggaggacctctcactggattttattacttgtcttcccaaatctcagggctattctactatcttagtggttgttgatcgtttctcaaaaggaacccatttcggtgccctacctccttgccacactgcctactcagtctccctgctcttcttcgatatggctctggctataccgccaaacttcacttgcatccacttacaacaagttgtcaaagcgctattttggttcttttcaggacaaaacacatgttgtccaacccctgaccgtgttggactagaagtggaacaccgatacatctcctccctcaagattggtgttggtccagtgggagggattatcccccgaagaatctacttaggaaacttagaggaactacagaaagcatatgcccttgaggacaaggacatttttcgtgaagggggtgttgatagcaataacaaggatactgggagtaacagacccaaaaagataagcaataggccaacttaccttactgacttcgtgtga

SEQ ID NO: 66941 - DNA, 1002 bp, Glycine max
  Peptide Sequence Number=SeqID_183719
gggtgtaacacttgcttctcaaggaagctttcttccttcaagtattttggcatgggggtgagcttagctattagaggggtgaaaggacatggtcagttgagtatagtcagtggtgacaggacccaagtctttaagccactgcaccccaagcaccacatccatgccgctaaagggcaaggcatagagggcgaggaacttctcaactcgagtctgaataaaattttggctactcccaccgtcaatgaggatgacgatacgatggtggtggatgtccccgtaaacgcggaaggagtaatcgcgtcaggggtgctcaatagagaaggatccaaagtaagggtagggttggcctttagggattacagcggtgaccctatatctattgttcctcgcaatgttagactaagaatgtcggggtcccttacgacgatcgttgagcttgtcttcttgaagcttggcgaggatgaagcagttgaggaggaacgtcgggggcatcgtgggggtcatagtaggaggtggcaaagcatgactctaatgcctgaagcatggcaggccacgtggagaggaacccgttgtgtgtcatccactgataccaacaaagatcctgaccgtcaaaccgaggcacctcaagttttagttgaggatgttggtttagggatggtggtggttgtgccggggaagcattctcgagaggctcaaaccctcattcttcgaaacaatggtaaacattctaagacatcatgggataacacaacaaggggtgaatgtttcacttcatgtcctgttgggagcctcttcgatgacacgacacaaaatcatgatggtggaagttgggccaagtttataagccacgaaaggtccatcgttgtggtgacaaagagaatactaaaggagacgttgagagtggggactgtggcgaagctttgcatggtgcttcaggttgatcatgcaaagtatttaaaggacaaagtgatggagattctcaagtggcactctgaggtttag

SEQ ID NO: 66942 - DNA, 474 bp, Glycine max
  Peptide Sequence Number=SeqID_183720
atgaccggtgtgctgaatttttacagaccatgtggtatattcaaaggagctctgtgtagttcctggacaggtggcggcagtctacatggagtggtgttttcggatatcgcacccttttgtcacatagaccgaggagactgctgggacgagacatccgcctccccctcatcacgaggacttcgtcgagccacccatccccgaggttactaccgaagaagatcagcagaaccttcttccgttggatcacgcggaagatccttcagaagcttcttccgcaggaatccgcagaagaaccttccacacttcttccacgggagttccagaagcccctttcctacgcgcagaagaaggttcttctcgtggaagaaccttcgtcttcaacctccagccattaatgtcgtctatcctaaggttcctacagccatttacaccattcacgctattgaaacagttacgaggaggttagaagactaa

SEQ ID NO: 66943 - DNA, 528 bp, Glycine max
  Peptide Sequence Number=SeqID_183721
atggaggacacgaacaacagcttcttctccaaatttcaaattcagaacgaaatgagggcgaggaggaagaagctcaatgagggcgaggaggaagaacaagcacgaatggagattgctgggtgcacgaggaagaaacaagtgcagaagcaagggtattttcggtacttcattgaattgctgggtgcaccagcaattttgctgggtgcccctagcaacagccccaaaactatatgcatgctgttgaaagtttactgtatattgaaagttttgcatgaagacaagtatagggcgctttgggttttcttttacgtttcaagctctgtttctttcattgtggtccactttctgtcgttcgtggtggtttttgcaagtgttgtaagaggtagcggttcagtgaagatggacaaagatcaatggacgtatgacaatacgatgcctcaagaagttgatatggattatgaaaatgaacaagaatgtggtgtgaatcaaccacatgttgattgttcagatgtttataatactttggag

SEQ ID NO: 66944 - DNA, 357 bp, Glycine max
  Peptide Sequence Number=SeqID_183722
atgatccgcggaagaacgtccgtaggatcttccgtgagaataaaatgtagcctgcggaagaagcttcagcaggatcttccgcgggtccgcggaagacaaggtttttccgctggatcacgcggaagatcttgcagaaccttcttccgttggatcacgcggaagatccttcagaagcttctttcgcaggaatccgcggaagaaccttccacacttcttccgcgggagttccagaagccactttcctacgcgtggaagaaggttcaacctccagccattaatgtcgtctatcctaaggttcctacagccatttacaccattcacgccattgaaacagttacgaggaggttagaagactaa

SEQ ID NO: 66945 - DNA, 1266 bp, Glycine max
  Peptide Sequence Number=SeqID_183723
atggatgtacctggtaagatcttaaatgggtatacaaagaatctacaccgtcctgaagcatccattattgaaaggtacattgcagagaaagctattgaattttgttcaaagtatgttgaaaaggcaaaaccaattgggcttcccgagtctcagcatgacgacagagtggtaggtaaaggttcgcaaggactgcatgttataactttgggactaaaggcattgcaacaagttcatttgtatatactgaataacaataatgaagttctaccatacattgttcgtcatgaagccttggtcaaggaaagtaaccaaaaaatgaccaagaatagggtgtttaaagagtataacaagactttcttaagttggtttaaagctacaatctttggtgacgataatccttttgaaacgttaaggaagttaggagatgggcctaaaagaaatgttataacttggcaaggatacaatatcaacaaattcattctacaccaagtcataagacaacaagagtacaatacaaaacaatgggctaaacaagtgttttacgttcaagatcctattgatgaaagatggtcaatggttctacacagaaaaaccattggtcttaatcttaaagatgatgattcaacccttgatacttgtttttctcctttctccatgcaaatgcctaatgtcaacgaagaagaaaaagttgatgacatcaatgctaatcataataatcatgatgaaggagaattaattaacatctcaacaccttcgtcatcttcgtcgaagaagactagaaaaccaacatggctcaaatcattggctaccaaacctgtcgggatggagagaccagtggttcatgtggatcctaccactgagaaaactgatggttcccacagaaagaaattaacgacgtatttggggatcatcgcccgagataatgctgaatttgatattccagaagtgtccaaccaaaggacgaagaaaaaactcatgaagacggtaggagagcgatggaggcaatttaagtcagatttgacctccaaatgggctctggcacaaggcaaggaggaggacaatgacactatctatgagaaaacagtcagcacagggcagcttttcgcccatagatgtcaggatgtactcactgctgccattggacaaccagagcactctgggcgtgttcgtgctgctaaagtcaatgtcacgataaatcaatactttggactgacttcaagaagctcttgcacgtctacatccatgactcccgaagacctagagtag

SEQ ID NO: 66946 - DNA, 231 bp, Glycine max
  Peptide Sequence Number=SeqID_183724
atggcgacgaggcctaccacgcatatgagggcgcagaggagcgccgccaagatcacgacaaagtcggactcgacagcggccgccacggcctccggcggtggcgctgccgcggattggaggagtctcagcccgcgtgtcatgtgtgatggaagatactctcaagataagagtgaggtgaagactttagactcaaaaagactagagagagaagtaaaaactggagatgcttga

SEQ ID NO: 66947 - DNA, 319 bp, Glycine max
  Peptide Sequence Number=SeqID_183725
gggttcttccggaaaggtcttccggaaatttgaaagttcttccggaattcttccggatgaaccatttcttccggaaagttcccggaagaggttttccgggagtcttccggaagaagtgttcttccggaagacgtttggttacttccgaaagaacacttcttccggaaactttccggaaaatgttcttccggaacttccggaagaacccctaacgggtcttccggaagacttctccgtcagccttttccaccattttttccggcatactctcgtcttctcccctctcgtcttctaccctaaggttccattgctatgctaa

SEQ ID NO: 66948 - DNA, 402 bp, Glycine max
  Peptide Sequence Number=SeqID_183726
atgtcacggaactccacaaattgtgcaacgatgctttcttttgatttccggcatgtcacggaacttcaagaattgcctaacgatgggtgccaagtacctcgaagtggtcaaacaaaagttgcatgccacgagacaatggtccctggaggaaattcggtcgcgggtgaccataagatatctccgcatgcaactgactcgctgtccctggatgaccataagatatcttcgcatgcaactgactcgctgtccctggatgacaaaggcacagtattcgtctatgcgcgtttaccacccaacttgctgctcttgaatgataaaggtaaaaatgcgggaccaactggttcccgcatctcatcgggcctggcgcctctggatgacaaaagatgcagaagacaacgttag

SEQ ID NO: 66949 - DNA, 759 bp, Glycine max
  Peptide Sequence Number=SeqID_183727
atgaaaatgagcatcaaacagttacgcgcgtttttagcggtagctcacactctgaacttcgcccaggccagcgagcggctgaatatttctcagccggcgctcagcctagcgatccgtgggctggaagacgcgctgggcgggccgctgctgctgcgcaccacccgccgggtgacgctgacgccggagggggaaaccttctttccgatggcgcgccagctgctggcggactgggacaacgcagaagaggcaatgcgccagcgcttcaccctgcagatgggcaaggtggcgatcgccgccatgccgtcgttcgccggcaacccgctgccgccgatcctcaaggcgtttcgcgatcgttacgccggcatcaacgtggcggtgcacgacgtcatcaacgagcaggtatttgaaatgatccgcgaagggcgggtggagatgggcatcgccttcgagccggagccgagcgacaccctgcacttcaccccgctgtgccgcgatcgctttctggcggtggtgccgaaggattcggcgctggcgcgcaaggcgcagcggccatcggcggtgcggctgctgctggagcaggaactggcccgcagcgggcgaacgctggaggtggcgtttgaaagccaccagctggtgacggtcgggcgcatggtggccaacggcctcggcgccagcgcggtgccggcgctgtgcgagcaacagatggatgagctgggggcggtctgcgtgccgctgatcggcccgatcatcgaacggcgc

SEQ ID NO: 66950 - DNA, 390 bp, Glycine max
  Peptide Sequence Number=SeqID_183728
atgacatctctctctctctctctctctctctctttctcgctccctcattctcgttcctcctcccgagaaaaaaagaccattccagaaagtactattttgacttatggaaagatcattttggaaggaaaaatagcaatccaaaatatcctttctggaagtacaatttgtgccttcccaaatgtgtttcataacaattatcctttcagaagggtcattacacatgagtatttatatccttacataacacctattctagaaacaagttcacaacgtgaacgtgaatggattaaaatgtacctgcggagtgaggagttggagaaggagaaagacttttgtagcgtcgagttggacttgctttataccttcaatgattgcaagaagaagaagtga

SEQ ID NO: 66951 - DNA, 267 bp, Glycine max
  Peptide Sequence Number=SeqID_183729
atgagccatgggcatttgtatcaaagatgggtgaagaattcttctgaaaagaaggtacgctcgcacaagttcaacgaaggggatcttgtcttgaagaaagtatcccaggcccaaaaggacaatagggggaagtgggctccaaactataaagggcctttcattgtgaagaaggcattctcgggaagagcactggtgcttgccagtctggacgatgaagagttgccttcacctgtgaacgtcgatatcgccaaacagtattatgcttag

SEQ ID NO: 66952 - DNA, 682 bp, Glycine max
  Peptide Sequence Number=SeqID_183730
atggtgcgcatggcggggtggttgttggcggtcatgctggccggtggagtgctgccggcgggcgccgtgtccaacgatctcgccggccgccagtccgatgccgagaagcagcaggcgcagctgcgcgaccgtatcgaaaacctgcagaaggacatcgatacgcgcgaagccgcccgcaaggaagccgccgatgccttgaaacagtcggaatcggcgatttccaggatcaacctgcgcctgaaggaactggccgaagccaaccgccaggcggcggccgacctgtccggcctggaaaaacagatcacggcccagcaggccgtgctggccaagcgccgggtcgagctggccgaccagctgcgcacccaatacaccagtggcctgtcgccctggaccgcgctgctgtccggcgatgatccccaggtgctggggcgcaacctgggctacctggattatgtctcccaggcccgggcccgcgcggtcgaggcgctgcgcgccgatatcgaccgcctggcggccctgcagggccgcgccgatgcccgccgcgccgagatcgaaaagctggacgccgaaacctccgaacaaaagaccgcgttggtggcccagcagaaagaacgcgccacgctgctggcgcagctggaaggccagatcgccgcccagcgcgccgaagcgaacaagctggggc

SEQ ID NO: 66953 - DNA, 447 bp, Glycine max
  Peptide Sequence Number=SeqID_183731
atgccgatctccccctgcggaagtatcagttggtctgtgtcgtcccgacataggggtcgcgcccacaagacacccagtggacccggagaagtccaacagggccctagggtttccagctctagttacgggcctctgtcagtcctacagggtgcccgttccaaccaacaagggatcacacccgcaagacacctagtggacccgaagaagtccaacagggtcttggagttgccagctctgattacgggcctctgtcagttctacgaagtgcctgtcgctcccagcaaggtcatcaggccccctactaatcgagctttcatcaagaagcactacgcccccaggcaggcgcagggcgaaacaccacagcagcctagggatggccggcagcgggcaacagacgcaccgccaccacctctagagttcacctcagctcgtccacaaaaaggttag

SEQ ID NO: 66954 - DNA, 462 bp, Glycine max
  Peptide Sequence Number=SeqID_183732
atggccggaacaaatttcgcggagctctatgggggtagcaatagtgaactcaagttgcgaaagggaagaaaggggaccagtcgcgggcacatggcatggtccaaaagaagcttgtctcagtgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccgagaggcaaccatgtgggtgggtcggtttgctcttaccttgaacgggagtcaagaacttccccgattgttagccaaggccaaggcgatggcagacacctactccgcccccgaagagatccatgggcttctcggctattgtcagcatatgatagacttaatggcccacataattagaaatcgttag

SEQ ID NO: 66955 - DNA, 267 bp, Glycine max
  Peptide Sequence Number=SeqID_183733
atgatccaaaatgcatcaatgatcaaaacaactaccaatcctaaagagaaactaccactagccaaaatggaacctgaattttgggacaaaaatcccttcaaggcaacgaccaaggctttcccatcaggatttcactacaaaccaactaccatcctgaagtcaagaactttttatgaattgattttggttatacctattgggattatgttgatgcttggactaaggtgttttggcaccaaaatacccgcttcaagcattcatggttga

SEQ ID NO: 66956 - DNA, 1071 bp, Glycine max
  Peptide Sequence Number=SeqID_183734
atgtttatgggatacgtcgccggcgtattcgatacttattcgatgcagggcaaccgcaatatttgcccggaagccgggatgagtatcggcacggccgccgatgcggtgatgcgctatttgaacgagcatcccgagcagttgcattactctgcgccttcggtgatcatgctggcgttaagcgccgcctatccctgcatcaatctccgcggcgctgtcaccttagcatcgtcggcatcccccgaacgggtcggggagagacgcgcaggaggttatatgaccacatttcacagcgccaacatcgctctcgattatcaggatatcggctcagggccgctcacgctggtgctgctgcccggctggtgcgagccgaaaaccgtgttcgatcccttcatcgccctggcggcagaacgttatcgggtgctcagcatcgactggcgcggccacggcctgtcgtcaaaaacggcggagatgtcgctcgcggcggtcgatttgctggaagatgtgcgtcagctactgacggcgctgcgtttggacaacgtggtgactctgtcggtggcgcacgccagctggctggcggtggcgttggccgaagcgttgccgcagcgggtgcggggcatggtgtttctcgattggatcatgacgcagccggaaccggcgttctttacggcggtgagccgcatgcagcagccgcagcagtggctggcggcgcgcgacgccttgttcgccttctggcagggcggcatccgccacgaacgggtcaaacgccatctggaggtcgagatggcacaagaagattaccggctctggcgtgccgccggcgtggccatcgaacaggcctaccggcaattcggctcgccgctgcaacgtctggcgggaatgagcgcgccgccgccgtgtcgccacatctactcgctggatcgccgcgacgactatctgcggcgccagcaggcatttgccgccgagcagccgtttttctccgtggtgcgtttgggggaggctcgcactcacctcggcattctggaacggcccgacgcggtgctgtgggcggtggaggattttttggcgccgtaa

SEQ ID NO: 66957 - DNA, 541 bp, Glycine max
  misc_feature (535)..(535): n is a, c, g, or t
  Peptide Sequence Number=SeqID_183735
atgacgtacgagcttgcagacagctggttcccacccttcctcgatgccctcgcgctcagcccgtcacacccgctacgtgaggaggcgttgaaggctgccgagcaggcggtctacgactcgtaccaggacgctgcgtctgagactgccgagggcggttcactcgacgagcggtatgaggagatcgcggaggacgtcgtgaaggtgcttcggggcgtcgcggactggagctgcgcctcagagagatcgtggcatggctctcgcaacggctgcgtggccccgatggctgagtacctcacttacagggaagcagccgcacgcacgaagcgcagcatccgctccatcaaccgctggcgccgcggtggcatgccgatggaatgggagaaacgagacggccagagagtccgcgtcgtccgcctcgacatcctcctcgcatggtggagagaacgcctcaactccgaccccggccaccagtaccgactgcgcaaaatgcgagcagatgcgacgcgcgacacgccgaatgattcatccttgccgncgagtg

SEQ ID NO: 66958 - DNA, 234 bp, Glycine max
  Peptide Sequence Number=SeqID_183736
atggataagagcttgaaggaaaaagaagaagatgagtggagggagaggaaaataaggagcatgaaattttatgcctcaaaagagcgagaagtcacttacacgcgatacgcgagcccatctcccgctaagcacacgcattccaatagaatttcctatttaaagttgaatctcgaaattgaggagtgtggagtttttttgagagttttggctgtggagagaccaggagaaaaatga

SEQ ID NO: 66959 - DNA, 773 bp, Glycine max
  Peptide Sequence Number=SeqID_183737
atgaccaatactgaagcctttcaaataaagtcgatttcagaactcctaatccacccgttgctatggagactcacaggctttgtgtcaagcgtatttgggttcagctgttatgccttcagcccctctttccacgacttgttcggacactggaacccgctgaagatctccttttacactgtggtaagctcacttttatctatctttatgctctttgttaaaagatgcagcggggaacacgggaagggtttcttgttgaaagcacatgtgggttttgtggtcttggggcttacctctctctggtctttcttggaagaccgtggccaacaagggaaagtggaacacgggttcgggaaaatgatgaacctcacttccactggggcatttgccttgatggctatgagcttgtcgcgacaacttcaatttgggttcgatgttggtgtttttaatttcttggttggatgtttcttggtcacaacgatgaagatgagtttgaagttagctccggttgctgcattcttctgctatgtgcttgtcaacatacgttccatttctgatttcttgcttgatttgcgtgcacatgcagccacacaacatgcagatgatgccacgaatgctgaatctctcgaccaaaatattgcagatagttctgaatataatgacctgcttgaagtgcatacacagcatgcagacggcaagaatactgattctggcgaccaaaatactcatagttccgaacatgatgagcaattatttgctcctatgatacatattgg

SEQ ID NO: 66960 - DNA, 285 bp, Glycine max
  Peptide Sequence Number=SeqID_183738
atggcacccggaaatgtcaaagctataggcattgacttgggaacaacctatagctgcgtggcagtgtggcaacacaaccacgtcgaggtcattcccaatgaccaaggcaaccgcacaaccccttcctacgttgccttcaccgacacccaaaggttgttgggtgacgctgccatcaaccagcgatccatgaacccacaaaacaccgtctttgacgccaaacgtttgataggtcgcagattctccgaccaatccgtccagcaagacatgaagctctggccttttaag

SEQ ID NO: 66961 - DNA, 315 bp, Glycine max
  Peptide Sequence Number=SeqID_183739
atgatgatttggaaacaacgtgcaaaattagtcatggccacaactaagtgggcactcaagcatccagtttatggcattgtgatactatggctggggttgttgtcctttgggacaaacgtgagaggtgctaataccttcctcaaatgtaaatacaactccctaatctggaatattctttatgaccggtttccttcggtttttccgacgttttccacaaataaacgttggtggcccgagagcctcgcctcgctcgcccgcaaaagggtaggttgcgacagttggcgactccactggggactgttttctgtgagttag

SEQ ID NO: 66962 - DNA, 222 bp, Glycine max
  Peptide Sequence Number=SeqID_183740
atgtgtgaggcgaacaagtcaccgacgcacaggatttcggtttgcaatcaaagggagagggccactttaggtcgtggtgtcgcaaactacccttcggagggagggcgacgcgtgactcgcgggatgcgtcttccaagaaaggaatacgcgcggagtcgccaccaacgtttattggaggaaaatgttggaaaaaccaaaaaagacgtggtctacgaattttaa

SEQ ID NO: 66963 - DNA, 1659 bp, Glycine max
  Peptide Sequence Number=SeqID_183741
atgggaaagatgcacaagaataggaaacaagctggtgggcatggaactccaagagaagaaaccgatatgcaggaacaagaaatggacataaggaagattatgaaagatccccaaaagaatcagagattacctttaagtgtggcacgaccaatgatgaagaaacaaaaggagagggagcagaaaatgcttcaagagcgtttgattcttggacaatttgggggaaaacttggtggtagcagtaaaagatctgctgggaagcacaagccagagaacaggggtctgaaatcaagtgaaggtcattttagaaatggcatactcaatgtgaagcatttgttaaattcagcaccatcaagagatcgtgaaactggaactaatatgtccaatgcatggaaagggaaaggtggtaagaagaaaaatagtaacaagggtggtgagggtggtagtgatgatgatgatgatgatgtaacaattgatgggcctgatacttcatccttcactgcgtttctctgttctttgttgtctacttcggattccggggataaggttggtgaagctgatgagaagaatgatggtggcagggccattcaccaagttgccagaatgggcggatttcgcaacaaggatggtaattacaccgatgaaggcgttgagatgaagcacattgtgaaaacgcctgtggctgtggctgtggctcggattggtgatcacctgcctgaaatttctgagccttcaatgctcgtttctgaggatgtgaggaatgtggtgtatgcttcactgccggcacttattcacggccggaaatggcttatgctgtacagcacttggaagcatggtatatcactttcaactctttaccggagaagcatgttttggcctggactgagcttgctggttgttggagaccgtaaaggagcagtctttggtggactggttgaagctcctcttagaccatcgaacaagagaaaataccagaccattaaggagacgtactcagtcaaccaagatgcatcaagagcatatcaattgtaccatgagaggctatggcaagaatatgatgctattgcatattgcaccatggagtgcactaaagatgttgagaaatataccaatacggttaattctccacgggtttatgtttttttggctggtctggattcacatttggatggagttggtggccatattcttggtaccaccccacttctaaacgttaaagtagtttatacaattgtctgtgctgaggcaaatcgccaagaggcaatgcttggtagtgtctctattgaaggaactgcctttgctgtcaagaagtcttccaagaaaggagtccccaagtgtagccattgtaatggagataatcatgtgattgaaacatgctccaaacttcatggctatctagattggcacccaaaaggcaaaacaacctccaataacaaggcagaaaatcttagtcaaattgctactgctgctggatttgtgatcaagtcaggtatgtctaactctgtcattaatctttccgttgttactgggagtagcgattggataattgatatgggtgctgctgaccatatgacttgtgatcctcatacatttactcatctttcccctggtcttctaaaattgtcattactaatgccaatgaagtttcatctcctattgaag

SEQ ID NO: 66964 - DNA, 246 bp, Glycine max
  Peptide Sequence Number=SeqID_183742
atggtaatgcaaaaagaagggcctggagttatacaaattgaaggttcagaagtctctaggaaaacttcaccgattgccttcagagcaacaggcttagagtgcgacggaattgctccgtggctccgtgcaatggacgaacagtctcgagacgcggcggcaccggcgccgagaacggagagaaccgcgcgagatgagagaactcgaaagttagggtttgtgtttgcttcgaattcgaaaatgacataa

SEQ ID NO: 66965 - DNA, 1230 bp, Glycine max
  Peptide Sequence Number=SeqID_183743
atggaagaagaaaaagaagaagaagaagacaaggccaatgtgaacaaagtcacacggatttatattggcaatattggcaacaccccagttgccaatcagactttcaagccgcaagaagaggctcacaagatgaacatcataagaactcgtcttcaacagatcaacaagcccgccgttaagacaattcagagtcctgatggtgatgtaatagactgtgtggtgtctcatcagcaaccagcttttgatcatccaatgttgaagggacacaaaccactggatcctccagaaaggcctaaaggccataaccaaatggacatgagtgagaattttcagttatggaccatgtcaggggagtcctgtccagaaggtacaattccaattagaagaacaacagaacaagatatgttaagggctagttctgttagcagatttggaagaaaaataagaagacgtgttagaagggacaccaacagcaatggacatgagcatgcagttgggtatgtgagtggagagcagtactacggagcaaaggcaagcataaacgtgtgggcaccccgagtggcaaatcaagatgaattcagcttgtcccaaatcaatagcattcataaggtagatagcatgctcaactacctgcaattcattttcgttcatgtcagccccgagctctacggggacagatacccgagattctttacgtattggacgagtgatgcatatcaagcaactggatgctacaacttactgtgttcaggctttgttcaaactaacaatagaattgcaattggagctgcaatctctccaacttcttcctatgctggtggacaatttgatattagcttgctcatctggaaggatccaaagcatggaaattggtggcttgaatttggatccggaatcttagtcgggtattggccatcattcttgttcacacacctaagggatcatgcaagcatggtgcaatttggtggagaaattgtgaattcaaggcaatcagggtctcacacttcgactcaaatgggtagtggacattttgctagtgaaggttttgggaaagcttcatattttaggaacatgcaagttgtggattgggataacaacttggtaccattgtcaaatcttcgggttctagcggatcacccgaattgctatgacatacaaggagggattaataatgtttgggggaattacttttactatggtggacctggaagaaatgtgagatgtccctaa

SEQ ID NO: 66966 - DNA, 1386 bp, Glycine max
  Peptide Sequence Number=SeqID_183744
atgaagaggaacagaagtttttccttactctttttcctgtccttgttggtgattatctttgtcaccttctctatagtttctgtggaagcaaggaagacaaacatcaagaaaaaacttcacaaacgtcacaaaggtggtcacactcaagggtcacattctccatgcccagtgccaacccctcaagggagcacctttgacgttttgtcttttggcgccaagggaaatggagtttctgatgattcagaggcatttctagctgcatggaatggtgcatgtaaagttgctggtgctacagttaaaattccagcacaactcaagttcctcatcaaacctgttactttacaaggcccttgtatatctgaccttactcttcagatagatggaactctgttggcacctcctgaagcatctacctggccaaaatccagtttgtttcagtggataaatttcaagtgggtgcggaacttcaccatcaaaggttctggcactgttgatggccaaggctataactggtggagctcctcagaattttatgacatacagaagagctactccaaacatattcctggcatgaaaccaaccgctataagattctactccagcaactttgtaacagttcgtgatatcagaatcataaacagtcctctgtgccatctaaaatttgacaactcaaaggggattaaagttaacaacattacaatatcctccccggagaatagccccaacactgatggcattcacttacaaaacacacaggacgtagaaattcaacgttctatcatttcaacaggagatgactgtgtatccatccaaaccggttgctctaatattcatgtccaccacattaattgtggccctggacatggtataagtttgggaggattaggaaaagacaagagtgcggcatgtgtgtctgacatcactgttgaggatatatctatgaaaaacactctatatggagcaaggatcaaaacatggcagggaggcattggtatggttaaaaatgtgacattttccagaattcaagtctatgatgttatgtacccaataatgatagaccaatactattgtgacaagcaaatctgcaagaaccatacaagcactgtggtgatttctggggttaagtttgatcaaatacatggaacttatggtatgcagcctgtgcatctagcttgcagcaattccataccatgcacagatgttgatttaactgatattcaactgagtccctcccctaaatatagaggtttgcaacaagctgtgtgctggaactcttatggaaaatcacaagggccctttctaccttcaagcattgattattgcttgagaagtggtggtggattaatcaagaggatagcaaggtcacatgataaagtgtgctactaa

SEQ ID NO: 66967 - DNA, 309 bp, Glycine max
  Peptide Sequence Number=SeqID_183745
atgaggaagatcaaatcgcaattgcgtccgcaacgagatatgagtaacatacaatgttactattgcaggaggtacaacaagcaaaaaggagcagaaataaaggaaaaaaaagaaaatcagaagaagcccaagtccagcaaggcgctaagcgcaggacgcgcccagcgcgcaagaagtcaaggcgctaagcgcacgacacgcgctgagcacgatgtggcactgagcacgaggctttgtgctcagcgagactacgaaaagcccaagcccaagttcgcacctataaataagagggtcagcctaggaaaatag

SEQ ID NO: 66968 - DNA, 522 bp, Glycine max
  Peptide Sequence Number=SeqID_183746
atgtcccttgcatcgttttttcttatcttcctttgttaccatgcacttcctgctcttgctgatccaagtgccacggaggtagcagtgttgagcaccaacacaacagccccaatacctcagcgacaagctttcttaacaaacttctatgatgccttggaagccttaaccgctttggttacaaggcaaaagtatgctcttattgttaaagggactactcaaaataatgccactgtctatgcttttgatttttgtgggaattggagtgtgtataaggccaatactgtggagttggtgagaaatttgagcattgaagcaccaaagaatgaagggttctttgtggggtataagtttgtgaatggcagtgcctgtcagaactgtttggatgaagctgtcactaggattaattcttgtgctccaaaagtagaagggaaggcattgaatgttgggtgttacttgaggtattccatacacaatttctataatagttcaaacaacaatgcccctcaagaaaatcacggttag

SEQ ID NO: 66969 - DNA, 1068 bp, Glycine max
  Peptide Sequence Number=SeqID_183747
atggagaagatcagtgatgagatgcgcaaaactggctttggcaccgcaattgtagggactggacccgatactaactatggccttgcccagtgttatggagatctttcattacttgactgtgtattatgctatgctgaggcacgcacggttcttcctcagtgcttcccttataattctggtcgcattttccttgacggttgcttcatgagagctgagaattatagtttctttaatgagtatacgggaccgggagacagagctgtatgtgggaacacaacaaggaagaactcaagttttcacgcagcggcaatgcaggcagttttgagagcagttcaagatgcacctaacaacaaaggatatgccaaagggaatgttgctgtagcaggaacaactaaccaatctgcttatgttctggccgattgttggaggactttggacaaaagctcttgcaaagcatgtcttgagaatgcatcctcttccatattgggatgcttgccttggcaagaagggcgagcgctgaacaccgggtgtttcatgaggtactcagacacagattttcttaacaaagagcaggaaaatgggagttcaagaggtaatgtggtagtgatagtgattgcagtagtcagttcggtgactgttttggtggttggagtaactattggagtttatatatggaaacaaagatacattcaaaagaaacgaagaggttcaaatgatgcaaaaaagttggcaaaaacacttcagaacaataacttgaacttcaagtactctacattggacaaggccactgaatcttttcatgagaataacaagttagggcaaggaggatttggaacagtttataaaggagttctagctgatggaagagagattgctgtgaagagattatttttcaacaacagacatagagcagcagatttctacaatgaagtcaacataattagtagcgtggagcacaagaatctagtcagactgttaggatgcagttgttcaggacctgaaagcctgcttgtatatgaatttctacccaaccgaagtcttgaccgctacatttttggtaattactga

SEQ ID NO: 66970 - DNA, 345 bp, Glycine max
  Peptide Sequence Number=SeqID_183748
atggctataaaaaggcttagcttcaacacatcacaatgggcatatcatttcttcaatgaggtcaatttgatcagtggcattcatcacaaaaatctagtgaagcttttagggtgcagcattacaggacctgaaagccttcttgtttatgaatttgtgcctaatcacagcctctatgatcacctatctggtagaaggaattctcaacagttgacatgggaagtcaggcataaaatcatattggaaacggcagagggcttggcctatcttcacgaggaatcaaagagaatcattcatacggatataaaattagccaacattctcattgatgataacttcacaccctag

SEQ ID NO: 66971 - DNA, 309 bp, Glycine max
  Peptide Sequence Number=SeqID_183749
atgtcagtagtagtggaaatgatcaacaacaaccatgaaattactcggccaacacaaccaccatttcttagttgtagtagtgcagaattcagcaaatctattttacaaggagagagttttcagcctagatctatgaagcaccgacaccgacaccggatacgacacggacacgtggacacctgtaatatccaaaatataaaacgtagtacgggtatcgtgtcagtgtcagacactcacacggacacgtgtcaaacacccgacacgacaagggactggagtatccgtgaccgaaagtctcattcaacataa

SEQ ID NO: 66972 - DNA, 321 bp, Glycine max
  Peptide Sequence Number=SeqID_183750
atgaggaaggaacatggagtatggggatttgcttttaatatgactatgttatggaagcaagctatacatggcgtggcatccacacttcacgagtggtggtcaaagaaggtagtagatggagacttggtgatggaaagcgatgagaatcctaaaactgtccaaatacagggacctatgatcaggagtaagaccaagcagtcagtggatacccttcaacaaatggtagcagacatacttaacaaggttcaagtggaaaatgatgaagacccagagatagaggcattactaagaatattagttattgctgaaggctcagactaa

SEQ ID NO: 66973 - DNA, 411 bp, Glycine max
  Peptide Sequence Number=SeqID_183751
atgaatataaagaatcgatgtggaaagcgcagaacatgccacatggcgatgacgtttgttccttcttcaacttcttccactttccgaccaacgttgattcgctgcgccagcgccaatgagcggcaggcgctgtttagccgcattgctcctgtctatgataacctgaatgatttgctgagccttgggcaacaccggatttggaagagaatggcagtgtcctggactggagcgaaaatgggagactgtgtgttggatgtttgctgtggaagtggggacttatcctttctcttgtccgacaaagttggctctcatggcaaggtgattggtcttgatttctcgaaggatcagctatcctttgccttatctcggcagcaatcactttcaaagaattgcttcatgaatatcgagtga

SEQ ID NO: 66974 - DNA, 753 bp, Glycine max
  Peptide Sequence Number=SeqID_183752
atggaagcttctttgtggcatacccttcaacatgcatttgattctttggaagacatgcatagtattattttctacatactgggaaagttcagtaccagcaaagtagaggaaatcgttactgtactttggtgcttatggcgtagaaggaacgagaagctttgggaaggagtttcaaagcctgtcggattgtccttgcagcaagttttcaaacatcttcaagaatggaagactcaacataaaaggccaaatacagctacatctcattctccccaccgcaactcaaagtggtcgaagccacccataaactacatgaagtgtaatattgacgctgttcttttccatgaagaaaacaagtttggtgttgctgcttgtatccatgaagaagaaggcatgtttgctgttgctgcaacttcttggttccatggtcaaccaactccacaagaggctgaagctgtggctttcctttttgctcttaatgggattaaagaacagcagttgggaaacattgttatagagacagattgcaaggccatttctgatgcgttcaaggcacaacagtttgataattttgaagcgggttgcatcttaaaaatctgtaatacacaaatttctgatattcataactgtagtatacagtttgtaagtaagcaagccaatcaagttgctcatagcttggctagagcatcgagatcttatgtttgtccacaaatgtttgatttcaatccttcttgtattgatttatctgattcatga

SEQ ID NO: 66975 - DNA, 309 bp, Glycine max
  Peptide Sequence Number=SeqID_183753
atggaagagcaaagcactattaacaaggtggaagagaggcttgatagagcccttgcaagacaagattggattgatgttttccctcatcatagccttatgaatggtgttgctggaatttcagcccgatggttaaaggagcaggagcttgatatgttagttcattattgctggactcaaaatgccactagtgatatcctctctaagttgcacacgtgttcagatggccttcttacttggggtcaacgtatacatgcaagattcatgaatgctatcaaacagtgcaaggctcggcttgaagagcttagctag

SEQ ID NO: 66976 - DNA, 192 bp, Glycine max
  Peptide Sequence Number=SeqID_183754
atggcctctgtggaggcctctgccatggctaggtcccagatcttaccaaatgcatatgacacagatgcattttacgaatacgggagcccgagagattgtccccttcttagatacaacattcggatagcatggcgcccgatgtatgcatttaagaaggcaacacggaccctccgtcggttcgtgacaaagtga

SEQ ID NO: 66977 - DNA, 681 bp, Glycine max
  Peptide Sequence Number=SeqID_183755
atggtcagcatcggcgaacgtgttaaattggggcatggtgtgcgtatcggtgctggttgtgtgattgaagatgatgtcacgatcggtgcaaatacggtactggaaccgcgcgttgtgattaagcacggtaccgtcattggcaaccactgccatttattttctggctgtgtcattggaaatgatggttttggctatgctgaagagcagggccaatgggttaaaataccgcagattggccgggtcgtgattggtgaccatgtggatattggagccaataccacagtggaccgtggtgcgctggatgataccgtgattgaagacggggtgaagttggacaatttgatacaggtcgcccataatgtccgcatcggtgcgcatacagtcattgctggctgtgttggcatcgcaggaagcgccgtcattggcgcgcattgcaagatcggtggcgctgccatgattctggggcatttgcagatcgttgatggtgtgacaatctcgccaggctccatgattatgcgctcaatccagcaggctggcacttatactgcgctgatgccattccagaagcatgaagattggttacggacggctgcaaacatccggcatttagaacaatatcagctcaagctcaagcagctcgagcaagcaataagcaatatacaaaaacattcggaagattga

SEQ ID NO: 66978 - DNA, 1230 bp, Glycine max
  Peptide Sequence Number=SeqID_183756
atggcagttgaagatagagaaaagacatctttcatcacgccttggggcaccttttgttacagggtaatgccttttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttaggtttctttgtcagtcagaaaggtattgaagtagatcctgacaaggtcagggccattagagaaatgccggttccacaaacagagaaacaaaagattctatggggctgtgtgctcggacaacaggatgagaccggaaggaaagaacatgccatctactacttgagcaagaagtttacagattgtgagtccaggtactccctacttgagaaaacttgttgtgcactagcctgggctgccaagcgtcttcgtcactacatgattaaccacaccacctggctaatatccaagatggacccgatcaagtatatcttcgagaaacccgctctgacaggaagaattgctcgttggcagatgttgttatccgagtatgatatcgaataccgcacccagaaggcaattaaggggagtgttcttgctgatcatttggctcaccaaccaattgaggactatcaacccatcaagtttgactttcctgatgaagagattatgtacttgaagatgaaggattgtgatgaaccattgcttggagaaggtccagatcccgagtctagatggggtttgatttttgatggagccgtgaatgtctttggcaatggaattggggcagttattatcactcctgaaggtaatcatctccctttcgctgcaaggttacagttcgattgcaccaacaatatggcagaatatgaagcatgtatcttgggcattgaaaaagccatcgacttgagaatcaagaaccttgacatttacggggattcagctctcgtaatcaaccaaatcaaaggagaatgggaaactcgccaacccggcttgattccatacaaagattatgcaaagcgtttgctaaccttcttcaacaaagtggagcttcaccgcatccctcgtgatgagaaccagatggccagatgcgttagcaactttatcctccat

SEQ ID NO: 66979 - DNA, 198 bp, Glycine max
  Peptide Sequence Number=SeqID_183757
atggcggtggtgggaacaacaggtagctacggtgggcacgacggaggtcagggaacggcgatttgtgttagaaagaataatccctactcttacactttggccaggaagataaggttagaacctccaccacctactggcaatctcttttgcaaaaacaatgagacacctagcttgctctccatgcccagtgaggagtga

SEQ ID NO: 66980 - DNA, 294 bp, Glycine max
  Peptide Sequence Number=SeqID_183758
atggctttatcatgtacaacattcatcataattgagtcttttgtaacaaaggaaaatggtgggacaaagtttacgtgtggaacgacctggaagtatagtaagtacatttccaagatgcgaaaaccagaggctacaaagcagcagctagctagtttatgctgcatagcactgcctaatagactcttccagttgatttggggaagaaaaggaagaagggaagaaggaagagggttggtcacgttggtgcctgatggcagcctgtggcaatggtgggtggtgactggaggagaatga

SEQ ID NO: 66981 - DNA, 1093 bp, Glycine max
  Peptide Sequence Number=SeqID_183759
atggcggccacgccaccccttcagtctttctcggttcttcattcaaacaaaccctctcactctctgcttcgcccctcttctaacaaaaacagaacctttttctctttcacttcgaatctgaggtgtgagatcaaaggctttgacttcgagagccaccgtggttggaccatcgagcgcgtctccgacatgagcaaagactccaccaattctcacaccaacccttcttctccgttgctctccgtctccgctgtcacctccgcctcccaattccccaccaaaaatgccaaaaaagttgtccttttctactgcgccgagaccaaggccctcgccgagaaaatcgctgccgaaactgatgccattgaacttcgtagcatctcttggggcaagtttcctgatggcttccccaacattttcattcctaatgctcaaggaattcgtgggatgcacgtggcttttctggcctcattcagttctccagcagtgatttttgagcagattcctgttatttatgcgttgccaaaactgttcattgcttcatttacccttgtccttccgtttttccctacgggcacttcagaacgtatggaggatgaaggagatattgccacagcttttactttggccagacttttgtcaaacatacccatttctaggggaggacctaccagtctggtgacatttgacattcatgccttgcaggagagattctactttggtgataacattttaccatgctttgagagtggcataccattgcttaaaagaaggctccaggatcttcctgattctgataacatatcagttgcttttcctgatgatggtgcttggaaacgatttcataagcaactgcagcattttccaacgatagtttgtgcaaaggttcgggaaggagatcaacggatagttcgtattaaggagggagaccctaggggtcggcatattgtaattgttgatgatttggttcaatcaggtggaactctgatagaatgccagaaagtcttggcagctcatggagcaacaaagattagtgcttacgtgactcatggtattttcccaaataaatcatgggcacgctttggacatgataatgggg

SEQ ID NO: 66982 - DNA, 1860 bp, Glycine max
  Peptide Sequence Number=SeqID_183760
atggcttcttctctagtggcacttctttctcttctcctcactcttcttgcaacttcatgtctaagtgcaactgtgttttccctccaagtttcaatcaaaacaacttacttggaacctttcaaatgctcccctaagatcaccacatgcaatgcctcactctaccacataagctacggcaacaacatagacgacatagcaaccttttactccgttagtacctcccaaatcaaaccgataatgcgcactaccgagcaagattacctcataacagtgccttgctcttgcaatgacaccaatggacttggcggatatttctatgatacaacctacaaggtgaagtccaatgacacgtttgtgaatattaacaactttgtttacagtggtcaagcctggcctattaacggagaattggaccaaaatgaggagttaacaatacatcttccatgtgggtgttcagagaaaagtgattctcaaattgttgtcacgtacacggttcagcggaatgatacacctgtatcaattgctgctctgctaaatgctacgttagatgacatggtgagtatgaacgaagttctggctcagaacccctcattcatagatgttacttgggtgttgtatgttcctagggaattgaatggtttaccactttccaaaggaaaagacaagaaacaaaagttggagataatcattggcatcttagcgggtgtgacattactttcaattattaccttgattattctcagtgtcgttcttaggagatccagagccaataaaactgccaaaaatgatccaagtgttgtctctaaaagatcaatcaccaatagaactatttccataaagaaccgagactttcatacagaatatattgaagatgcaacaacatttgaatcagaaagaccagtaatttatgctctagaggagattgaagatgctacaaataactttgatgaaacccgaaggattggagtaggtggatacggtacggtgtatttcggaatgttagaggagaaggaggttgctgtgaagaagatgaggtctaataaatccaaagaattctatgcagaactcaaggccttgtgcaggatacatcatattaacattgtggagttgttgggatatgctagtggagatgaccacctttatttggtgtatgagtttgttccaaatggatctctctgtgaacatcttcatgatccattactgaaaggtcaccagccactgtcttggtgtgctaggattcaaattgcactggatgcagcaaaaggtcttgaatatatacatgattacacaaaagcacgatatgtgcaccgtgatataaagaccagtaatattcttcttgatgagaagctcagagccaaggtagcagatttcggacttgcaaagctagtagaacgaaccaacgatgaagaattgatagcgactaggcttgttggaacaccaggctaccttcccccagaatctgtgaaggagcttcaagtgactataaaaaccgatgtatttgcatttggtgtggttctggcagagttgataacagggaaacgtgcactatttcgtgacaaccaagaagccagcaatatgaaatcacttacttcagttgttggccaaatattcaaagatgatgacccagagactgttttagcagatgccatagatgggaatcttcaacgtagctatcctatggaagatgtctacaagatggcagaactagctcattggtgcttgtgcgaagatccaaatgtcaggcctgagatgagggagattgttgtggcattgtcacagattgtgatgtcctccacagaatgggaagcatcactaggtggagacagagaggtcttcagcggggtacttgatggaagatga

SEQ ID NO: 66983 - DNA, 258 bp, Glycine max
  Peptide Sequence Number=SeqID_183761
atggttttaaacagcttattttccatcttcttggcacacttccaacgtaccacaaaagcaaggttgccatcattctttggagactttggaaagccaaaaaccaataagtttgggagaactcagaaactcaaccatcttcagcaatcaatctgcccatgcaattcttatcagaatggcacgcagtttgacagaacagcaacatcaaccagcaaagtcttccgccaatgcaactccaatgatactttcattaaggcctga

SEQ ID NO: 66984 - DNA, 1182 bp, Glycine max
  Peptide Sequence Number=SeqID_183762
atgacacggatcttccttacgaccctttcattgtggctcttggtcctcgctccttccaaggccgaggagggatttcccgacaaacttccatcaacatttcattctctatttccgtttctcggtcgtcaagatgacctgaacaagccacaaaagggtcctaatgacgagtctcaacaacagaacgtgcctcaacaagcggctgaccaaaatcctcagatactcagccaagatttctacattaagacttgccctaatgcacaaaaaatcgtggccgatgcacttgccaagattgttaagaccaatccgggcgcactcggaaacttactccgccttcaattccatgactgcttcgttaatggatgcgatgcatccatcttgctagattactcgccaagtggcgacgctgtggagaaaagttcaatggtcaatggtctactcctcaaaggagctgatatgatcgatgaaataaagttgaagctggaggagcagtgtcctcaaaccgtgtcatgcgctgacacattggcatttacagccaacgaggtaatgaccatggcgggtttggcccctcagaaacccctcggtggccgtagagacgcgctcgtttcccttgcaaccgctgcagaaaccgacaacatccctatgccaaactggaccatggaacaaatggtaaaactcttcaacaagaagggtttcaacatcgaagaaatggtgatcctactcggtgcacactcgatcggcatggctcattgcgacttgttcattgaaagggcatacaacttccaaaacacagggaaaccagacccttcccttactgtggaagtgcttgaggaattaagaaaggcatgccctaatcttaatacacctaagtaccggaaccccccagtgaactttgatgcaacaccaactgtgcttgataacctcttctacaaggatatggtggagagaaagagaactttgctcattacagattcgcatatattggaagatcctaggactttgccaattgtgcaacagtttgcacatgacgctagcttgttccccaggagatttcctgaggtcatgcttaagatgagttctttgaatgtgctcacagggaatgaaggtgagcctcctgttttgggtgggatgcgccaggcacttgcagtagtgcaagacaagagcgacgctcgagaatcccagtag

SEQ ID NO: 66985 - DNA, 1077 bp, Glycine max
  Peptide Sequence Number=SeqID_183763
atggcaggggcagcctctgctctgttcctcctcgacatcaaaggccgcgtcctcatctggcgcgactaccgcggcgatgtctccgccctcgacgccgaacgcttcttcaccaaactcatcgaaaaacaggccgatccgcaagctcaagatccggttgtgcacgacaacggcgtgacctacatgttcatccaacacagcaacgtgtacctcatgatagccaccagacagaactgcaatgccgccagcctcctcttcttcctgcaccgaatcgtcgatgtgttcaagcactactttgaagaattggaagaggaatcgctcagggacaacttcgtcgtcgtgtatgagctacttgatgagattatggactttggctaccctcagtacactgaggcgcagattcttagtgagtttattaagaccgatgcttatagaatggaagttacgcagagacctcctatggctgtgactaatgctgtgtcgtggcgcagcgaagggataaactataagaaaaatgaggttttcttggatgtggtggagagtgttaatatacttgtcaatagcaatggacaaataattagatctgacgtcgttggggcgttgaagatgagaacgtatttgagtggtatgcctgagtgcaaacttggcttaaatgatagagtattgttagaggcacaaggtagaacaaccaagggaaaggctattgacttggaagacataaaatttcatcagtatgttaagcctttaatttgggtggaagcaagtgttgaaaagcattcaaagagtcggattgagattatgagtttattttatagcactgccacaaacgttgagattgagttgcctgtgcctgttgatgcaaccaatcctaatgttcgaacttcaatgggatctgcatcatatgcacctgaaaaagatgcattaatctggaaaattagatccttccctggaggcaaggagtatatgttaagagcagagtttcgtcttcccagtataacggatgaggaagcaactcctgagagaaaagctcctatacgtgtaaaatttgaaataccatattttactgtatctggaatacag

SEQ ID NO: 66986 - DNA, 197 bp, Glycine max
  Peptide Sequence Number=SeqID_183764
gttttatatggttgaagtgtgaggagggcatagaagattgtgggagttatctgctggaaaaattgaagattcgtgcaagaggaggagaacgatttggtgttagtccaaagtatgctagaattagcatgataggaacggatgatgagttccatgaatttttgaatagggtgtcgaatgctaaaaaagaatgtgattga

SEQ ID NO: 66987 - DNA, 348 bp, Glycine max
  Peptide Sequence Number=SeqID_183765
atggtttgggagttgcagatgaatgaaggcaggaagctgagacatatagatgtccttagagatgcctttggcaacaaggtgagctttgtattgggaattataaccatcagtgatacatttgagtcagaagacccatttgttctcgatgacattaagatttggctatggagggacaagtgtccaggttccattagcaatgaacgcatcgaattctttggacatggcttctttccacttaagagtgagtcaccatggggtgagttgagagttaagctttggagcatggggaagaacatctacattggcgagagtgataagcatgtgtaccgacaattgggattggattga

SEQ ID NO: 66988 - DNA, 722 bp, Glycine max
  Peptide Sequence Number=SeqID_183766
atggcggtggcaacaaacagcttcccttcttccagtgtcacaattcccccaacaaatatctcacctaatgccatcctacctcttgagaggggtgatccaatagtgtttggtgaatactggaaaaagatgagtgagacttgcaccgtagttatcaaagggtgggagcttatgagctatctgagtgacatgaacaacgtgtgctggtacatgttaccagagacgaaggaagccattaaaaggctccaccacgtggtgggaaatgctgttaccgaagacagatacattgtggtggggaatggagccacacaactcctccagggtgctgtttttgctctcactccttcagaggcttctaaacccatcaacgttgtggttgctgctccatactactcggaataccaagatgaggttgatattttgcgttcagggttgtatcaatgggctggtgatgctgctttgtatgagaaaaatgaaccctacatagaggtggtaacctctccaaacaaccctgatgggactatgaggggtcctgtggtgaaatctgaagctgaagggaagctgattcatgatcttgcctattactggccacactacactcccattactcaccaagctgaccatgatatcatgatcttcacattctccaaatgcactggtcatgctggttcacgtatagggtgggctatcgtgaaggacattgaggttgctaagaagatgacaag

SEQ ID NO: 66989 - DNA, 600 bp, Glycine max
  Peptide Sequence Number=SeqID_183767
atggactatttctcagtcaacatcactatattcgttatcttctccaaacccacaacatgcatgatgatgctagaccagtcaacacccatctatcgaccacatgcaatctcacatcaggtgatgtctcctcttgcgatgacactatctattgccagcttgtcgactcactgcaatatctctctcacatgccctgttaacaagctctctcagtacatgaaggcccctattgaaattcacatgcaagcagccaagcgagtcctcaggtccataggtgtttacctaatttactttggcccaaatgtcatctcctggagctgcaagaagcaatccaccattgccaaatcttccacagaagttgaataccgcacaatagccacaacagtcactgaattgctttggctacaacaactactcaaggaacttcacgttcatcctgatcgttctccaatggtgtattctgataacattggaacaacgtatctttgtgtaaacatggtatttcactcgcgtaagaaatatctcgcgattgactatcactttgtgttggatttagtagccaaaaagaaacttggagtctcacatgttccatccagtcattag

SEQ ID NO: 66990 - DNA, 603 bp, Glycine max
  Peptide Sequence Number=SeqID_183768
atgaaacatgttgaagtctcaaatcaaataaagataattacctcatggctcctccgtcatgtgggattcaacacacccttctatccctcattttttcctcatggctcttatgtcatgtgggactttcaacagaccatgtcagaaggtgggtttttcatgggcttaactcaatcctacaaagatcgacttgaaaggacttgtcttctggtgatgggaaggcagaaaccagaccaaaacatgatggaaaatgagaaacacaattttcacatgaatctgacactattgtttcatccatggatactgagggacgaaagaaacggtttccacctatcaaataggtcgaaacccaaaagtgatcccattattaacttggttgatgcgtcaaagtccttagtacttaaggaccagacattccatgtggattgtgatgcaagtgtcttcgtcgtgaataattttacattgtacattgcagtccaagatatatatgaaatagtacaacaccgtgcgatgcttaatattgcagttatacacttgtggatgttgtatatggataaaatacgtcaacagttggggcatggtgacctagctatatggattccttga

SEQ ID NO: 66991 - DNA, 213 bp, Glycine max
  Peptide Sequence Number=SeqID_183769
atgaagggtgatgtacagagtcaagttgttattgacttttggcggtgtgggactcacgagagcagcaaggggaagtcacaagagtcacaagaaaaggcacagttaagagttgaagggagagagaatggagacagtttggggcagcctgagcaggaagaaaagtggtggaaacggacagcttctagacgcttccaatattatggagttggttga

SEQ ID NO: 66992 - DNA, 1707 bp, Glycine max
  Peptide Sequence Number=SeqID_183770
atggggagcgtttcgtccgaagatggttccgaccgttgtgggagttatagcctcagtgctgatgtcagcgagtccgagagctgcagcagcttctccgcacgccgcttcgacgccgagggagcttccagctccgccaacctctcgccgcggcccgtcgctgctcactttaacttcccgccggcacaggtaatgcttcccgtcattggcggcaaagacgtcgtcgtttgggatcacaagcgtgacctcgatttgtcggagcaattgcattttgcagaagtggaaatgatgaaggagaggtttgctaagctgcttctgggagaggacatgtctggaggcggaaaaggggtgtgtactgcacttgcaatctccaatgcaataactaatctctctgcaaccgtttttggcgaactgtggaggttggagccactggcgccacagaagaaaaccatgtggcgtagagaaatggagtggctgttatgtgtgagtgattccattgtggagttagtgccatctgtgcagcagtttcctgggggtggaacctatgaggtgatggccacgcggcctcgctcggatttgtatatcaatcttccggctctgaagaagcttgatgggatgctgcttaatatgcttgatgggtttcatgacacgcagttttggtatgttgaccggggaattatattgggtgattccaaggattgtgatgcctatggtagaccttcggttaggcaagaggagaaatggtggcttccctctcccaagcttcccccaaatggcttgtccgaggaaagtaggaaaaggttgcagcagtgtagggattgcaccaatcagattctaaaagctgctgttgcaattaatacttctgttcttgctgaaatggaaattcccggtgcctacattgagtccttgcccaagaatggaaaggcttgtctaggggatataatctatcgatacataacggcagaccagttctcgcctgaatgtctccttgattgcctggatctttcaacagagcaccacactctggatatagctaatagaattgaggctgctatacatgtatggaggctgaaggaccataagaaacatctaagttcagcaaaatccagacggtcttggggtggaaaggtgaagggacttgttgctgatggtgagaagaacaagaacaactttcttgcccaacgggctgagacgcttctagaaagcttgaaacacagatttccagggctccctcagactgcactagatatggccaaaattcaatataataaggatgttggacagtctattcttgaaagttattcaagagtgatggagagcttggcctttaacataatggccaggatagatgatgtcctatatgtagatgatagcataaagcggtgtgcagctgcagattctctctcgttgttcagcaggggaggttttggaggcatgcccattcagaagcgattctctcctagtcccttctcaattcagcacaccccatatgcctccccatttgcaacgccaacattttgttcctccactcctgttactgggagcccttgcagtcctgcaaggatacatgatgtgaaaaggaatgctccaaaggagggtgcagattcgaagactgaaaagttggccacatctgagtttgagagggtttggtcatatgccggaaacctcagtgcaagaagagcatctggcgatgctccagaaagagactga

SEQ ID NO: 66993 - DNA, 324 bp, Glycine max
  Peptide Sequence Number=SeqID_183771
atgaaggctgatgactcttccactcaaaaagaagagcagatgaaacctatgcgaaataagcaaaatgcactccaccacaaagttgccaggtccatcaagttcaaccagatgattgggtgggagaaagacatacctgtggaccttgcgacggtgagtgttttcgcatgctggagaagcacacttgcgacggtggtcagcgtggtgttgcaagagtacgagagtgggagtgagagtgtgagattgggagtagggtgtgcgagagtgcgagagtgggagcgagagtacgagagtgcgcgggcagtccagttttggtttttaaattaa

SEQ ID NO: 66994 - DNA, 309 bp, Glycine max
  Peptide Sequence Number=SeqID_183772
atgatatttgtacgcggaaacaattataatggctttgtcgcttctgggacattctatgcgaagtttgtggcggaggatttggtgaaagactacgaggctggccttgagtacgccgtggctgaggcggtgcttgcgaaaagggtcgccgatgaagggacgccggagtttttggttaaatgggccgatttggaggagcccacgtgggagcccgagcttgtcaaagcctttgaggaaactaacaaccaggcccagcccagtaataatgggcctgctgtggtcgcttccaatcaggatagccctagcccgtga

SEQ ID NO: 66995 - DNA, 954 bp, Glycine max
  Peptide Sequence Number=SeqID_183773
atgggaggaagaatgcacacgaaatcagactcggaggtgacgagcaacagcatggagcagtcgtcgccggcgcgttctcctccgcggcggccactctactacgtccagagtccttcaaaccacgacgtggagaaaatgtcctacggctcaagccccatgggttccccacaccaccatttccactactacctctcttcccccatccatcactctcgcgaatcctccacctctcgcttctccgcttccctcaaaaaccctcgcaacttctcctcctcctcctcctggaagaagctccaccctcaccccaaccgcgacgttgaccccgacgaccatgacgacgccgaccaccacctcaagcagtcctcccgcaacctccgcttgtacttgtggttcttcctcctctttcttctccttttgaccctcttctctttcatcctctgggccgccagcaagacctacaagcctcgaatcattgtcaagagtatagtgttggagaacttgtatgttcagtcaggaaacgatggaactggggtaccaactgatatgttgtcgttgaactcaacggtcagaatattgtacagaaatcctgccactttcttcggcgttcatgtcacttctacccctcttctcattagctattaccagcttgcaattgcctctggccagatgcagaagttctatcaatcgaggaagagtcggcggagtttggctgtagtggtttcaggacaccagattcctctctatggtggcgtgtcagttttagggaatactaaagagcatttggagagtgttgcattgccactgaacctgacatttgtagtgagatcaagggccttcatcttgggaagattagttaagtctaaattctttcgaagaatcagatgttctgtcactttgcatggcaacaaacttggaaaacatcttaatttaacggattcctgtgtctacaagtga

SEQ ID NO: 66996 - DNA, 1479 bp, Glycine max
  Peptide Sequence Number=SeqID_183774
atggaagaagtggctgaagaagctcaatatttcagatcagaaatagctctgttgaatttctcggatgccaccttcaaacccccactttctcctctgttgatacacattgatcctctcctacccaatggtcacacttgttctgcatcagaatctgatccatcacccacttcacagcatcagcaggagcagcatcatccaaaagatgcgtggcttccaatcactgaatccagaaatggaaatgcctattatgcagccttccatattcttaattccaacattggattccaggctctcatgcttcccgttgccttcgctactctcggttgggcatggggtacagtatgtttgtcactagcatttgtttggcagctctatgctatatttcttcttgttcagcttcacgaatacgtccctggaattcgtcacagcagatacctcttccttgctatggctgccttcggaaaaaagttagggaaggtgggagcattattccccgtaatgtacctttcaggaggcacatgcgtcatgctaatcatcaccggaggtgggaccatgaaacaattattcaagacgctttgcgaaaacgataatgggaaaacatgtaatgcccatgcacttagcggggctgagtggttcttggtgtttacctgtgtcgccattcttattgcacagttgcccaacctcaactcaatggccatggtttctctcgtcggcgcggttacctctatcacttattgcaccctcttttgggttctctctgttaagaagggtaagcctaacaacgtatcctatagctcatccctgtcccaagaacacacaccagttgctaagatcagtgacgttctcaatgccattggaatcattgtcctagccttcagagggcataatgttttgctcgaaatacaggcaagggacgctgccttcaaatttggaacaaacatccaaaataccaatgcgaagaggagtgagcatgtcatatgtactcatttccatattaacgatggaggattgttatattcgtttccagaattccacaagaggcaaatcacaaaattctctatgggtgccatatatgttctagtaataatacattgtttaaccagctttcaaatatatgcgatgcctgtttttgacaacctggagataagatacacgagcataaagaatcagagatgttcaccattagtgagaacatgcataagattattcttcggggggctgacattttttatctcagtcacgttccctttccttccaagactatcaacactacttggaagcatgacccttgtgcctatcacatatgcatacccctgtttcatgtggttatccctcaagaaacctcgtccaagaggtataatttgctgcttcaacgttgcactcggttctgtagggatgcttctcagtgctcttttggtagctgcagctattcggactctagctctcaatggccttgatgctaacttcttcagaccataa

SEQ ID NO: 66997 - DNA, 333 bp, Glycine max
  Peptide Sequence Number=SeqID_183775
atgccaatctccccctgcagatgtatcaattgggatcgcgcccacaagacgcccaatggacccgaagaagtccaacagggccctggggtttccagctctggttacgggcctctgacagtcctacagggtacccgttcccccagcgaggaatcgcacccacaaagacacccagtggacccggagaagtccaacagggccctggggtttccagctctggttacgggcctctgtagtcctacagggtgcccgttccccccggcaagagatcgtgcccgcaagacacccagtggacccgaagaagtccaacaaggtcttggagttgccaagctctaa

SEQ ID NO: 66998 - DNA, 741 bp, Glycine max
  Peptide Sequence Number=SeqID_183776
atgatatcccggcgcaaagcgcactgtcaccccggcgtccagctggcgatggaaggcgcggccgcccagcgtcaccgagccgcgatcgcccggcaggtaggcggcggagccgaactgcgtccccccgtcacacgtgacgaagtcattggaagcggcatccggctcaacatagaagttgccgcggcgcgatcggtcgccgtagcgcagacgccctcccaaccaggccttgttcgagcagaactcgtttttgccgatcatgtgggtgtaggtcaggtcggcgtagaacaccccggcgtcatagttgagctggtactccagcccgcggaagcgggttttagacaggttgttgacgtaagcggcattgccgatgctcggctgcaccagccccggtttattgcggtctatcgccaagttgatgtagttatccactttggtgtcgaagtaggccaccttggccaccaaccgatcgccctcaaaccacagatccggctgctgcacgttgaacccgacttcccaggcgcgcgagcgctcgggctgcaggaacgggttggggtattgcgtggaagaactgtgtgcgctgccgttagtcagcgtttcggtgatcgccggcggccgccaggatttgccgtaggtggtatacagctcaagccactccacgccggggcgcaccgccaccgccagcgtcggcgacagcttgccctgatcgcgatccacgtcccaatcttcgcgggtagtggttga

SEQ ID NO: 66999 - DNA, 318 bp, Glycine max
  Peptide Sequence Number=SeqID_183777
atgccggccagcggccggcactacaactcaggcttccgcgctggcggcatccagctgcgcgacgtcctgcacgctcaacgacaggttggccgctgccagcagatcgtgcagctgttcgacggtggtggcgctgacgatcggcgcagtgatcgacggccgcgcgatctgccacgccagcgcgatctgcgcagcgctggcgccgtgcttgctggccacgtcatccagcgcctgcaggatgcgcaggccacgcgggttcagatagcgcttcaccacggtctctccacgcgccgggctcttggctgcatcggccggcgtgcg

SEQ ID NO: 67000 - DNA, 354 bp, Glycine max
  Peptide Sequence Number=SeqID_183778
atgtttgggtgcgatgcagataatgtccaggcgttgccatgcacgcggagaaactcccccggtggggcaggaaaaacctgggtcagtgagcggcgggttgccgcgcggggtgcagttctggcatcgcgggtccttgtgccgacgcaaacgaaaacgcccccgggacttgcgttccgagggcgtcgtcaggcctcggagatcggggtggccgatctccgcagggcgggtatcaggccgttgtcagctggtcttccttgccgaacgcgcgcgccagcacgtccatgcgcaggcatggcagtagtttggcggtggcgacggaatgcgcgttcaagggagttttccagtggtcgttga

SEQ ID NO: 67001 - DNA, 612 bp, Glycine max
  Peptide Sequence Number=SeqID_183779
gggacacgctttacgacgcccttaccgaactcgtgcttagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacaagcacgccttcccgtcatatggcttgcctctcaactatacgccacccaatgtggcgtacactcccaataagaatgtcaataactccactcctatacccattgaaagccagcaaccccaaactgatcatgcacatggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattgaaggag

SEQ ID NO: 67002 - DNA, 177 bp, Glycine max
  Peptide Sequence Number=SeqID_183780
atggagaaatgctttacctccgtgctccattgggccaccaaggtttgtttcttagaccaccaagagactaggttaggaccaagaaatacgcaggacacatatgtgaagattccaacatctcaggttaaatgcctaatcaacatcacagtaggcctggagaacaaggggaagagctga

SEQ ID NO: 67003 - DNA, 453 bp, Glycine max
  Peptide Sequence Number=SeqID_183781
atgaaaacagtgaagagaacgggcatcgcgctggcgatagccctgactttccccctcgcattacccgccgctacggcggcgcaaccctccctgactaacagtaaggcggcaacgatgacggaaaaacacgggcagttcattgcggtcggtaaagtggtgcaggtgaccttcggcgatttcgccttcaagctggattttaccgatgacaagaccatgaccttcaccggtatcggtgaggcgtcgcagggcatcaccgacaccgtgcagtacaccgcggtggagatccggccaaaggtctatatggtctattggcatgagccgcagtccggcgacaacgtgacgcatatcgaggactttgagcgcggcgaggtgtacaccaacatcgccgccaaggatggcagcttcacccatctgaaagggcagctgaaaatcgtaggtcactcaggaaaataa

SEQ ID NO: 67004 - DNA, 363 bp, Glycine max
  Peptide Sequence Number=SeqID_183782
atgagctcaagctccgaagagaggagagagatcggtcacaggtccaaaaggagtttggctcaacacttggaaaccacagagcaaagcatgctagctatcatagggcaatacaaggaagaattgaaccagtccatggcccatgaacaaaagctagtggaggattttgcacaagtgtatgccgaaaaagaagcaagggggagggtgattgatgcactgcatcaagaagcgactatgtggatggatagattcgccttgaccttgaatggaagtcaagacctcccgcgtctattagccaaagcaaaatccatggccgaagtgtgtactgcccccgaggagattcataggctaatcaattactgttaa

SEQ ID NO: 67005 - DNA, 716 bp, Glycine max
  Peptide Sequence Number=SeqID_183783
ccaaagcagttggtatgatttcaataatggaaatatagagtatggcattgattttgagccgttgacgctgacggtgtcaagagacaaaaaggtattgctatcacaggatgctaaaagtaatatccattatgacactaaaaatgtagctcaagctgatgaagatattgctgttctgacggtacataaagctatcagggataataagctatcgttattacgcgatcattgtttagcatatgattatgatgatgtctctgacagtaaatatttcattgtcgatgttcgagaggataaacgctatgctatttgtgttatggctttcggcatgatgtcagccagagcagacgtagtgatgtctgattataatagccttgataaagtttcatccgtttttagcaacaaagatgtactgctgaagctaaagagcattttgggtcctgattacgataccttcagtcaaaactttgatgtgtatggtgaaccgcacctgacatcagcaggcggattgtttgtggaaggctggttaagagatctctacctggaacaggcttcagcctttgtaatacaacctgatggcaggacctatgctgcatggacagatgctaaaacgggcaaaataagttatcgatgtaatgttaatactgagaaaaatccgcagcctgatattgctgcctgggcaaagcgtttcaatagcgaccctgcgggggactctgcag

SEQ ID NO: 67006 - DNA, 687 bp, Glycine max
  Peptide Sequence Number=SeqID_183784
atggcactggtcgttgcgtgcagcggcgtagccaacgccagggacaaggacgcacctgcatcaccggtagccgccgttgatgaacttccggctgaccagagcgtgtccgaaacggtgatcgaactggccggctgggtcgtcgccagcaaggacaaccagggctatccgtttgcagtcatggacaaggcggcggcgcaggttctgatcttcagcggtgacggcaagctgcgtggcgcggcaccggcgctgttcggttcggctatcggcgatcattccgcacccggcgtcgccaagctcgcactgagcgcgattcccggccacgaccgcaccacgccggccggccgcttcatcggtggctacggcccctccgacgatgccgggcgcgtgctgtgggtggattacgattccgcggtttcaatgcacccgctgccgccgggcagcccgaaggaaaagcgtgccgaacgactggcatcgcccacgccggacgacaaccgcgtcacccacggttgcatcaatgtctcgcccgcgttctacgggcagatcgtgcagcccatgttcgagaagggcggcgtgttctacatcctgccggacaaggattcgatcgcgaagaccttcccggagttcgcgcagagccgcggggatgcgaaggacgaagacgagaagggcgcgcggcgcgcaagcaagtaa

SEQ ID NO: 67007 - DNA, 729 bp, Glycine max
  Peptide Sequence Number=SeqID_183785
atgaataagccaatcacaagccctgacctgcccaatctggtggaatcgtcattgccccagcccaatcatcaccagctcgccgcggcagatctggggccgccacgcatcctcctgctctacggctcgctgcggccgcagtcgttcagccgcaagctggcgctggaagccgagcgattgctgcgccatctggggtgcgaaacccgcatgttcgatccgcatgcgctgcccatgctcgacagcgtggacacgagccaccctgaagtgcagcggttgcgtgcgtggtcgcagtggtcggaaggccaggtctgggtcagccccgagcggcatggcacggtcaccggcgtgttcaagaaccagatcgactggttgccgctggaagatggcagcgtgcggcccacgcagggcaggacgctggcggtgatgcaggtgagcggtggctcgcagtcgttcaacaccgtcaatacgctacgcgtgctcggccggtggatgcgcatgctgaccatccccaaccagtcatcggtggccaaggcctggcaggaattcgatgacgatgggcgcatgaagccctcgccgtactacgaccgcgtggtggatgtgatggaggagcttgtgaagttcacgctgctgacgcgagggcggtcggactacctggtggaccgctacagcgagcggaagggcgacgcgcatgccgcggtattggcgcgggccgcaggggctgcggcttcctga

SEQ ID NO: 67008 - DNA, 915 bp, Glycine max
  Peptide Sequence Number=SeqID_183786
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggccggttggaatatcacaggagggactataacgaatccgggtatttggagttacgaaggtgtggccggagcacatattgtgttttcgggcttgtgctttttagcggctatttggcattgggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggatag

SEQ ID NO: 67009 - DNA, 294 bp, Glycine max
  Peptide Sequence Number=SeqID_183787
atgggatttccaaagtttttaatagaggaatttatagctggacaattaaagaatagagtttcgtttcgtaaagcaatgaaaaaagctattgaattaactgaacaggcgggtacaaaaggagttcaagtacaaattgcaggacgtatcgacggaaaagaaattgcacgtgttgaatggatcagagaaggtagagttcctctacaaaccattcgagcgaaaatcgattattgttgctatacagttcgaactatttatggggttttagggatcaaagtttggatattttctaaataa

SEQ ID NO: 67010 - DNA, 306 bp, Glycine max
  Peptide Sequence Number=SeqID_183788
atgtctccactgccctatgctatttgttggatctttcaggtgtctgtcttggcagatgacattctaaagaatgtggagtatgacgcattaaggattgttttcaacaaatttcattctgttgtacaatttttgccaacagttgcaactgtactgtctcctgaggttattgagagagaggctgaatcaggaggaaagcttggggaattggattcatatgagattgaaggtggcgagacaaaagctgaaattcttcagaatctggctgagttccagttttcttgtgtgagtaattttcaaaaactttga

SEQ ID NO: 67011 - DNA, 1137 bp, Glycine max
  Peptide Sequence Number=SeqID_183789
atgcgtgtagatgttactcaattttttgcaacttgcattgattgccagcatactaagtatgagagaaagcaaattgcaggcctattatgtcctctgccagtgcctcatcgtccttgggaagacctctctttggacttcattaccggtctgccaccatatcatggccacacagtcatcctcgtggttgttgagagattttccaaggggattcatttggggatgcttactccttcacatacggtccacactgttgcttgtttattcattgaaactatggccaaattgcatggtatacctcgcagcctggtctctgatcgcgacccactcttcgtcaataacttctggcaggaacttttccgtttgagtggcaccaaattgcggatgagttcagcttaccatctccaaagtgatggacaaactgaacggctgggaacgtggggcaaattgctgctgtgggtagaatggtcacacaacacttcttggaatgttggaactggcaccactccatatgaaataacgtttggccggaaaccttgcacgattccagattacatcataggcatttccgacattgccatcgtcgaagctatgttaaccgatagggaggataccttcaagtacattaggaagaagctgcttaaagctcagggtttaatgaagcagtacgccgacactcgacgtcgtgatgttgaataccaagagcacgtcggcaaacttgcaaagagattttatgggcctttttcgatcacaaagcgcattggtcaagttgcttacagactccaacttccggcaggagcgcgcatacatccggttttccattgttcattgttaataccattcaagggaactccaccatcagataccactggacagctacccgagaagttctttggcactcaacccatcattgcccctctagcaatcttggaccacagacaaatttcgaatgatcctccacgctgggaagattatcaccttgaggacaaggtgcttttgcaagggccatggagtgttagcaaagcatcagacacagaggcaaactcaggggcaattacaagaaatcatacagagatgcaaatagcaaaagaagggaaaaaaagaattgcaaaaccagcgtaccttcaggattatgtgtga

SEQ ID NO: 67012 - DNA, 1635 bp, Glycine max
  Peptide Sequence Number=SeqID_183790
atggctcaatacctggctgaatttgaagaacttgcgaatcgtgttgtctggctccctacgcaattccttctgagttgtttcatctttggcctcactccagagattcagtgggaagtgcaggctttgcaacccctgaccctcaaacacttgtcaccggaggaacttgcgtcgcgctgggaccgcggcctgtgcttcaactgcgatgaaaaataccatagaggtcacagttgtgcctctagggtttttttccttgtcggggatgctgaagacccgtccctttctaatatagactctcctaacccgccctctaacccaccatatgtgagcgacccgacccaggcccaaatcaatttccattctctcgcgagtcatctggccccaaaaacgctccacttacttggctccatcaccgaccaccctgtcgtgattcttgtcgatggcggtaatacacataatttcatccaggaatcgctcattgctcatttgggattttcctctcgtgaaactcgaccattacgagttatggtagggaatggacaacatttggagtgcacacgatggtgtgaggcggtcaccattgacatccaatcaactcagtttacccttgatctctacgtcctccccatctctggcgccaatgtcgtgcttggtgttcagtggcttaagtctcttggaccagtactcactaactacaacaccttgtgcatgaagttcttctatgcgggtcaattggtggagcttaaaggagatcgtgagaccaccttccacttgatgtcgccaccccaattcaataaggtgctcaggaaacaaagtcctggtgttttctatcacattgtggtcctcagggatgacacttctgccagctcccgtgacgaacaccccccaaaaattcaggaattactcatccgtttccaagtcctgttccaaccaccgtctgctttaccgctggagagactgactaatcatcacatccacatgcttcctcaggcaaccccggtcaacatgcgcccctaccgctacccccattaccagaagtgtgagattgaacttcaagtggaaatgatgctccagaagggcctcattcagctgagcaccagcccattttcttctccggtcttgttggtaaggaagaatgatggctcatggagattttatgttgattatcaggctcttaatacgctcacagtgcatgatcggtttcccattccgaccattgatgaacttcttgatgaattggggcatactcgttggttctcaatgcttgatttattgcaaggctacaatcagattcgcatgcacgccaatgacatccctaagaccgcctttagaaatcaccatgggcattacgaattgaagtcacaggtcgaatatttgggccacattgtctctcaaggtggagtggcaccgatagctgccaaaataggaaccattgaccaatggcccacacctcagacgaccaaagcactttgcagcttcttggggctccttgggttctatagacgcttcatccaggggtacgccaccatcgctgcccctctagtcaaggccacaacaacagaaccacttaagtggaatgcagaagcccaatcttcttttgatcaactcaagagagccttgtctcaggcccctgtctag

SEQ ID NO: 67013 - DNA, 381 bp, Glycine max
  Peptide Sequence Number=SeqID_183791
atgtatgcgtgtaaaaatttgcagattatggttagaattagagggttaggtcgtgtcttaggcagagttataggtagagtcatggggagagaggatcgttattcagatgatgttctccagcgacgaaggtctacaccatccgcacgtaagcagcgggaagctgcccctgttgctgaggatgctcctgacgtggctgacgtgactgaagatgtgacgtggctgacgtggctgaagatgtattccaacatgctgaagaagcagttgatgatactgaggggtttccaggaacgtcctgaattgaagctatcctcccatggaaggaaggttcagaaatttgggaggcctgctcctaaaattgaagggctagtggctgccacatga

SEQ ID NO: 67014 - DNA, 366 bp, Glycine max
  Peptide Sequence Number=SeqID_183792
atggacgacgatcaatggatgtatgacagtataatatctgaagaagttgatatggatgatgaaaatgaacatgatgttggtgtgaatgaagaacaacatgttgattgttcggatgcattcaatacttctcggttgctcaagaaaacagatttgtggtggtctcacatttactccgataaatatctcatagccacaataagcagtcttgaagttgtgggatgcgcctataataggaagatgaagcagagagaccacatcatcaagggtgatggtcacctctccaacaggaagatggaaactgttcgtttccttatgtcatctctccacaaaagcatatataagtctccgattgtcagtgttcactga

SEQ ID NO: 67015 - DNA, 906 bp, Glycine max
  Peptide Sequence Number=SeqID_183793
atggaagaattgctacacaaaaagagatatccttatcaccacccagtgtacggaagtctcaccagatcagagacattgaggtttaacctcagtcaccagccctctcagattttcacacgcgcctcaaacgctttcacttctaacatctgcagaagttttttttttgtccctggatttggaaaacagctagtttccatggaaggtttggtgagttctgggatcaacacggttcgtgtttttggcattacaaaacaccaatctcgttttcttccttcatcaactctgcatctgaggaataacagtgtgtgtggatttggaattggggttgagaagaagaagaagaaacagtgtttcgttgtggctgcttctgttggtggctccaaagtggtccattttgagaatacactcccttccaaagaggttcttgagctttggagaaatggtgatgctgtgtgctttgatgtggatagcactgtgtgcttggatgaagggattgatgagcttgctgaattctgtggggctggaaaggcagtggctgaatggactgctagagcgatgggtggttctgttccgtttgaggaagccttggctgctaggctgtctttgttcaatccctctttgtcccagcttcaggattttcttgaacaaaagccaccaagcaggtcacaggttctggaatcagcttgtaaggttgcctgtaatagacctgtaatgggtttgacatttcccaggctttcccctggcattgaagagttagtccagaagttaaaggctaatggcatagttgtttatctgatctctggtggcttccgtcaaatgatcaatggaggggggatcaaatctgatattggaattttgatcagggcctcttccattgcccttaagccagctgcaagtctgttttga

SEQ ID NO: 67016 - DNA, 750 bp, Glycine max
  Peptide Sequence Number=SeqID_183794
atgagacgtcgttgtaggcctccggccagtctacgacggtctccttccaccattttagaaacacacgattcctgcgacggggatgactggaggcccgtagttgcaggttcgccttcgaagacgttgccagcacgaggaacgacgttgaaaggtaagcttttaaggtcgggctatggcagcaccgatgtagtgtataacaatcaatgcttgaaaggtaaggtctactacgtcgttgaccggcaacgactgccattgaatggttggtcaactacgtcgttgctgttgaaagcaacgacgtcgaaaggaaccttgctacgtcgtttccaggggaggaacgtcgttgaatgcatggccttgacgtcgtgtctgggagaggaacgtcgtggaatgcatggctactacgccgtttcgcgaaggagaccgccgttgactgcatgggaaaagctacgtcgttgttgtcatataattagatttaacaggtatgatgatacaaatcctgaagcagaaaagaaagagtatattgatcacattgaagaaagtgttcagtggatgggttggaaaccattcaagattacttacacaagtgattacttccaagaattgtacgaattagcagtggagctcataaaaaagggtcatgcttatgttgatcatcagacacctgatgatccaggtgtctacaatcaagtcattaataaaggatgttatggtgaggaggaagatcaattttatgtgcctacaagaaactaa

SEQ ID NO: 67017 - DNA, 661 bp, Glycine max
  Peptide Sequence Number=SeqID_183795
gtcgactctagaggatcccacggtggcgccgggagatggtcatcgcgtctggatcagcgtgccggagggggtcgatctggcctatgcgctgctgctgcgcaattttaccgacgggaagcgataatgcaaaataaacccctcactttgctgattctgaatggaaaaggcgcaggcaatgaagagttgcgtgccgccgtgaataccctgcgcgacgaaggctttaacctggcggtgcgcgtgacctgggaaaaaggcgacggtgaccgctacgtgcaggaagcgctgcagctgcaggcggaaaccgtagtggctggcggcggcgatggcaccatcaatgagattgccaccgcgctggccgccctgccgccagcgcagcggccggtgctggggattttaccgcttggcaccgccaacgattttgctaccagcgccggtatcccggcagaaatggaagcggcactgcggctggcggtactgggcaaagccacgcccattgttatggggagggtgaactgcgaccgttacttcatcaacatgccgaccggcggttttggcacgcgcatcaccacagaaaccccggagaaattgaaatcggcgctgggcggcgtctcttattttattcatggcctgatgcgcgttgatgcgctgaagccgaacagct

SEQ ID NO: 67018 - DNA, 168 bp, Glycine max
  Peptide Sequence Number=SeqID_183796
gttgaaatcgctggtgctggcagcttgaacatacgaaattgtataaattactgggaatttgtcaggaattggaaaggaggattggtgccatatcttgaagaatttgagtcaagaggcaaggggccaaccaccttaagagctattggactaagaagcacttcaaattga

SEQ ID NO: 67019 - DNA, 954 bp, Glycine max
  Peptide Sequence Number=SeqID_183797
atggaggttcaaacaggctgggaggagttattcattgagtattcacagtggttattttcagttttagaagactttgaaaaagactttgcactcaagaattacacaacacaagaaaaaagagtgattgggcacatagctgaaagtgaaatgaaaggtgtttacactcgcgcccactttagtgctgccacatatgctcgcttattcattccttctcttttttctgattttgaaaaagtggttttcatcgatgctgatactattgtcgaacatgacatctctgaacttttaaatctaaaccttggaaatgaacttgttgccgcagtaaaagacatagtcatggaaggttttgtaaaattcggcgctttgacacacattgatggtgaatcaaaaaatataaccgccgaatattatttgaaaaatgttcttgacatgaaagacacgcaaaaatattttcaggctggtatcttactttttaatattaaacagatgaatgcagaaaatacttttgcagcgttaatgaaagggatgaaagctcggaaatattggtttttagaccaagatattatgaatatggtattctatgagcgagtatattatcttcctatggaatggaatgtataccatggtaacggcaatactgacgatttctttccgaatctaaacttttcaacctacatgagatttttagagtctagaaaaagaccgaaaatgatacatttcgctggtgagaataaaccgtgggatacgacttcagttgacttctctgaaaatttcataagttacatttcagatacgccatggaataaagaattatttgataggctaaatggtattaaatattcacttagttcaaacagcgacaataaaaaggtgctttttcagacaaaagttaaaaggaaagtaatgccttatcttaataagtttgcgcccgtggaagtaagcgtaggcaaatga

SEQ ID NO: 67020 - DNA, 700 bp, Glycine max
  Peptide Sequence Number=SeqID_183798
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggacggcaaagaaggcctccttctgggggggccagagccatcagtgagataccactctggaagagctag

SEQ ID NO: 67021 - DNA, 450 bp, Glycine max
  Peptide Sequence Number=SeqID_183799
atgagatgcagatttgggatcttgctggtttttctggtttttatatcaatgttgctaggtgctggctcttctttctggatgctcggctggtggtctggctactattatacactgatgaattcagaggttttttcccagaaactaccaaagattgatgtctcctggggacataccatcaagaatttattcagtggtgttgtaaggctacagggagtgcaaaagaatctgccgcacttttgtactaatcaccttgatcccacttcgtgcttcttccctcagaatttgattgccggtattagaaccccactattcattcttaatactgcctatgactcatggcaggtccaaacaagcttagctccttcatcagcagatccccatggcttttggcatgattttagattaaatcatgatcaaaacagcggaaacaatgcaaaacaagaccaataa

SEQ ID NO: 67022 - DNA, 423 bp, Glycine max
  Peptide Sequence Number=SeqID_183800
atggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaactcaatggtttggatagaagtatgacacctgatgagataaaggagcatagggagaagaaattgaacagtccttggagagacaggccaatttcagagtcattgaagctctttgaggatatgaaaaatggcagtatagaagaaggaaaagccacacttagaatgaagcaagacatgcagagtgataactacaatattttaccccacaccctcatgctggagacaaatggtgtatctatccaagttatgattatgcacttctcacattag

SEQ ID NO: 67023 - DNA, 537 bp, Glycine max
  Peptide Sequence Number=SeqID_183801
atgcagggaagaatcaagatttgtgaaggaaagaatgttgatatggttttggatgaggagattcatgagttgacactgaaacttcagagattgcacaggaggtcgaaagtcaaggatttaggggccaggaagaacagaaattttgacaagcaggtttctgttctgcagaggcgactggagcagattggagggtcatcagatgagatttgtttgagggagtttcaagagatggaaaacataagcttgtcaattaaaagaagtagcatagttgatgataacgttgttgcaagtggaaaactaaatgtggagattttgaggaggaaaatggagggattgtcaaagggcatattattacagagaatggaggaagagtataattcactgctgtccactgctagtagttctcttgctagttctggttcaaattccaaaagacttgaatatcaagattcatcttcggtacgagtacctcatcagtgtacacagtgcacagtacacacacaatgtttttgctatggtgtacctaatcctgtttaa

SEQ ID NO: 67024 - DNA, 192 bp, Glycine max
  Peptide Sequence Number=SeqID_183802
atggctctgtttttgttttatctttttctccagatttggaattttgcagttttgcaaatagaaggggaggtgttcttcatgtggaggaaaagggcttggaacttggaagggagatgcgagactaaccataaactgggacaaaacgggaaagatactcttctatggggtaaaattgcaaacaaaaatatataa

SEQ ID NO: 67025 - DNA, 549 bp, Glycine max
  Peptide Sequence Number=SeqID_183803
atgctatttccatcccatttcagttattgcatcggaattatcaccacaataattcctaaagactggctttgtgagccttgccaatccaagcatgttccaacttcaccatgtaaagtgaatcaggatattggctcatgggcttctaaaaagcatcgagctgtcaaaacagcgaaagtgaagttccgtcacttggatgaagtcattagactttcttcccagaaggcttctgctgtatccaaaaatgttactttctccctggctccaaaatcaaatcctcaaacttcacctcctaaagtacttgggaagcttccaagaaatgatgaagtacacaagaagccaatgactaatcaacatgtttcttgctcgttagcaaaaagtgagaatttctcttcatctttgctgccatccctattctttttttctcttcagaaagaacgcaagttcctcttaacattgaggatacacgttctgaaaagtgcaaattttaagtggatgctgaatttgatgcaattaaaatgttgtgcacttgtgcttgctcctgtcaagtaa

SEQ ID NO: 67026 - DNA, 930 bp, Glycine max
  Peptide Sequence Number=SeqID_183804
atggatcttgtaggaccaacgaaggagtgtattggagaaaatcagcaaccacttggtggattagtagctgataaaaaagttcgaccccatgttcctcagaaagaaaagcctacaaaaagggcaccttttgaaggtttatcagcaaaaaaatcttcccctttggtcaattcaggtggtatatttagcgctgctgctgaatctaaccagtttaatattgataaaagcaaccgtcaaagaattcagaaaaacttaaaccttcatcgtaaatttttaccctcatcaattccttcttggaggggtcaaatccaaattcttcaaaccgctgcatccggagaaacttatgatgggtttgaggcccaaccaccatgcgtggttaagaggaaagcatatgagttttcaagagaaatgccatcagtccttcaactggagtcactttcggcatcgaatgttttgactgacatattctgggatggttctcctaagcttcaagatattgcattgtacttctttccatcaaaacaaactgagaagtccaaagagaacctgaatagcatattgaagtttatgaatgccaagaaatcaatgttgagaagttatattgatggagtggagttgatggtatttacctcaaatcaactcgacatggactcaaggggtgctattgctgcagtaaatgctggacatttcctgtggggactctttcgccaaaataagattgataaagctatcaaaagaatacctgacatggagccagtcgatatggacattgatatgattgggggaaaggatgtggtggggagagttgatcatgttcgaaaagataaaccagagagtgcctctatgacggagtatcgtaacaaactagatgttccaccaggttttgaagcattttccaaaatgtcttcatgcaatattgttgtggaagattag

SEQ ID NO: 67027 - DNA, 498 bp, Glycine max
  Peptide Sequence Number=SeqID_183805
atgggggtacaggatccaggaaccaaactgcgggtggagttgtttcaaggaatgggtcttatggaggatcgagttaaacccaaacatcataacaagggtggttcaggggatgaaaagctatattttcagtgtgcaggagcttttgggataggtcatagatacccagaaaagagtttaagggtggtgattttagcggaggatgagcagatcaatgaggaaggagaaattacaagtataaaaactgagatgggtggtgaggaggatgataatgaggaggttgaggtattggttttaatagatagtggagcaagccacaatttcattttcatagaactggtacaatggctagggttggtggtggaaccaactaagccttataagggtggatgtgatattatgagtagcatggctagctactttgggataagtcaaagtgaattggaaaactcttacaatgaaatttgtaaagcaaggacaagttctagaggtaaagggtga

SEQ ID NO: 67028 - DNA, 573 bp, Glycine max
  Peptide Sequence Number=SeqID_183806
atggccatcgaaggttcaaaatgtcgtcttaggaatatccgtaggatgaacccgaatttgatggtagcccaaacgaagatcaattttaaaaaacacggtagccttgcccaattcatcaaggagctcatccacagtcctgaaatggttggggaatgttggatgggagaaacagaggatgtaaaggtgttgtatgagcagttagtgaggaaggttgaaaacaaaggagtgaagtgtcactgcgtgaaatgtcgtagcgtgagagtcgctaagaagtcaacaatcaaggatgttacaaatggtatcagagcaaacatctctcccagtatggtgtggttcgagaacgaattaggcagaagttggtgggcatgtaacaccccaatcgaaacacaccagaatgagagggatctagaggctgtgcaggtatggaactgtacagttgaagatgacttaaaggaattaattggtactatctataccaacaatatgcatctactttttagtagcccatcacttaagaacttcatagttaggcgtgtttggcttggagtagttgtgggatggatgaccttttga

SEQ ID NO: 67029 - DNA, 606 bp, Glycine max
  Peptide Sequence Number=SeqID_183807
atggtcagaactagaggattgagtcgggctttaggcagggttataggaagagccttagggagagaagaagttgcacatgttgctgtggatgttgagcatgtggatcatgaagctgacgagttatcctcccatggaaggaaggtagagaaattgggcaggcttgctccagagattgaaggcttagtggcttccacaagattaagtcctctaattgcatattccttggatactagtgacaggggacttatatcggctcttgcgaaaaggtggaaaaaggaaacttgtagtttttatcttttggtaggagaggtcactatcactttggatgatgtggaatcattgctatatctgcccattacagacgccttccatagctttgaggctgttcatgtggacgaagttgtggacctcaatgacttccaagattattttgatgatgccaaagaatcaagagttaagcaagttccaaagaatcaggagtcaaaaagcttcaagaatcaagattcaagaataatcaagtttcaagattcaatcaagtttcaagaatcaagattcaagactcaagattcaagaatcaagagaagactcaatcaagataagtactaa

SEQ ID NO: 67030 - DNA, 1131 bp, Glycine max
  Peptide Sequence Number=SeqID_183808
atgtcgattttggtattgcacaacaaaggggatcttgacatatcaagatttggaggaaaaccaaattcagatataagccaggctttcttaggtgcctggactcaagcatgtgcatcgacaactgctgtcaaaattgtgattctagctggtacatatcaaatgggtgcagttgatgtaaaaggtccttgcaaggctcctattgaggttcaagttgatggaacaattcaagcacctacaaacttagctaaccttaagggggctgaacaatggtttaaggttcaacatgttaactctttcaccctgtcagggaaaggagtttttgatggtcaaggtccaattgcttggaaacaaaatgattgtacaacaaacaagaactgcaagatgctttgcatgaatttcggttttaatttcctcaataaatcaattgtccgtgaccttacttccagggatagcaaaaactttcatgtgaatgttttggcgtgcaacaatttgacatttgatgggtttaaaattagtgccccagaagatagtcccaacaccgatgggattcacattggaagatccacagatgtgaaggttcttaatacaaacattgctactggagatgactgtgtctcattgggtgatggttgcaaaaatataactgtccaaaatgtgaactgtggacctggtcatggcattagtgttggaagccttgggaggtacgataatgaagaggccgttgaaggtcttctagttaagaattgcattttgacagatacagataacggtctgaggattaagacttggcctagcacgccattaacaattacagttactgatatgcattttgaagatattaccatgaaaaatgtttcgaaccctgtcatcatagatcaagagtattgtccatggaaccagtgctccaaaaagagtccgtcaaaaatcaagataagcaaggtttccttcaagaacattaagggcacttcaggtactaaagaaggagtgatttttatttgtagtagtggtgcaccatgtgagggtgtagagatgactgatgttgatctcacattcaatgtagctgcaacaacagctaaatgtgctaacgtcaagcccgtaataacaggaaaagctcctacttgtgcagcctag

SEQ ID NO: 67031 - DNA, 627 bp, Glycine max
  Peptide Sequence Number=SeqID_183809
atgactttgacattgtgcataaaaaaagggctacaaacaaggcagttgatgctctatcaaggaaaggtaaggagaaggagtttcaaggtttatctaggccttaatagaagttatcaaggtgcagtgaggtgtacaccatttaaggtggtgggtggtagagttccttcttcactagcaagattcatttcgggggagatgttggtagaagttgtagcacaagatatgatggagagagataaagctttgaaacaattgaagtatcatttagggagggctcaagatcatatgacaaggtatgcaaatgctcatagagtgccatccaagataaaagttgaagattgggtgtacttaaaaatcaggcctcttaggaaaacttcaatgcctattagattgtatcctaagttggtagttaggtactatggtccttatcaagtggtccaagcaaattggagtagtggcttttcaactacaactaccagaacatgctcatattcatccaatttttcatgtctcccaactcaagttagttgttggagatcatccggtagaagtcgagctgtcagcagagctgcaaggccattccaatggtgtgcaaccgcatcaagagttggggagagactaggatga

SEQ ID NO: 67032 - DNA, 504 bp, Glycine max
  Peptide Sequence Number=SeqID_183810
atggatccaaccatcgatttagatgaagttttagatcaagtgataaatgaggaattggaagacaacaccgatgaggaaatcattaggttgatacttgagagccaacaacaactacatggaaacaccactaggcatagtcaaagaagaagagtgaagtgcgcagctgctattcgtatattggcttatggatcacctgctgatagtgtggatgaatatgttcgagttggtgaaacaactacagtggaatgcttgcagcgatttgtattaggcatctgcaccatatttgggaatgagtacttgaggagaccaaataacgaagacaccgaatgcctactacaaatgggagcagcacgtggatttccagttttgtcaggacgtgcacctgcagtgcaattcacagtgaataaaacccaatataatatgagatactatttagcagatgacatttatccagactttgccacatttgtgaagaccatctcaatgccacaaggagaaaagtga

SEQ ID NO: 67033 - DNA, 429 bp, Glycine max
  Peptide Sequence Number=SeqID_183811
atggatgttgtaggaccaccaaaggagtttataagagaaaatcagctacccttgggtggagcaacacctggtaaaaaagttcaaacccatgatgctcagaaagaaaatcctacaaaaggggcaccttttgaagctttatcagcaggaaaatcttcccctattgtcggttcaggcaggatgcttttctcgttatgtctgatgcttttttctattgtttgttgcatttactcaagtctcttcgtgcaaatgtgggcatgtggtatccctcgtgctgctgctgaatgtaacaaatctaatattgaaaaaagtggccttcagagtgttcaggaaaacttaaaccttcattgtaaatttttaccctcttcatttcctgcttggagtgacatctttcaagcaatatcagaaatgactatgtacatgggtgcataa

SEQ ID NO: 67034 - DNA, 450 bp, Glycine max
  Peptide Sequence Number=SeqID_183812
atgccaccagtccttcaactggagtcacttcctgtgttgaatgccttgactgacatattccaggataattctccaaggcttcaggatattgcattgtatttctttccatcagaacttactgagaggtccagaaagaacctggatagcatattgaagtttatgaatgctgagaaatcaatgctgagaagttatattaatggagtagagttgctggtatttacctcaaatcaacttgacatggactcaaagggtgctatagctgcagtaaagactcgacatttcctgtggggattgtttcgccaaaagaaaattgataaagctgttgaaagagtacctgacctggagctagttgatatggacatcgatatgattgggggaaaaaacatggtagggagagctgatgacgttcaaaattataaacccaagagtgacattcctctaggcttttga

SEQ ID NO: 67035 - DNA, 507 bp, Glycine max
  Peptide Sequence Number=SeqID_183813
atgtggctgagagggagagaaagcctgagagtggctgggaattttaattcctctatttttgacgtaagtgaaggcgccggcgaggccactcgtggcggcaccaatgagggcacggtcgaggacgaagagggttttaaggaggggctttggggtgggccaggcccatttggaggtggaggtgaaggggagagtgggggtgtgggaagaaaagtgtgtgaggagagaagggaaatcgaaagatgtggagaaagagaggcagatctaactagagaggcatgtccaaaaagtcatccaagagatagaaaggacaaagagaaaagctttatgatctattgtgagtgcaagaagccaagacacttcaagtttgaatgtttagacctagaaaagacaaaggacaagaagaaacacttcaagacaagagacaagaaggtgctcatgagaatatgggaagactggaccgcacatcgtctaacaaagagacaaaagaaaaagcaaatttctgcttaa

SEQ ID NO: 67036 - DNA, 336 bp, Glycine max
  Peptide Sequence Number=SeqID_183814
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtgggtag

SEQ ID NO: 67037 - DNA, 195 bp, Glycine max
  Peptide Sequence Number=SeqID_183815
atggatatggcatggggaagtgccgaacatgccaacaaagatatgattcacgatcttgggaaagacggttttcaacaagcacatgcacccttgtatgacaaaatacaaagtcattcaaagaagtctttgtattcgaggtgcacatctttcacaaggttgtcagcggtgttaagtttggtcaacttgaaggcatga

SEQ ID NO: 67038 - DNA, 180 bp, Glycine max
  Peptide Sequence Number=SeqID_183816
gtgagggcgtgcaaccctctaaaggcgagggcgtgcagtcctctaaaggtgagggcgagtaacccattggaggcgaggacatatagtcctccgaaagggaggacgtgtagtcctctgaaggtgagggaatgtgtagaagcaaatgactttgatgttttgatgatgatcatgatgatttga

SEQ ID NO: 67039 - DNA, 300 bp, Glycine max
  Peptide Sequence Number=SeqID_183817
atgaagtttcagcggatttcaatcggtggaagtgaaagaggagtgaaaaataggaagattgggttttacgggacacgatttggtgaagatttgagtaagatacgaagtttggaagatttaggtatggaggagacgagcaataagccttctggtaatcgattacaggatattgtaatcgattacaagctgcctgttcatgtatgtgatcaagaagcatgccatagtcagataattgttgcttcatccataaaatctatgcacaacaactaccagcagagatatactccgcttcagcagtag

SEQ ID NO: 67040 - DNA, 318 bp, Glycine max
  Peptide Sequence Number=SeqID_183818
atgtggctccgcatgccaccggcctcttgggtcacggtaacaaaaagtagggtggtcgacaaaagcagagcttttgctcctaccatttcgtttctaaacgaccatttagaggaaacactgggtccaacaaagataggagaaaatcactcaaagtgtatcaatctcacacagggtaaggattatggtgaattgggattttggctcaaggcttgtagagcggctggtcatgatacatgtcaggatttggccagcggttcggggataaaggggatgtccccacattattcccatgatacacatgcaacaaatgatgattag

SEQ ID NO: 67041 - DNA, 171 bp, Glycine max
  Peptide Sequence Number=SeqID_183819
atggagaaaactaagaaattgaagtcgggagaatgggtcaatgacaagtcccgcgaatttgcttctatcataccagctcctagtctatcgcctaccatagcagatggaacagagcaccatgctaatgatgctcaggttgatcgtccttatgacatgggaaataatcattga

SEQ ID NO: 67042 - DNA, 228 bp, Glycine max
  Peptide Sequence Number=SeqID_183820
atgaggtcgaggcactaccgaattgcgaccgtaattgacttctacatcgttcttcattcgttcttcgttcatcattcgctgggtgagcccaccatgaagtctaagcgcaagcatcacactaagcgtaacttcagcgagcttagcatgacagagaatctggcagatcactcatttcaaggtcgtgcgctaagcgcagagggcaccctcaaccaggctgagcgcaagagg

SEQ ID NO: 67043 - DNA, 456 bp, Glycine max
  Peptide Sequence Number=SeqID_183821
atgctccgtgctattcgctctcatgctttacggtgccctcaccgaacttgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcatcaaccaaatgaatcatccaacctcagctatggtaggcaaagatttgggaagtacgggcggcccccattatgtgcaaagtcaaaacaagcatgccttcccaccatatggcttgcctcccaactatacaccacccaatgtagcgtacactcccaatgaggatgtcaataactccactcctatacccattgagagccaacaaccccaaaattga

SEQ ID NO: 67044 - DNA, 679 bp, Glycine max
  Peptide Sequence Number=SeqID_183822
caccgctggtgtttcttgctcacgtggccgcgcacacacgtcatatccgcctcggcaccggcatcatcaccctgccgctggaaaatgccctgcgcgtggccgaagacgcggcggtgctggatctgctgagcgacggacgcctggaagtggggctcggctccggcggcacgccaacctcatttttgccgtttggcctgaccagcgaacagcgcgccggcgtgtttgccgaccagttgcatacgctgctcagcgcgtggcgcggcgacacgctggcccatccggacaatcatctctatccgccggctcccacgctggcgcagcgcctgcaaaacccgatgatcgatgcttatctcgcggcgctgccgtcgggcgtggcgccccgcatcctcgcttcacgcaccgcgtttgttgccgactcgaacgactacgcgcgccgccttgccgcgcccggtctgcagcgccaggcggagcagtttcgcaaggcgggccacgacatcaccggcagcacgctggagagtcatgtgcgccagctcgatgcgcatatcggcgatgccgacgcggtgctggcttcgctgctggccgacagcacgctgacgcgcgccaccgacatcaccttccaggtgcactctatcgatccgccgcacgccgatacgctgcgttcggtggcgttaattgctga

SEQ ID NO: 67045 - DNA, 279 bp, Glycine max
  Peptide Sequence Number=SeqID_183823
atggaagcatggaggaaatgccttgtgtcgcaacctacccttcgatgggagggcgacgcgaggctcacgattgcgtctttcgaggaaggaaaaacacgcggagtcaccaccaacgtttatttgaagaaaatattagaaaaacaaaaaacaggtctacaaattttaagaaataaaggttcgggagttgtttacgcacgagaaagctttttgggatcgacaagagcggggctcttgctcctacgtatcctcaattgcgatgaggaactcagacctacgtag

SEQ ID NO: 67046 - DNA, 372 bp, Glycine max
  Peptide Sequence Number=SeqID_183824
atggcaaatgtgaatccaactgttgaagtcaacatatttggttattcagaggctgcagacgttgtatttacaagtggggtagatgtacttgcagtggggataaatgttacccaccaagttgtactaactgaatttatgcataagactccagtgccgccttggagtttgatagtcaccgttttcggtgtgtcgagcaccaatagcgcttcgaggccatcaagggatggtctttccacagggagagacaagtatcctgacttccagggagatatctcttgcagacattgggcacgactagtgacccctatggctaaatttgacccggagatagtcatagaattttatgccaatgcctggcctactgaggagggg

SEQ ID NO: 67047 - DNA, 237 bp, Glycine max
  Peptide Sequence Number=SeqID_183825
atgtcaaaatattgtcttaatgtcaacatagttggaagatattgtcttaactctggaggtaatatagctgcatcgtctaagatattgtctccacggtggtgtgttgttctttgcctctatgatggggatttccgtggtggtggtgctgttcttcgttgccgtgatggggctctcctcagtggtttttgcgttagtgtagcagaagtgcagaacagcaaaagccaagatcgaataaag

SEQ ID NO: 67048 - DNA, 502 bp, Glycine max
  Peptide Sequence Number=SeqID_183826
atgggtgaagtagaggaggtacaagaacagatcaagattgacatggaggccatgaaagagcaaatggccacaataatggaggccatgatgagcatgaagaagataatggaggtcaatgcggctgcaatagccactaccagcaccattgctgaggtggacctgacctccccatctggcctcaaccaaatgaatcatccaacctcagatatggtttgtctgggaggcaaagagttggaagatccgggcggccctcatttggtgcgaaaaaacaagcatgccttcctaccatatggcttgcctcccaactatacgccacccaatatggcgtacaatcccaatgagaatgtcaataactccactcctatactcattgaaaaccaacaacctcaatctgatcatgcacatgtctctcgacccatgggggagacacatgaaatgccccagcacaatctagccgacttcgagtctcgcctcggatatgccgctaaagggcaaacagttg

SEQ ID NO: 67049 - DNA, 900 bp, Glycine max
  Peptide Sequence Number=SeqID_183827
atgctggaacctctgctgcagcgcctggaagcctggcggcccaccgcgatcgcagtggagaacctgtccggcctgcagtgtgacttcatgcgccgcaatccagcccgatacgcggagagcgtagcggactactgcgtcgatccggccccggcgcaggccgccaccggcctggacgtgcccagcgcgaacgtggagatggaacgcctgcttgcggaatggccgaaggcgccaaccgctgcccagcgacgccgattggccgcagtcttcctggccgcgggcgaaagcagctcggcagtcgtccaatggctgcggctgcccagggaagagcgacgtgcttcggacagcctgacgccggagctggtgcggttcctcgacacgcgcatgacccgccgcaacgaggccggcctggtggccggcgtccttgccgcacgcctgggactggagcgcctgtggtcggtcgacgaccacactgcggattcgccaacaccggaatcgcagcagaaggcctacgctgccgccatacgcggtgcctgggacaattccttcgtcaaagcgcgcagggcggccgatgaacggctcgaagccaatcttgaccaagcggatgggttgctcgcgatgtatcgcgcctacaacgcacccgaggccgtgatggcggccttcaacagcgatttcggcgcgacgctcgtcgaaccctcgccggaaggcttcggccgcaactacgtgggctactgggaaacccgcaacctgcgcatggtcgccaacatacgcgacatactgggccagcagccaggcacccgcatgctgaccatcgtcggtgcctcgcacaagggctactacgaggcttacctcaacctgatgcacgacgtgcagctggtcagttcggatgaagttctgcgctga

SEQ ID NO: 67050 - DNA, 549 bp, Glycine max
  Peptide Sequence Number=SeqID_183828
atggtggtctttcgtggtgaaattttgtcttgcacactttgggagaattactgtactcagttcctatcctatttgaatgaacgtggggatgatgggccgatggttattatattgacacatgccagaataaaagatgcacagggaagttatccagcttcagtgagcaattccttcaaggcgtcaaaactattgattaatgatcctatattggaaattcaggaatttaaagagaggcttttagatttaggtgttgaggtgagtcgagttttgctacctggcgatcaagcaacctcacaagtttcagggggaagtcagctatcatcaaaggattcgtttctttcaaaggctgaagccaaaactattttagaaatcgatgccatttctgaggacgttgtttgtgttacggtggggactattagcaaaatagtcatggataaccattcatggtcttatccagcctgtgctcaatgtcataggaaaactgacatccaaacaggaccattcacatgtggatgtggcaaggataatgatcagcctgttctgaggtaa

SEQ ID NO: 67051 - DNA, 285 bp, Glycine max
  Peptide Sequence Number=SeqID_183829
atgggtgtccaagtacctcaaagtggtcaagcgaaggtcacatcccaccaaacagatggtccccggacgaaattagggtatgacacctgtgcatctggagttctatgctctgtaggcgattggagatggacctcagagacggtacctcctcttgtggcgggggtggcgcatcttcagcttgttgttggtcctcctctagctgctgcgacgcttggccctgcgcttgcctggggtgcagtatttctcgatgaaggtgatgtgccattatcttctccaatttcttaa

SEQ ID NO: 67052 - DNA, 998 bp, Glycine max
  Peptide Sequence Number=SeqID_183830
gtcctcaccttcagcgggttgtatgccctcaccttcagaggactacacatccttgccatcagaggactacaggtcctcgccatcagagggttgcacgccctcaccatcagaggactacacgtccttgccatcaaagggctgcacgccttcaccatcaaaggactgcacgtccacaccttcagagggctacacgccctcaccttcagaggactgcaggtcctcgccatcagagggctgcacgccctaaccttcagaggactacacgtcctcaccatcagagggctggatgccctcacctttagaagactacacgccctcgcctttagagggttgcaagccctcgccttcagagggctacacgccctcagcttcagaggactacacgtcctcgccatcagagggctgcacgcgctcaccattagaggacttcatgtcctcgccatcagagggctacacgccctcaacttcataggactacacgtcctcaccttcagaggactacacgtcctcgcctttagaggaccacatgtccgcgccttcagagggctacatgcccttgcctctagagagctgcacgccctcacctctagagggctgcatgccttcgccttcagaggactacaaatcctcgcctttagaggactacacgtcttcacctttagagggctgcatgtcgtcgccttcatagggttgcacgccttctcctttagcgggctggacaccctcgccttcaaagggccaccccctgatattggagggcgaccaatggtgcgagcacatccagagagggagcaacattctgccaagcgaccgcaatgtcgatctccccctgcagaagtattagttggtctgtaccgttccgacatagggccttggggtttccagctcgggttgtgggcctctgtcagtcctacaggggatcacgcctgcaagacacccagtggacccgaagaagtccaacagggtcttgaagttgccagctctgattacgggccttt

SEQ ID NO: 67053 - DNA, 487 bp, Glycine max
  Peptide Sequence Number=SeqID_183831
ggcgccatagttcacatactaaacatcactcccaaagaagggaaagggatagaaggcctcaagaggattcatgaggatcctccagtggagtattggaatgatcctaagagtgaccttaggaagaggcacgttccctcctactatgaaagggagcttatgaacaagctccaaaggcttgtacaagggagtatgagcgttgaagaatatagacaacaaatggaactactccttttaagagctggacttagggaggaggaaagaacaagcatagctaggttccttagtgggctcaatatggaagtgagggacaaggttgaactccttccatatagggacctagatgagctagtccaactttgtataagagtggagcaacaacttaaaagaaagccttcttcaaaatcttatggctctcactcttatccaaggaaggaccaagcccatggaattttaggggctgcaccttcaaaacccaaggaagatcagg

SEQ ID NO: 67054 - DNA, 249 bp, Glycine max
  Peptide Sequence Number=SeqID_183832
atggaaaaccttcacggatttgctcacggaaacgtctcagaagcgttactgaagcacctcggcttggattttcttcacggaaacaattttttttcaccaaaaacagttgaaatgcatagccaagggggaaaagggggaggaggttgccgcccagctcgcctaggcgtcgcccaggcgagctgggttgcttcctccataagcaaccccgcttcgaaaatattctggaagggcctagattcgaaaatttga

SEQ ID NO: 67055 - DNA, 165 bp, Glycine max
  Peptide Sequence Number=SeqID_183833
atggctgaatacgtctgcccgtacgcaaataagctaggcgaggttcccccgcaagcaactcccctttcccactctcctttggctggatccctacactggcttgggactggctcatatctaactcagtggaaggcaggaagtagtggattctatagacttaattaa

SEQ ID NO: 67056 - DNA, 593 bp, Glycine max
  Peptide Sequence Number=SeqID_183834
atataagattcgtgggcgaaggtgttcggcaaggcggaaacaccgcgcatccaggaggcgcgcacgatcggcgccatgtcctcgatgctgacgcgcagcgccggatattcataaggcggcaccgaggtacggtcgcccatttcataggccaccggcagcggttcaacccggccggtcagcagcagcgccagcgtcggcgcgccgttggaaggataataggtgcgaaaatcgtaggcgaccggatgtccggcggcgtccagcccgccgtccacctccatcagctgcgcggtgccctttggttcccacacatgctcttgctcgcgggtcagctgcacccgcaccggcctgcccaccgcgcgcgacagcagcgccgcgtcggcgcagacgtcatcggcgcaattgcggccatagcaaccggccgcctccatgcgaacgatctcgatctgcgcttccgggtattccagcagccaagccagatcggcgcgcagcaggtgcgggttctggctgcccgaccagacctgcaggcgctccggccggtagtccgccagcgcgcaggaagggccaatcgaggcatgcagctgatacggccacag

SEQ ID NO: 67057 - DNA, 168 bp, Glycine max
  Peptide Sequence Number=SeqID_183835
atgaagtttgggctttgtgggaagaaatttggtcaagaattgagtgagatatggctggaagaaaaattgggggcgagggttttcgagagagtgaggagttgcaggattgaagtgtctagatctttaaagatgaggatcatgctttttctccttgtttttcatccttga

SEQ ID NO: 67058 - DNA, 321 bp, Glycine max
  Peptide Sequence Number=SeqID_183836
gtcgacaaaagcgaggcttttgctcctacgtaccctccatcgaagaggaaatcagacctgcgtagttcttttgagggtgaatcaagcgaatctttttacttggaaggtgatcattttaaggcgttggaccttaaaaatgatccatttacttggcgagaaaacggcttaaacgatcggttaaagctcgtcaaaaatggaagaaaagaaaccgaaattgaacgaaataaaaatgaaagccaagaaacaagaaatgaattaaaagtctcggatttggaaacttacccgttgaagaacgaagaacggatgaagaacggtgaataa

SEQ ID NO: 67059 - DNA, 745 bp, Glycine max
  Peptide Sequence Number=SeqID_183837
ggctacatgcccttaccttcagaggactatacgtcctccccttgagaggactacacgtcctcgccttcggagggctacatgcccttatcttcagaggactaaacgtcctccctttcagagggctacatgccctcgcctttagaggactacgtgtcctcacctttaaagggctgtacgccttcgccattagagggctacacggcctcaccttcaaaggactgcacgtcctcaccttcagagggctacattgcctcaccttcagaggactgcacgtcctcaccttcagagggctgcacgccctcgccttcaaagggcgacacatcctaaacttcagagggctgcatgccctcgcctttaaagggctatttcctgggccaccccctgatattggaaggcgaccaactgtgcgagcacaaccagagagggaagctatcgcccaactactttgcataccggggcaagatctcacccgtgccactgcaaagagacgagtgcgggtcatgtgcaccaacatgaccactcttacacagatatggatgacgttgctacttagcaacattccacccgacgaccacaatgccgatctccctcctgcagaagtatcagttgggatcgcacccacaaggcacccagtggacccagagaagtccaacagggccctgggggatcgtgcccacaaggcacccagtggacccggaggagttcgacagggccctagggttttcagcttaggttacgggcctct

SEQ ID NO: 67060 - DNA, 540 bp, Glycine max
  Peptide Sequence Number=SeqID_183838
atggattgtagtagctcgtgcttatctcctacacctgaggcttttcgcgacttgggtcagagtgggggctatgcctggggagctaccgcgctggttcatatgtatgaccagttagatgaaacttctaggaccacgacacgacagattgggaggtaccttactttattacagtgctggatctatgagtacttttcgagtgtgcatcagtgcgtcaccgatgatgcgtatgaggagacgtccccacgtgcctcccggtggctgacgacgaaggcacatatgaagggaattataggagcgtcataccgggcacgttgtgatgctttgacggtcatagacgtgtgctggttgccttatactgagatgggtcctatggtggtcacagttcaaccggagagggtgctatgccagtttcggtacattcagagcatccctccgccgcctgttagcgcttcgttgtcatatgatgatatggatgacaggtggatgcatttctcagaccacgtagcagctgtgggtgacatttgtgtaatgcctaggcag

SEQ ID NO: 67061 - DNA, 237 bp, Glycine max
  Peptide Sequence Number=SeqID_183839
atgggtgccaggcacctcgaagcggtcaagcaaaggttgcatgccatcaaacaatggtctcggacgaaattagggtatggcaatggggtaaatgggctaatgccagggatttatgctaaattccatccaatggctttcttgtgcttcttgagcactagcaacaacttctcctcttgcgcagcagtaagggaggcagagatgatcactggaaatttttcgtttttccttgtcctccaa

SEQ ID NO: 67062 - DNA, 360 bp, Glycine max
  Peptide Sequence Number=SeqID_183840
atggcgcgcctggcggccagcagcggctgcatgggctatatctcagtgctggacggtgacgatgtgctggtgatgcgcatgtaccacggtcgcttctttacccagctggtgacgccgccgggtacacgggtcgataactggcaaaccgcgtcgatcaattcaccgctgaatatcgatgcactgtgcaaagagctggcgctgattcgtcagcagggctgggcactggcccgcaatgaaacgctgcctggcattagctcgcttgccgtagcggaagcggccccgggttatccggaagcgctgctcagcgaattgcgcgcaacggctgcacttatggccgaaaaatatggcgcagcgtcctga

SEQ ID NO: 67063 - DNA, 1125 bp, Glycine max
  Peptide Sequence Number=SeqID_183841
atgcgtctggataatccaataaaaaatattggcgtgggcctgatgctggttctgctgtcagttgcaggggccatcattggggtacagctgatcacaactattggggtaacgcccaatacttctattatcggcgcgctatttgccatgctgctggcgcgcattccactgcagtggtttcgccgctaccgttcggttgaagtgcaaaaccttgcacagaccgccatctcttccgccaccttcggcgctgccaatagcctgctgatgccgattgccgtgccgtgggcgctgggtgagccgcagctggtgctgccgctgtttgttggcgtcagcgcggcaatgctgctggatgcgtggctgctgtatcgtctgttcgacacgcgcgtgttcccggccagcaatgcatggccaccgggcgtggcagcggcagaagcgattaaagccggtgataagggcggtcgccaggcgtggctgctggtggctggaatcgtgggcggcgtcgcgggctcaatgctgaaaatcccgatgtccgcctttggtacggcattcattggcaatatctgggcgctgactatgctcggcatcggcttcctgctgcgtgcctatgcgcaaccggttgctggtatcgatattaacgcgctgtacattccgcacggcgtaatggttggagccggtctggtggcgctgattcaggtggtgcaggtgattcgcagtcgccgtcacgacaacctcaacgtcagccgcagtgacaacgaagtcaaacgcgcgctcggcctgggaactgtcggctatatcgtgatctcggcactgctggcgctgggcggcggactgtggagcgaaatgggcctgccgatgctgctgctgtttattatctacgcggcctttgccgcctttgtgcatgagctgattgtcggcatcgccgccatgcactcgggctggttcccggccttcgcggtggcgctgatcaccctgatcctcggcatcctgctcggcttcccgccgctggggttgtgcctgctgtgcggattcaccgcggccaccggtccggccttcgctgatatgggctatgacctgaaggccggctttattctgcgcggtaacggggccgatgtgcagcaggagctgtga

SEQ ID NO: 67064 - DNA, 1267 bp, Glycine max
  Peptide Sequence Number=SeqID_183842
gtatccggacgtggatggtcagcccggtggtctggttggcatcgttttccctcttatgtcaggtttccacacagacagcggtgatcctctgcctgctattgagtatagacaatcgaggatcgctgatatcttccatctcttccgcgatgggccggccggtcagggtgggacgctgtgccgcttctggctgacgctccagccgatcggccagtacgtcagagggcgcgttgagccagatgacctggccatgctcgcgcatgaagtggcgattgacgtcagccagcaccatgccgccgccggtggcgattacgctggcaggcgcggtaaccgctcgcagcgattcactttcacgcgcgcgaaagctgtcccagccttccgttgccacaatctctgccacgctacgctgtgtggtgagctgcaggtggtggtcggtgtcacgaaaggcatagcccagcgcttgcgacagcgcctggccaatggtggttttaccgcaaccgcgtgcgccgatcagatagatgggcaacggacgtcctgttggtcgcctgaagaacaacacgctatgcctaaccggaggttcaccatgcagagccaggaacaacaacttattgaaagcctgttcagccgtctgaaacaggcagaaagccagagcggcccgcgtgatgccggtgccgaacagttaatcaatcagcatttacagagccagcccggtgcgccctactacatggcgcaggcgatcctgattcaggaagcggcgatgaaaaagctcaacgcgcaggtatcggagctggagagccgtctggcgcaggcgcagcagcaggccccgcagcaaagcagcggcggtttcctgtcgagcctgtttggcggcggttcacgcccggcgcagccgcaacagccggcatggaacagcgcaccgcaacagccacaatatgccgcaccgcctcagcagcagtatgctgcaccggcgcgcggtaccggtttcctgggtggcgcactgcaaacggctgtcggcgtggccggcggtgtggtgatggcggatatgctcaccagcctgttccaccattcgcagccggaagagatcgttaatatcatcaacgaaccggcgctgccgcaggtggatgataatctggacaccttcaacggcaatgacagcaacaatgccttcctgaatgacaattcaggctgggacaacaacagctttgccgataacaatgatttcaacgatttcggcagcggcggtgattttgacgacgacgacagcttcgtctga

SEQ ID NO: 67065 - DNA, 1407 bp, Glycine max
  Peptide Sequence Number=SeqID_183843
atggcgccgatcaatatgtttatgaccgggctgtcgcgactgccggctaaacagccctattttccggttgaggattttcctgagctgcgtcagctgaccgataactggcaggtgattcgcgatgaagccattcgcctgcaggatcacattaaagcggcgcagacgcataacgatgccggatttaatactttcttcaagcgtggctggaagcgcttctatttaaaatggtatagcgatgcacatccgtcagcgcgcgaactctgtccggtaactaccgaattggtgagcaacattcccggcgttaaagcggccatgtttgctgaactgccgccgggcagccatctgggcaaacaccgcgatccttatgccggttcggtgcgctatcacctcgggctgcaaacgcccaacgacgatcgctgctttattgaagtggatcgtcagcgccacagctggcgcgacggtcaggcggtgatcttcgacgaaacttacgtgcactgggcgcagaatgaaagcgagcagacgcgtatcatcctgttttgcgatatcgagcggccaatgaaatggcgctgggcgcaggcggtcaaccattgggtgggctcgacgttaatgtcagcagcggcatcgcccaacgacgaaaacgatcgtaccggcttcctcaaccgcatcttcaaatacgtttatgcgctgcgcgatgccggtcaaaacctgaagaaacgcaatcgccggttgtattactgggtcaaacatggactgattgtggcgattttcgcgctgatcatcgcgctggcgcagcgtaaacccactaaagtgaccgtcggtgaaacggatatggtgctgattcgcgacggcgaccgcgtgcaggcgctgcaggcaaaatgtccgcacgcgggcgcgccgctggagcagggcgcagtgtgcggcgacaaactggtgtgtccgtggcataaggcggtgtttgagctgcgcgatggcaaaatgtgcgagccgctggcgctggccaatctcaaacgctatccggtgcgcattgaacaggggcaggtgctgatcaatccgcaggcgatgtcgccggccagtgcgccggtagctcagggtgaagcgccggtgtgcttgattctcggctctggcgcggcgggcagtgctgcgatctggacgctgcgcgatgaaggctttagcggccgtattgtgcgtatcgagcgtgaaagcgacgcaccttacgatcgcaccacgctgagtaaatttgtcccttccggcaagatggccatcgatgagggggaggtggtgcagctgaaggcgcaggagcagacgctggtgctgaaagacgggcagcaggtgaagtttgaccagctgctgatcgcgaccggcggcgtgccgcagccgcttgatatcccgggcaaggatctggatggc

SEQ ID NO: 67066 - DNA, 870 bp, Glycine max
  Peptide Sequence Number=SeqID_183844
atgacgcaccagcagggtttgcaccgccggcatcatcgcgccatcggcaaagccgagcagaaagcgcaggacgcccagctgcgtggcgctggtgacaaacgacatggcaatcagcagcagcagcgaggcgatcatggtcgccagcaaaatacgctgggtaccgatgcgatcgccgagtttgccgagacgcggtgcggcgatgagtgccgacacgccgggcagcgcggcaatcacaccactgagaaacgcgatattctgcgcatccggcgccagctcacgcacgaacagcgtcaggataggattcaccgagccgttacacatctgaatcaccatggtggtgacgaacaggcagaacatcaggcgtggattatcgaggctgcgcatcacctcgcgtccgctcagtttgtcctgcttgctcaccggcgtgtagccggtctccttaatcagaaacagcgtcaccagaaagctgaccatcagcagtaccgcggtaacgataaacaccatgcgcaggcccagccagtcggccagcagaccgccaatcattggcccgaggatcacgccgccaatttgtccggtcgacacgcagctcagcgcccagccgctgcgctcacgcggcacctgcgcggccaccagcgccatggcgttgggaatataaccggacatactgagcgcgttgccgccacggatacccagctcttccacccaaaccagacggatatcagattgatcttccaggattcgatggagcgtaacatgagcgcagatgtcggaaaaaatgaaacgagggttcagtctaacaacctcgtaacattaccggacggcaaaacatggcatgaggatgaaaacgcagtttttcgctgccgggcgtga

SEQ ID NO: 67067 - DNA, 949 bp, Glycine max
  Peptide Sequence Number=SeqID_183845
atggggaagattccatctcagattgggaatctctccaatttggtctatcttgacctcggaagttatttgtccgagcctctgtttgctgaaaatgtagaatggctatcaagtatgtggaagcttgaatatctttatttgactaatgcaaacctatccaaagcatttcattggctatacactctccaatctcttccttctttgacccacctatatttgtcagactgcaaactccctcactataatgaaccatccttgctcaacttctcatctctgcaaactctccatctttccttcactagttattcccctgccatttcttttgtccccaagtggatattcaaattgaagaaacttgtttctctcaaattatggggtaataaattccaaggtcggattcctggtggtattcgaaacctcacacttcttcaaaatctttactggtctggaaattcattttcatcttctatacctgattgcttatatggtcttcatcgtctcaagttcctgaacctaagggccaactacttgcatgggactatttctgatgccctgggaaatttgacttctcttgttaaacttgatttgtcatacaatcaacttgaaggaaacattccaacttctttgggaaatttgacttctcttgttgaacttgatttgtcatatagtcaacttgaaggaaacattccaacttcattgggaaatttgacttctcttgttaaacttgatttgtcatacaatcaacttgaaggaaacattccaacttctttgggaaatttgacttctcttgttgaacttgatttgtcatatagtcaacttgaaggaaacattccaacttcattgggaaatttgacttctcttgttgaacttgatttatcaggtaatcaacttgaaggaaacattccaacttctttgggaaatttgacttctcttgttgaacttgatttatcag

SEQ ID NO: 67068 - DNA, 726 bp, Glycine max
  Peptide Sequence Number=SeqID_183846
atgtcggcctcgacaccacttcgtcgagccaccagggacgacgtgctgcgctcggctgtcgaggtcgcccccacgctcctcggcggggagctgcgcacggtcgtgatggaggacgctgggccggtcgaggtgcgggtgcgcatcaccgaggtcgaggcgtaccacggccagggcacgggcgatctcctcgacccgggctcgcatgcgcggatggggcggacggcgcgcaacgcgacgatgtggggtgagccgggccacctgtacgtgtatctgagccacggcatccactcgtgcatcaacgtcgcgtgcgggccggaggggcagggtgacggggtgctgctgcgcgccggagagatcgtgtctggcgaagaggcggctgcgcggcgtcgccgtgcgctcctgccgctgagccgtgcggcacgacgcgacctcgcccgcgggcccgggcggctgggccaggcggtcgggttgcggcatcctctccatgacggcatcgacgcgatcgtcgccgaggaacggcagggggcgacggccgagctctggctgggcgagcctcgggatgacgtggtcagcggccctcgcgtcggcgtggccggagtcgccggcaccgatgcgttcccctggaggttctggatcgagggagacccgagcgtgtccgcgttccggtggggccgcggtgctgcggaggctgcggcgctgcgagcagcctcggccgtgctagactga

SEQ ID NO: 67069 - DNA, 289 bp, Glycine max
  Peptide Sequence Number=SeqID_183847
ggattgcgcccgcaagacacccagcggacccggagaagcccaacagggccctagggtgtccagctctggttacgggcctctgttagtcctacaaggtgcccgttccccccaacaagggattgcgcccgcaagacacccagtggacctggagaagtacaacagggtcctggggtttccagctctaattacgggcctctatcagttctacggagtgtccatcacccccaacaaggtcatcaggccccctactaatcgagctttcatcaagaggtattgcgcccccaggtag

SEQ ID NO: 67070 - DNA, 558 bp, Glycine max
  Peptide Sequence Number=SeqID_183848
atgggttgcttttcatgtttcgattcgagttccaaggaggatcacaatctccgtcctcagcaccaacccaatcaacctctcccttctcagatttccagattgccctctggagcagacaagttacggtccagaagtaatggaggttccaaaagagaactgcaacagcctcctcccaccgtccaaattgctgctcaaacatttactttccgtgaacttgccgctgcaactaaaaactttagaccagagtcctttgttggggaaggtggttttggaagggtctacaaaggcaggcttgaaaccactgctcagattgttgctgtcaaacagttagacaaaaatggtcttcagggtaatcgggaattccttgtagaggttctcatgctcagtcttctacatcaccctaaccttgtcaatctcattggatactgtgcggatggggatcaacgcctcctcgtttatgaatttatgcctttgggatcattggaagatcaccttcatgataagtctcaacagtatttgtttaccctttgggaggggagaattccactaggtggttag

SEQ ID NO: 67071 - DNA, 222 bp, Glycine max
  Peptide Sequence Number=SeqID_183849
atggaggaatccaatcgggaaaataacaaatatcacatttcccagtcaagaggttccgctcttggcggtgaagaacacattggagaatggaggaatccaatcgggaaaataacaaagatcacatttcccagtcaagagggtccgctcttgacggtgaagaacacattggggaaaggaggattcaatcgggaaaataacaaagatcacatttcccagtcatga

SEQ ID NO: 67072 - DNA, 297 bp, Glycine max
  Peptide Sequence Number=SeqID_183850
atggcacatttcataccctgtaagaagaataatgatgcgtgtgatgttgctgttttatttttcaaggaagtggtgtatctccataccaagaagcatcatttcaaaccgagacaccaagttagaacaaagctactcttttcaaccacatgcaaccctcaaaccgatggccaaactaagcataaggatgcacaggctaaagttgagtatgtgaaggctcaaattgcaaagaagaatgaaagctatgccaagcaagccaacaagaacaagaaggaagtgatacttgaaccaggtgattga

SEQ ID NO: 67073 - DNA, 288 bp, Glycine max
  Peptide Sequence Number=SeqID_183851
atgcagacaagcagtacacacgtagcagaaagtacacagttgcttaaggttaggaaggtgcaaagaattaatgaagcattgggcttgaatccagaattgggcttggacttgaagagggctaagtctccagcgttgttttctcttgaggatcaagcacagctctctttgaggaacatggcaacaccacccagctcacctcgtcctcttcttgagtcaacaacaccttcttcaccatctacgttgaagaagacaagaaaagaaacacgacttagatcattggctacatga

SEQ ID NO: 67074 - DNA, 225 bp, Glycine max
  Peptide Sequence Number=SeqID_183852
atggatattgattcgtatagagaaacaatctttggtagttatcttacttcaagctgtatgagatcctctttgagtgagtttcaggtcatcaaagcttttaacatcaatattcatgcacccaaggctggtaaaatcatttcatggttcccttcgctatgctcattccaaaggttagggaaagctttggctggaggtggattctcttttagtcctcaaggcttttag

SEQ ID NO: 67075 - DNA, 594 bp, Glycine max
  Peptide Sequence Number=SeqID_183853
atgtttcaagggtatgcaatgtgtgcatatttggacaaacaattcagggcaaccataattaactcaaggctttgggaactaggcaatattctggacaaacaattctgtcatacttgtgtggcttgcactcacagttggtgccatcgcattttccctatccaagctacatgcaatttgaacgaaaaagaactacaagaagtagtatcaatgcttgttaaaaagttcttggctgataaacaggacaaacttgaacgacctctaaagtttgctgttgggttcaaccgaagaggaattgaagagaccacgttagcaaaggaaaattcaaatgattctaaagcatttagtttgctggaccgtaataaatgctttggagtagtggcatctgcagttaatcatgttgtggaagattcagtggtggatctcaggtctccagagctctctgtgcttgttgagttgctacccctttctggagtacccgatgcgtccataatagttgctgtctctgtcctcccaaggaaccttgttagtacaaagcctcgattatgcatcaaagccttgaattctaataccaaggaagggtctgtagcaacatga

SEQ ID NO: 67076 - DNA, 297 bp, Glycine max
  Peptide Sequence Number=SeqID_183854
atggatgtttcccttgcacaagttactaaattaaatgaaggaaagagcacttcacagcctagtaatgtacttgtgaacactactactgagacagctattgcagaagttgaagatgaattgtcattatcgctcacattgccaaatccttcacctcagagttcaggcagtgagataagtgaggcaatctcatcatgccctgggtttggcaacaactacaaggactgctctagttcatccactcacactctcaaagaaagaattaatttggacctatctttagccctatgtggcaattga

SEQ ID NO: 67077 - DNA, 243 bp, Glycine max
  Peptide Sequence Number=SeqID_183855
atgcatgtagatgtacggatgacaacatggtgcgacttgggaaactgggaagagcaacaaaatgtagaagaaacaagcacaatcagagaacaaccaaacgtagaaaaggaaccaaattcaaaagcaatccaagaagcggaattagcagaagcaggatcaaacacaggggcaagcacagagaaagcacaaaggccaaaaaggaccattaccaaaccatgttacctgcgggatttcgtggaatga

SEQ ID NO: 67078 - DNA, 636 bp, Glycine max
  Peptide Sequence Number=SeqID_183856
atgggtagttgtggaagagaaggatcagtgagacaatatgtaagatcgaaggttcctcgtttaaggtggactcctgagctgcaccgttgctttgttcatgctattgatagccttggaggccaccataaggctactccgaagcttgttcttcagttgatggatgttaaagggctcacgatttcacacgtcaagagccatcttcagatgtacagaagcatgaggggtgacttgggcagacaaggtaggacatcctcccaacataggaaccaatcttttgaggagcatgatgatggatgtgttgatgaagggaatgatgttggtgttgagtactcttgttcgaaaccaatgggaagagaatctgattccttcttcggccacagtaatctccctccaaaaagagcaagaatcgagacgaggagttccatctcagagagcctgcagtgcagccaaagattatgtgatgcagttcaaaatccgtactgtttttatgattatctgcaacagaagaagcccatggctgatgagcacaaggagttctcaacatggcagcaggcacaaccccattcccttctgtttccagaatttcccaaccacacttcattcaattctcctaaccaacaatctgatttccttcag

SEQ ID NO: 67079 - DNA, 1225 bp, Glycine max
  Peptide Sequence Number=SeqID_183857
atgaaagttgacgtgcctcgctttgatggctccgacccatcagggtggattttcaaaataagccattttttcgcatatcattccacctcagaatcagagcgcctcaccattgcctccttctatatggaggggtcggcgttggcctggttccaatggatgactcggaaccaccaactcaccacttgggcaagtttcttggaggccatcgaggctcgttttgcacactcaccgtacgaggaccccactgggatcctcttcaagctaacacaaaaaggttgcttcgtctccgggttcgaccccgaaatccgccgcgaggtgcaagcgcttcagccgctcaccttggttcacgtcgcgggtctggcacatctccaggaagaaaaactcaccgagacacgcccaccgtcaaaccccactatttttcctccgcgctcaccctctccaccaactctaccattgttacccaccccgcctaaactgccacccttgcctttcaagcgcctcacccccgccgagctggctagctgccgggaatggggcctatgcttcaactgcgacgagaagttcacgagagggcatcattgcgcccctcggttctttctccttgtcgctgatgaagacagccctaatgaacccctagaccctttaataccatgccctaacccagacccggaagaccaaccccaacccgaaccgcctaaggcccaaatcagtttttatgtgttgcgggcccgcctcgtccgccacctggacctcgccgcgcaacccacaccaccacttcgggtttttttcggaaacggaaatatgattgactcccatcaactgtgtgttggtgccacgatccaagtacaaggccatgccttcaccacagacctccatgtcctgcccatctgtggcgccgacgtggtcctcggcgtccactggttaaaatcccttggccccatcttgaccaattacaccacccttaccatgaagtttgttcaccatgggaaaatcatcgagcttcgaggggataccactcaggaccttgagtctgccctccgccaccctcatcccaaaccatcctcccagaaattcaatccctcctccattaattcgccatcttgttccaaacactgcccacattaccctcgtcccgaccaaccaaccatcatatccaccttcttcccgcgtcttccccggcatcattcccctgagcacgagccccttctcgtcgccggtgctactg

SEQ ID NO: 67080 - DNA, 258 bp, Glycine max
  Peptide Sequence Number=SeqID_183858
atggagagaattaactctttctctctctctctctctctctctctgattctgaagtgtgtcagtgtgataatgatggaaatggcagaagagtcgagactggggaagcctagaggccgccggtacctttggcgtgaccagccaaacgattttgagtcaggcatggtgatggagaagaaggggagaaaaaggagaaagaggctgaacgacgttaaggcctgtgtgcggaaggttaaggaaggttcaaaaatttttctctaa

SEQ ID NO: 67081 - DNA, 942 bp, Glycine max
  Peptide Sequence Number=SeqID_183859
atggctgctcatcgtccagggagggatgctaccctgccaatccttttcttcaagattattcttaaaactaatcttgaaaggcttaaaatacctaacaaatttacaagcaaatatggaggaggcttgccaaatccagtgtttatcaagcctttggatggcactcaatggaaagtgaattggacaaaacagaacggaacttctcagattgatgtactcatacttgaccaaagtgcactagagatagactatctttgtgacacttgtgatgaaaatgaaatcctcgatcatactcatgaggcacccaatatgatttttggtgaatggccagatcagaaagctgaaaaaattagaggagaagagcctattgaaagaacttcatcattgaatatgccaacgcaaagtagagcaaaggaagtagcaagaaatttcatctcatacaatcctttcttcacggttttcataaagcctgttcatgtagcagatggccggctgcctttaccagatttgaaaggtattattgagaacaaggagaagtatctgaagctgcagcttggggaaagatcatggaatgttaagttgctcaataataggctctctgctggttggacctcgtttgcaagtgaaagtgaattgcaaccaggagacgtttgtgtatttgaactgattaacagggaggattcggtttttaaagttcacgtcttcaaaagacaatgcagtgagaggcttggtaagcaagtacgcaagttgatgactagatggaacgtgagagactttgagctgattcttggtggtaaggtcacgcacaaaatgataatcaatggcaagatgtttcatccaggaatgaaagacgggcctatggtacgatattcagcttctatcgatgagcgggcaaccgtggactatttcttgcaagaccatgaaatggcatttgggccaagataa

SEQ ID NO: 67082 - DNA, 1335 bp, Glycine max
  Peptide Sequence Number=SeqID_183860
atggctactcctcctcttgttcagcgcaaagcatccctgcccatccatttcttcaagactattcttgaatctaatgttgaatggatgaaaataccgaataagtttacaaggagatatggaggtggtttgtcaaatccagtgtttctcagacctccggattccaaggaatgggaagtgcattggacaaaagagaatggtgagtacaatggaacatcccttattgatgtactcatacttgatcgtagtgccatagaaattgatgatgaaatgggcactgttgatccaaatgtggaaaagttgcatgcagataagggtgttcgttctgatcatcatcagaccaaggttagagttagaccaaggtcaccattggtctcttctgaacctcgtaataaaatgccaagtggcagtcatcggaatgtggaaagaaacttcaatctgcaaaagttggatgcagatgccgttgttcatagtgatgaaggggccaagtttcgaaaatctgtgaagcaccagccaagaggtgagaaggctattgaaagaacttcatctttgaatacacccaagctactcagagctaagaaagtagcaaggaattttgtctcgaacaatgtttttttcacagtcgtcatagcccggcctcagttggaagaaggtgcatggaaagttgttcccaagttcttggatatggagaggaaaaaacagaatgtgatgttgcagattgagaatcggatgtggcctgtgaagttgacaaatggtggtggtgatatgcaatatgaccggttcacttctggttggtctttgtttgcaaaagagagtaaattgcaagctggtgacatttgtatctttgagttgattgaccccgatggtccaactcttgaacaaatccccaacaagtttactaaaagacatggagatcgcttgtcaaatccagtgtttatgaagcctccagatggcactgaatgggaagtacaatggaccaaacagaatgggacttctcagattcatgtactcatacttgaccatactacactagaaattcactacccttcttctcatactcgtgaagaaaatgacaaccttgtccagagtgatgatgaatcagttcaagttttggaggaagggcctgacaagaatgctgaagaaaatgacaaccttgtcaacaagtcaaggttttggatgaagggcctgaccagaatattgctgatgaatcagttcaagttttggatgaatggcatcaccagaatgctacacaaatcaaagtatgtaccagatttgaaaagctatattgggaacacgaagattgtgatgctgcaagttggggagaatcatggagtgtga

SEQ ID NO: 67083 - DNA, 528 bp, Glycine max
  Peptide Sequence Number=SeqID_183861
atgaacaaagaagtgtcagggaatcagttcaccctctctatcaagcctaatccatcgtatcatgagcccataccattagaattgatcagaaatcttggcattgataatgtaaatgatgtgaacttgcatattggggagcgatcatggcctgtgaggtttccaaagcataattatgatgttgctgggaatgtaaaactagagtatgtgggagatgatattgtgattatggaaggaatttcagatgagagaatcgtggaagagatgaagaatgaggaggacagcctgctgagtatatttcatagtgctcataagtggaatgatgaagagtattctggaaatagattggcattggtccagtgcttggggataccgctaaaggcatggaacgaagtatgcttctcaaaattagtatcagagtttgggaagttcatattcgtggataaggtcactgctagtagggagaagattgatgttgcaagggtgatggtccaaatagctacgccatcaacgattatattttgtgacaat

SEQ ID NO: 67084 - DNA, 504 bp, Glycine max
  Peptide Sequence Number=SeqID_183862
atgtcttctatttgcagtgacattcattttttcaagaggattgaagaagatgccattcgaaatggggagctgaggattcctcgaagttttgtgaacaaatgttgggaaggaatgtcaaacccagtagtccttctgcttcgtaacggtgctgaatggaaagtgaaatggaaaaaacttgatgttgatgtttggttgatcgatgattggaaggaattcgcagacttttgttgtttggatcaggaccatcttttggtgttcaaatacatggggaagtcacggtttcaggttgtaattttttatcaaaatggcttggaaatgcagtaccctttgatggaagaaacaatagatggtaattctttatgccagcctaagagggcaaaatctcctttaccattttcttcttctattaagaaggtgaagaccaacccaagaaaggaaccttctagttatccaggccatgaccatgatgttaaaactgaacctgcacaatctcaaaggagaaag

SEQ ID NO: 67085 - DNA, 672 bp, Glycine max
  Peptide Sequence Number=SeqID_183863
atgccaggcaatttcattacagaagaccaacaaaaggaggatgaccatgtttttctttggatctctaatgaaagagcttggcatgtcaagttttatctgagtcatagcagtggacaaatattacttagcataggttggatggattttgtaaaggataataacttgaaaatagggaatgtatgtgtttttgagcaaattaagaaacctggaatttcatttagagttgttatttttcgtgacccagaagaatcaagtcctttcaagtttccagggcttcaaaatattattgctaaaagtggtagtgatggaattccaaaagagcattcagggaggaatgtctttgatgattctgaatcccgtagattcaacaacaacaaagtatcagagaatcacttcaccatctctatcaagccgagtcaactatgtcatatgaacgtaccaaagaaattcatcaaaaaccatgacattgataatacaaaagaagtgacgctgcaagttgggaaaagatcatggaatgtgacgctagactgttacgggagattcacttcgggttggtctgaatttatgagtcaatgtgatttggaggccggtgatgtttgttactttgaattgattgataagaagaaatttgtgtttgaagttagatttaagagatgcatcagcatcgattga

SEQ ID NO: 67086 - DNA, 786 bp, Glycine max
  Peptide Sequence Number=SeqID_183864
ttagtggtaaaaggtatggactactcatagtggatgactactctagatggacattggttatgtttcttgcctacaaggatgagtcttttggagtcttctttaaattctacaaaaggattaaaaatgaaaaaggagtatgcattgcttcaattagaagtgatcatgtggagagtttgaaaatgaaagctgagaggaaaaatagatcgttgcatgaaatggctaggacgatgctcaatgataactatacacctaagcactttggggttgaagcagtgagtactgtttgttatttgcgaaacaaattttacataagacctattctgaaaaagattccatatgaaatatggaaaggaccaaaacctaacattgcatacttccatccttttggatgtcaatgtttcattctaaacactaagcaccacttgggtaagtttgactctaagtgtgacaatggaagattgcttggatactctcaaacatctaaggcctatagagtatacaactttagaaccttagctatggaagaagctatccagataaggtttaatgacaccaagcctgatacaaaaatatcagagctagatgagtctattgcagatctcagattgggcgatggcattggaccatcaacatcaacatatcagccaatagaagtagacaatgatgtcaggacgcttgtggaattgcataagggaaagaaggcactaggtgcaaaatggttactcagaaataagttggaggaggtaggtaaggttgtgagtaacaaggcaaggtcagttgccaaag

SEQ ID NO: 67087 - DNA, 1275 bp, Glycine max
  Peptide Sequence Number=SeqID_183865
atgcaatacactatattgacaataagttcctcgcagaggattcctcgaagttttgtgaacaaatgttgggaaggaatatcaaacccagtgctccttctgcttcctaacggtgttgaatggaaagtgaaatggaaaaaacttgatgctgacattttgttgatcgaagattggaaggaatttgcagaattttgttctttggataaagaccatcttttggtgttcgaatacttgaggaagtcacagtttctggttgtaatatttgatcaaaatggcttggaaatggagtaccctttgatgggaggaacattagatggtgatgagaaaggtaattctttatgccagcataagagggcaaaatctcctttaccattttcttcttctattaagaaggtgaaaggaaagacacttactagttatcccagccatggtgtgagaactgaacgtgctcaatctcaaaggacaaaggttgagttttcaaaagaattccttgctgaggatcttgaaagaggtggcagaggaagagggatgatgaatgcaaaaaggagatgctctaactctaatgctttaaaaagtagcactgctttagagagagccaaggctttccgctctgagaatcccttcttcattcgtgaaatgcatccatcatacattcataaatatattatggtcatgccaggcaatttcttaacagaagaccaacaaaaggagaatgacagtgttactctttggatctccgaggaaagagcttggcatgtcaagttctatacgaatcgtagcagtggacaaataaatcttagtactggttgggtggattttgtaaaggataataacttgaaaatagggaatgtgtgtgtttttgagcaaataaagaaaacaagaatttcatttagagtttttattttccgtgacggagaagaatctagtccttccaacttttcagattctgaatttcgtggatgcaacaacgaagtgtctgagaatcacttcaccctctcgatcaagccttgtcaattctattgtatgaacgtaccaaagaaattcatcagaaaccatgagatggatggtataaatgaagtgacgctgcaagttgggaagagatcatggaatgtgaagttagactgttacggtaggtttacttcgggtttgcatgactttatgagtcaacataatgtggaggctggagatgttattcactttgagttgatcgataagaagaaatttgtgtttcaagttagagttacgagatgcatcagcatcgattttgagttgctgtaa

SEQ ID NO: 67088 - DNA, 468 bp, Glycine max
  Peptide Sequence Number=SeqID_183866
atgtcagggctagtgtttacactgttggtgaccaagaagaatgaagtagccaaacaaattatgcttcatgggcagagagatacaattttagcagtggcgatgttcttgtacgtgaaagggcaacataatgtgtatgaagtgacagaagacactttccgatcgtgtgatgcaagtagtggagtgttggccaagtttgagactggagaagatcaagtagcactcagtgaggtgaagagatattggttcatttgcaacgtagcagggcactgccttggaggcatgaggttcggaattgaagtaaaagatggtaataataatgttactaattccacggatgttgcatttaacccaccaattgaaccaactccctcggataattcttgtaccagttattatgtatctgaaagatggggagtgattaagaatttgactcctttaggattattattgttcaactattatttttga

SEQ ID NO: 67089 - DNA, 1248 bp, Glycine max
  Peptide Sequence Number=SeqID_183867
atggatcctaacatcttggaagaaacaattgggacccaggttttgatttcggtgccaggtggactagttgaactgtttgtaactaaacaagtgcctgaagatcatcaactaatagattatgtcataaaccagtgcattgaagccgtgaaccactcaatgagcttccacattgacgagaattcaatgagcaacatgcaatcaaacccacttataggcgatgaaaatgaagggaacaacaacagcagggacacttccacccttcagaacatgtcatcacaatggacctccgcagtattgcaaaccaaccaagaagatcaggagcatgagcatgagcatgacacgtatcagaaaagcctcatgacaacaacggattcacaatacgtggagcctttggaggcaaaagagaagcaagaggaggacaaggacttgctgaaaaacgttgttggtagatcagattcaatgtcagattgcagtgaccagaacgaagaagaggaagatggaaagtataggaggaggaatgggaaagggaaccaatccaagaaccttgtggctgagaggaagagaaggaagaagctcaatgataggttatataaccttcgttctttggttcctaggatctctaagctggatagggcatccattcttggagatgccattgagtatgtgaaggatttgcagaagcaagtgaaggagctccaagatgagcttgaggagaatgcagacactgaaagcaactgcatgaattgtgtaagtgaacttgggccaaatgctgaacatgataaggcccaaactgggttgcatgtgggaacatcagggaatggctatgtctccaaacaaaagcaggaaggtactactgtcattgacaagcagacccagcagatggagccgcaagtggaagtggctctgatagatgggaatgagtattttgtgaaggtgttctgtgagcacaggcctgatgggtttgtgaaactgatggaggcattgaacactattggcatggatgtagtgcatgccacggtaaccagccacacgggactcgtgtcaaatgtttttaaagtggaaaaaaaggatagtgaaacggttgaagctgaagatgtaagagactcactgctagagcttatgcggaaccgttacagagggtggactcatgagatgacagcaacgtcgggaaatagtgtggaaagcgatcaacatcaactccacaaccacaaccagatgggtgcctacccgcacgagtttcatagttaa

SEQ ID NO: 67090 - DNA, 1039 bp, Glycine max
  Peptide Sequence Number=SeqID_183868
atggagaagaagaagatggataaaaagtggctggttatggaatgtgactacatctttgattatggggcaacaaacatcaagcttgtctttcgagggcacaggaaaacattaatgttggaagcaattgctaacgtgcttccaagtggaaccatcagattcttgtcaaaggttgttgctattgaggaatctggtttctctaagattaagatagtccgtcttgctgatggaacaagcatcaaaaccaaggtattgattgggtgtgatggaataaactccgtggtggcaaagtggttgggcttcaaagaggcctcttttaccgggagatacgtaatcaggggttacaaaaaggtgatggataatcatgggcttgagcccaaattcatgcactactttgggaagggctttcgatctggtgtaatgccatgtgatgacaaaactgtttattggtttctaacttggactcccaccagtgaagagaaggagctagcaaataacccatccaaaatgaagcaattggtgttgagaaaggttgagaagatgccaagtaatattaaaacctttatagagaaaacagacccaaaagacattttaacatctccattgagatatagacatcagtgggagctcatgttggggaacattagcaaaggcaatgtttgtgttgttggagatgcatttcaccccatggcccctgacctagggcaaggtgggtgttgtgccttggaggatgggattattttagccaggtatctagctgaggccttctccagaaaaacttgcaaacatgttgttaaaaagatgggtgaagagggtaaggccaaggagcaatacaaaaaaattgatgctagcttgaggaaatatgcaaaagagagaagatggagaaacattgatataagtgttacatcttatgttctggggtttgttttgcagggtgatttgaaaatggttgcacattttagggacaaagttttgcctgatttcctagccgaactgctgttgaagaagtcagattttgattgtggaaaacttaacgcctcta

SEQ ID NO: 67091 - DNA, 1389 bp, Glycine max
  Peptide Sequence Number=SeqID_183869
atgatctttctggcaattgggccaggcactggaacctcaggtcatgggtttcaaaagtttctccctcctggaataaatgctggtggtggagtaatgggcttatgcttaagagaagcaattcatcttctgatgcctgtggccaaaaacaatgttcatttggggatgttggtcacagtttctgttactgcgtgtaatagattggtacggcataaagagaaaaaggaagaaacaacagaacctgctgatcctgaaagagatcaaagagctgtgtttgcttatcagatttctctgaaagcagatgaaagagatgtatttgagttcttctcaagggctggcaaggtgcgagatgttcgcttgattatggatcgcaattcaagacgttccaagggtgttgggtatattgagttttatgatgtcatgtctgtccccatggcaatagcactttcaggccaacctcttcttggtcaaccagtgatggtgaagccatcagaagccgaaaagaatttggttcagtccacaacatctgttgctaatggactcactggacttataggcccttattctgggggagcaagaaagctgtatgttggtaatctgcatatcagtattactgaagctgatattcgtagggtgtttgaagcatttggtcaggttgagctagtccagctgcctcttgatgaaagtgggcactgcaaaggttttggctttgtgcagtttgcacgccttgaagatgcaagaaatgctcagagcttgaatggtcaattagagattggtggtaggacaatcaaggtatcagctgttactgatcaatctggaatgcaagaatttggaggaaatactggtgattttgatgatgatgaaggaggtggcatgtccttgaatgcatgttctcgagcaatgctcatgcagaagttggatcgtagtggtactgcatcaagcatggttggttccctcggtaattctgttgtcaacaacacaggtcttaatctaccagcgacaggaaacatactcgcagctgcgcctgttggtgaattggcaggtggaggtctccaaatacccacggctacaattccttctattgatacaatcggtgttgcaagtgaatgcttaatgttaaagaatatgtttgatcccaaagatgagattgaaccagattttgatttggatattaaagaagatgttgaagcagaatgctctaagcttggaacgttaaaacacatatatgttgacaagaagagtgctggttttgtctacttacgatttgaagatacccaatctgcaataagtgcacagcaggccttgcacggaagatggtttgctgggaagatgatcactgcaagcttcatggtgcctcaatcatatgaggataaattcccagacagcagataa

SEQ ID NO: 67092 - DNA, 645 bp, Glycine max
  Peptide Sequence Number=SeqID_183870
atgactggctctcataataatcaaacaaatgctgctccagaagcatctcctgtctccgaaaataggtataggagaactaatcatcatggtgagaataacgtccaatctaatgcacacgtgcctcctgctgtgactgagaacaggtacaaaagagtagagccaagaggcagattccaacaaacatcaaataatgcaggtatgaactatcaaggtcccggaacaagagatgcattcaggtcaccactgccgaattggaatcagacaaggcatgcgccggtaaatgctaacgttaatccaagaatagaaaacaacaggcaagcttttacacttcctggatcaagacactcaatgccttcccatgagaatatccggagtcctcctcctaatgctcctaatactcctagacctggttatggcaattttagtagcccaaatgagagtatccctacgcatcctggtgctaccaataccccaagatcttctagttatggcaattttagtgctccaaatgagggtatccccaggcatcctagtgctcccaatagcccaagaccttctaattatggcacttttagtactccaaatggccctgagacacaaggtttaaaagcagggatgcataggaacagagaagggaataagtaa

SEQ ID NO: 67093 - DNA, 228 bp, Glycine max
  Peptide Sequence Number=SeqID_183871
atgggggtgcaaatagcaattttcaaattttcgaatgtgggcccttctagatcatattggaagctggctgttttgggagaaaaaaattgtttccgtgaagaaaatccaagccgaggtgcttccgtaacacttccgaaacgtttccatgagcaaatacgtgaaggttttccgtcgttcttcaccgttcctcatccgctctttgttcgttcttcgttcttcaaccagtaa

SEQ ID NO: 67094 - DNA, 438 bp, Glycine max
  Peptide Sequence Number=SeqID_183872
atgctcgttttccttccagaatgttgcgaaactttacggattgtgcaacaatgctcgttttccttctggagtgttgcaaaactttatggattacgcaatgatgcttgtttcgaaggatccgaagggagcaaacaaggttcaaagaccaaccacaagtactcccggacgaaattaggggaatggaagcccaaggaacatgagatggaacttcaatggcaaaatcaaaatgaagaaaccgacaagaggaaacgaagcataacactaaaagcctcctcgtcaatgcaagaggaaaatgaagatgaagaatttgaagatgaagaagacttctcactctttgtgaagaagtttcacaaatttttcaagaatagaagaatcaagaggcgtcaaaatttcaaccatggaaaaagattccaagaaggctctccaactcttacatga

SEQ ID NO: 67095 - DNA, 147 bp, Glycine max
  Peptide Sequence Number=SeqID_183873
atggtcttcattttgcctaaggacaatgttatcatctggttttgttccttgcacaataggtctgacaactacttgaatggaattattaacagtgctttgaagggattcaatgacaatcaaggaaggttgctgctagatggatcgtag

SEQ ID NO: 67096 - DNA, 935 bp, Glycine max
  misc_feature (916)..(916): n is a, c, g, or t
  Peptide Sequence Number=SeqID_183874
atgagtgatttgcagatcgggctgattgccctgggcgtcttgctgatactgctggtgctgggcttcaactggtggcaggaccggcgcgtgcgccgcaagatgcaaagccatttccccacctccgagcaggatccgctgctgggggcgggcgccaacgccgccgcgggcgccgcggccgtgcgtcgcgagcccggcatgggcgacgcgcccaaggcgcacccggaacagcccaagccggtcgatccgggcagcgatgccgatgatgccgaggaacccgatcccgcctgcgaagtggtcatcgagatcaacttcgccgagccggtgcgcggcgccgacctgctgccttacatgcagagcctgcgccaggtgggtcgcaagcccatgcgcgtgttcgccgaaaccgaccagcgccgccatcgcgcccgtgtccatgccggcgagtcgtatgcctcgatgcaactggcggtgctgctggccaatcgcagcggcccgctgaccgccatcgaatggtcgcaggcctgggcccgcgcccaggacatggccgaacgcttcgatgccaccatcgagggccccgaccagcaggccgtgctggagcaggccgcgcgcctggacgacacttgcgccgcgctggatacccaggtcggcctgaccctgttgctgggcaccgcccagccggccgccgaggtgctcaacgtggcccgcgacgccggcttcgtcgccgatggcaaccgcctggcctggcctgccgagaacggcgtggcccgtttcacgctggcgcgcgccgatggcgccgccttcgacgccggcatggggggcatcgaacgcctgtaccctgctggctgggaccgtgcccctgcagcccggccgacagccgcgccttcggccgcatggtggacgtgggccgtgaactggccgnccggctgcgcgccgacctg

SEQ ID NO: 67097 - DNA, 216 bp, Glycine max
  Peptide Sequence Number=SeqID_183875
atgggtggaaccaatagttgttcaacatccagatgcaaagaccgttattcgcatcctaaagaaaaacatcttttcaagaaagttctccaacactatagtgtcagacacaaggtagcctcaccttaccacccccagaccaatggacaagctgaagtttcttacaaggaagtcaagaagatctatgagaaaacagatgctcaatcaaggatggattga

SEQ ID NO: 67098 - DNA, 231 bp, Glycine max
  Peptide Sequence Number=SeqID_183876
atggggctccgtaaaaagtgtagagaatggagaattacactaagcaatcactatgcatggctccaaactcgtgggcggaggatgcatgaacgctccaaactcaagggtggaggatgcatgaacgaaaacgcaattcatgaggctccgaaaaagggtagagaatggagaaatgcacaaatcaacactatgcatggctccaaactcctgggcggaggatgcatgaacacctaa

SEQ ID NO: 67099 - DNA, 552 bp, Glycine max
  Peptide Sequence Number=SeqID_183877
atggcaccagctgattctgaggagattgtggcagacattcctgcggacacaggcgtggaggctgctgaggatgagcatgagggattttcgggtggtccgagcgacccatctgtgttgacccagtatgcagatcacattgcttgcagcgtatggacgggagagcgtcctgagttgaagttatcctctcacgggaggaaggtccatagtttaggcaggcctgtccctgccattgatggactcgttgctgggacaggactaagtcctctaatcgcgtgttcggtagacaccggcgattggggacttttgtcctcgtttgtggagcggtggcaccgggagacgtctagtttctatctctcagtgggagagctcacgatcacactagacgacgtctcgtcgcttctgcatctgctcgtggttggcgacttgcacgcctttcagcccttgcacgtggatgatgtggttcagatgctggtggacttattgatggtctctgcagagtctgccatggctaagacagcccagtgtcgtggaccgtacgtacgcctgcaatgg

SEQ ID NO: 67100 - DNA, 298 bp, Glycine max
  Peptide Sequence Number=SeqID_183878
gcatggctccaaactcgtgggtggaggatgcatgaacgaaaacgcaattcatggggctccgaaaaagggtagagaatggataattgcactaagcaatcactacgcatggctccaaactcgttggtggaggacgcatgaactaaaatgcaattcatggggctccgaaaaaaggttgagaatggagaatttcactaagcaatcactacgcatgactccaaattcgtgggtggaggatgcatggaggaaaatgcaattcatgggtctccgaaaaagggttgagaatggagaattgcactaa

SEQ ID NO: 67101 - DNA, 357 bp, Glycine max
  Peptide Sequence Number=SeqID_183879
atggaagtatcagttggtctgtgtcgtcatgacatagggatcgcgtccacaagacacccagtggacccggagaagtccagcagggccttgaggtttccagctctggttacgggcctctatcagtcctacaggatgcccgtccctccagcaaggtcatgccattgtgacatagggatcgcacccgcaagacacctagtggacccggagaagtccaacagggtcctggggtttccagctctaattacgggcctttgtcagttctacagagtgcccgtcgcacccaacaaggtcatcaggcccccttttaaccggactttcatcaagaagtactgcgccccccaggcaagcgcagggtga

SEQ ID NO: 67102 - DNA, 393 bp, Glycine max
  Peptide Sequence Number=SeqID_183880
atggcagaaccatcaaagaagcgaaagggttcttcgagtcggagtcaacgacattccgagactcaggaaacgccgattccttcctctattccctctgcctcattgttttcatccgaagaacagcggatacggtacacaaatctcttttcttctcgttctattattgatccaaaattcattgatatgaatttcttttcaaatgagagttttgaatgcattcaggcatttgaaaactccaatcttattcctttcatgtctttaaaattgcctgtttactttgatttagtcaaagccttctattcaaaccttgaaatccaagaaggcactttaatttctgaagtttatgggattaaaatggtcattgaccaatctctattctatgatttaacctaa

SEQ ID NO: 67103 - DNA, 861 bp, Glycine max
  Peptide Sequence Number=SeqID_183881
actctcgcgaagcgactgaacgtcccgttcgcggtcgccgacgccaccgcgctgaccgaggccgggtacgtcggtgaagacgtggagaacatcctgctcaagctcatccaggccgcggactacgacgtcaagcgcgccgagcagggcatcatctacatcgacgaggtcgacaagatcgcccgcaaggccgagaacccgtcgatcacgcgtgacgtctccggggagggcgtgcagcaggcgctgctgaagatcatcgagggcacggtcgcgtcggttcccccgcagggcggtcgcaagcacccgcaccaggagttcctgcagatcgacacctccaatgtgctgtttatcgtcgccggtgccttcgccggtctggaggacattgtctcggcgcgcgtcggcaagcacggcatcggcttcggcgcccctctccacgacaagggcaaggatctcgacctgttcagcgaggtgctcccggaggacctgcacaagttcggcctcatccccgagttcatcgggcgcctccccgtcgtcaccaacgtctcgccgctggatcaggcggcgctcatcgacatcctgaccggtccccgcaatgcgctggtgaagcagtaccagcgcatgttcgagatcgacggcgtgcagctcgagttcgaagacgacgcgctgcgatccatcgccgacctcgccgtggagagaaagaccggtgcccggggcctccgtgcgattctcgaagacgtgctggggccgatcatgttcgagatcccgtcggcggaggacgtggcgaaggtcatcgttacccgtgccgccgtcgaggagggcgcaccgcccacgatcgtgatggagcgcaagcgcaagagcgcatga

SEQ ID NO: 67104 - DNA, 192 bp, Glycine max
  Peptide Sequence Number=SeqID_183882
atggtagccataaccccaaccaaggttcatcaacctccatttctccgagaatatgactcgaacgcaacgtgtgcttgtcacggagaagccccggggcgttccattgagcattgtagggctctgaagcgtaaggtgcaaggattttcaagtgcaagccattggtcagtttgctcaagcaacctgcgctcctga

SEQ ID NO: 67105 - DNA, 427 bp, Glycine max
  Peptide Sequence Number=SeqID_183883
ggatcatgtctataaggcacccagtggacccgaaggagtccggcagggccctggggttttcagctctggttatgggcctctgttagtcagttctataaggtgcccgtccccccagcaagggatcacgccctcaagacacccagtgaacccggagaagtccaacagggtcatggggtttccaactctgattacgagcctctgtcagttttacggagtgcctgtcacccccagcaaggtcatcaagccctatattaaccgggctttcatcaagaagtattgcacccccaagcaggcagagggcgagacaccacaacagcctggggatggccagcaacaggcaacaaatgcaccgccgccacctccagagcccctcaactcatccataaaaaggttagagcgttgcctacgacacatggccgaccaatag

SEQ ID NO: 67106 - DNA, 309 bp, Glycine max
  Peptide Sequence Number=SeqID_183884
atggctcaattgatttctgatgtcatctattgtttgcatggatcacgcccacaagacacccagtggacccgaagaagtccaacagggccctggggtttccagctctggttacgggcctctatagtcctacagggtgcccgttccccagcaaggtcacgtcatcatggcatagggatcgcgcctgcaagacacccagtggacccgaagaagtccaacagggtcttgcagttgtcaagctctaattacgggcctctgtcagttctacggagtgcttgtctcccccagcaagatcatcaggccccctactaa

SEQ ID NO: 67107 - DNA, 507 bp, Glycine max
  Peptide Sequence Number=SeqID_183885
atggcttccatgatggatgccatgctaggaatgaggcgactaatggagaataatgcggtggccgccgccgccgctgctgttagttcggctgccgaagcagacccaactctcccagctactgtgcaccaccctatcccaaacgtggtaggacgagaaagaagcacactggggcacatcagcaacccccattcggggtacaaccgagtagcttacccctatggattaccaactaattacacaccaccagtcctacgtgacgacgctggtcatgtccctccccccatccttgaaggggagcctcctcaacagccgaacgagatccacaaggatcgtcgagagcatgctcagggagacatcgattcctactccctattccccgccgaggggccggcacccgtcggggaaaggatcgaggtgggcttgaagagagggaagttcgattacgtctcctccacaggtaccaacggtaggaggatcggagcaactggggcaaagaggaaggaatga

SEQ ID NO: 67108 - DNA, 298 bp, Glycine max
  Peptide Sequence Number=SeqID_183886
ctgggttgcttctggaggaagcaacccagctcgcctgggcgagctaacgtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcattcttcaacgg

SEQ ID NO: 67109 - DNA, 422 bp, Glycine max
  Peptide Sequence Number=SeqID_183887
atggctctgaaaaagctttccgcgaagagatctaggagggacgccatggctgaagggaccagtgccgctcccgagtttgatagccactgtttcaggagcgccgagcatcaacagcgtttcgaggccatcaaaggatggtcgttccaccgagagagacgcgtccagctcagggacgatgagtacaccgactttcaggaagagatagctcgccagcattggacgtcgctggtcactcccatggctaagttcgacccagatatatggattccctttgatgcagatgcccttagccagttcctgggtgacccgctagtgttagaggaaggccaggagtgcgaggaggcgagtgcggatcatgcgcaccagcatgaccaccctgacccagatatggatgacgttgctgctcagcaatgtcctgccca

SEQ ID NO: 67110 - DNA, 210 bp, Glycine max
  Peptide Sequence Number=SeqID_183888
atggttacttccatacttcaacttgactcgatgaaccttttcgtaaaagcgcgagcttggttcaaccccataacccagggaatggcaattttgatcgccaatacttcatcaacaattcatagggatgcaagacttgggaatatgcatgctatgcatggaaaatgtaattatgagattgagatgcctgaagaaacatcctttcttagttaa

SEQ ID NO: 67111 - DNA, 1755 bp, Glycine max
  Peptide Sequence Number=SeqID_183889
atgggccttcctgaaggatccaaggttgcacagtcagcaagcacacgtaccttgctgcgttgctgtgaatggtggagtgagcatgaccaacgacttgctactcttgagtttgaccgtgataggaagtcaatgggtgttattgtggactctggtttaggcaaaaggtcgcttctagttaagggtgctgtggaaaatgtgttggacagaagctctaaaattcagttgcgtgatggttctatagtgaacctagatgataatgcaaggaaccttgtattgcaagctctccatgaaatgtcgactagcgcattgcgctgtttgggatttgcatacaaggatgaactccccaaatttgaaaactacagtggtaatgaagatcatccagctcaccagcttttgcttaatccttccaactattcatcaattgaaagtgaacttatttttgttggcttggttggattgagggatcctcctagggaggaagtataccaagcaattgaagactgcagagaagctggaattcgtgttatggttattactggagacaacaagaacaccgctgaagctatatgccgtgaaataggtgtattttctccagatgaagacattagttctaaaagtttaactggtagagattttatggaactgcgtgataaaaagacctatctgagacagcctggtgggcttttgttttcaagggctgaacctaggcacaagcaagaaattgtgaggctgctgaaagaggaaggggaagtggtagccatgactggggatggtgttaatgatgctcctgccttgaagcttgcagacattggtattgcaatgggcattgcagggacagaggtggcaaaggaagcttcagatatggtgttggcagatgataattttagttcaattgttgctgctgttggtgagggtagatctatctacaataatatgaaggcctttatcaggtatatgatctcttccaatattggcgaggttgcttctatatttttaacagctgcattaggtattcctgaaggattgatacctgtccagcttctgtgggtcaatcttgtcactgatggaccccctgcaacagctttgggatttaatcctccagataaggatataatgaaaaagcctcctcgtcacagtgatgactcattaattaatttgtggattttattccgctatctggttattgggatttatgttggattagctacagttggtatcttcatcatatggtatacacatggttccttctttggtattgaccttagtggggatggacatagtcttgtgacttacacccaacttgccaactggggtcaatgctcctcatggcagaacttcactgcttctccattcactgctggtgctaaaactatcacgtttgataacccctgtgattacttttcaactggtaaagtgaaagctatgacactgtcactttctgtgttggtagccattgaaatgttcaactctctcaatgccctatctgaagatggaagccttttgacaatgcccccttgggtcaacccttggcttcttttggcaatgtcagtatcatttggtctgcactttttgatcttgtacgtgccattcttagcccaagtatttggtatcgtgcctctgagcttcaacgagtggcttttggttttggttgttgcacttccggtcattctaattgacgagattctgaaatttgtggggaggtgtacaagttctcgagcatcaagtgcaagaaaatcaaagcaaaaatcagagtag

SEQ ID NO: 67112 - DNA, 2541 bp, Glycine max
  Peptide Sequence Number=SeqID_183890
atgtctcgtctaacaccatcaccaaccaaccctgtccacgaagacaggcttcctttcttcaaccaatccatggaactagtccaacccccaacccgaaccagatccagaaccctcggcgacctccttaaacgcgtcgaggatgctcaaaacgacactcctcttgcaccaccccaccatgttctcgatctctcctcttcctccgccacccacccctttgtcctctccttcaccaacttaacctacaacgtcaacctccgccgcaagttcactttttttcccgccaccaccgcttccgcgcccgaccacgaaaccaaacccaacggcaccaagactctcctcaacgacatctccggcgaggccagggacggcgagatcatggccgttctcggcgccagcggctccggaaagtccaccttaatcgacgccctcgccgatagaatctcaaaagaaagcctcagaggcacggtgaaattaaacggcgacgttctggaatcgagtcttttgaaggttatatccgcttacgtcatgcaagacgacctcctctttcccatgctcaccgtcgaagaaaccctaatgttcgccgcggagttcagactccctcgctctttctcaaagtccaagaaaaaggctcgtgtacaagccctcatcgaccagctcggcctccgctccgccgcctccaccgtcatcggcgacgagggccaccgcggagtctccggcggcgaacgccgccgagtctccatcggcaccgacatcatccacgaccccatcgtgctcttcctcgacgaaccaacctccggcctcgactccaccagcgccttcatggtcgtcaaagtcttacagcgaatcgctcagagcggaagcatcgtcatcatgtccattcaccaacctagctacagaatcttgagcctcttagaccacttgatcttcctctcccacggaaacaccgtcttcagcggctctccggcgaaccttcccgccttcttctccgagttcggccaccccatcccggagaacgaaaaccgaaccgaattcgcactcgacctaatccgcgaactcgaacaagaagctactggtaccaagagtttagtagacttcaacaaatcctggcagctgaaaaacaaaaaccaggcccaggcccagaacgagtatgattccaaactatctctcaaggacgctatcagcgctagcatttctagaggcaaactcgtgtccggcactaacggtaacggcaggaacaactcaacggcactggtttcagttcccgccttcgcgaattcgttttggatggagatgttggtgataggaaaacggtcgctaactaactcaaggaggatgccggagttattcgggattcgtttgggtgcagttctggtcacgggggcaatcttggcaacaatcttttggcacctggacgattccccgaaaggagtccaagagcgcgtggggttcttcgcgttcgccatgtccaccacgttctacacgtgcgccgaagccatgccggtgttcctccaagagcgctacatcttcatgagagaaaccgcacacaacgcgtaccgtcgctcgtcctacgtgctcgcgcacgcaatcatttccctcccttccttgctttttctctccctcgcatttgcggccacaacgttttgggccgtgggcatgaccggcggcacttcgggcttcctcttttattttatcacaattttggcctcgttttgggccgggaactcgttcgtgacgttcctctccggcgtggtgtcgcacgtgatgatagggttcaccgtggtggttgcaattctggcttacttcctcctcttcagcgggttcttcatcagcagggacaggatccctccgtactggatatggttccactacctttcgctggtgaagtacccggattcagatgttcgagaacacgccgctggggatggtgccggaagccctgaaggtggagctgctcaagagcatgagccagactctaggaatgaacatcacgaggtccacctgcgtggtcaccggagaggatgtgctgaagcagcaggggatcacgcagctgaccaagtggaactgcttgtggatcacgctggcttgggggttcttctttcgcttcctcttttatttggcgctgctctttgggagcaggaacaagaggaggccaaatgtctgtttctgaatgatgatgtgttaccttgggtcattgtcactaacaaagatcttcccctgatgaatgcattggaggttgtcttctcttcttccaccaacttgttgtgtgaattccacatttttaagaatgttagaggaaaatgcaagatacttgtgactaaggtgttatccattagtgatatagacaacacaaatgattcttggggtgacttaactctcacaaatgagggtgttgcgttgttaaagagattgtcactgcttgacatggacaggaaaatgacattgcataataagttcattgtaaaagttgttgatgcgagacttgatggaagttgtggctatatggcaattgcaaccttactaggtcagggtgaggaatcatga

SEQ ID NO: 67113 - DNA, 174 bp, Glycine max
  Peptide Sequence Number=SeqID_183891
atgacaaagggtaaccttcctgcttatgaggctgaaacaaaagctctgctggctgctattacttgggttgttgaaaagccatatcaaaacgttacttttgaacttgactgcagacaagttattgatgcccatagctcaaatgtctcttgcacgctgaggttagtgttatcatag

SEQ ID NO: 67114 - DNA, 452 bp, Glycine max
  Peptide Sequence Number=SeqID_183892
gacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggacgggccacttcggggatcttccccgggcgtcgaacagtcaactcagaactg

SEQ ID NO: 67115 - DNA, 1056 bp, Glycine max
  Peptide Sequence Number=SeqID_183893
atgttgacactcacttctccttccatggccttatccatggattctcttcccaaattgcgccacccttccccatttcccactcccttatcctcttccatctccttccgatctttgccgccacctcactttccctcttcctcctcctcctcgtttaggttacactccatcagaccctcctcccaaaaccacccctcgtttcgcaccccctccctcccccctctcctccaaaccctaacctccttcctctcccccgtcgtcgaaaccacctgcatcgtcatcgccgccgctgccttattcttcatgcgcttccaccacacaccccccgccatcgccgccccgctcactccccccgccgccgagtccgacaccgccttcaccgaggaggaagccgagagtcttctcgaagagcgtctcagcaccaacccgcgcgacaccgacgcgctccacgcgctcatggaggtcaaaatcagagcgcgtaaaatggacgaagcgtttggggttttagaccgtttgattgagcttgaaccggaggagctggagtggccgctcctgaaggcgaacatgcacatctacaacgacgaccacgccagcgcgcgcgaactgttcgaggaaatcctcaagaaagacccgctccgcgtggaagcgttccacggcctcgtcatggcgacttcgcagtccaacgagcccttgaaagggttattgaagagggtggaagaagcaattgaggtgtgcaagaagcaaaaaagggattccgatgttagagacttcaggctcttgattgcgcaggttaaagtcatggaaggggatttctctgaggcgcttaaggcttatcaggaattagtcaaagaagagcctagggattttaggccttacttgtgtcagggtattatatataccctccttaggaagaaagatgaagctgataaacaattcgacaagtttcgcaggcttgttccaaaggaccacccttacaaggattatttcgaggacaacatgttcgccaccaagttcttctcgcagaaattggagagggagggagctggtgccaggggctga

SEQ ID NO: 67116 - DNA, 834 bp, Glycine max
  Peptide Sequence Number=SeqID_183894
atgaagaggaaagaaagtaataagagaataaaggagttatcagttgggtcttccagtagaaattctgaacccttgcaacctcctgtatctggacttgaatctgcatgctgtaaagatgcagatcaacccagtccagtctcagtgctagaatcttcttttacagatgatctgtcatcttgttctgattgttttgaaagtctcaatgttgacatacaagggcttcgaatgcaactccagttgctgaagctagaatctgaagaatttgtggatgaacctgtgctaattcaaagtgatgaagacggtggggaggcatctactggaatttcagaagacaatgaattgcataagactggagatagttgggagtcctcctacatgattgatgtcttgtatgaatctggtatcgatagagctcagcctgatgcatttttggaagtttgggattctcaggaatgccctgttagtctttcagtgtttgatgaacttgaaaagaggtactctgattggactaattgtccaaggtctgaaaggagattgctttttgatcgtataaattcgggaattatcagtctaaacgagcaattcatgggggtacagccatgggtaagccctactacagccacaaatctttgttctaaattgattaaaaatggactccaagacggtctatacagtatgctggggagccaaggaaaagtaaaggataccgcactggggaaggtgctggttagcgaaatgcagtggttgaacttaagagatgacattaatggaataggtagggaagttgagagcttgctgctagatgatctagtgacagagatagccgttacatag

SEQ ID NO: 67117 - DNA, 873 bp, Glycine max
  Peptide Sequence Number=SeqID_183895
atgaaaggcatagacatcttctgtgcatcacaggcctcaacagctatatgtcttagcatggatcaaccctcttcctcctattcctcttcttcatcttccatttccaacactgctcaatttggtggcagagccattgaccgccacaaccccatcatcacagatcctagaagaaccccctcaagagacctcatttcccctagctcttcttctcagtcccccattgagcccaaacctttgcatgatcatctccaaaagacaaagaaaaactccacttccaagccaagtggtcagaagaagaagagtgctgcaaagggtcatgatcagaagaagaaaagtgctgcgggaaagttgaccgaacacatcaccaacaattactcctcaaaaccaattgacagcattctgaggaggagttgggctaggccaccttctgatttgatcactcctcctggttcttcaagatatttgctcattgacacgccttccttggaccgcgtatcttcggtttatgatcctgttttggctttaactgatgttaataaggagaaagcacaggttattcatcttgatcaaaccaaacattcatctaaaccctctagctccactcttccaaaatctgattcctcagaccaggttgtagaattgagggtttctctgcactgcaaaggttgtgaagggaaggtgaggaaacatctgtctagaatgcgaggagttacgtccttcaacatagactttgcggcaaagaaggttacagtagttggtgatgtgactcctttgagcgtattggcaagcatatcaaaggtgaagaatgcacaattttggccagaacatgcttcaatagttggatccgaaacaaagagaacaaatttgatctaa

SEQ ID NO: 67118 - DNA, 159 bp, Glycine max
  Peptide Sequence Number=SeqID_183896
atggaggactcttcttcctctgctgcttatatccgcctggtgcaccgtctgatagaggagtgtatcctattcaacatgagcaaagaagagtgcatggaagctctttccaaacatgcaaatatcaagcctgttattacctccaccggtaaggtcatttga

SEQ ID NO: 67119 - DNA, 216 bp, Glycine max
  Peptide Sequence Number=SeqID_183897
atgggggttcaaatagcaaccaggcccacttgggccttccaggatgttcctccagaaggtggtcgcttctggaggaagcaacctagctcgcctgggcgagctggaaaatccaagccgaggcgcttccgtaacatttccgtggatgatttcgcgaagattttcaactgttcttcgacgttcttcgttcgttcttcctcgttcttcggtcttcaactg

SEQ ID NO: 67120 - DNA, 975 bp, Glycine max
  Peptide Sequence Number=SeqID_183898
atggaccggcggcaatggagtatctatctgacgccagagcaggtgaatgcagccgtatcgctgaatgtcggttatcagaacgcgatcgttgttgccccggaaagctcgaactttcaggtcagcgtgaacaatgtcgggcttggtgcagcgcgtatcgaggcgccggacagtcaggggaatatttcccttaaaattccgcccggtgtccttcaggtcggcgcgaatgtcgtgtcgctcggggtgcagcagcgccacagaacagattgcacgatccagtccacttacgatctatggaccgatgtcgatccggcaaataccttcataggctttaacgccgatgttgcgggcagtttcgccaacatcgacgacatccaggcgaccggaccggatggcaaggcgacgacgtcgatcgaaatcgtggcaccggcgctcggcaatccggcatttgcggattctctcctgcgtctttcgcaggcgctggcgctcagaacccagatgccgaaccagacggtccgttttgtgacggcccctcccgtcgaacggaaagcgggaacgctttcggtcctcgtcggcaccgctcgggaaatcgccggcatggccggaactttgccacctgaagcatcagcgggcgctttcgcaggcttcggcagcgccgtcgcgggcggagcgtcgccgcttctcgtcactggtccgaccccccaggcggtgcaagcggcgatagagacgctgttttcctcgatctcgcgaacaccgggcgctcagcgagccactttttcgacgcgcagctggcacgcacccgatgtgccactgatcatgtcggaccgtcggatcgcgctttcggaactcggtatcgaaagcagcgagttcagcggccggcgtttccgcaatgaattttacatcggcatgcccgccgatttttatgcgtcggcctatggcgaagcgtcgcttctcctggatgcggcctattcctcgcag

SEQ ID NO: 67121 - DNA, 402 bp, Glycine max
  Peptide Sequence Number=SeqID_183899
atgtaccctctacttgtaccacaaaggatgtaccctccaatgtgttgggacaaagaatttacagggggcattgcttccacagcatgccacccaattcagccgcagaaaggtgatcagtgggtatggaaggcagactcgagtgggcaatacacgaccaaatccacctatgatatggtgtgggggaaaacatctgaacaacaacaggatggagtatttaaggagccgtggaagatcaagctgccacctaaaattactatgttcgcatggaggttaataagagatagactaccaactaaagcaaatttgcggagacgacagattcaggttggggagtccacatcccattctacagagaagtggaggagagggcaggtcatctattctttcattgtggcaagataa

SEQ ID NO: 67122 - DNA, 318 bp, Glycine max
  Peptide Sequence Number=SeqID_183900
atggatatgaacataggagagctgatctctagccaaatgacctctatagcccagtctaacacttctagacttgggttccctactctaatcaccacattatgtagagccaggggggttgtctctgatagcctcacttttgagcgcctgagcccgatcattaacttggcctacatcagaaagaactgctggaaccccgaggatctaacagtttctatccgaggggctagaagggcgagggcaaggccagctgagcttccttctacttctgcagctcctactccagcatccacttcagcagccccttctgtcccagcttag

SEQ ID NO: 67123 - DNA, 537 bp, Glycine max
  Peptide Sequence Number=SeqID_183901
atgatgttgacggtgcacgatgctaaaagagaatgttgtatattggttgtagatgctaaaagagaatgttgtataagtggtttcattctttgcagttgtgtgcagatacggaattggtttgactatcttaatcatatttgtattgtatttgagaagcttggaccaagcttatacgattttctccgcaaaaacaattatcgttctttatcaattgatcttgttcgggagtttggcagacaacttttggagtctgtagcatttatgcatcacactgatttgaagccagagaacattcttcttgtctcatcagaattcattaaagtgccagactataaggtcttgggtggaactatgatctttggagtgtgggctgcatactggttgttgagctttgctctggggtttatagtgttattattcattgcatatgagcagggagaggcagttttccaaacacatgagaacttggaacatcttgccatgatggagagagttttagaaccactacctccgaatatggtggtcagggtcgagtaa

SEQ ID NO: 67124 - DNA, 821 bp, Glycine max
  Peptide Sequence Number=SeqID_183902
caatgaggatatcaaccacaggtttgtttgtgccaagcttgaattgatagtagcaaaaatggaagccaatgctaagataaagaaatatgaggagacagttaaacatttgtataaacttttaaagaaagtttgccaagaaagagacgaagcaagaggccaacttcaattgataaggaatttccaagcatctaccccagctgagacaagcagtactattccacaagttgatcatccatgcctccaatacaaaacaaagccatcattgaatagcaccaaggtatcaaattcaagttccaaagtattctcaaatcatccatgtgatttatccttgtcaagtctccacccaaatgagaaacattcctcccagagcttatctcacacaagaattgctgaaccaagcaacttgaccttaacaaagcaaccaaatcatatgaaggcagacataggtgcttcaagagataataatatggttgatggtgcttccctagtgtttgataaacttgtttgtgggaaacccttgcctcaaattggtagattgttgcaaagtgtaacagaagctggacctttgcttcaaacacttctagttgctcctgctccacagtggcaaaatcctccttctttgtcttcctctggccttacacttggtacacaagacaatagctcttctactaacacagatgataaggcaaatgttaatccaaatggattcattccaacttctttgggtttggtatttccagggaattctcatgtaccttctcagatgtcttatgcatccggttttgggttagcgctaaagaatgaactggtgtcatatgtgg

SEQ ID NO: 67125 - DNA, 318 bp, Glycine max
  Peptide Sequence Number=SeqID_183903
atgtgtatttacgggaaaaaacaaattttcatggtaaccattcgtgcaggtaccgtacttcaagtaggcgacgatattgctcgtatttatggtcttgatgaagtaatgacgggtgaattagtggaatttgaagagggtactataggcattgctttgaatttggaatccaaaaatgttggtgttgtattaatgggtgatggtttgatgatacaagagggaagttcagtaaaagcaacaagaagaattgctcaaatacttgtaagtgaggcttatttgggtcgtgttataaatgccctggctaaaccaattgatggttga

SEQ ID NO: 67126 - DNA, 783 bp, Glycine max
  Peptide Sequence Number=SeqID_183904
atgtgtggcaatggagttcgatgctttgccaaatttgtttctcagcttgagaatttacatgggaggcatagttttaccattcatactggtgctggtctgattattcctgaagtcttggaggatggaaatgtcagagttgatatgggggagccagttcttaaagccttggatgtgcctactaaattacctgcaaataaggataatgctgttgttaaatcacagctagttgtagatggagttatttggcatgtgacctgtgttagcatggggaatccacactgtgtaactttcagtagagaaggaagccagaatttgcttgttgatgaattgaagctagcagaaattgggccaaaatttgaacatcatgaggtgttccctgcacgaactaacacagagtttgtgcaagtattatctaactctcacttgaaaatgcgtgtttgggagcggggagcaggagcaaccctagcctgtggaactggagcttgtgctactgttgttgcagcagttcttgagggtcgtgctgggaggaattgcacggttgatctacctggagggcctcttcagattgagtggagggaggaagataatcatgtttatatgacaggctcagccgattttcctttctctctttactttaaccaagggaaacaaacatatgctcttggatacagtaatgctgaaccacgagtccacgaccacgggaacgaggaaattgattcgatgagaggaacacggtggcagtatatcaaatatccgtgtccaagcagaaaagtgccatgttaa

SEQ ID NO: 67127 - DNA, 681 bp, Glycine max
  Peptide Sequence Number=SeqID_183905
atgtcgtgtacaaagctagaccagaaagtttctataaaaagagatttatccaaacagggcccaagtccaatcaatcaaaagcatgcaggaataacagttcgtaagaagaactacctcaggctcactaccatcagagttaaaaatcctcatggtataatcggtgccattgatgccaggcaatacaaagataactccgtcagctccaacgccgaagttccgatcacacagttgcaccgctttctctgcactgatcctgggctcggacgtgtctctattgtcaatctattcaaaatcacgcgtcaaaaccgaacacggttattttgtaaggaaaagcgaagcggaacgtggactcaccaaaacgaagtcgtttccgaggccgtggtacttggcgaaatggagaaagccggactccttgaggttgaggaaggaggcggaggaggttttgacggcggtttcggtgctcatagaggacgcgacgaggcgcgaattagggtatttgaaagtgcgttgcggtgtgggcaaagtggatctgggagaatggggagagaggctattgacggaggcgagagtgcggcgggtgggggatgtgagaggaacggaaatggtggcggctatggccatcgctgtagcttcgaatggcggcggaaattccactcagccagtgtcaccgtctcggtttga

SEQ ID NO: 67128 - DNA, 252 bp, Glycine max
  Peptide Sequence Number=SeqID_183906
atgaagggattaaattggattgatgagtgggtggagggtgcaagcttgacgatcaaattcccaagactatttcttatctcggagcaaagagaggaggtacctagagaggaagttgattcttggatttggttgtataacccaaatggactttacacttcaaattctgcctatgcttcacgacttcaagaggaggttttggagaattggaatacaattttgcaagaggtttggaaactcaaaattccaagctga

SEQ ID NO: 67129 - DNA, 873 bp, Glycine max
  Peptide Sequence Number=SeqID_183907
atgtgtttggcatgttggacttggatgaacattttggcaaaagcactggtggatccttttgaatatgaagcttatattgaacagcagaaacgagaaaagatggaagctgagcgcgcctcacgaatcacggtcaggaaaaagttacccaaagttaatcgggcccttgcagctcgcctcctagaaactgaagaagctgaaaatgagaagagggatgaagatgctgatgatggtgaaactaaaaaggcatccaagaaaaagaaagggctcagcatgcaagatcttcaggacgatcgatttaaagcaatatttacaaatgaggaatttgagattaaggattcctcacaagaatatctggctttacatcccatgggttctaagaagcaaacatccttgttaaaggaacattttgaacctgtcatgtcagatgatggtcaaagtctaagtgattctgatgcatcaacatcatcacaagatgaacctgcgaatggaatgaaagacaaatctcgggttccaagaatgtatgaaatcaagaatgagcagcatgcggaggcattctggagccaaaaatcacttgcaggggaggactcacttcctatgggagacagagtagcagctctaagagatgaccaacaatcttctcgtgttccaaaaggtattaagcagggtccaggaggatcacgagaaatcactttcgccacaagaagctcagctaagtacaaggaagacgaggaggataaagaagtgccaaacaggaaaaagaggggagttcaatccttggggcttaagcccaatagaccagtgtttcgtggtcaagggagagggaaacgagggaatggcagaagaggacgtcgatatgacctttacataatgtaa

SEQ ID NO: 67130 - DNA, 159 bp, Glycine max
  Peptide Sequence Number=SeqID_183908
atggcagtaaaaggaagcttaagattcgtgtacgctcattttccgatcaaagctagcattggcaacaacaacaagtccatcaagatcaaaaatttcctcggcgagaagaagcgattcaaactggtgacactgcgtcagactcttggtcgaaaccactaa

SEQ ID NO: 67131 - DNA, 426 bp, Glycine max
  Peptide Sequence Number=SeqID_183909
atgacttacagagaacatgaaaagcattccgtggaggtcgccgaactcttgctcttcgatagcgaaatcgaatcccgacggcgtgaatcgcgggacagcgagtggaagagaactgaaggaacaaaatccccacgatcagagaagatagatggagaggataatcggagtaacacgcgcgcaaaatctttcaatgagatgacctcgcgcgacacagcacattataaattagggtttctcaaacaaagacgactattgcgatctttttcccgtatctcttttcgatcaaattcctcctcatcatcttcttcaagaaactccaatttactaaatgatcaagataaccagacccaagaggtcgcccccaaacacaatctcttcgatgaggaagtccgattcgaagatatcaatcaaaacatggatgactga

SEQ ID NO: 67132 - DNA, 231 bp, Glycine max
  Peptide Sequence Number=SeqID_183910
atggcatttccgaccaagaagctcatcgacgaccccaatgatgttgtgactgaattcattgaaggtcttgtggagacatatcctggactacagtatttagatggctttcctcaggtgaaggttgtcctacgtgcagatgtttcagctgcaacatatgataaagttgcaattcatatcaggagttgtgccattaggattctgttcaaagcgtgtaacaattgtcatgtctag

SEQ ID NO: 67133 - DNA, 561 bp, Glycine max
  Peptide Sequence Number=SeqID_183911
atggaaggaccatatggatctgagtggccagaggaagaaaaggtgaagcgcaaagaaatggttttgcccgaagcacattatgtatttgtgcatgaggttgccaattcaaatgctgatgagatgacgacagtgttgactgcagcagagacttcaacttgtttggaagatagtggccccttggttggattcgtacagtatcgctttgttttggaagaagagataccagtgctttatgtttatgaattacagcttgagcctcgtgttcagggcaagggagtggggaagtttctaatgcaacttgttgagcttatggcacaaaagagccgtatgagtgctgtcatgctgactgttcaaaaggctaatgtattagctatggatttctatataaataagctaagatacatcatatcagctatgtcaccttcaagagtcaatccaatgatgcagttggagaagagttatgaaatactttgtaaagcatttaatgatgaagctaaaactattctggaggatagagaggatgagttggaccagttggacaaagacggctcaagttattag

SEQ ID NO: 67134 - DNA, 231 bp, Glycine max
  Peptide Sequence Number=SeqID_183912
atggaatttgagtctctccaacgacgtcgttcaagcagtgtcagtgccaaccagaacaacgcttctatcagagagaagaggccgaaacgcagtgaggtaatcgccaagaataaaaccattgaagaactcatcaaaacagcacgtgccgaaaaagaccacctcgctcctttccccgactttcgacgtttccacgtaaacggtaaccgttttggatttgtttcatgtttttag

SEQ ID NO: 67135 - DNA, 156 bp, Glycine max
  Peptide Sequence Number=SeqID_183913
atgtctttaaggaaattggaaattgctgctttgtacttcccgtccagactgctcctcgtctccacgtggcaaggtaggaaccagttccaatccatgtacgcattgtatttgcaattttgcggtgaaatgcaattcgttgactttcctacttcatga

SEQ ID NO: 67136 - DNA, 1329 bp, Glycine max
  Peptide Sequence Number=SeqID_183914
atgtccatggccaaaatgcgaccagcattgccccttctgctcctcctcctcctcttcctgttctctccctccgcggcggagataaagtcgctgacgataaactccgacagccgccccatgatcctcttggagaaattcgggttcacgcacaagggccacgtgtccatcgccgtctcctctgtctccgtgggcgtgctctcctcctcggtgcaaccagaatcctctcgcctgggtttcttcctcctgaacgaagaagccctcctccaggtcctgatggagatccagcagaacccctctttctgcgtcttggactcccactacatcctcctcctcttcaccttccgcgacctctcccctcccccctttgcctccttcaaccgctcctaccccgtcacctcccccaacgaatactccctcttcttcgccaactgcgcaccggaaacctccgtctccatgtccctccacactgagtcctacaacctcgactccgactcctcccgcgactacctctccgccggccaaactcacctcccctctctctacttcctcttcttcctcacctacctctccttcttctccctctggctctacatctacttctccaacaaactctccgttcaccccattcacctcttaatgtctctccttcttctcgtgaaggctcttaacctaatctgcgccgccgaggataagcattacgtcaaggtctcgggtcttccccatggatgggatgttctgttctacatcttccagtttatccgcgtcgttttgctctttactgtaatcgttttgataggtacaggatggtcttttctgaaaccctttttgcaggacagggagaagaaggtgctgatgattgtcatcccgcttcaggttctggccaatttggcttccgttgtgatcggggaaacaggacctttcatcaaagactgggttacttggaatcagattttcttgcttgtggatattatctgctgttgtgccattattttccctattgtatggtccattagatcgctgagagagacttccaaaaccgatgggaaggcttcgaggaatttggccaagttgactctgtttagacagttctacattgttgttattgggtacttgtatttcaccagaatagtggtgttcgccttgaggacgattgcggcttataagtaccaatgggtgagcaatgctgcagaggagaccgcgagtcttgcgttttatgttgtcatgttctacatgttcagacctgtggagaagaacgagtactttgtgcttgatgaggaggaagaggaggccgcggaaatggcgctcaaggatgaagagtttgagctttga

SEQ ID NO: 67137 - DNA, 297 bp, Glycine max
  Peptide Sequence Number=SeqID_183915
atggggtctgtttttatggatgccgccagaaaaactggcgacatagttgttccgccattgcagatagcgagaacgatgctgagttggagggtgtacgttggtgccgccactgaaaatggcgagatgcatgatccgctaatgcagttggctagaagcgttgaacgaaatacattcagcgcttcgccaactgcattggcggatcatgcatcagcatcgttctcgtcatttacaatggcggaacagttatgttatcagtttttctggcggcatccatacaggaacaaatccctcttttaa

SEQ ID NO: 67138 - DNA, 228 bp, Glycine max
  Peptide Sequence Number=SeqID_183916
atgtcgatgccaccacacctcttgaatcctgcaacatctctccctcagattcgcacagggtcatacgagttgcaattgttcaacaagagtaccagggcagagcaagaaaattcaatcaacagtgccatctctcattgtaaaaagtcacaactacagggtagttcaaacaacgtttgttcacaatctctggtttgtggaaataaagaaacaactaggttgacccactga

SEQ ID NO: 67139 - DNA, 682 bp, Glycine max
  Peptide Sequence Number=SeqID_183917
aggactacacctcctggccttgagagggctgcacgcccatgcctttagaagactacacgccctcacctttagaaggctacacgccctcacctttagagggctacacgccacctttagaggactacacgtcctcgccttcagaggactgcatgtcctcgccttcagagggctgcatgccctcgcctttagaggactacatgtccttctcttcaaatggctatacaccctcgccttcaaaggacttcacgtcctcctcttcagagggctgcacgccctcgccttcagaggactacacgtcctcaccttcaaagggctgcatgccctcaccttcagaagagggcttcacgtccttaccattagaggactacgcatcctccccttcagagggctatacgccctcacctttagaggactaaatgtcctccacttcaaagggcttcacgccctcccattcagaggactacacgtcctcctcttcagagggctatgcgccctttccttcagaggagtacacgtcctcgccttcagatggctacacgccctcgccttcaaaggactacacgtcgttgccttcagaggtctgcacgccctcgcattcagaagactccccgtcctcaccttcagagggctacacgccctcctctatagaaggctgcatgacctcaccttcagaggactacac

SEQ ID NO: 67140 - DNA, 372 bp, Glycine max
  Peptide Sequence Number=SeqID_183918
atggcgaattctttttggcaaagggagaagggaatgaaaaagatgaatagcacaacttgcttctacaccaccccctccagaggaagaaggctggtctctaggccaggccacctgtgcgtcaaactccctcatgctcataatggagggcaagcccaagccctaaaggctctgcataatgatggactaccctcaatggatactctagagcatggagtgaaaataaaatatgctggacctacagaaagaggagctggtagtggtatctatgaaggtgtagaaaggaatcactggaatatctgtggaggaagaaggaggaagtgtagaagaagagggtgctggtgtgatgtgccatcattttcttctattttctaa

SEQ ID NO: 67141 - DNA, 628 bp, Glycine max
  Peptide Sequence Number=SeqID_183919
ctactgacggggtggtgcgtaacggcaaaagcaccgccgggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgtttgcgttgggtatcgagaagggcaataagtatgtcattccggcttttctcgcagccgtttatcagcagtctcttgatgataatgcttcatgggataaagttaggagtgccagaaactatgtcgccattggtgcagcagtgatagcagctcctttcacagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 67142 - DNA, 1524 bp, Glycine max
  Peptide Sequence Number=SeqID_183920
atgaaatgttccaactcttcaagctacacagcaccacctgattttgagcttgagtctgatccaacactcaccaatgaagacctcaagccaacagcaccaagtcaaaggacattttctggctttgaaatagcaagtttatgggttggtttagttgttggtgtcccttcttactaccttgctggaagccttgttgaccttggcatggcatggtggcaaggcatagcaactgtggtggcagccaacatggttctcttggttcctttggttctcactggccatgcaggcacacgctatggcatatcattcccagttctagttagatcctcttttggaatcaatggtgctcatattcctacccttataagggcacttattggttgtggttggtatggtattgagtcttggattggtggagaggcaattttccttctcttgccaaaggcaatgaaggaaacttcattgtctcagtctctaccttggcttggcacttccccacttgaatttgcttgttttttggtcttttggtttgctcaattgacctttgtttggaagggaattgatggcattagaaagcttgagaagtactcagctccaatattggttgctcttacttcttgtcttctcatttggtcttgtgtcaaagctggtggcattggtcacatgctctctttgtcttctaggctctctacatcagaattctggtctgttttcttcccttctctcactgccaacataagcttttgggccactgtggctattaacatccctgattttactagatatgctaagagccagaaggatcaagttattggtcaaattgggcttcccatctttatgggggcattcacatttgttggtctagcagttacttcatccacaaaagtgatatttggtcaagttatttctgacccaattcaacttcttggtcaaattggtggcctcacaactaggatcattgcaatccttggtataagcctagcaattatcaccaccaatattgctgccaatgttgtggcaccagcaaatgctcttgttaatctaagtcctaaatggttcacctttagaagaggagcacttttaactgcactccttgggattgcatttcaaccttggaggcttttgaaatcaagtgagagctttgtttatacttggctagttggatattctgctttgatgggtcctattgcagggattgttctagctgattactatattatacaaaaaacatatttgaatattagtgacttatactctaggagtccttatggagcatataggtattcaagagggttcaatgtggcggctattctggcactagttgttggagttttacctgtggttcctggtttcttgcagaaagttggaattgcaacttcagttcctaacacttttgttgtgatctacaacaatgcatggtttataagctttttttctgcagggttcttgtatttggttctatcgaatttgagagggaaacctggtaactctgctgctagagacccccttttgcccactgcaaagtaa

SEQ ID NO: 67143 - DNA, 429 bp, Glycine max
  Peptide Sequence Number=SeqID_183921
atgagagagcttgatgaagaccctaacatgacaaggctaagaagggacccaactccttataaatgtagccaatgtggggcaacaggtcataataccaagaggtgtacatttccacctctagtagaacttgaagaagtaaatgaggaagctaatggagctattaaaggtgtagctgagggtgtagctcagggtgcagatgttggagttcagactgggcaactcaatgtagttgagggtggcactgaaggagcaactaagggtggaaatgagggtgcaacttctggagttcagactgggcaagtcaatgttgttgagggtggcactaagggagcaactgaaggtggaaccaagggtgaaggtgatggagttcaaactagtcctattcagcatcaaaagaatgacattacacaaatcaaatgtacaaactaa

SEQ ID NO: 67144 - DNA, 222 bp, Glycine max
  Peptide Sequence Number=SeqID_183922
atggctggaagagtaagacaagcttggagtttttttggagggtggtgtcactggggtgagaaaaggagtagtggggtggttgtttgtagaatgttatggtatgtgatggagatggatgatgagtggtgggcaatggctaaacgtcaatcttttatttattcgttttttgcttttattgtgaacgaagtgaatttgaagagagaggcaagaattggtcattaa

SEQ ID NO: 67145 - DNA, 144 bp, Glycine max
  Peptide Sequence Number=SeqID_183923
atggcgcttaagcatcatatctctatgctaagcgccagcatctataggaaaagaactgtattagtgcaatggctactgaagttaaagagaggtgacacaggtttcgcggttcaagctggatcaaagtcctcagggtcaaagtga

SEQ ID NO: 67146 - DNA, 399 bp, Glycine max
  Peptide Sequence Number=SeqID_183924
atgggtgagaggatgaatggaaatggtgggtcatcatcgtcgccctcatctcctagtatggtcaagtgcaaatgtgaggtacctgttatcatgtttacgtcgagcaatgtgaatcatccagggagaaggttttggaggtgcccacactggaacgaatcaagttcttgcagattttttcaatggatttgtgatactaaggttggcaataaaatgtctgtagagtggagtgagttgatatggtatgtttgggaaaatgaagagctaaagctgaaagttgcttcattaatgaaggaaactaaagcaaatgcagaagaaataacaaatttgaggggaaaaaattgttgcacaagaggaagaatgtcatccatcctcagttcaagttgtgcaattgaagagtaa

SEQ ID NO: 67147 - DNA, 228 bp, Glycine max
  Peptide Sequence Number=SeqID_183925
atgtacgcaaagaatgttggaacaccaagaagaggaagggaagctaacactagaagcgcccaacaaggagggtcgtgcaaagaaagccatgtggcagctcaggagtggagaaagagggccacatcatttgcaaaactcgcccaacaaccaaattcctatggaaggaagaaaatgtatttcaatttgggaattcaaaagaactcgtccaaggagcagtgtttaaattga

SEQ ID NO: 67148 - DNA, 816 bp, Glycine max
  Peptide Sequence Number=SeqID_183926
aactatactggtgatcgtttgaactttggcttggctgctgagatagcaaaatctgaagggtataaagtagagactgttattgttggtgacgattgtgcactacctccacctcgagggattgctggaagaagaggtttggcaggaactattctggttcacaaggttgcaggagctgctgctgctggtggtctttctcttgctgatgttgctgcagaagctaaacatgcatctgaaatagtgggaacaatgggtgttgctctgactgtgtgcacaattcctggtcaagttgcatcagatcgtttgggaccaggaaagatggaacttggtcttggaattcatggagaacctggggcagctgtggctgatattcagcccgtaaatgtggtggtttctcatgttctgcagcaaattttgtccacggaaacaaactatgttccgataactcgaggagaaagagtggtccttatggtcaatgggttgggtggcactcctacaatggaactaatgattacagctggaaaaacagttccaaagttacagctagaacatggattggctgttgatagagtttatacagggtcatttatgacttctcttgatatggcaggtttctcaatttctattatgaaggctgatccagttattcttcaacgattagatgctccaactaaagctccttattggcccgttgctgctgatggtaatcacccgcctgctaagattcctgttccaatcccagcatctcgaacagcaaagactgatgaggatttcattattgagtgtggaattgctgtccatgccaccaacaatgtctga

SEQ ID NO: 67149 - DNA, 1080 bp, Glycine max
  Peptide Sequence Number=SeqID_183927
atggccacaaaaaaggtttcatcggttcatgtagacgaagactacattgacattgaactaagatcttcttcccccaacagcttctcttattcccttgacaccccacaacagaacaacaacagagaattcgagttccaaaacaaggaagagtccacaacttccccagctgatgaactcttttacaaaggaaaactccttcctcttcacctccctcctcgcttagaaatggtggaaaagcttcttgagaacgctgatgccacctttggcttctcaagatcacagtcatcattggaagacagtagatttaggttgcattcaacaaatgccacctcacctcttgagtcctgcaacatctccccctcggaatcacgcagggttagttcctgtgaatcactcccttctgagtatcagtttgattggtcctctgagatagaagggttggttagtgatcatcatcatcaccaacatgttccaaataaacataccaagcagaagcaattctggctggctcaaaggttcaaggcttcaaaaatttacttgaaatccttgttcagcaaatctggttgctctgataagagctgtgccagtgatgctgcagcaagcaaagtgggggaagtgaagaaaccaaaatgcaaggatgatgctacgaaaagcaaaaacaaaaacaaaagcccatttgagttgttttgtgacaacaagcacaggagtcagagatcctgtgcggtgaagaacagtgacatgcatgaaaatggtttctttgacagtagcagcagaaggtctttctctggggtgattcagcgacattatgcttccaaggcttcatctttgtctacatcttcttctgggtcatcttcttcgtcttcgtctttttcactcagttcagctgggtcttatgagttgcaattgttcaacaggagtatcagtgcggagctggagaattcaattgagagtgccattgctcattgtaaaaagtcccaacaaaagggtggttcagacaaggtttgttcacaatctgcagtttgtggaaaaaagggaataatggagaagaccctggtcagaaaggatgagtttctcatttga

SEQ ID NO: 67150 - DNA, 684 bp, Glycine max
  Peptide Sequence Number=SeqID_183928
ccacgaagtcggccacaacaactaaatgagcaaggccaaattcttgaggtagccattgaagctgctgcaaatgcaattataaatctgaaggacaatctaaatgaatgggatggtaaagttggtgatggcgactgtggatcaactatgtatagaggtgcaaaagcaattcttgaggacatcaaagattaccctctaaatgatgcttcagaaactgtcggcgaaattggttcatcaattggaagatccatgggaggaacaagtgggattatatatacaatattttttaaggcagcacattcagtgctaaaagcaagctcccattctggtgtcacatcaaaacaatgggctgaagcactcgcaacttccattgctgctgtaagtaaatatgggggcgctagtgctggttatagaacattgttagatgcccttattccagcatcgtcggttcttgaagagaaattaaattctggagatgatccttgcaccgcttttgttctctcctctgaagctgcattggctggagctcagtcaacggtagacatgcaagcacagtatatgcaggctggacgttcgacttacatttctggagagattctttcgacaattcctgatcctggtgctatggctgcagcgacatggtacagagccgcggccttagctgtgaaggccaaataccagagctaa

SEQ ID NO: 67151 - DNA, 1768 bp, Glycine max
  Peptide Sequence Number=SeqID_183929
atgaaaggtcaatacagttccaagcatccattctctccctcagcaaaacattccaagttccatagttggaaccctgaaagcaaaacattaggtcattttgatcgagttgcaaacatgagaaagttgtgttttaacccccaaacagagtcgtttgcgttggcccgcagttctccttcttcaccactatccttaacctcaagcccaactcctccgaggctgagcttttccgaagctgaggcactgatactgaaatggaaccctgacacttccgcttacgccaaagtcacttccctcttctacgaggacaaaaccgaagccaaacactacattgactccgttaaccagcttcagaaatccatgcattccttgctctctcagaacccttcctctgagaaactcattctcgctcataacctaatgcagatggctatgaagaggctcaagaaagagttctaccagatcttatccatgaaccgcgcacaccttgatccagaatccgtctccgccagatcctctcgcacctccgccaactccagcgcctccgattacgacgacgacttcgctgctgaggacgacgatatccgcgccgccggcgactctatctccgaagtcgagcaggtttcttccggcgccatggcagatctgaaactaatcgctgactgcatggtatcttccggttatgccaaagaatgcgtcagcgtttacatcttaatacggaaatccataatcgacgaaggaatctaccgcctcggcgtggagaaactgagctcctcgcgcgccaacaagatggattggaatgtgcttgatttgaagatcaagagttggttagaggcgataaggatttccgttagaacgctcttcaacggagagagaatcctctgcgaccacgtcttcagttactcagattctgtcagagaatcctgcttcgccgagatttcgagagacggtgcctctctccttttcggattccctgaactcgttgccaaaacgaagaaatcatcgctggagaagctgttccgagtgctcgatatgcatgctgtggtttccgaactgtggccggagatcgagtctatcttctcctccgattacaactccggcgctcgttctcaagtcctggtttcgcttcaacgactcaccgagtccgcgcaaatcttgctcgcggagttcgagtccacgatccagaaagactcttccaagtcggcggtgaacggcggtggcgtgcacccgctcacgattcagacgatgaattacctttcagtcctcgccgattacatcaacgtgctctctgatatattcccgcgcgactggcttccgccgccaaagtcttcgtcgctgccggaatcttatttatacagtccggagtctgattactcggcgtcgaagccggcgctgacggcgcgttttgcgtggctaattctcgtcctcctttgcaagctcgacggcaaggcgaagcattgcaaggacgtttcgctgtcttacctctttctcgctaacaatctctggtacgttgtcgccagagtgcgaagctcgaacctgcagtacgtgcttggcgacgattggatccttaagcacgaagctaaagcgaagaggttcgtcgcgaactacgagaaggtggcgtggggagaagtggtttcgtcattgccggaaaatccagccgcggcggaggcgagggaggtgttcgagagcttcaaccgcaaattcgaggaagggtatcggaaacagaactcattcgtcgtagctgaccgcgaattacgagacgaaataaaag

SEQ ID NO: 67152 - DNA, 690 bp, Glycine max
  Peptide Sequence Number=SeqID_183930
atgacattattcagtgtagaaaaaacattgaaaatgcttaaggagcttgaggtgttgttcgtgaatataatgaggcgtgagaattgttttctgatgagaatcatgaaactggtcaaatacaggctaaagacccaagtggagaaggacgaaggcccaagtggagaaggacaaagcccccgagtggagaaggatgaaggcccaagtaatccttgtggcgtctatcctgacttatcttccttcaccggaagtggcgtctacccagacttatcttccttcactggaagtggcgtctacccagacttatcttccttcattggaagtggcgtctaccctgacttatcttccttcactgaaagtggcgtcatccaaatctctgtaacctgtatcaaacgatccgcccctttgagggcaagaaagaagtttgggtttgtagatggaacaactaaacaacatgtagagaaatcaccaaatcttgaagattggtggaccaagaatttgttgttggtgtcgtggataatgaacaccattgaacccacactccattcaacaatatcacatatggagatggcacaagacctgtggatagatatgctagaacatttctcaatagcaaatgagcctcacatacaacaactcaaagcagagttgactgaatgcaaacaaaaaggaatgattattgttgcttattaa

SEQ ID NO: 67153 - DNA, 324 bp, Glycine max
  Peptide Sequence Number=SeqID_183931
atggctactattgtttgtgaattaaaatggttgaaggatttgttttcatgtcttggttgtgcacatatgagacatatgaacctttactgtgataatcaggttgcacttcatataactactaatcatgtttctcatgagcacaccaagcacatcgaggtggattatcactttgttcttgatgagctatcgcaaggaaccattgctacatctcatgtgtcgtctcatgctcaacttgttgatatcttcatcaaggctttaggaaagacccaatttgatttcatattttccaagttgggcatttgtaatccatatgctccaacttga

SEQ ID NO: 67154 - DNA, 174 bp, Glycine max
  Peptide Sequence Number=SeqID_183932
atgccaccacacaaactaggcccgcagactggcccgtttgcccagcggggtccgcggggcaggggcggaccaatttatttggtccgtgtaaaaagcaggggcagattgacccggtccgctgccaatgcgggcgggccttacgcggagtgggccaacctgcttacccacccctaa

SEQ ID NO: 67155 - DNA, 225 bp, Glycine max
  Peptide Sequence Number=SeqID_183933
atgcccgaggatggtcttgatgtattgaatctgactattgaagaaataatgcaagatgaggaggttgctcctatgcatgggagtgtagatgagattgtaacgatgttacgtcctattttggaggaaataatcaatagaaggattggagggctctcctccccttattctattggtttaagtgcttatttggagaacaaagaggttattacttattatgctcattga

SEQ ID NO: 67156 - DNA, 492 bp, Glycine max
  Peptide Sequence Number=SeqID_183934
atgagagagaagagggaaagggaaagtgagaaacaacagaggagagggagggtgagaagtcggagagtgggaccattctactgcagtcagggctcaacaggggcgaggctagtggtgaccttgtcaccagtctcgagagtctttggttgtaattcaaaggtggcaatgaagaaggcattgatgccaacttggtgctcaagggcagaccttgatggagggccaggttttgatgccaaggatcttgttcttaatgtcaatggcagagtggaccattttggtgatgttcttgttgtgcatggttgtgagcatggcaacgaggtagatgttgctaatgtcacaaagtacaatgtcgagggccatgtagatctcagcatacttgtgattgagcttcatcggtgtgacatcagtgtcgctacaggttgtgacaacatcgctcacaatctggatgaattcaaagatgttgacaatgttgtccttcataaggtggactaa

SEQ ID NO: 67157 - DNA, 366 bp, Glycine max
  Peptide Sequence Number=SeqID_183935
atggacattttttataaaccaatacattgcaaggtcattggtgacgatgaattcgaactcgacgaagtcaatagtgtcgttaacggccatgtgcgtgacacattgttgccttcttctatctattgcaatgctctcttctctctaagggtgagacacatcttcactaaccaaatccgactgatgtctccatggataaggcgtgaaggtgttagacgaagtagatctgaagagtgggtttgggtggtgcgacggtgctatatgggggtcatcgacattaatatgaagaaggagaagagatggagacagaggcacctttttaatgatgttagtataaataatggaaatgataacattgaagcattttaa

SEQ ID NO: 67158 - DNA, 240 bp, Glycine max
  Peptide Sequence Number=SeqID_183936
atgagttgcgcgaatgagcaaaagactacatccagatggaagaaatgcacaggttcaggaacgaagtcagacaagtcggacaaaaacacgacaagtgagaaggaagcaccaaggccgactcacatgtcagacaagaggcacaagtcggacaagcgccagcctctcccaaaagggctcaggtacgagcgttacacatccctgacaatcgcactatattcctcgaggaggctttcaacttag

SEQ ID NO: 67159 - DNA, 261 bp, Glycine max
  Peptide Sequence Number=SeqID_183937
atgagtgagcaacatataacattctgggcttttatggatacaatgaagtctattatttctgacctcaaaaccacttacaaagatgaagtagtcctaacacaaagacaactgttaagactttggcaagtgcaccaaatcgtgacaagtagtaaagctcggaagtccgagtgtcgtgtccgcagggattttattgcacttattcaatacctctcaatttatgttctattaggtgttaccctttcccaagcgtataacccctaa

SEQ ID NO: 67160 - DNA, 738 bp, Glycine max
  Peptide Sequence Number=SeqID_183938
atgaagattaacgtcaagactctcaaggggactcactttgtccttcaagtgaaccctcaagacacggttgctgttgtgaagaagaatatagagacagcgcaaggtgctgatgtttaccctgctgcgcaacaaatgcttattcatcaggggaaggtgcttaacgatgccacaacccttgaggaaaataaagttgttgagaataattttgtggtgatcatgttaagcaagaataaggtatcaagtggagcctcatctgcgccctcaaacctgggaacccaacctcaaagttctttgcctcctacttcatcaacatctcaacctcctgcatcggctgtaggacagggagaatccaattctgagcagagtccagttataactcctcccactattgctgtgcccagtatctatgatcatgcagcatcaaatcttatggcaggaagtaatttagaaacaactattcaacaaattctagaaatggggggaggaaattgggaccgggatactgttaccggtgctcttcatgctgcatttaacaatcctgaaagagctattgaatatctctattctctgttaattggtactttgttatctgttggattagagactcctgttgctgctcacgtcatttttaaattgactggcttaatgctgcaaagaattaagccctcaaaacttgtgcttttagtcaactatgctatcttgtgccagtacagttttaaacttatgatggttgtttaa

SEQ ID NO: 67161 - DNA, 924 bp, Glycine max
  Peptide Sequence Number=SeqID_183939
atggcgcctttgtcactcgccgaaaaaaagaaggttcttttcataatgggtgcaacgggcacaggcaaaacaaagttatccatcaacttgggcactcaattcccttctgaagtcattaactctgacaaaatccaagtctataagggcttggacatcatcacaaacaaggtaccagagtctgaacgtaatggcattcctcatcatctgctaggcatcatcgatgatcctgattatgacttcacagttgatgacttttgcaagcatgtcctcattgctcttgatcttattattgaaaatggacacctacccattatcgtgggaggctcaaacacttaccttgcaacattgcttgaggatcccaacatcgcatttcgttccaaatatgattgttgcttcatttgggttgatgtgtctttacctgtgttgtttcagtatttagataaaagggtggacgaaatgcttgataaaggagttgttgatgagattcgagaaacttttgtgcctggagcagactactctcgtggggttagaagagccatcggggttcctgagctgggggagtatttcttggttgagaagaaaatagatgatgagaccaaaaaggagaagatgttgcaaggtgctattgcgagaactaaagagaacacttgtaaattggctgaggcgcaactcttgaagatacataagatgaactatgagtttggatggggaatgaccaaaattgattccacacaagtgtttgaggcagttttaaaaggaatggattataagcacttataccatgagattgtgttcaaaccaagcgtggatatagtgaaaagatttctacatgagacaacttcaggaaagggaaaggcactgcgtcaaaatggtgaacaagtgacggttgtgcttcaaaaatcgttgaaattggctaaggattag

SEQ ID NO: 67162 - DNA, 480 bp, Glycine max
  Peptide Sequence Number=SeqID_183940
atggcatcatgcatcaaagatattgaagttaaagcattgaaggtcattctaaacacttatggcaaagcttatggccaacttatcaaccctaacaaatctaaattctttttcagcaccaacactcaacactcacataggaaaaggatatcatcctttctgggaatcaaagatctaattgggaaaggaaaatatttaggccttccttcacttattgggagaaataaaaaagtagtcttcgattttatgaaagacaaggtctggaagtgcatcaaccattggtcaagcaagcatttgtccaaggcagaccaaattcaaaaaatgatgaacaactttggtggggttctaaagcgacaaattcaagagaaagaatattgcataatgggttgtcaagacctccatggtttcaaccttgcaattctagggaagctaaggtggaagttctccactgatcatgatggttacacaaatcttcaaagctaa

SEQ ID NO: 67163 - DNA, 273 bp, Glycine max
  Peptide Sequence Number=SeqID_183941
atgggtgcgactgttttgagttcaagatggtgggaaacagccaagggaggcggagctgacgtggatgctgttggtggtggtggtttgagaagagatggagatggagatggagtgggtgttgttaaggtctccacaggtggtggtgcgtccgttggggatgagttgggaggaaagggagtgggtgtgagagtggaaagccgggaggcttggatgttggataggcgagtgatggcttcttcgagcctattaatcgtggtctttcgggttgcatga

SEQ ID NO: 67164 - DNA, 290 bp, Glycine max
  Peptide Sequence Number=SeqID_183942
atgattcaggcgcactacttcttctccttccatgtccccaagggttccgattccgatgaagaggaagaagatatgttcagctacgacttaacgatcgcagaatgtcaagaagaaaagggaggcgctggatggtttcgtggtgagggaggtttcgctgaaggatttcaatcggggaagaagaaggagatgatggagggatgggcaagccctggtgcagcggtaaagttgtgtcttggtgacttgttagtcatgggttcgaatccggaaacagtctctttgcatatgcaagg

SEQ ID NO: 67165 - DNA, 386 bp, Glycine max
  Peptide Sequence Number=SeqID_183943
atgggtaggcaagaaaccaaggaccgggaaatgggcaaaatcctcaaaacgggatcacaagaacaccatcatggttcttcttcttccagcaccagcacttcacacgttccccctggccaagctgctggacttgttgctattttgaaggataaaagtgttgatgagttgcggaagctcttatctaacaaagatgcgtatcagcaatttttaagttcgcttgatgaggtcaagattcaaaatgatgtaagtaagatgccaaggagtcatggtgatgataatgctgagaatagccagataattgagctcaacaacccattcccaacacatggtgcctatcatggatcagccacttggtggtttgatcctacaaatggctacaaagcaag

SEQ ID NO: 67166 - DNA, 756 bp, Glycine max
  Peptide Sequence Number=SeqID_183944
atggcaacgtgtcttcttcgcgttgggagatttacgagtatcgattcgcgctctctcttcgtttccactgctagtttctcctcttctttctcttcgccgtcatcttccggtaagtctaagacggggaagaagctcacggatcgtctttcctccgtcatcgacgccgtcaacgatcgcaaactacctcccgagctacgcggccagcacaacaacgtcaggtcagaaactgacatgatcaatgttgttgagcaaagaatatggcattccatggaagagggccagtttgagaacttgccaggcaaaggcaagccgcttaagcttgacacaaatcctcatgcggatccagctgaagacaccctgtaccgcatcctgtcgaaaaatggatgtgcgccagagtgggttgagcttaacaaagagattagatctaaaatatctgaatggaggaagtccttgaagaaagcttgggctactaagtgcagtggtgatcactctgagtgggttgaaagtacagaggctttaaaatcacagttacgagaaatcaacgataaggttttccggtataaccttattgtgccttttggtcggcaaatgtttggccttaagtgggagaaagagctagatgactggaatgagatgggtgagggtttttccaatggcagtgcaatagtctgcactgcatttgccatttatctcccggccttgatcataaaactctacgttctccaagtcctttatcttttagaagatgattgttga

SEQ ID NO: 67167 - DNA, 456 bp, Glycine max
  Peptide Sequence Number=SeqID_183945
atggtggatcatttagatttggaggcgatggtgggtgtcctgaactggtggagggtcggtgaagagtggccgaaggagatggagggttgcctaattataacagaatctcagagtggaggacaactagggggagtgacagtgtgcaaggggacgaggaattggatctgtaaaggggtagtttactatgtgctaactgacagcagactaggtggcggtgttttcaattggggtggtgacggcagtgtagtgaactgggtgatattaacagtgacagggattgtacctatcaccattgcaaagcttgaagggctttccagttatagagaattggtacttctatttcagtatggagaattgttacgggatgagaagatgaaaggtctaccaccaacgggaaggcaaaggtccacttctatttcagaagtggaaaaggtcacattgcttcattatgagtga

SEQ ID NO: 67168 - DNA, 570 bp, Glycine max
  Peptide Sequence Number=SeqID_183946
atggggagtgaggtttttgatttggagattgatgtgttgagatttatgttggttgtgttttgtggtgtgcagattgagcttaatttctttgacacggttggctcatccacagcagcgttgattccctgctcggacccaatatgcacttccagggtccagggtgctgctgctgaatgctctccgagggttaatcagtgcagctacacctttcagtatggagatgggagtgggacatcggggaaatgtgggatatgcttggtaggagtgaaaattagagggaatgggagggaggaggggattaaagtgacaatgtgtagcatcagtcagtctggagatttgactaagacagataaagcagttgatgggatttttgggtttggccctggtcctctatctgttgtatcacaattgtcatctcgaggaataacacccaaagttttctctcattgcttaaagggagatggcgatggaggaggtgttctagttcttggtgagattttggagccaagtattgtttatagtcctcttgtaccatcacagaatgtacaaggcatttctgaaagaaattga

SEQ ID NO: 67169 - DNA, 891 bp, Glycine max
  Peptide Sequence Number=SeqID_183947
atggaagatcaaagaaaggacaaggatttgcaaatggtgatttggatgagcatgcagcgcatgacaccagagccaaagcgcaacaagccatttaagaagagggaggcacacacatttcagagaaaatgggaagaggaacactcaaatgaacaagctgttgtgttttccgcatacagggaaagaatgagatttgtcacgcctcattacaacttgaatcttcagagtattgctgtcaatggacaacttctcccaattaatccagctgtattttctatatctaacaaccgaggagggactatagttgactgtggtacaacattggcatatcttattcaagaagcttatgatcctcttgtcactgctataaatactgccgtgtcacaatctgccaggcaaacaaattcaaaaggaaaccagtgttatctggtctcaaccagtataggtgacatttttccttcggtaagtttaaactttgagggtggagcatcaatggttttaaaaccagagcagtaccttatgcataacggttaccttgatggtgctgaaatgtggtgcatcggtttccagaaatttcaggagggagcctcaattttaggagatcttgtcctaaaagataagatagttgtgtatgacatagctcaacaacgaattggatgggctaactatgactgttctttgtctgtaaatgtttcggtgactacaagtaaggacgagtacatcaatgcggggcagcttcatgtcagcagctccgaaatacacattctttctaagttactacctatttggatagaagctttgacaattggagatttcgatgaaaggttgagaagggaaaattttgacaaaattctgataagtggaaatttcgatggaagttcaaagaatgattag

SEQ ID NO: 67170 - DNA, 1425 bp, Glycine max
  Peptide Sequence Number=SeqID_183948
atgttagccaataacttatctccatcgtcagttcccacttctgagccttttccctgcactgaaaatggcactgccaccaataaaaggaagagaaggcccgcaggaacaccagatccagatgcagaagtggtgtccctctcgccgaagacgttgttggaatcggatcgttatgtgtgtgagatctgcaaccagggattccagagggaccagaaccttcagatgcataggaggaggcacaaggtgccatggaagctactgaagagggagacaccagtggtgaggaagagagtgtttgtgtgtcctgagccaacttgcttgcaccatgacccatgtcatgccttgggtgaccttgttggaattaagaagcatttcaggaggaagcacagcaatcataagcaatgggtctgtgaaagatgctccaaaggctatgcagtgcagtctgattacaaagcacatctcaaaacgtgtggcacccggggccactcttgtgattgtggccgcgttttctcaagggttgagagtttcattgagcaccaagatgcttgcaacatggggaggctcaggcctgagtctcaacctcttcaaccatctgcatgcctttctagaacagcctcaagcccgagtccttcaagtgaaaccaatttcagcacagctccatggccaacaaggatgataataccaaagccatcagaaccaccaacaatcttcatgaataaccctattactgctatcaccactgctgaaacctcatccaagagcaacaacaaactactccaccccaacttggatcttcaactctccacccccaccaccaccaacaacacatcaaatgttgcaaaccgtattgatgctgcaatatcacctaagagggatcatcatcatcatcatgagaaccattcaacccatttgcaactctcaattgggtcatcagatatgagtgagaagaacgaatcaaacaggaactcatcagagaagagcagcaacagcaacattaatgatcagaataataataataagcagtccaacaacatggccttgttgagggttcaagagcaagcaagggagcacttgaggatagccatggcagagaaagcatatgctgaggaagcaaggaaacaagcaaagagacagattgagctggcggagcaagagttcacaaacgccaagaggataagacaacaagcacaagcggaactcgacaaagcctactccttgaaagaacatgcaatgaagcaaatcaactccaccatgctccaaatcacttgccatggttgcaaacaacagttccaagctcgaaatgcagcaaccacccccgatgagaattccttggtgttgagctacgtgtcttctgctattaccacggaaggaggaggagaagtagaaaatgataataatgcaaaagatcatggcaaagacaacaactaa

SEQ ID NO: 67171 - DNA, 541 bp, Glycine max
  Peptide Sequence Number=SeqID_183949
atggaggataatgttctgcttgacaaggaagatattgttgctgaggaggaggttggcgaggaggagtgtgtaccaagggtggaccttgggtttttatgttcttgtattcctgcacagctgaaaggctcaccaagggtgaaccttgggtttaacgagccttggactgggaacgtgtttgccctgagttttgacaagcctgtagagttgcatcgaggcttaccatggacgaaccctgagttttgtgaacctgtgaaactcaccaatggtggaccttggcgcacatgccaagctatcacatacatgtcacttgtggagtggtacatattggagatgtggtgtcgtgctcttgcatacatgtcactcgtggaatggcacacactggagactaatgacacatactggagacgtggtggcatgctcttgcatgtgtcactcatggagtggcacgtattggagacgtggtggcgtgagcctggaggactcaccaaaggcaaaccttgggttttacaagccctttggagaaacaaccagaaacgtgttg

SEQ ID NO: 67172 - DNA, 183 bp, Glycine max
  Peptide Sequence Number=SeqID_183950
atggataagtcatggattctgaagccacaaaactcaatcgagtatgaagaagggattatgattgatgatgctcttggagttgataggcagcatacaaatgaagtgtccattgctccaaatgtagaggttgatagggatgaagtagttccaaacgacacacaagaaaggaatgaagccaaatag

SEQ ID NO: 67173 - DNA, 378 bp, Glycine max
  Peptide Sequence Number=SeqID_183951
atgaagatgcaggggttacactgtgtttggatgagaaaatttaaccagttcgagatcgcacgcccgacacagcgattcttgaaggcgctggccaccgtccccgacgtgttcatcaggggcgcggaggagttgaaacacaccatttcaactacgtgtgacaccgtgaggaggtgttttaggagcagggggcttctggttccgccgtggaggaagaaccggttcatgcaaaacaagtggttggggccttgtcaccgaaccacgagagatacttccatgggatttaacggtggtgttagttgtagggtggtggggttcgacaacgtcgtttcggaagcgggaagtggcagtagcagtggcgttgttgttcgtacgagatga

SEQ ID NO: 67174 - DNA, 489 bp, Glycine max
  Peptide Sequence Number=SeqID_183952
ggccttcccaatatgagtgcaattgataatagaggagacttggattccttgcgaaacagagaagagttccaagcattaagagagacgatgcgagaaaacccccaaattttgcagcctatgattcaggaactgggacaacaaaatcctcagctaatgcagatcatccaagatcatcaagaggacatacttgaccttatgaatgaacctgaaggggacgagaatttacagagtcagttggattccatgatttctgggactgtcactatcacccctgaagagaatgaggccattcaacggaccaaggttaaaaaaaagtttatgtcaagtatcaagtatgtaaggccaagcgtaaggcttagccttgctggatccattcccatccatattcatgatagaggatatatagagatagatttcttcaagcatttttttttctcatcccaagggctggctactaatgtttatacttttgacatgtcctgcttttaa

SEQ ID NO: 67175 - DNA, 279 bp, Glycine max
  Peptide Sequence Number=SeqID_183953
atggctggacttttaggatataggagccttccacctaaggcaaagaatctggtagttgctgggggtttgacagcttttgtctttggtgcatacttctacaccatgagggctgttggaggcactgatgaactgcaggtagcaattgataagtttgaagctgacaagagcaagaatgagggtgatgccaacatgccatcaaagaatgttctaaaaggaatgatattgaatctagttgctaataagtttcaaccagctttatgtactatgactgtgtggtag

SEQ ID NO: 67176 - DNA, 522 bp, Glycine max
  Peptide Sequence Number=SeqID_183954
atggaaaaacacattaaggttgcaatttttatctcaaaaacttcatgggttcaggttgagaaggtggaaaaacacattaaagttgcgatttttatctcaaaagcttcatggattcagagaaggtggaagaagacattgaaactaccattttttactacaaaaagcttcgattttaatctcaaaagaaggtggaaggagacactaaagtttccatttctaactccaaaaaccttcgatttttatctgatttttatctcaaataggattcttttctttgtttctctatctacagacaaggtggaagaagacactaaagctgtcatttttaactccaaaaaggatgatgttattggttcttttaactattatgtcgagcttgcagcaggagtggatacacatcaaaatggttatgtaccccttcctatggaaaccttcaatacttatgttcacaaggagcccaatggagttgctgcattaattactccatgtaatttacttccacgaacaatcttcataaactga

SEQ ID NO: 67177 - DNA, 2322 bp, Glycine max
  Peptide Sequence Number=SeqID_183955
atggcggccatggcggatgtggcggcgaggcggaaaatggcggatgcagctgcaaccctcgacctcgaagctccaacacagcgcgacgacccacgacccctgcaaccagccacgacctcggaaccacccacacctgcaaccagtgacgacgagcacggcagcgaccacccaaggcaacgcgaacggcgcacaactgatgaatcttttacccaactttgttttgtagatgaggctgagcctgatgatagcattctccctctaagagatatgtttggaacttgtctgagtgtagttgctgctctgactaaggattgcattgagggatttcatttgcaggaggttcaagtaataggattgcaatttcttaaagccaggattcaaagaggtgtaaatacagaagataactcttttataatgtttcttgttggggagctaattggtgatattttcactttgatccacaaaatgttgaaggccattgtcatgattttcttgtcaacagaagatgggttctctcaggaagtcaatgatttaagaagcacggctgttaagcttgtttctcgccttgctcaaattccttcatcagccattcatttcaaggatgttttactatcaatgcctcctcttcaccgccaacaacttcagggtgtaatccgagcttctgtaactcatgataaaaatccaacagatctaaaagtaccagttttggacataaaaatgccaaagccatcagaaggaactgaagagaaacattctgtaccatcatctgctgcagtgatgcagacagatgaaaatgacaaggaagaagatgaattcagtgaagatgattgggatgcatttcagtcgtttcctgtctctaaaagtgaggatggagatgattcaaaaacagagtatgttgctgaaggaaaggatcctagcacagttaaaatgtcatcagaaatagaaagttctattggaggagttgagtttcaagaatgttctatttccaaatccatcaatagtgaaaaggagctgaaaggtgatgaatgtctggaggctgttaaagagaaacatgatcaaacttatcctagtgctaacaagccacatgataatgagaatcaagagatggaggaaaaattgcaaacctcagtgcttcaagaagaggggacatcaatcccaggaagtgaactagtttcttgtgatcagaagcctgaggaagaggctaagatggaggaaaaattgcaaaactcagggcttcaagaagaggggatatcaatcctaggaaacgaacgagtttattgtgatcacaagcctgaggtagaagctgagatggaggaaaaattgcaaaactcggggcttcaaggagaggggacagcaatcccaagaaatgaacgagtttcttgtgatcaaatgtctgaggtagaagctgtgatggaggaaaaattgcaaaacttggggcttcaagaagaggggacatcaatcccaggaaatgaacgagtttcttgtgatcaaaagcctgaggtagaagctgagatagaggaaaaattgcaaaattcagggcttcaagaagagggaacatcaatcccaggaaatgaacaagtttcttgtgatcaaaagcgtgaggtagaagctgaaggatcaattgaagaggaagtagtgtcagattctccgacacttcaacaggggttttctgaaccaggtaatagtgaacagcttaacaggtgtgatgaagatgctgagaaggacagtgttaatgaaaatgagagtcatcacccgcagctagaaatgtctgaaactccaatagagtgtacaaaattagaaccatttgctgaagaccataaagaccacaatcgcgctggagtgaggttaacactcttaggaggaggcgctgtttggttcgtgaagctgaagatgaaaggcatgcgtaaactgctcatactttatgcctctcagaccggcaatgcattggacgcagctgaacgactttctcgcgaagctgaacggagagcctgccccttcaaccttctctctgtagaccaatatgatcctagtttgttaccacaggaggaggctgtcatttttgtggtttctaccactggccaaggtgatacacccgattccatgaaggtattttggagatatcttcttcagagaaacctaggtcagcgttggctgagtggggttctctatgcggttttcggcttgggtgattctagttatcagaagtacaatgttcttaaatatgagactggtgatgtccttgaagttctacctggtcaagattctgctgcagttgatgctttcatacgacgttgtaatttggatcctgattcattcatcact

SEQ ID NO: 67178 - DNA, 1284 bp, Glycine max
  Peptide Sequence Number=SeqID_183956
atgggactgtcgaaagtaaaaggggggtgtcaaatagaaaaacggaaaaaaagctgcagacagcaaaaaggggtgtcaagcagcaaaaacaaaaaaaaaagctttggcccacccaccagtataagtcacggtcgcggttctggctgggtcgtcttctccgttcgcgttgccgtcgttcacgccgtgctcgtcaccgccgttcgcgttgccttgggtggtcgctgccgtgctcgtcgtcactggttgcaggggtcgtgggtcgtcgcgctgtgttggagcttcgaggtcgagggttgcagctgcatccgccattttccgcctcgccgccacatccgccatggccgccatggccgccatggcgccgccatctttaactcgtcacgccaccgctattcggtggcgttttttcagaaaaccgcaacgcaactccgccatggccgccatttaacaacactgttactggctattctgtctatatctactcaacatcacgcattacctggcggtcgcgacacacaaaacgaccgtctgggtaatcctttggaccagtggataaaaatctcgagccgttgcagcgattgcgacgcaagctcagaagcaaacaaaagacagaacgaagcggatgaagagacaagagcaggagctgaggcagaagacaggtacgaggaaaggaaagaagtggtcaacggatcccgcacccctgacaagaagacaaaagaggagcatgaaaagggaagtatcagggcagaagggaatgggtcagaatttgaagttgctggctttcaccaaacttatgcacgtgacaaggagcaagtggacttagatgggctgattttacttccatgcacccccaatgttttaaaaacacaccaggaaaataaaatagaggcccactcaaacaaaaaacacccaatcagtgtgtatgctaggaaaaagtggcgtaaaaagcaacctctggaaaatggagtgcagaggaacctaagtggcagcttggaaattggaaaagtaccatcccaacaggaattaaatagcgaagaccataaccatgaaaatattcagcagcaggattcttgtcatgatgatatgggccaagttatggagcaggatgaaatgcaagatattaataataattctaaggaggcagaaatactatggcagttagcgaaggaactaggagtaactggatggaatgacaatgtgaagcaggtgcagcaaatggttgaattggaagaaagggatattaaagagtcagagaaattgggagggatgaggaagactccatga

SEQ ID NO: 67179 - DNA, 1435 bp, Glycine max
  Peptide Sequence Number=SeqID_183957
gattttccgtgaagtggattcggccactaagaagaagtgcggagtaaacgcggaagattgtttgtcaaacgacgacagttttggcgccgacgggaatggacggcacgccgttttcaatgcgctggatactctgcttaaggacagtttagagcgtcttaagatgatgagcgagaacctatgtttggtaaagacaggtctaactataggatatgcatgtgaatccaagtatgctgaagatacagctactattaggcgtttgtgcttagatggtaagttggaagcagctgtttggcttcaggggaaaatggtgcagaaaggtgttgttcctgatgtgtttacccacagccatattgtaaatgggctttgcaaaattggtcttccggacaaggcggatttggttgttcgagagatgctagaatttggtccttgtcccaactgtgccacttataacactttaattaagggctattgcgctgttaatggcgtggatagggctttgtatctgttctccaccatggcctatgctgggattctgccaaacagggttacttgtagcatactggtgtgtgcactgtgtgagaaaggtcttctgatggaagctaaaagcatgcttgtagaaatattaaaggatgacgacgagaaaggtatacctgatttagttacctcttctatatttatggatagctactttaagaatggagcaattattcaggctctcaatctttggaatcagatgcttcaaaattgtacaaaagttgatgttgtagcttataatgttcttatcaatggattttgcaagagtcaactaatgaaccttgcatatggatatgcatgtgagatgtttaagaaaggaaaaattagtgaggcttgctataccattggagttatgtctaatatgggaattatgcctgaccaaattacataccagattgtgattcgaggcttttgttttgacggagagattgttagagcaaaaaacttgctttggtatcagatgctggattttggtgtttgccctaatgtatttacttataatgctttaattcttgcacaggttaagagtggaaatttccatggacggcctgattttgctcttcaattacataatgagatggtgcagaggggaggtaagatgaaagaggcagaagagctctatgccaaaatactaaaatctggtttgttgaatgatcatgttccagttcagattatttttaataagtactgcaaattggaggaaccagatgcagataaagtgcaagaagcagtgcaagtagatactgctttggagaaagttttggacaaagtaggagctgatcctaactccaaatctgggtacactagagcaggccatgttggagaatggaggagggagattcatgaatcctggaatgagagagagaaatggttaaatggaggaggagggggaagtaactga

SEQ ID NO: 67180 - DNA, 132 bp, Glycine max
  Peptide Sequence Number=SeqID_183958
atggccaaaagtccacgtgcaaggcttcatccttttctgaaggacaatctaacgacagtgctgaaggttacgacgctttgcccatggaagagttgggataggctattgaagaataaaggtattgaagaataa

SEQ ID NO: 67181 - DNA, 972 bp, Glycine max
  Peptide Sequence Number=SeqID_183959
atgcttctgttttttgggatcatatttgcttctcaggatagtggtggcatgctctcccttctgggcattattgagcagtgtctgaaagctgggaaaaaacaacattggcacaaagctagtcttaccaatatttgtgtgggcttacttgctgggtttaaggctttgctctcatttcgaccacaaacattaggacaagagattttgggtttggcacaatctatttttctgggtattttggcggagggagacatttgtgcatcgcagcgcagagcatcatctgaaagtcttggatatttagctcgatttggaaatgatatcttcactgctagaatggcatgttccttcaatctgactagatcactacttggtgacctaaatggtgcaactgatcccaactatgctggatcaattgctttggcacttggctgcattcatcgcagtgctggagggattgctttgtcaactttagtgcctgcaacagtgagctctatctcctcactggctaaaagttcggtagctaatctgcagatttggtctatgcatgggcttcttttaactattgaagctgctggcttgtcctttgtctctcatgtccaggcaaccctatctcttgctatggacattcttttatctgatgagaatggtttagtagacattcagcagggagttggccgccttataaatgctatagttactgttcttggtcctgagcttgccccaggaagcatctttttctcacgctccaagtctgccattgcggagattagcagctggcaagaaacttcaactatgctcgagagcgcacgcttcacacaacaacttgttctttttgctccccaagctgtttctgtacactcccatgtgcagactcttctgtctactttgtcatcaagacagccaactttacggcatcttgctgtgtctactctaaggcatctaattgagaaagatccagttggttccccatcttga

SEQ ID NO: 67182 - DNA, 807 bp, Glycine max
  Peptide Sequence Number=SeqID_183960
atgggaagcaatttacagtttgagcttgattctttgcatgggcaagctactgtcttggcagctttagtctctatttccccaaaattacctcttggttatccagcaaggcttcccggattagtgtttggggtttcaaagaaaatgctgacagaacatagtcgcaatccagtggcagccacagttgaaaaagaagctggatggttgcttttatcatcattatttgcttctttaccgaaggaggagcttgaagaggatgtctttgatattcttgccttatgggctagcctatttactgggaatccagaaaatgaaattacgaaaactgatgatctaaagtcaaggatattcgtatggtctgcagctgttcatgcactgacagcatttataaaatgtttcatatctcctaatgttgcaaatgatggagttctacttcaaccagttcttgtataccttagtagtgcattatcgtacatatcagcattaagagccaagggactgccacatgtaaagcctgcagtggatgtattcgttatcaaaactttaatagcttaccaatctcttcctgatcctgtgtcttttaaaaatgaccatcctcagattattcaactatgtacatttccgttcagacatgcttcagaatgcgaagaaagttcatgcttgaggttgctcttagacaagagagatgcatggttgggtccttggattcctggaagggattggtttgaagatgagcttcgagcttttcaaggaggaaaagatggccttatgccctgcgtatgggagaatgaaatttctagctttcctcag

SEQ ID NO: 67183 - DNA, 375 bp, Glycine max
  Peptide Sequence Number=SeqID_183961
atgccttatttcttgctacaggcgtgtgttctgtacgtccttcgtgtcgctgtaacagatcaaatgactgaacctactcaaaggagctttttggtgtttttaggaaatcagctccaatcacctgaagcaggtccctccatgaaagtggtggccttacgtacactgtcttatactctgaagacactgggagaggttccacttgaatttaaggaagtgcttgacaacactgtagttgcatcagtgtcacattcttcaaagctagctgctttggcattacgtgcattggctgaagttgatccaacttgtgttggtggtttaacttcatatggggtgaccaatcttactgctttaagagagagtgtctcttttgaaaag

SEQ ID NO: 67184 - DNA, 870 bp, Glycine max
  Peptide Sequence Number=SeqID_183962
atgtctaatggtgctgcacaatgcttgggagaattgtataaacactttggcagaagaatcacttcaggtttacctgaaacaacaagcatagcaactaaacttatgaaatccaatgaggagtttgtacgacaagaagcattatatatgcttcggaatgccttggaaggctctggtggtagtgctgcttcaacagcatattcagaggcattccgtctcataatgagatctgccacaggggataagtcgtttgctgtgagaatagctgctgcaagatgtttgaaggcatttgctagcattggaggtccaggcttaggtgtggccgaactcgacaattcagcctcttactgtgtcaaggcagatcctgtttcatctgttcgggatgcctttgctgaaactttgggttccttgcttgctcttggaatgaatcctgaagcacaggttcaaccaaggggaaagggtcctttacctcaagcaaaaaaactagaaggtggattgcagaagcacttgattttggctttcacaaaagcaagtggagtgaagtctagggtcattcgggttgggttaacactagcttgggtattcttcttgcaggtcattcgcataaaatatctgtttcctgacagtgagcttcaaaattttgcattgcaaattatggaaatgctccgtgctgaaaattctgttgatgcccatgccttgacaattctggaattttttttccttattttgatgagggttaaccttggtgcaatggtaaggttgccaaggaaacagcccgatgcaaggataaagttgcataaatcggatcctctccaaactccactgtggttggagccttgtgtactgaaccaccattttgatgataagaagtga

SEQ ID NO: 67185 - DNA, 960 bp, Glycine max
  Peptide Sequence Number=SeqID_183963
atggctgccatttcactcaggcataaccctcaagtaaacaacactaaccagcaacgtgaaatcatcgctgaagaaatccaaggactcataagagtccacagagatggacgtgtagaaaggccaccgattgtgcctagtgtctcctgcacagtgccatcagaacgtggtgtcactgccaaagatgttatgatcaacaaagagaccaacttgtgggcacgagtttatatgccaataagttgccaccactcaaagcttcttcttcctttgcttgtttacttccacggtggtggattctgcgttggttctgctgcttggagctgttaccacgagttcttgaccaaccttgcttccaaagcaaactgtgtcattctctctgtggattaccacttagcccctgagaaccgtcttccaatggcatatgatgatggttccaatgctctcatgtgggtgaaaagagaagcactgaatggctttagtgtccaaaagtggtggctgagtcattgcaacatgtcttcccttttcctagctggtgatagtgcaggtgccaacatagcctacaatgtggccacacgcatgggatcaacatcaaacacaccattatctcttaagggtgttatattgatccaacctttctttggaggagaagatataactttctctgagaaacattcccttcagccacccaattcagcactcactttatccgtttctgacacttattggcgcttggcactccctcttggggccacacttgaccacccttattgcaaccctcttgcacatggcacggtcaagttgagagatttgaggcttccatccactatgataggaacttggagttctcaaacgctttggccaaagcagggaaaagggttgaaacagttgtttacaaaggcgttggccatgcattccaagtgctgcataattatcagctttcccattcccgaacccaagaaatga

SEQ ID NO: 67186 - DNA, 474 bp, Glycine max
  Peptide Sequence Number=SeqID_183964
atggcggtacgccacaaaaaggggctctattttgattgtgacgagaagttcaaccatggtcaaaaatgctctgccaagttcttcctcttaatctctaatgagaaagacgatgcacaaggcgaacctaatctcacagatttgcaacccaagtttccaatagcaacagattcgtcgcaaacccaaatcagttttcatgctttttcaggtcacttagctccaaaaatcgtgcgtttattgggccgcatatctaatcaaaaggtggcgatattaattgatgggggtaacacccataattttgtgcaagagcatatgggccaaatcttcaccgtggacctccatgttctgccactatgcggggcggacctggtattgggcatccaatggctaaaatcccttggtctcatcctcatcgaatacaatgatctaacgatgaagttcatgtattctgacaaagtgatcgaggggatcctctag

SEQ ID NO: 67187 - DNA, 1809 bp, Glycine max
  Peptide Sequence Number=SeqID_183965
atgtctctgcgagtgctgaaccctaacgccgaagtgctgaacaaatcggcggcacttcacatgaacatcaatgccgccaagggtctgcaagatgtcctcaaaaccaacctcggtcccaaaggaaccatcaaaatgctcgttggtggtgccggtgatatcaagcttaccaaagatggcaacactctcttgaaagagatgcaaatccaaaacccgacggcgattatgatcgctagaacggctgtggcgcaggatgacgctagtggtgatggcaccacttccactgtcatcttcattggcgagcttatgaaacaatcggaacgttacattgatgaagggagagatttagagaagtggaagaacgcaagtatgcatcctcgtgtgttggttgatggttttgatattgcaaagcgagcaactctgcaattccttgaaaagtttaagactcctgttgtgatgggtggtgagcctgataaagagattctcaagatggtagcaagaactactgtgaggacaaagttgtacgaatcacttgcagatcaattgacagatataattgttgatgcggttttatgcattcggaaacctgaggaagaaattgacctgtttatggtggagatcatgcacatgcggcacaaatttgatattgacacacgcttggttgagggtattgtccttgatcatggttctaggcaccctgacatgaagcgacgtgcagagaattgctatatcttgacatgtaatgtatctttggagtatgagaagagacacaatatgttgatgtcgtatagtaatgagtatgctcacatgacaggaaatgttctcattagtgtaggtttatgtttactctgtctttctaaggaaggcttagttaacctgaaacaaatcaatgaagtaaactcagggtttttctactcaagtgcggaacagagagaagctatggttgcagctgaaagacggcaggttgatgaaaaagtcaaaagaatcattgaactgaagaataaggtttgttctggtaatgatagcaattttgttgtcatcaaccaaaaaggaattgatcccccatctctggacctgcttgcaagggaaggaataattgcccttcggagagcaaagaggagaaacatggaaagattggttttggcctgtggaggggaggcggtaaactctgtagatgatttgactcctgaatgtctgggttgggcaggattggtatatgaacatgtccttggtgaagagaaatatacatttgtggaaaatgttaagaatcctttttcctgcacaatcttgattaaaggtcctaatgatcatacaatagctcaaattaaagatgctgtacgtgatggtttgagggccgttaagaatacccttgaagatgaatctgttgttttacctctttgcatatgcaagggtaaggctgcgtacaacatccctcctccataccttcgcatagcgaagagcctctggacaatgggacttgaagagaattttctttcccatgatcagggtgctggtgcatttgaagttgctgctagacaatatctgatgaacgaagttaagaaaacagttcaagggcgtgcgcaacttggtgttgaggcttttgctgatgcgcttcttgtggtgcctaagacacttgctgaaaactctggacttgacactcaagatgtgattattgcccttacgggagagcatgacaaaggaaatattgtggggttgagcctgaacacaggagaacctatagaccctgcaatggagggtatttttgacaactactctgtgaagcgccaaatcataaactcagggtatggttga

SEQ ID NO: 67188 - DNA, 372 bp, Glycine max
  Peptide Sequence Number=SeqID_183966
atggcccatcttgaatcaagtcctcactctccgacctcttctgctgctaacccgcaatccgtctctcacccttataatccccatcgaatgaagttagaggttccccgttttgatgtttcgaatccctcgggttggatctttaagatcaccaaatttttcgagtatcactttaccccagaccacgaatgccttacaattgcttctttttacatggaaagtcttgctcttgcacggtttcagtggatgacctgtattgcccaaatttcgtcatggtttggccttctctttgggttgactctggagatacaccgtgaggttcaagcgctacaacccttaacgttgattcttgaggcagccttggcccgtctctaa

SEQ ID NO: 67189 - DNA, 468 bp, Glycine max
  Peptide Sequence Number=SeqID_183967
atggcagaagaagcactactgcaaaacaagcaggttctattcaaagggtacatagatggtgttcctaaagaaaccgatatggaactcaaggtcgactcacatattgcgctcaagcctcccccacaaggctcatcagctattctcgttaagaacctttatctctcttgcgatccatacatgcgcggtcgcatgcgtgatttccacggatcttatatccctccttttcttccagcccaggcacttgaaggatttggtgtgtctaaagttatacactctgataatccaaattacaagcctggtgatttcattaccggcttcactggctgggaagaatatagcctcatccaaagaactgaacagctccgaaaaattcaccccgatgatgccattcctctctccttccacgtcggtcttcttggtatggagcatcatatgcatccagcacatatgcctgtttctttattttaa

SEQ ID NO: 67190 - DNA, 1044 bp, Glycine max
  Peptide Sequence Number=SeqID_183968
atgccccagaataagattttccatgaccaacaatcatcgaatccgattcctgatctttcccttcacattagcctcccaaacagtgctccttcttcaatttgcactgaaggggattcaccctttgatgctgaaggcttcaaatcacacagtgatggttcaatcaaaggttgcagtagcccctatcacacagacacacaactttccttagccaaccctacaaatactacttctactccttctgaggctgaaagcacatggaggaagagaaactttgttaggcttgttgctgagggtcaaataagactcattaatggaatccctctctacagtaacctttcttctttggatactattccctcaatagagagaaaccaacctaccaataagttttccttttcttctctatatgcatttccacaccctccttcagctcctaattatggcaataataatggtgttgttgggggtgtagcagtagaaccaatatcaaggtttcgtgagataaggaccatggagagtagtagtctaagacctcaacagtttcagtactttgattaccctcatcagcatcagcatcatcatcaacagcagcagtttgggagtagtaataatattggagcttctgatttttcttcaaatggatttgtgaggtcaagaatgttttcaaggcaacaaagtaataagaggaacatgagggctccaagaatgcgttggactagttctcttcacaatcgctttgttcatgctgttgagctacttggtggccatgaaagggctacccctaagtcagttttggagctcatggatgtcaaagatctaacactagctcatgtcaagagtcatttgcagatgtatcggactgttaagaacactgacaaacctgcagcttcttcagatggggatgaagatttcatgtccttaacagtaccaaatgatcaaaataacagttttttacccaatcagagaggaacttcaaatgcatctatagataatgatatgggctacacttcaagcaatctatgggttaattcttcttcgaggtaa

SEQ ID NO: 67191 - DNA, 1320 bp, Glycine max
  Peptide Sequence Number=SeqID_183969
atgtggtgccccttctacggcaagattgctcccatcccactaccagaagcatctgtttctacggtgaaagggacttcaaagtccagaagagacaacacaggggccgtcaggtgcaacaatggaagcatagccacggaaaaaatgacagcagaaatccgccaagcccaagaagcttcgaatggcccttatggactgaggcataggccaaatgaactggcagtctacaaggacttgaaacacagttgccaagtgggacaaatgcccttcaagaatactgtatatgaggatgtcgtcgaagaagacgataacaaagcagtagaggttcaaaatgaggttgtaagtgaatgtggtggtcatgtggtctggacggcagcaaggcttggggttcatgaaagaggatgtggaattggtctaaaaggatttaaactagtgatggaagttgggggttggcactcactccctgcttccggacaatacggcggagctggggtgagtcatgataggtccaaaggtcttgagccactgcacacccaaaaccacattggcactacacaagggcaagacatgaaggttcaccacaaattgaatgcgcttgatagtaatggtgactgcttcacaaaggttatcacaatgaagctgttgaccattcccgaccatgacgcgaagcggagtagtggtgcgagtagtgaggcccaatttccacaccaatggttcctgaataaagtggtgggtgttgcctccatcaaccaggataaccaattggggcgtgacaatgtgacccaagagacgcagggtctcaggtgccaaatgacccgcgaaatagtggagtgtgatctaggcctgaggcgggttagtggcgtcggaagcaagggggtagcgattgtcgacaagggtcgtggaggtggcgtagcgagagggggtgggcagacggtcaaccccgagataaagaaactcaaaaggaacggtggaggcaagctgacaatctgcttcgtaagatcttcaaactccgaaaggtacttggtgattgtggatcgctgggcgatgctcagcctctcgtgctctagcgtggcatggtatgatgtaagatccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagatcacgaaattttgtgctctaattga

SEQ ID NO: 67192 - DNA, 1383 bp, Glycine max
  Peptide Sequence Number=SeqID_183970
atggagacaatatttattagggcaccgcttcacaattctgacagatcatcacaaattgaaggaattgctcactcagacgcgctttcacgaacaccccaatattctcaggctacattgttagtcttatatgttccctgcttgacatttaacgatgagcttaagaagcatctcctccgcgaaccccaattcgtccaactcctacgagacattcaagctcacccagagaattactcgaactacactattactcaggaattgatcatgaagggggggcgtatatggttgcctcgggggtttcttttcattccctctcggctagcggaatatcattccacaccttcaagcggccacatgggagctgctaaaatagcggtgcggttaatggagaatttcacatggcatggacttcgaaacgatgtggagagctttgtcaaagcttgtgtggactgccaacatgccaaatatgaaacgaaaagggtagttgggttactctgtccattgccagttcctcatcgcccttgggaggatccgtcactggatttcatcaccggcttacctctattccgaggtaacaccacaattctggtggtcgtcgatcgcttctccaaaggcatccatttgggcattttgccaacgtctcactcctccctcactgttgcgacactattcattgagatcgttggaaagatacacgaaatgcctcagagcttggtgtccgacagggatccacttttcctgaggatgagcttcgcttatcaccctcagagtgatggccaaatagaagtattgaaccgcatcattgaacagtgcctccgcgcgttcattcataagaaattgacgacgtggggcaaattccttccttgggtggaatggtcgcataatacatcttggaacacgaaggctggctccactccattcgaaatcacttttgggagaaaaccttttaactttccagagtacctcgtcggaacggatgtggagttcaaggtgggggatttggttatggtcagattgagacctttccgacaatccacggtcacggggaatgagggagcttactccaaactggataagaaattttgtggcctatttgaaattatggaaaggattggcccagtcgcctacaagcttcatctacctgagggagcccgcattcatctcatcttccactgttcattgcttaagccatttcatggtgctccggactcgtctctgccaaaatgggaggtcttagtccaatgggaagggttgtcaccagatgacacctcctgggaggattgggaccaacttcgtgctggctaccaccttgaggacaaggtgtttccgcaagtggcagggaatgttagcaatcagggggtgcaaacaaagggtagcaaaccaggg

SEQ ID NO: 67193 - DNA, 261 bp, Glycine max
  Peptide Sequence Number=SeqID_183971
atggttttcttgacactttcagtgtcggcactcaaacacaaattcctttttttcttggcactttatgtccttgccatcggcgacggaggtcacaagccttgcgtccagaccttcgccgccgatcagttcgacgaggacacgcctgaggagaaggatgccaagagctcattcttcaactggtggtacttggggattgtggctggctcaactgcttctgtttttgttgtcatatatcttcaggctaaagggaatgttatttga

SEQ ID NO: 67194 - DNA, 186 bp, Glycine max
  Peptide Sequence Number=SeqID_183972
atggggcctaacttaagaaaggaatcaatgtccaaagttggagtctacggattagaagaggagataaaagtaaattgggatgcaacgtttttggagtggaagaaaactactgatggagacaccacagctgtcaacctctttcgcccttttacccttccttcccacttggatcatatcattaactaa

SEQ ID NO: 67195 - DNA, 207 bp, Glycine max
  Peptide Sequence Number=SeqID_183973
atggattcgggcaggtctaataggcagatccaagatcctatgtcactggagggagaaaaaagaaaaacatcgcagcagcgaagaaacctcaacaaaaccctgcctccctctctctccttggcggcagctggggcaaccaagctctgtgtgcaacgacgccgtttcgacctcctttcttcactctttggcgagcaagcaagcaagtaa

SEQ ID NO: 67196 - DNA, 711 bp, Glycine max
  Peptide Sequence Number=SeqID_183974
atggctaagttgcttaatgttcactgttgtacaagctcaagaccacatttccaagtcccaccagcatcgctccaaggcctagttggagtcacaatactctttgctgtgccattctatgaccgtgtctttgtgccactagcaaggaaaatcacagggaaacccactgggataacagtgctacaaagaattggggtaggacttttcttgtcaatccttaacatggttgtgtcagcacttgtggaggccaaaagggttggtgttgcaaaagagagtggcctaattgatgacccaaaagcagtgttaccaatcagcatttggtggctgcttcctcagtacatgatcactgggatctctgatgcattcacaattgtggggctacaagagttgttttatgaccaaatgcctgaggcacttaggagtttgggggctgcagcatacattagcattgtgggggttgggagctttgttggcaacattgttatagttgttgtggagggtgtgacatcaagggctggtgagaagtggctaggaaacaacctcaatagggcacaccttgattacttctattgggtcttggcagggttgagtgctgttaatttgtgtgtttatgtgtggcttgccattgtttatgtgtacaaaaaagttgatgagggtcatcaaactagtgaccaacagggttctagccacaagaaatacaaacctggagtgtga

SEQ ID NO: 67197 - DNA, 219 bp, Glycine max
  Peptide Sequence Number=SeqID_183975
atgaccttactgggtgcctccaaattgatgtcatttgttgttcttttagcaatacttttactgctcatgccctccacgctgggaagtgcttcccaacctagtattatactcgggcgaaaacttttccaatatcctggtggtagaggatatggatatgctgatggtgagtcaatatataaaaaatatcctggtggtggaggatatcgaaaaagaccatga

SEQ ID NO: 67198 - DNA, 2796 bp, Glycine max
  Peptide Sequence Number=SeqID_183976
atgctctgtctaggtggtcttcaaattccaatcactgcacctggacttggcctctccggcaaactaccccctctgctttccaacctcacttacctccactcacttgacctttccaacaactattttcatggccaaatacccctagaatttggccatctctcccttctcagtgtgattaaattaccttccaacaatctccgtggtacactttcaccacagctgggtcatctccaccgtctacaaattttagacttttcagtcaataatctcacaggtaaaattcctccatcatttggcaatctctcttctcttaagaatctttccttggcaaggaacggtttgggtggtgagattccaactcaacttggtaagctccaaaatcttttatctcttcaactctctgagaacaatttctttggcgagtttccaacttctatcttcaacatctcttccttagtcttcttatccgtgacaagcaacaatttatcaggcaagttaccactaaattttggccatacccttccaaatttaaaggatctaattctggcaagcaataggtttgaaggggtaattccggattccatatccaatgcctcacatcttcaatgcattgaccttgctcacaataactttcacggccccatacctatattcaacaacttgaaaaaccttacccacctgattcttggtaataattttttctcttccacgacctcgttgaattttcagttcttcgattcccttgcaaactccacccagttgcaaattctcatgatcaatgataaccatttggctggggagcttccaagctcttttgctaatctgtctggcaatcttcaacaattatgcgttgctaataatttgctaactggtacccttcctgaaggaatggagaaatttcaaaatctcatatccttgtcttttgaaaacaatgctttctttggagagctaccatcagaaataggagcactacatattctacagcaaattgcgatatacaacaacagcttgtctggagaaattccagacatttttggcaatttcacaaatctgtatatccttgcaatgggatataaccagttctcgggtagaattcacccaagtattggacaatgcaagagattaattgagcttgacttgggaatgaacaggcttggcgggaccataccaagggagatttttaagctttctggtttaacaaccttgtatttagaagggaactctctgcatggttcgcttcctcatgaggtcaaaatcctgacacaacttgagaccatggttatatctggcaaccaattgtcagggaacattcctaaggaaatagagaattgttctagcttaaagcggcttgtgatggcaagcaacaaattcaatggttcaatcccaactaatcttgggaatttagaatcccttgaaactttggatttatcatcaaacaatctcaccggccctattcctcaaagtttagaaaaacttgactacatacagacattaaatttgtcattcaaccatttggaaggggaggttccaatgaaaggtgtttttatgaaccttacaaagtttgatcttcaaggtaacaaccaactgtgtagccttaacatggaaattgtgcagaatttgggagttctcatgtgtgttgttggcaaaaagaaaagaaagatcttactccctatcatactcgcagttgttggtactactgctttgttcatttcaatgctcttagtgttttggacaatcaacaataaaagaaaggagaggaaaaccactgtgtcgttgacccctctcagagggttgcctcaaaacatatcttatgctgatattctgatggccacaaacaattttgcagctgaaaacttgattggaaaaggaggctttggttctgtgtacaagggagtgttcagcttcagcactggtgaaaccgccacccttgctgtcaaaatcctagacctgcaacaaagcaaagcttctcagagtttcaatgctgaatgtgaagcttggaaaaatgttaggcatcggaacctagtgaaggttattacttcttgctccagccttgattataagggagaggaattcaaggcccttgttatgcagttcatgctcaatggtaacttggacgtgaatctatacccggaagatgttgagtcaggatcctctctaaccttgttgcaaagattgaacattgccattgatgttgcttctgctatggactacttgcaccatgactgtgatccaccagtagtccattgtgatctgaaacctgccaatgtccttctagatgaatatatggttgcacatgttgcagattttggattggcaaggtttctctatcaaaatacatcagaaatgcagagtagcactctaggactgaagggatcaatcggctatattgccccagaatatggtctaggaggcaaggcttcaactcagggagatgtatacagttttgggatcctactgctagagatgttcatagccaaaagaccaactgatgaaatattcaaagaaggattaagcctgagcaaatttgtctcagccatggatgagaatcaagtactgaaggttgctgatcgaaggcttattgatgattatgcatattcaacacaaagctcgagcactggtgatcatagcagtagcttttgcggcaacacaaattggacgcacaaagctgaggagtgcatagctggtgtgataagagttgggttgtgttgcacagttcatcaacccaaagatcgatggagcatgagagaggcctcaacaaaattgcatgcaattaagcactctatgttgtccttgtga

SEQ ID NO: 67199 - DNA, 135 bp, Glycine max
  Peptide Sequence Number=SeqID_183977
atgtctaacataataacaccaagagaaactccttactacggagatacaataaccgcaaaagcattaaacgtgagtaatacaaataggtggattttgttcttgattggacaacgtaagcccaatccacagagctga

SEQ ID NO: 67200 - DNA, 252 bp, Glycine max
  Peptide Sequence Number=SeqID_183978
atggctgttggaagtagtgctggaaaggattttaaggaaatgttgtcttcatcccacaaccatagctttgtgaatatggatgtatatacaactaagacaagccaggtttatttcataaagcgagcaatgttaagagctaacttcccaaaagctgaagctattaggtggaattccatgaatggttttatatctctgacaaggaattctagaatgggcattgtactccataaattcttcagtgacataaaatag

SEQ ID NO: 67201 - DNA, 201 bp, Glycine max
  Peptide Sequence Number=SeqID_183979
atggaaatcgtgtttccattgtggcattcaaaaggaggagcgaatgtgaagaagggcacaaagggtttgggaagggaaggagaagtgaaggtttgggagcaggttgagaagggaatgagttgggaaggagaagggagagtgtttaggacgttggagggagacacaagggaaagggatgctaggaaggtggggtgccggtaa

SEQ ID NO: 67202 - DNA, 534 bp, Glycine max
  Peptide Sequence Number=SeqID_183980
atgtcatttgctgctcttttagcaatacttttactactcatgtcctttgagctaggaagtgctgcccagcctagtattaaactcgctagaagacacttgagattcaatggctcaatcccaactaaacttgagactttggatttatcatcaaacaatctaaccggccctattcctcaaagtttagaaaagctcgagtttatccagacgttaagtttgtctttcaaccatttggaaggggaggttcctatgaaaggtttttttatgaacctcatcaagtatgaagagttaagatcctgtctgaccccgttgcaaagattgaacgttgtcattgatgttgcttctgctctcgactacttgcaccatgactgtgatccaccagtagtgcattgtgatctgaaaccttccaatgtccttctagatgaaaatatggttgcacatgttgcagattttggattggcaaggttactctctcaaactacatcagagatgcagagtagcacgctaggactcaagggatctatcgggctatattga

SEQ ID NO: 67203 - DNA, 909 bp, Glycine max
  Peptide Sequence Number=SeqID_183981
atgcaccaccctaaacataaaaaacaaaagggtaacaagattgaatggataacaagaaatggaaatgagatgaatattatgtttggagttggagtagacagtcaatgtattttctctttttctgcgtggtccaaacgccccatatggcatctacacattattccacgcggtcgatctaacggcatcaataaggtgtcacatccaaggcaacaaaacaagatgatgagtccaaaccttgcaaaacaagttggggacacaacctataccaagatctttgttggaggattagcttgggagactaagagagatactttaaaacgctatttcgatcagtttggggagatcttagaggccgtcgtcatcactgacagaatcacaggaagatcaaaaggatatggctttgtgatcttcagggacccaaattctgcaataagagcttgtcataatccctatcctgtgattgatggaaggagagctaactgtaatcttgcagctcttggtgcacagaaatttgatccatctataacaacaggaaggcaaaaattcagtagcccttcatggaatatggcaccaattccattgcaaggaacttccactcattacaatcagcacataccacactacccatttccgcatccagtctacaggtatcctggttatcctcacccacaagacttgtatgaaatgaactacaataatgcttatggtggacagcagcttccactctgttggtttccagcatattgccaacccttttatggccttagtagacagtttattccaacagcatatgtgaaaaaggcacaaacccctgacgtgtcacctcaggagttcacggttgttggcttctcagaacctatttcagcttctccctcaatttgcagcactggttcagcatctaaactctaa

SEQ ID NO: 67204 - DNA, 425 bp, Glycine max
  Peptide Sequence Number=SeqID_183982
gcatagtagtcgtgatgtggacggtggcattgtttgccagaaggaaaaactctagcattgatcggtctgtggtggaatccttatcgatctttaacttcagagcgctacgggggcaaaaggaaagactcgattgcgtggtgtgcctaaacaagtttgaggtcgtggaggttctccgactattgccaaaaatcaagcacgtgttccacgtggagtgcgtggacacgtggctggacacgcattctatgtctcctctttgtcactgccgcatggatccggaggacattctcctggtggaggacgcaaagcctttccgccaagaagtaggagatagtggagtcacgacgaaggcattcgtctgttacggtgggggaaggagaaaaaatggaggagcagcaacagaatcggaggtggatgacgttgtttag

SEQ ID NO: 67205 - DNA, 1160 bp, Glycine max
  Peptide Sequence Number=SeqID_183983
atggcggttgctgagaatgttggggccaaaatcggttcttccagtcaaaatttagaaaacagtgtagtatcatcggactcgggcgaggttgagaaatcaaaacccagaagtgggtccatcaacgacgatcagaagctgaacaacggtgtcttcaaccaccaagatagagttcctggcactatgccagtgcccaatagcaattataactacaatgcccaaatgggtcagatgcacgcaaatggggtgaacaatgatgggtatgggatgaatggggtcatgagtggggagaatgagggtgagagtttcaagcgtgatatgagggatttggaagagcttttgtcaaagttgaatcccatggctgaggaatttgtgcccccatcactaagcaatactcatggctacctagctggacccggtgccggcgccgggtttggttaccctaataattttatactgctcaataactttggtaacgctaacggccaaactaacagaaggaggaagaatggctataatcaagggaagcgaagagtgaatcataaaatggatatggagaaaagagaagaaatgactaggaggactgtttatgtgtctgacattgatcaactggttactgaagagcagttggcggcactctttcttaactgtggccaggttgttgattgccgtgtttgtggggatcctaattctattctccggtttgccttcattgagtttacagacgaagaaggtgcaagggctgctttgaacctgtctggaaccatgcttggatattacccgttgagagtgctaccttcaaaaactgctattgcccctgttaatccaacatttttgcccaggtctgaagatgaaagggagatgtgttcaagaacaatttattgcacaaatattgacaagaagcttactcaagccgatgtcaaacacttctttgaatctatttgtggagaggttcaacggttgaggcttcttggagattaccatcattcaactcgaattgcttttgttgagttcacagtgcattatctatccgtttgtgaagttataacccttgctcctgaaaacttcttcaatctgtttgtgattcttgtgggtgcacttgtgtcaataaatgcgtttgtagtaataactccgcattacttgctaaaactgtccttctccat

SEQ ID NO: 67206 - DNA, 672 bp, Glycine max
  Peptide Sequence Number=SeqID_183984
atggcagaacaagctgagcaagtgtttcatgttcaagattcttgtgatgaaaggcggttagtggttctacacggaaaaatagttggtgttaatgttgaagatgatgattcaatcgttgatacttatctcagtcctttctccacacaaatgtcgcgtaacgtcaatagagaagaagaagttgaagatgtccatgcaaattgtaatgatcatgatgaaggagaattaattaacattaaaataaaagcaacacggctcaaatcattggctactagaccagttggggaggagagacccgtggctgaatttgatattcctgaagcatctaatttgaggacgaagaaaaaaatacttcagactgtaggagagcgatggaggcagtttaagtcagatttgatctccaaatgggctctggtagatggcaaggagggtgaggatgatagagtatgtgaaaagatgttcgaaagaaggcgtgggccattcagaaataaaacactacccaatcatgggggttatgattatctaaaagaaaagtttatggaggacaagaaaaagaaacgattggaggaagcatcccaatccgagagcactgacataattattgatccttcatctcccattagacgacacatgaagtggaagatgacccacacgaaaaaatttagtcaatggtaa

SEQ ID NO: 67207 - DNA, 897 bp, Glycine max
  Peptide Sequence Number=SeqID_183985
atgatgagaagagatcaaatacgtgcacacaagaggccaaccccaaccctggttgacctttgtgttcagaaagtaatacataatgtaaggtatcttggaaatgttggttcttttgaccaacatctgctcgagcaaattttgccgcattgcacagctgaccagttgatgcatgtggagaagtccaccaagggaagagatctcagccctgtaactgataagttgtggaaaaagttctttgagaaacagtttggcacaaatagcactgatgaagtgattaagaggatgaaagaaaaaagagtgtcttttagatggatgcagttgtttgaggctggtatgctagaagtagtgtctaatccttggaggtttacagcagggaactggttatgtgactcagatctggttagtcctactggaattgaacgggttctaaccgaaaaagaccttctggctgactcatattcagacctagaggcttctatccttgatgaaaaagaatttctcctattgaaggttatctctacctttccgaagactctagatgcacaagtattcatgaccttgtactggatcctatatattaaggctgctgggattgatccttctttcatgtctgtttcagaatcatcgtctgattctgaggccatttctgcccaggtctttttggctaattttgttgatgactcagatttgacagtagttgtctgggtcaaagacccttcatgttttcctttctgggttgatgacccagtctgggtaggtgacccagaagatgttgtagttgcctttttggttattggctctggtagagccagtagaacctctttaccttttgtattggatcttcctcctctgccggaggaactagacaccttaggaggcatcgggaattttctgtaa

SEQ ID NO: 67208 - DNA, 633 bp, Glycine max
  Peptide Sequence Number=SeqID_183986
atgtttgctccacaacaagaggaaagagttgtggttcttggacaatggatgctccagacatatgactggagacaaaaacaaattcctcgacctttagaagagaaggatggagggtctgttgcttttggagataatagaaaatccctcatcaaaagagcaacctttgaaactgataagtggctatggcataaaagggtaggttgtaacaccctaacgaatcacaccggaatgagagggatccaaaggttgtgcagtagaactaatgcttggttggccaataatggtcaaccgttggacatgttgacattttctggttgtacccaggttgtaacagtgatgagttattatgtgatattggtagaacaggctgaaagagaagtggaattggagcacaaagcagttgagtcatccactgcacttgcaaggatacaagtaatagatcaggttggctggagcatttttgggctactatgggtaggtcatattgcatttggcatccttgtagggacaatgacaaagattactttgattgatcaggctttgggcatgaacgtggtgaggatggctgataagcctgagtacaatgtgaaatttcttcttgcctatatctttgcactagctggaaccttctag

SEQ ID NO: 67209 - DNA, 171 bp, Glycine max
  Peptide Sequence Number=SeqID_183987
atgtctattggtttggtatatctcctaaaaaaatgttttaagaccaagttcagactgctcaagaatgccaataaagccaagcttaaagttgtgaccacattaaccagatttatctgcaatttcccacaaatcaaggatcacaatgaaacagcaattgtgaccgcaatataa

SEQ ID NO: 67210 - DNA, 798 bp, Glycine max
  Peptide Sequence Number=SeqID_183988
atggagcttgtggagcacggctcacctcaaggattgctctcttgttgtgttgcaatgatatcctcactacagtatggccgtataatggatattgaattgaaggttcctccccgccctccatgttattgctttgttgagtttgataatgctcgagatgccgaagatgcaattcggggtcgagatggatacaactttgatggttgtcggttaagagtggagcttgctcatggtggtagagggccatcatcaagtgatcgacgtggatatggaggaggaggaggaggaggaggaggaggtggtggcagcggcgcaggcgggggtcgttttggcatctcacgccattctgaatttcgagttattgttcgcggactcccatcttctgcatcttggcaagatttgaaggatcatatgcgaaaagctggtgatgtgtgttttgctgaggtttcccgtgatagtgaagggacttttggcattgttgattacactaattatgacgacatgaagtatgctattcggaaactagatgacactgagtttagaaatccttgggcgagagcttatattcgggtgaggaagtatgagagtagtcgttctaggagccacagcagaagtcccagcaggagcagaagtccaaaaagagttagaagtagatctttggagcgttctgtgtctaggtctcgatctagatcgcgatcagtatcaccaatcaaatcttctaggccaagatcacgttcacgatctggatctcctcgtcaggtagtggttgagtttctgaaaaagcctgtggttctctggtga

SEQ ID NO: 67211 - DNA, 180 bp, Glycine max
  Peptide Sequence Number=SeqID_183989
atggtgtggcattgctgtcattccagtcggagaaagcggcggtgccgaagacatccacggcagactttaaaagataaggtcgaacgtgggaggaaaatggaccagatacagaaaacatattcccaaaaaatattgctaccgaaatatacagttgacacagaacgtgggtcatccgaataa

SEQ ID NO: 67212 - DNA, 225 bp, Glycine max
  Peptide Sequence Number=SeqID_183990
atggtagcctggcccgggacccaaccttcacttcacagggaagatgaaggtcccacagcccagcatgcagcagacccctccactcctcttctagagatgccagaggacccgactacagcagttctggctatggacatttctcctccagctactccagtattgcatctgatagatgaggaggatgttcagacacaggacacccaggaccagtcacaggaattttga

SEQ ID NO: 67213 - DNA, 611 bp, Glycine max
  Peptide Sequence Number=SeqID_183991
atggagttacttaacatcggttttagcaaaaccgatgttaactacttcatatttcacaagtcgcacgcgctcgaaaaccttgccctccctcttctctttgtcatcctcctacctgaaatcgctcttctctttctcctcccgcctgaaatctcccagaaaccgctccctcgacacccacattgtcctcactcgaacccacagaaccccctacattgccggaaaaactacattgtcctcgctcgaacccacagaaccccctacactgtcggaaaacccacattgtcctcgctcgaacccacagaaccccctacactgttcttggaagtgtggctcgaagaaaatcctacatacactgttgctactagggtgctgaaacactcgtgggtgctcaaagctcaaagctttctccgcgaggtactattgttgattgaggtacgaggaaagcttaaagtttcgtgccattttgttagatctcactgccattgtcactgtttgggttcgagactgcttggagcaccagtagagataactagtgataaggatcctgttattgttcataacaagttactgacacttcttgaaattattttggagtttggggcacttgtttg

SEQ ID NO: 67214 - DNA, 1143 bp, Glycine max
  Peptide Sequence Number=SeqID_183992
gcccagccatgggctgtgcgaatcgggccacgccctggttgttggcggcggcaaagccgggattgtccggattgccgacgaaacgcacgcgcgggtcgtggctggcatggcgctgcacgatatccagcgtgccatccatcgagccattgtcgatcacccggatctcggccacgtcctgcgcctggcgcaggcgcgagaggcaggcatcgatggtgctgccgctctggtaggtgacgacgatggcggcaatggcaacattcaagcaggaggctccggcgcggaagacgggacgaacagccagccgaggcacccagcccggccagcgcgcggccagggcctcgagatcgccatcgcggctgaccgcctcccctgcccggctgatgaaggcggtctcgcacaacacgttgcgccatcccaggccggccatgcgcaggctcaggtccaccagcgccgcgttccagccggcatagctgtccacgtccaggcccccggcacgccgacgcgcgttgccccgcaccagcaccgcgtgggtgaccgccgacggcagctccgggtgcagcgctggcaggccggcacaggtctgcgccagcagcgcggcatcgtcgggttccggattgatctcgcccagccggggccacgcagcggtttcgccggcattgcaccatggggttgcggtcgcgatggcggcatcgcgggcgaaggcgtcctgcagctgctgcagccagcccggtgcgggcacgctgtccggtgccagcaccgccacgtccatgccatcgcaggcgcgcagcatctcgtccaggtgggcgacttcacccagtggccgtgcacgccgggtgtactcggcctgcagtggcgtgtgcgccaaccagtgttccaccaccgcctgcgcacgcggcccggtctgcgcgtcgtcggccagccagaccgcggtccccggcgcggtgcccgcatccagtgcggccaggcagcggtcgagcgcggcatcgtccacgcacagcggcaacaacacgatcgcccccatcccgcctccgtggttgtcggtagccacagactagcactgggagggtatcggccgggttgcacccggcacccgcctcaggccagggcaacagcaacagccgaagcaaagctgggttcctgggg

SEQ ID NO: 67215 - DNA, 225 bp, Glycine max
  Peptide Sequence Number=SeqID_183993
atgaactgtcgcaacgccgcgtgtctggccatatacactcccctcgctgctgctccgtttccgctcgaacgccaaggcgaggcgtttgagagcggaggaagccatcgccaaattgcaaacgtcgccgagactcaggtggccggcgcagtgagctatgcagtcttcgttcaggtcggttatcgtcgttgccggcggcaccggagaccgggattgctcggccattaa

SEQ ID NO: 67216 - DNA, 192 bp, Glycine max
  Peptide Sequence Number=SeqID_183994
atggatttggtgcaaactatggcagacgatgccaacgttgaacgggagggggccggtgggggtgaggggagcttggaaaaacaatttaaagtgtgtgggggtgagaataacaatttcctaactctatcaccaccttatacgaaggttacttggattattctttcacatcatatcccgaaatgcctaatctaa

SEQ ID NO: 67217 - DNA, 295 bp, Glycine max
  Peptide Sequence Number=SeqID_183995
cggcggagaggaaggcggagaggagggagggggtgtcggaggggaagtcgccgaggaggtggagggagagggagattgggagagagagggagaggagggaattggaggagaagtcgagagagtgggagaggggggttttgatggaggaagggagggagaggaaggagtcgttcgaggcctgaggatcgattcgggattggaggaacgccaacaccgggagggtggtggtggcggaggaggaggaggaggacatggtagggttcaattgagagttgagtgtcacggctccatttag

SEQ ID NO: 67218 - DNA, 270 bp, Glycine max
  Peptide Sequence Number=SeqID_183996
atggaagattacccactaacgtttatagggtttctcggcaccttgctattgatgttcgttgtaacagggactgctcaaaggccaggaggatttggacgatgctggccatctacggtgtctttcaacagaatgatgataacattcaccaatggttgcaacgacactgcacaggctcggcaagcactatgtgcggagcagcttgctgaacgatttggagatccaagaacatggaggtttttgaagataaggagtgaacaccttggtacctga

SEQ ID NO: 67219 - DNA, 599 bp, Glycine max
  Peptide Sequence Number=SeqID_183997
atgtccattgtaagtcatccattggaaccaggccaaagctctgtcgtccatatagaaagaagcaacgataagtcgttcttgctttggagtaccgtggtactaaaaaaaattggtgatcttaaagatccaacccaagggggacttagactagtggtgagaggcgatgaagaagctcatcgattttggggtcatggtttgcaaggattctccaagggaaagctgatgggtagtgagtttgaggataacatcctcgagggctggtttcgaaaaccagcccctccagaagagatgaagaaggaaaaatatcagaattggttatgcttgtcccccctatacgatcagcatcattcaagcaagatcttctgcaccagctcatacgtaatccttaagcttgatcccgaacctgaacagcgagatctagttcatttagcggtgattaactcgatctcgaacctgaacaatactcttaggtctgtttggtttgtggctactgttcacggaggtggtaattgcattattgtttgtggtggaggggtttttggggtgattgttttggaggttgatgagtctgtgctggttttcggttttcggcgagagag

SEQ ID NO: 67220 - DNA, 153 bp, Glycine max
  Peptide Sequence Number=SeqID_183998
atgccagatgttgttaaccagtcgatagaaatattggcaagtggaggtccaggcatggcaacttctagcttaggcatatgcaagatcgatcacaggacctcacgcataatagtgatcttgctaggaatgctcatggccttgtcctatggctag

SEQ ID NO: 67221 - DNA, 162 bp, Glycine max
  Peptide Sequence Number=SeqID_183999
aaggatgctgccaggaggaatgtactgttgacatcgctgaattacagcataacgagtgctatagatagatggaacctttttaagtacaagctgaacaaagccatgtctgcgttgtctcacttggattttgagataggctctgttttacttgcggtcttctga

SEQ ID NO: 67222 - DNA, 921 bp, Glycine max
  Peptide Sequence Number=SeqID_184000
atggcggggttgttgtgcccactcccagtgcctcatcgtccatgggaggacctctccctcgacttcatcatgggacttcccttatatcacggcaactcagtcatccttgttgtagttgatcgcttttctaagggaatccatctgggcatgttaccttcctcacatacagctcacacagtagcttctttgttcatggataatgtgggaaagattcacgggttacctcgaagcctggtctccgacagggaccctctgctcagtgatggtcaaacggaagtgatgaataggattatcgagcaataccttcgtgcattgcaagccgcgaacgtggggcaagctactcctctgggacatgttgaaagacagagaggaaaccttccaagacatttgaaaaagctcctgaaggcacaaaccgctataaagcattttgcggatacgagacgacacgaggtgtcatatcaaacaggagattgggtattgctcaaacttagacctcatcgccagctttcggccaagggtcctcaggagatgcagggcaaattggccaaaagattttatgggccctttagagttgtcaaacgcattggaccagtagcgtatcgcttgcaacttctagacaacgcccgcatacaccctgtcgtccattgctcggtattgaaaccatttcgaggatcactggagctcgatgaagcaattcaattatccagtaatttctttcaggaccagcctggactatcaccggatgatacatcatgggaagactgggacaaactacaaaaagactatcaccttgaagacaaggtgattctacaagggctaaagggtgatagtgcagtcaaagaacaagttacagaaataggggcattggtggatatcagtaaggctaagagggtgagtaagaacacctgctacaggggatag

SEQ ID NO: 67223 - DNA, 1311 bp, Glycine max
  Peptide Sequence Number=SeqID_184001
atggctcaatacctgtcagactttgaagacctcgccaatcgaatcatcggccttcttccaccttttttactgagctacttcgtttccggcttgacgccaaaaatccgctgcgaggagaagaagctcctcgatggctgccaggtgccccgtggccgaacgtcacaacccataccacccccacctctactccccttacccagccgcccttccccaccatctttgaagcgattatccttagaggaaatagcatcgcagcgagagcgcgagctctgtttcaattatgacgagaaataccatagaggtcatcgttgcgcctctagggtttttctcctcataacagaggatgaggacccctctctgtctaatatagaagcaagtgacccgccccttgacccgcccgatactgttgacccgtacccgacccaaataagctttaattctctagcgggtaatgtggccccggagacactccattttctgggtctcattagtgatcatcaggttgtgttgctggtggacggaggaagtacgcacaacttcattcaacaccaattggtgacccaattgggtctgtcgccccgagccacaactcctttgcgggtaatggtgggaaatggccaacaattggagtgtaattgcctatgtgaagccattacagtggacattcaggatacgaagttcaccgttgaccttcatgtgttgccgatatcgggagccaatgttgtcctcagtgtccaatggctaaaatctctggggccaatcctcaccgattacaactccttatgcatgaagttcttccacgagggtcatctcattgagctcaaaggggataatgagtccactctgaactcgctctttttgccacagtttcgccgatttttccgtaaacaacaggacaacatgtatttccatatcgcggtgctttctgacgaccactctgatggcactagcaaggacattcctcccaccgttcaagctttcctcaacaagttcaattccttgttccaggctccccacaaactgccgtcggaaagggacaccaaccaccatattcacctgctacctaacactaccccagttaatgtgcggccataccgctatccccattaccaaaagcaggagattgagagccaagtggaatccatgcttcaaaagggactcatacagcccatcaccagccccttctcttctccggtactcttggttaagaagcaggatggattgtggaggttgtgtggactatcgtgccttgaatgcactcacgatcagggacagattccccattcccaccatagacgaactcttggatga

SEQ ID NO: 67224 - DNA, 1056 bp, Glycine max
  Peptide Sequence Number=SeqID_184002
gtgactgccaacccatgggatgagtctagggtgccaggaggatcatcaggtggatcagcagctgcagtttctgccagacagtttgttgtatcattgggaagtgacactggtggaagtgtgaggcagccagcatctttttgtggtgttgtaggtttgaagccaacatatgggcgtgtctcaagatttggacttatggcgtatgcatcatcacttgatgccattggctgctttggttcatcggttgctgatactgggattctccttcatgcaattgctggccatgatagatttgatgccacctcaagtaagcaggatgtacccgactttcaatctcattttcactctgtgagctccttggaaagtaagcccttgaagggactgagagttggtctgatctgtgaaactattgatgatggcattgatgctggagtaatttctgcaattcgtgctgctgctttgcattttgaggaattaggatgctctgtgaatgaggtatcactgccatcgttttcccttgggttgccagcctattatattcttgctgtgtctgaatcatcttccaacttgtcacgctatgatggtatcagatatggaaaccaagtttatgctgatgagctagattctctttatggaggttcccgagctaaagggtttggttctgaggtcataagggtaaataggtggcaatgttggtggctggccctgacatggtctatttggcagcataggaacagcatactgttttccaatgcagtgttcaatggcaacaaagtcaaaatgagaattttgatgggaacatattctctttcagctggttactatgatgcgtattacaaacgtgcacagcaggtaaggaccataattaggaatagctttaaggaggcactcaatcaaaatgacatcttgatttcccctgcagctccttcagctgcttataaaattgtgcctgcagtgctaattgtttcgttgcctttggcatttgccggtgaaaagaaaaatagtcctttggctatgtatgccggcgacatcatgactgtgagcatttcattcttctag

SEQ ID NO: 67225 - DNA, 204 bp, Glycine max
  Peptide Sequence Number=SeqID_184003
atgcatttttctaatggtggagcttgcttgataaaatttgacttgactgcttctaaagttattgttacgggagaagtaaaggaaggggtgtcactagcaagggaggtgcaggaagcaaggaatgagaggccacgaagggaacaactcaccccagcatatctagaagggtacgatagaagccatgcagaatggaggaacgcgtga

SEQ ID NO: 67226 - DNA, 4200 bp, Glycine max
  Peptide Sequence Number=SeqID_184004
atggcagatggcacacgttcgaaggcatcatcagagcgtttggaagatgcaattgccaagctcattgcttcgcaacttgctatgaattcaaagattgatgatcttctccagcgaatgtctcagcttgaggcgaatcaaccgcaaccgcagtctccgtcgtcgtcgtctgccggacacacgccgcagactcaaacctcttttcaccgtatgaagcttgatgtcccgaggtttgatggatctgatccaaccggctggaccttcaagattacgcaattctttgagtttcactctacgccggatcacgagaggttaaccattgcctccttctacatggagggaccagcactcgcgtggtttcaatggatgcatcgaaacgcgcagttatcctcatggtcagcttttctacatgcttttcattcacgatttgcaacatccacgtatgaagatcctacgggattactctgcaaattacaacagcgttcgtcggtatcggcgtacctttcagaattcaaattcttggctaacaggatagtaggattaccggctccattcgtcttgagttgcttcatcttaggattgaatccaacgattcacagagaagtacaagtcttacaatcgatatccttagctcaggcagtatcctatgcacgattacaggaagaaaaacttctcgatgctcaccggccaccgccatatcggccattagtctccacaggaccttctagcacacgctcatcatcaaacaactctacacaacctttactaccaacaccggtacgaacttcctcctcaattccttttaaacgtttaacaccagaagaattggcctcgcgcagggaaaagggactatgctttcactgcgatgagaaattctctcgtggccacaaatgtgcatcttcattgtttcttttagttatggatgatgaggatatcacgatcgaagcactcataatttcctccataatcggggtggtactgagcttaggattaaaaaccactgaaacaacaccgcttagggtcacggtggggaatggcgaggagattcactgtaatcagctgtgtacggcgattcaggttaacatacaacaacactccttcaccattgacttccatgcattgccattatgtggagtggatgtggttctgggggtgcaatggttgaagactctcggaccagtcttaacagactacggtgctctaacaatgaagttcatcactgggggtaaactcatagaactccatggagatcgcgagaagggaatcgaaccagtgtcaccatctcaactacgcaggttcgtacacacaaaccctactacaaccttcttccacattcgtgtcgaaatagcaaccacacacaactcttctccaaaccatcccttgtcggcaatcaacacattaatctccaaatacgcgtccctctttcaacctcccacgaccctgtcgccatcgcaatccacaaatcataccatcaatctattgcctaactcaactctagtaaacgttagaccatatagatatccttactttcagaaaaaggagatcgaagaacatgtagctattatgctagagaaagggttcatacaacctagctcgagtccattttcatccccagttttgttggtaagaaagaaagatggatcatggaggttttgtatcgattatagggcccttaatgccataacggtccgcgatcgttttcccataccgacagtggatgagttacttgatgagctgggcggagcaaagtggttctctaagcttgatctcatgcaaggatatcatcaaatattgatgaacacggcggacatctgcaaaactgcatttcgaacacatcaagggcattacgagtttcgtgtaatgccctttggattgtgcaatgcaccttctagttttcaggccacaatgaatcaactatttcaaccatacctcaggaagtatatcattgtcttctttgacgatatcttgatatacagcaggaccatgcatgaccatcttcttcacttggagaaagcttttcaggttcttgtagaagggaagttttctctcaagctttccaagtgcacatttgcacaggagcagttggagtatttgggacacatagtgtcctcgagcggggtcactccggtgccggagaaggtacaagctgtctcacggtggccaacacctcgcacaccgcgggcattgggaggctttctaggcctcgccggattttacagacgatttataaaaggctacgcagctttagcttcttccctcaccaaacttctgtgccacggtcaatttgaatggagtcacgaggccgagatagcatttcaaaacctcaagaaggctctcacagaggcacccgttctcgcgttgcctaacttcactacgtcgtttgtggtggaaacggacgcttcagggtctggtatgggggcggtgttaacccagaagggccaccctctagcttattatagcaaacaattatgccctaagctgattaatgcttctacttacgttcgggaattgacagcaatcacgacggccgttaaaaagtggcgccagtatttacttggccaccacttcgtcatcttaacggaccatcagagtttacgtgaacttatgaaccagacgatccaaacgccggagcagcatcgttacttagccagactattggggtttgattactccattcagtatcgcgctgggaaaactaatgtggtcgcggatgcattatccaaatcacaggaagactacactgcttcactcttcttcctttcgatgccacgcttcgtcttcctcgatgatctccacaaggagctagcctctcttgatacatttcaagacttgcgcagacgaattcaggaaaacccaacttcgtatccagattatgcattaactgagggactcatcatgtacaagaagcgaatatggcttccctctaactcctctttcatcaaacaattgcttgaggagtttcatcaatctcctataggtggccacatggggatccaaaagactctccaaagacttcatgataattttacttgggcctcgatcaaggaagacactcgcaagttcgtcacagcctgtgcaacgtgccaacacactaagtatgataattgtaaaccagtcgggctcctttgccctcttccgatgccgacactaccatgggaagatctatccatggattttattacgggactaccctcgtatcacggcaacacatgcatcttcgtcatggtggatcgcttctcgaaaggtttgcacttagctcttcacactgagtggtacgaagttgcgcttaagctcatcatatcatccgcagtccgaaggacaaacggaggtcgcaaaccgcattatcgagcaatatttgagagctttcgtgcattaaaaaccagcaacagggaagaagtttttgcaatgttgcaccgcaaactactcaaagatcagtcacaaatgaaaacaaatgcagatcgccaccgccgtgatcaagaattccaagtgggtgattgggtcctcgtcaagctcaggccacaacgacaagtttcggtcacaggcaccacctgttcaaaactgagtaagcgctattatgggctctttcaaatagttgaacgtatgggtacggtagcctatcggttacaacttccagaacactcacgcattcatccggttttccatgtctcactcctcaagtcttacaccgcgaaccccaccacggcgacaacagtcatggaccttccccctttagcatctgataatcacccaattatcacacccttagccattgtagcttctaaagtcattccgtcggagacaggacccatgcatatggtcctcgttcagtggcaagggttaccacccgaagagacttcatgggaagactgggcgagcttgaagcgcactcaccaccttgaggacaaggtgctgctagatgggcaggggagtgttatgggagaagtaagggaaggggtgtcactagcaagggagccatgcagaatggaggaacgtgtgaagcttctcgaaggaatcgcgagcacgatcaaggcgttagaaggcatagataccttctggaagaatgatgtaatcttggagtttcatgtggatgacacaactggagctaatgagatgacggagaacaaaaatgtagggtgcttagcagtggaggtgttgtcaaaagttgcaggcattgaactcatcaattccacttcaaccatatga

SEQ ID NO: 67227 - DNA, 237 bp, Glycine max
  Peptide Sequence Number=SeqID_184005
atgagtgtggatgatagattgtatgaagagaaaatgaggcaaagaaagtgtataatagagcacgatttcagtgtcgtggggcacgacacaactttcattcaagacaagttgtgtggcagggcacaacttccattcgcagactgtggtgttgtatgcggtttacagcagctcatgaagaatcttaaacttgaagaatctttgcaggttgctaacactcctactcgtgaagcaccttga

SEQ ID NO: 67228 - DNA, 3429 bp, Glycine max
  Peptide Sequence Number=SeqID_184006
atggtgaaccaacctctcacggtggctcaagcagcagggttagctcgtctccatgaagagaagctgcgcaacttccattttgacttccggcaaaacccacggcctcgcacaccacagttactgccgttggcaccaccccagcctccactagtcacgccctttgcttctccacgcgtctcgtcccttccccctctcctgcccctgccttcgtgcccgactccgccaccaccacccacggtccgccgtctgactccagaggagctagcttctcgccgtgagcgcggcctttgcttctcatgttacgagaagttccacaagggccataggtgcgcccctagggttcaccttctgatagcagacgaagatgaccctctcgagcacgtgggttctaatatagacccaccagaccccaacaacccgattccagacctaagtgagttacccgataccccagcccacattagtctcaattcccttgcgggtcacctcgcacccgagactctgaggctcgtcggccacatctctggcaaccctgtcctggtcctgattgatggtgggagtacccacaatttcatccaggaacagctcgtagcccaattggggctaccctgtcgtccaacaactccgttgaaggtcatggtagggaatggccagatggtcgagctccaaggtgaccctgaagctcaacgaggattgctctcatctcctcaattccgacgtgtctgccgcaatcaacccaatagcatttgcttccacatcatggtgcttcctgaggaacctgagcccgtgttgaccacaatcgttgaccctcaagatcctacgactctactgccggcaagggacactgatcatcaaatccatttgcgcccagacgctaccctcgtcaatgttcgaccatacaagtatccctattatcaaaagcgcgagatcgagacacaggttgagacaatgctccaacgcggcatcattcagcctagcaagagccctttctcttcgccggtgctgctggtcaagaaatccgataatacctggaggttctgtgtggattaccgtgcgttaaatgcattaacgatcaaggatcgttttccaattctgaccattgatgagctcttggatgagcttggaggcgcgagttgtttctccaaattggatttgctgcaagggtatcatcagatacgcatgcaaccggatggcattcccaaaacagccttcaggactcaccacgggcactttgaatttaaagtcatgcctttcggcctgtgtaacgcgccgtcctcgttccaggcaacaatgaacaatctcctccggccataccttcgacgctttatcatcgtcttcttcgatgatattctcatctacatcgtctccatcagcgaccacttgcgtcatctccaaactacctttcaggtgttatatgagaatcatttcattctgaagctctccatgtgcctctttgcccaaccccaagtggagtatttgggccatctcatctctcacagaggcgttaaaccagttgcctcgaagattgccgctattgctcagtggcctacacctcgttccgttcgggctttgcgtagctttttagggctcaccggattttatcgtaggttcattcgcgggtacgccaccattgctgcccctctagtaaaggaaaccaccatggagcctcttcaatggactccatccacgcagacagcttttgaggccttgaaacaagctttgacttctgctccggtcctcgccctccctgattttcggctacccttcacagttgagactgatgcttctgcaattggaatgggggcagttctgtcacaacagggccacccaattgcatttttcagtaaaccctttagtcagaagatgcttcgggcttctacttatgtaagagagctgttcgccatcaccaccgccgtgaagaagtggcgacaatatcttctcggtcacagcttcaccatcttaactgatcatcagagcttgaaagaactcatgacccaggtcgtccaaactctagagcagcatacctacttagtgcgattaatgggatatgattatcatatccagtatcgcttagggagccataatcaagccgcaaatgcgttgtcccggctactggaaggtgcacctcaggccttcctcatcctttcggttccatgcctcaccttcttggatgagctccatgatcagcttcgcacgaattcaacctttcagcaattgatgcttgatgttcaaaatcacccagatcgtcatcctgagttctccatcgctaacaagttactgttgtataagggatgcatttggttgcctcaaggtctacccatcttcaccaccttgctgacagaataccatgccacccctaccggtggccacgccggcgtggcaaagaccgtggctcgactcatgaccaatttctattggcctggtctccgagatgacctttcatgctttgtagctcactgcgttgactgccaagtcaccaaatacgagactaagaagatagctggacttctctgccctcttccggtgccaagtcaaccttggtatgacttatccttagacttcattacgggcttaccatcatgtcgtggcaacaccatgatccttgtcgtcgtcgaccgcttttccaagggcattcatttagggatgctgcctcagagccactcagccctcacggtggcacgactattcttagagatggtggttaaaatccatgccatgcccagaagcctgggtcgtggaacaatacttgcgtgcgtttgttcaccggagacccacgagctgggggagattgcttccatgggtggaatggtccataatacgtcatggatggcgaacatcggtactaccccttatgaaatcacttttggtcgccgaccattcaactttccggactatcttgcaggttcctcgaaggtagatgctgtagacgacctcttaacggagagggacatgacattccaattaattcataaaaagttattgaaagctcagagcaagatgaaactttatgctgaccaacatcgtagggatgtccaatttacacctggtgactgggttctggttcgtcttcgtccctaccatcagtcctcagccaaggggcaacacacgaccaatgcaaaattagctcgccgttattatgggccatttcaggtcgcaactaagataggaccagtggcataccgtctggactttccggagggagttcgcatacaccctgtgtttcattgttcgaacctcaaaccttttcggggtgagcccgaatccatctccccaactcctctaccacccacttttcatgagaaccagcctctcatagcacctcttgccattctgggttctcgtcgtgcgacctctgaccctcacagcccaaggcaagttttggtgaagtggcaggggcttccaccagaagaaacctcatgggaggattag

SEQ ID NO: 67229 - DNA, 138 bp, Glycine max
  Peptide Sequence Number=SeqID_184007
atgggaatgcacgtttcagacttcagcgagaaggggagcaaatggagacaggagcagatagcaggtgaaagcagccaacagccactcaagctagcaggggacatgggctgcaactgcaacctcacagatcacaagtag

SEQ ID NO: 67230 - DNA, 204 bp, Glycine max
  Peptide Sequence Number=SeqID_184008
atggctacatcctactgcgatagctattcaaaccctgcaataaaagcattcaatctcattggcaagaaactcacaatgacgatgccaggtcgcaacaaggctggatcaaggctttcaattctgttggttgcaagaatcactttaacatcacctcttcaatcgaaaccatctaactggttcaacaactccaacatagtcctctga

SEQ ID NO: 67231 - DNA, 1746 bp, Glycine max
  Peptide Sequence Number=SeqID_184009
atgtacacttgtgcaggcttcttgcttgtggaaacattagaaggtttacacgttctgttcacaagacaggctgcttggaagtattttatccaatggggtccccatactcaagatacaattttttctcgcactatagacatgtacacaaagaacaatttctattcatgttatttaaatcaaaggatgtgtttccataaagggccagctctaccaccagtaggtcaaattgcccatgtggtaactttggctttggtcaaatcaaattttgttgttcatggtgtgattgccttcataattggagagtttgcttggacacaaaggaaatgggcagaaacagaatccttcccaacaagggattcactttatgtgcatgcacaagatgggcgtgtgtatttaactgcagctctgttggcagtcattgagatttttgtcttgtttcttagggctgtctatttggtgattttgttctctccttgtatagctatggctcctttagttgatttttttggcactcaatttagaaaaacatggattcatgttgttcgagttacacttgaaaaagctggtccagcattcattaagtggggtcaatgggctgcaaccagacctgatctctttccaagggatctctgtgatgaacttgcagaatttcaaacgaaagcgccatcacataaatttagctatagcagaaaatgtattgaaaatgcatttggtcaaaaattatctgaaatctttgaaaattttgaggaggaacccatagcttcaggtagcattgctcaagttcatcgagctacactaaaatacaaattccctggtcagcgaatcaagcctgttgttgtagcagtgaaggtccgacatccaggggtttctgaagcaattaaaagggattttatccttatcaatcttgttgccaagatttcgtctttattccctaatttgaagtggctgagactagatgaaagtgtacaacaatttgcagtctttatgatgtctcaagttgatctttcaagggaagcggcacatcttagtcgctttatctacaatttccgtagatggaaagatgtttcattcccgatgcccttgtatcccctcgtgcacccatctgttttggtagaaacctttgaacaaggcgaaagtgttttgcactatgttgaccagcctgaaggacatgagcatttcaaaagtgcccttgctcatattggaacacatgctcttttaaagatgcttttgatatatctcttcttccaggtggataattttatccatgcagacatgcatcctggaaatattcttgtccgagtaggaaaaagaaaatcaacacctataccactgttaaagtcaaggcctcatgtaattttcctcgatgtgggtatgactactgaactttctaagagagaacgaggatatttagtggaattctttaaggctattgcacttcaagatggccgcactgctgcagaatgcacacttagattatcaaaacgacaaaattgcccagatccgaaatttttcattgaggaggtggataaatcatttgaattttggagatccccagaaggtgaatctgtccacacagctgatcgtatgcaacaattgcttgagcatgttaggcgctgtaaagtcaatatagatggcaatgtttgcgctgtgatagttaccacattggttctggaggtagagagtgtggtggaaatgtggaatacttgtttagaaatgcacaacttttcaccaccacctgaggtgtaa

SEQ ID NO: 67232 - DNA, 288 bp, Glycine max
  Peptide Sequence Number=SeqID_184010
atgttgtccttgacgcccacgagcacgccggcgaaggggccggggtcctctccggcggcgatttgggcgtcgaggcggcgcgcgtgggagaggaggacgtcgtcgtcggggaggtggggctcggtgaggcggaggcgcgcgaggtgggagaggacgagatcagcggcggaggcgcggcgggagaggaggacgtggcggatggataggatttcggactgcggcggaggggagggggtgagggaggcgcgtgaggcgagagagggagcgaggggtttgaagtgtggatag

SEQ ID NO: 67233 - DNA, 783 bp, Glycine max
  Peptide Sequence Number=SeqID_184011
atggggatatttgagggatttcattggtattatgcttggtgtttgatatttgcacaatgtcaaccaaaatcatcatatgcttcttgccactatgtcaatttgcttttatgttctttaatttacacagacctattctattgcatgaatttcactaaagttgataatgcatttgcactccagcttttcacaactatcactgtcaatgagcctgctcctggtctcaagactatttttagctttagagttcctgatcaaaggtctggaaaggtggaagtccagtacttgcatgactatgctggaataagcaccagtgtgggtttaacagcaaacccaattgtcaacttctccggcgttgtaggaactaatgtacttgcccttggtactgatgtttcttttgacaccaagattggggagttaactaaattcaatgctggattgaacttcaccaaagatgatttggttgcctcattgactgtgaataacaaaggtgattccctgaatgcttcatactaccatacagtcaatcgcttgaccaacacagctgttggtgctgaggtaactcaccaattctcaaccaatgagaacaccctcacacttggcacccagcatgcattggatccattgacgactgtgaaggctcgtgtcaacaacttgggcaaggcaaatgctctcatccagcacgagtggcgtcccagatcgttcttcaccatttctggggaggttgacactaaggccattgagaagagtgcaaaggttggattaggtttggccctcaaaccctaa

SEQ ID NO: 67234 - DNA, 372 bp, Glycine max
  Peptide Sequence Number=SeqID_184012
atggggagattgtggaagcaaagcttccaagcttattttgatgatgccaaagactcgagtcaagaatcaagattcaagcaagtttcaagaatcaaagagtcattcaagtcaagaatcaagattcaaaaaaagcttttcaagagacctactcttggtgactgtttccaagagaagagattcatcgtgaggttttggctcaccaaccaatgtcattgtcataagccaccagttagcttatttgcaccagggagaagtcaaattgctactcacaaggttttaatcctgatgggcaatggaagcacgcataacttcatccaaaagaaggtagctctcaaattggaccttagtaccaacccaacccaagcactttaa

SEQ ID NO: 67235 - DNA, 498 bp, Glycine max
  Peptide Sequence Number=SeqID_184013
atgggagatcttttaaagatgaaagatattttcaagaggtggactgaatatcttgacaacacacaatcaagggtcaataacctactaccggtaaattgtgttttttgtggaggagagcatgtcaatgacgactatcatctctactccataaaaaattcttggtgggaacaggagttactcccttacaatcaatatgaagaagaaagaactcctactcttgaaagtgtgctcacggaattcacgacataccatcctagctctacagccaatcaaaacccaatgcaaaatctggaaattcaggttggcaagagctactccatggaaaattatcagtgggagcaagagttacaaccctacaatcaatatgaagaagaaaaaatttctcacaacacatatctagaagaacttggtgtgagacatcatcacactattaattctttttttaaaaaatccacttgtaagacaaaaaaacaatttcctatggaagtcatggattaa

SEQ ID NO: 67236 - DNA, 369 bp, Glycine max
  Peptide Sequence Number=SeqID_184014
atggaacgcttcaatggtggtatctttggcaaaccatctgaagaagattttgctgcattgaaaatggaaaatggaaagaaaaacacaagggaaaaaaatgaagaaacggagaaggggttactttttgtacttgcctccatcaataaggatctcgccaatcttctactaggagcacgcaatattgcctttatggccatcgatctcgcgaaaattgcacacattgacaatcttcgtgctcttcttcgcaaaatcatcgagggaggtgaaatatctcattcaggaaggggtggtgctatcgacggtggtttgaagtgtcatggctgtgacgtgccgaaggtgctaagtgtggtgctcaacaacaacacatag

SEQ ID NO: 67237 - DNA, 810 bp, Glycine max
  Peptide Sequence Number=SeqID_184015
atgtctaaggctaggagtgaccagattgatgatgcagttgttgtgaaggcccaaactacagagaccaccaggcccaaaaggaatgtagtaacactaaggaaatggactgattatgcgtcttacaaaccacccatccattcctccacttccaactacaacactgccaattattatcatcacaaacatttcctcaagctagatatccctagttttgatggatatgaccctcatgggtggattttcaaaataacccaattctttgattatcatgaaacccctgagaaagagaggattacgattgccctattttacctagatggagtcgcattagcttggtaccaatggatgcattgcaatgggaaaatccactcgtggtcacatttcttgcaagctttggagatgcgatttgcacccacgacttacaatgacccacgaggtaagcttttgaagctccttcagacctccttcgttgcttcttatctaagtgagcttgaagctcttgttaatcggattgttgtcggccttgctaaactccatgagaacaaattctatgacttgctccatttgtctcgtccttgcttagaaggtcaacattcagctccaacaatgtcgtgtgccatcactctcctaccacctcagttttcatcagatttatcctcacagaagcagcttccgccattgttgcctaccctagcttcgcgaacccgctacaaacgtctcttctcggaagaaatcgccaagcaccgtgagaaggggctttgttatggttgtgatcaaaagtggttgaagagccaccattgctcgacatga

SEQ ID NO: 67238 - DNA, 405 bp, Glycine max
  Peptide Sequence Number=SeqID_184016
atggcggattttcatggcggtttttcgaaaaaacgtcaccaaatagcggtggcgtggcgggtttgggatggcggcgccatggcggtcgtggcggttatggcggggtggcggaaaatggcgtccctcccgcaccccacacgcgcacccagccgcgtccctcccgcaccccacacgcgcacccagccgcgacacccgcagccgcacgcgcacgcagccgcgacgacctccggcagcgacgcaccggcacaaacggcggtgacgagctccggcagcgacgcatctgtcacaaacggcggcctgcagcgaggagttctcgcggagaagacgaagctgctgtcgcgaagaagaagaaggcgtcgcgaagaagaagaaggcgtaggttttagttttatttttgctgtttga

SEQ ID NO: 67239 - DNA, 924 bp, Glycine max
  Peptide Sequence Number=SeqID_184017
atggctaattctaacttactggagtatcatattttcttgtgcagtggcagcagtgatcatacaacaaagttttggtgcagaaataggccaggagaccctgcccgtgatagatttaacactggcatgccaggatatgctgaccaaaatcctgttgttggtcggatgggtggtaattttacaatagctgaaggcccaacaactccaggaccatttgcccctgggttgactcgaaatgagggtaccattccaggtgttggagttgcaatgcccttgtctattccttctcttgacatgcctcaaggggagcagaagcaaccccatcctgtttcaatgggtgctcctcctcttccccccggtccacatccctcccttcttaatgccaaccaacagcaaccataccaacagaatcctcagcagatcccacaacatcaacaccaggctctaccacaacagatgggtcctttgcctatgcctccaaatatgcaacaactacagcacccttcccattctcccttccctaatatgcctcgccctccaccccaaatgcctattggcatgccaggatctataccagggatttcatcagtgcctacatcacatccaatgccaatgccaggtccaatgggaatgcaaggggcgatgaatcagatgggtactccaatgccacaaggtccttatgtaggcatgaatcaaatgcattcagggtccttgcctacaagtggagggccacctcttggtggttttccaggcaacttgccaaatatgcaagggccatcaaatgccaattatcctcaaggtgcttcatttaacagacctcaaggtggccaaatgcctctgatgcaagggtatagtccttaccaggttattgctcagaagaaaaaactcaatgagttagatacaacacaggtatttaaagagttctga

SEQ ID NO: 67240 - DNA, 195 bp, Glycine max
  Peptide Sequence Number=SeqID_184018
atggacatggaaccaccaactctatcttctcctaccatgcaaaaccaggagcttcatgaggatcctgtaccatctcagattgctaatacccctcctctttccattggcaatgaccctctcatcactccattgacaatcttggacttcaagacatccacaactgatggcactcccactcgttatgctttagtttag

SEQ ID NO: 67241 - DNA, 1149 bp, Glycine max
  Peptide Sequence Number=SeqID_184019
atgagaagaaagagtaagggcaaacgcaggcgtgcggcacctgcaacaactctcacttctccttccctctccgccattcccattctatcggatgaacacaacaacaacgcaccaactgcgtttgataccgactgcgacgatgacaataatgcccttcatcaccgcggctccgaacccgaacccgaacccgaactcgaacctgtggatatatttgacaaaactatctgcattcactgcgataacaaaggcgaggaggcggagggagttttaatctgcggcggaaggggctgccccgtcgcggtccacgccacctgcctcggcttcgagcctgaattcgacgattccggtaacttttgctgcccctattgctggtacaagcgcgccgtggacacgtgtcgacggttgagggagaaggccatgaaggcgaagggagaattgtcacgcttttttggacaatcacgtgcgggtgcaacagattatagtgctgctgcacgtgtggatccggttgttcaggatagtgaagaactcatggaggaaacagaaacagaagaacaatctgaagagaataaagatgaggagggaatggttgaggaaagtgaaaaactcgtggagggaaaagaaacagaatctgaagagaataaagaggaggtagagggtaaggttcaggatagtgaagaactcgtggaggaaacggaaacagaaacagaaggacaatctgaagagaagaaagatgaggagggaaaggtggctgtgatgagtagttctgtgagtgagaccaatgattcggaatctgtggccgaagcagtgaagaaaaggaaggatcagaagaagaagaaagttgcttcctcgaggaaatctttgtcgcgacaacaagagcataagaataagcattataagactagagggaaatttgccaacaaggacgaggaggaagttaccagcttcaaaagtatcagtttgaggcagcaaccacagagaatgaagcagagttcactgactgcaaagcgaaggagattactttggacagctgaagaagaaaaagttctcaaggtgatcgaaagtccatttggtgtattggaaggtacaggtgaaatgaacaaaaagagaggggatattagtgtcatgtcggttgctgtctgtgtgctgtga

SEQ ID NO: 67242 - DNA, 447 bp, Glycine max
  Peptide Sequence Number=SeqID_184020
atgtccaacactaactgcatggggaaactttcacagttccaaataaaatggggccaatctatcatttctacttatttttatgtttgttctagatacttagtttattgtgcaaagccaggccatggttgggatgtgaagagtgttgactggcatcctacaaaatctctattagtatcaggtgggaaggacaatctagtgaaactttgggatgctaaaacagggagagagctttgttcattatttattcttgtgtcatgcagtcatggccacaaaaacactgtgctgtgtgtaaaatggaatcaaaatggcaactgggtgttaacggcttcaaaggatcaaataataaagctttatgacataagagcaatgaaggaacttgaatcgttccgtgggcatcgcaaggatgttactaatgctgggtggatgttttcagtgggatgcttataa

SEQ ID NO: 67243 - DNA, 177 bp, Glycine max
  Peptide Sequence Number=SeqID_184021
atgacgagtgtcgttgcactgccacagagagtgcgtgagaatacgaaaaataaggttgcatttagcaaaagtggcacagaaaggaagaaaaaagaagaaattctgaagcaggcccaatccaataggggcgctcagcgcgcatcaggcgctaagcgagcaactaactggcggcgctga

SEQ ID NO: 67244 - DNA, 252 bp, Glycine max
  Peptide Sequence Number=SeqID_184022
atggctatttcattagttttcattttcactttgacgctgtctgtgtttattttgccattgaaaatgaatgctcttgaaatatttagttgtaaagcagtatcagtatgtaaatgctgtgaggcaacacccaccccctccaccatatttgttggctatgtctattttgtcctggaggtcctctgcttcaaatacagcatccttgacatcaagccgggctttcagatatcgatttctgattttgtgaacttctag

SEQ ID NO: 67245 - DNA, 639 bp, Glycine max
  Peptide Sequence Number=SeqID_184023
atggaagaaggatatgctaccagcaagccaacattgttcaaaggagtcaaatatgactataggaaggaaatggatgaaggagtcaagaagggaaaatctcttcctcttagcactcttaaaaaaaggaaaacaccatcatgcaaggaatcatcatctaggtcattgtccaaaagtgcgtccaaagcactgagcatggacaactcttctgatgcagaatctgaagaaaaatatactgaggatgataagttggctttcatctatagaaagatcaagaagatgtgcccagtccaggtttgtaaaattgggtcgggttgctgggttccatcaaagtcggtcgggtttggctgcatcatcccgggccacatgtatgaacattccaataacgaaatctgcccagttaggccaccaggtcccagttcaatcgaccaagtcaaatcaggtttcataacactggtttggacacttcaagtcaaagtgcccacaactagagaaatccaaggacaagtacaggaaaaagaaaagtctcaaagcacttgggaggatttggatgacaccacctttgatgaaggagaaaagaaagccaacctatgtatgatggatgatacaacttctaaacaatcaaaatcagaacaagagtag

SEQ ID NO: 67246 - DNA, 783 bp, Glycine max
  Peptide Sequence Number=SeqID_184024
atgatacttgatgatgatggtattgctgctccaggggaaattcttaggccatatgacatctatatcaataaacaatcaccaattgatacacgtactccaaaaacaggatctgcagcaaatttgcccgatagtgcatatcggtccaatgcacaatcattcaatgataatggaggagaagtagttgatagggtgggtaaagcatctttctcattatggtttggcaacgggcaactaatgttctttggagtttttcacaggatatggaaccatgaggaggttacactgcttaacagttttgataatcatgattttcccgacaaaggaatttctaagctctgccttgtaaatgagcttgatgatagcttgtttcttgctgcttcatctgatggaaacatttggatttggaaggactatactctgaagggtaaacaaaaacttgtcactgcattctcttcaattcatggtcataaacctggtgtaaggagtctgaatgcagttgttgattggcaacaacaatgtggctatctatgtctcagtgttggtaagcctcatctttgcatgatgtggtttgtgttgtttgttgtacttgtggaggtccttgaaaaattaagaaaaagattggtggtaactggtaagaaactcttaattacctgggccatgtttgatctccactcacaccacaacatcacaacatcaatagactatggtacaccaggggatgtcctagctactaaatttggatggcttgcagtctatctacatcatatcccttatggtatatga

SEQ ID NO: 67247 - DNA, 336 bp, Glycine max
  Peptide Sequence Number=SeqID_184025
atggtgcaaaaagaatacgaaagcttactcaaaggaaagctgttgattatacaagcacagttgtgcgttatatgcagcgggattcaagggataggacagtactgcaacccaccccggcagcagcaattgatgtcaatgttgccagcagttggctatccagacaatccatccacaagctttgctgctaaatttgttcatacatctctaaataaaaatcgttgccccattaatcgcgttctttggactccaacaggccggcgacttattactggttcacagactggggaatttactctttggaatggacaatcttttaattttgaaatgattcttcag

SEQ ID NO: 67248 - DNA, 276 bp, Glycine max
  Peptide Sequence Number=SeqID_184026
atgttgttcgcaggaatagagctgaacaaaggagaaagatggttgtttcaggaggaggagaggaggcatggcggtgttgttaatgatccactggcagagccatctttgtttgactatctcactcctcaagtagggatagtcaacaacatattgttcccagaattgggagatgtcaacatggagctgaaactaagtaaaagacaacaagaagaaaaagacaactatctaacaaaggagatgcctagagcatcagcaagaatggaagaagctagctga

SEQ ID NO: 67249 - DNA, 735 bp, Glycine max
  Peptide Sequence Number=SeqID_184027
atgcaagatgaaaattgggttaaagctatgcaagaggagctcaaccagtttcagaagaatgatgtatggaaagtagtggagctacccaaggataagaaagttgttggagctaactcagtcattgatgaagttctttatgaagtttttaaagagaaaaccattactacattatggctcaaagaaggtacgtcattgaaagaacatcctgatgagttaagctttgttctaataaagctctgtgacattgatgtcaagatagaagatgaagatctgacaatgattatgttagcctttctccctccttcctttgagaattttttgagttctcttagttttaccacacagtccattacacttgaagaagttaagtccagtctctattctagagagcttcaactaaaagtgtttggaaatggtggcgaagcctttgcatctagattatcagtgactaattctgctaaagggcggaagaaaaagaaaggaaaaggtaacaagaagagaaaaattggtccaaagggcatctataattactgtaaagaaccagggccttcaagagttccatcattgggaggggcaaggtatttcccatccaccatcaatgattactttgagatgacatgggtattcatgatgaagcaaaaatataaagttttcaaatgtttcaagcattggatgattcttatgaagaatcaaacaggaaagacagtgaagtgtcttaggactgacaatgactag

SEQ ID NO: 67250 - DNA, 141 bp, Glycine max
  Peptide Sequence Number=SeqID_184028
atgggcacccgtctccatgtgattggtgatcccatgaatggagttcaacgaagtgggggtcacaacccactctttgaggattcacctagtgagtgtggtggtggggccgccactgtgagatatgggctaatctctaagtga

SEQ ID NO: 67251 - DNA, 1389 bp, Glycine max
  Peptide Sequence Number=SeqID_184029
atggttaccataaaaacttctcacactgtggttccaaatcaaccaactccgaaaggtcgattatggctatctaatagtgacaattccacacgtccagcacatacacccgttatttacatatacaaagcacaactcaacattgaatatgacattgagagaatgagagactctcttagcaaagttctagtgtactactatccagttgctggcagattgagcttagcagaaagtggtcgaatggaagtggattgcaacgcaaagggagtgacattgattgaagccgcaaccgcaaaaacatttgctgattttggagacttttcaccctctgattccatcaaggaagagcttgttccagcaattgattatcattctcaacctatacaagagattcctttgctatttgttcaactaacaagattccaaggtgaccaacaacaaggccttgccattggagttgctttctcacatcctgtggctgatgggtctgcttggattcactttatgaacacatgggcaatggtcaatagaggagacatgttggatcttaatgaaatgccatttctagatcgaactatactcaaattcccaccatcatcgttgcagtcaccgccgccgccgcactttgatcacccagagttgaagcctctgccactcatactaggcaaatctgacagcactgaagagcaaaacaagaagacagcagcttctatgttgaaactcacatcaaaacaagtggagatgttgaagaagaaggccaacgatcaattaacaaaacaagggtcaagaccttttagcagatttgaagctgtggctgcacatatatggagatgtgcatgtaaggctcgtgaactacatcacaatcaaccaactcttgctcggttcaacgttgattttcgcaatcgattaattcctcctctccccaggaattactttgggaatgctttggtagcaacagtgacaccagaatgttatgttggagaaatgacaacaagaccattgagctatgctgcccaaaaaatgagagaagcagtggcattgcttacagatgagtacataaggtcacacttagaagttgtatttggtgaggagcaattggattgcataaaggcttttttcttgggacaaggagaaggtagatatgcaccttttggagggaatccgaatcttcaaatcacaagctggatcaacatgcgggcgtatgaaaccgatttcgggtggggaaagcctgtgtattttggtttaggatatgtgtgtgcattagataggggaattattatgcgaggtccacaagatgatggttctgttattgtgatcatgcatttccagatagcacatatgcaacttcttaagaaattcttctacgaggatatattcacatcaaggttgtaa

SEQ ID NO: 67252 - DNA, 453 bp, Glycine max
  Peptide Sequence Number=SeqID_184030
atgcctttttctatgaagcttgacataaatgaggacaagtggttcttctttgaattggttggcattaagaaggatggcattaagtgcacaagtgactttaagctttggtggataggggctaatgatgttggtctaaaggagttggccttttataaccatgctcttgagttggaaaattttgcctcgagtcacaaaactcaagtaaaagtttatgtgaagaagttgaatggtggagaggttgttgttattgtcggtgatgttgtagcacctggtaatgggaatgaaggtgttgttactatcagtgagtctgatggtagtgattttgaaagtgggtctaagaatgataatgaagacactctttttgaagatagtgaagaggagagagcagttgcggttgatgatgattttgatagtgaggaagaacctttagttaacttgactttgaagaaataa

SEQ ID NO: 67253 - DNA, 138 bp, Glycine max
  Peptide Sequence Number=SeqID_184031
atggcggcatgggcttcacgtcagcatgtctcgcctgtgccactggcagtaccctccatgcttctcgccatctgcaatggcgaaacacctatgtcgccagttcttctggcggcatccatggaggaacaggcccccctc

SEQ ID NO: 67254 - DNA, 867 bp, Glycine max
  Peptide Sequence Number=SeqID_184032
atgcttccagcatttcaatggcggcatgggctatgggtgtgtctcgcaggaggaattggcgagatcagtgcacgtcagcaagtctcgcctgtgccactggcggcaccctctagctcagcatacttctcgccatctgcaatggcggaacacctatgtcgccagttcttctggcgacatccatggaggaacagaaccccctcctccattgctagattcatcggtgttgtggcgagatcctccgccaaatcgaggctccgctccatcagaaggagcacgaacttgagccttcagatgaggaggatgagctctttctccatcgtgaagtgcgtctccagaagcgtggccaaggtgcaggatcccatggccaaacaacaaggtctcaagcttttgcttctctttctctcaacacttaagctcgaaagacctgtctcccctggcccatcgtctcctcctcactgtgccactcaacatgccattgaggtacatgtaactgccgcaaactgctcaacttgcaactgcgctgctccacgagtttgggttttaaacatagtcttggctcttggttggtgggttcgtgagttcccgggactaaaattgcctatgatgggaggtcaatccagtacgatacctagcagtagtgatgttccaacacccatcaaaatgggtacccattatctgtatccggctgatttgagctcttatgaggcgacatgtgttgaacatccaaacttgcaatccttggatgctacaattgaggagtgcaccaacagggtgatcacatcgcttgcccaagggattgaggttcattccatatcgattgagtcactaggggaagtattaagtgattccttcagtctttttgtttag

SEQ ID NO: 67255 - DNA, 378 bp, Glycine max
  Peptide Sequence Number=SeqID_184033
atggctacatcgcccagctctcctcctcctcctactggtgtagcaccgcatttgtcgtctaccttgaagtggacaagaaaggccatacgcttaagatcattggcgactagaccagttggggtagagagacccctggttcatgtggatcctactactagaaaagtggacgatccccacagaaagaagttaagaacatatttggggatcgtcgctcatgataaggtggatgtgacatacgagaattggaagcaagctgaatttgatatccctgaagcatctaattatttcaatgatgctagaccattggaaccagagatattgaaagcgcttcgcatcaagtggacaaagtattatttgaaagttaaaaatgaaacttag

SEQ ID NO: 67256 - DNA, 255 bp, Glycine max
  Peptide Sequence Number=SeqID_184034
atgtgggtgtcgacggagcggtttctggcagatttcgggcgggaggagaaagagaacagcgatttcaggcgggaggagaaagagaagagaactatagggacattgatcgatcttaaggtttccccttggaagttgatctatacaatggtgggggcttataaggagggagttgccgtggtaccccacaactaccatcaggacaagaaggaggtcgcaaaggagaaaaccacaacccagcaagcgtcgaaggggtga

SEQ ID NO: 67257 - DNA, 465 bp, Glycine max
  Peptide Sequence Number=SeqID_184035
atggaatgcataccatttgacttgcctcacatcatctacctcaacattgtgcacatcacaaagactataggtagccttcaagacatctattatgctacactattgaacaaaatcttgtgggaacaaggagtttatcaagtcttcaacatactggatgatgcaagcaataatgagattatgagaaagatcatagctcaacaacaagctccttttgctccaaagaaggaaaaagttgataaggcaattccctctggcaaggaacctatcattgtagctgttgtgctcagaaagatgaaggtaattgcaactagggcaaatcctaccatctttgaaaaggaatggactctaccctatccttctcaaggatccagcagcaatgatgttttttctgatgctactatctcacaagaccatcgtccatcttcaccaccatggcagtgtccaccccatctcttatcaacttga

SEQ ID NO: 67258 - DNA, 234 bp, Glycine max
  Peptide Sequence Number=SeqID_184036
atggatgaggactttgaagatgatagattcatctccaagatgaaagaacttttcatggtcttcaatgatcatgtggtgcaacttcatgatatacaaaaccttgacaaggggggggggaagaaagcctgtcaagagataaagggtgaagaacaaacaacatcccctgctgagtccaatgcaacaacgactgatgaggttgttcaaacacgtcaaccttttcctgcatccaagtag

SEQ ID NO: 67259 - DNA, 738 bp, Glycine max
  Peptide Sequence Number=SeqID_184037
atggaattcaacggcaaggccgccctcgtcaccggcggcacgcgcggcatcggcgcggccatcgtccgcggcctggcgcaacggggcgccgcggtggccttcacctacgccagctcggacagcgccgccaacgaactggcgcgtgaacttggcgcgagcggcgcgcgggtcctgggcatcaaggcggacagccgcgatccagccgcggtccgggcggcggtggaccataccgcccgggaactgggccggctggacattctcgtcaacagcgccggcgtgttcccttcaggcccgatcgaggacgccacgctgcaagagatcgacgacaccttggcgatccacgcgcgcgcggtcttcgtggcttcgcaggcggcgctggcgcatatgggttccggcggacgcatcatctccatcggctcgtgcttcgcgcagcgcgtgccctacggcggcgtgacgctgtacgcgatgagcaaatccgcgctgatcggcttcaccaagggactcgcgcgcgaggtgggcgagcgcggcatcacggtgaacatcgtcgatccgggctcgaccgataccgatatgaacccggccgacgggccggcggcgtccgccgaactggcgctcatggcggtcaagcgctatgcccggccggcggagatcgcggccgcggtcgcctatcttgcgtcggccgagagccagttcatcactggatcatcgctcgccatcgacggcggcttcacggcatag

SEQ ID NO: 67260 - DNA, 921 bp, Glycine max
  Peptide Sequence Number=SeqID_184038
atgcctcccatgtcaacgattccaattcacagacctgaatttcgtaccttattcttcaatgggtctccaagcccttgcaaatgcctcagaattactgcctcatggaccatgtggtttttcttagcctgtttctgttctatgtttgacatgagcaggaccatggattcgaaattttctccaacaacaaagaatagtaatgataataattataatctgaagaagaaggaagaactctctgtgcagattccaaccccacccatttccaaagtggaaactttaaactccaatgatctccaatttgatcgattgcagccatcggatcaagaattgggtcgagtaaaaaggtttgagtttgggcaatttgtcgcacgagaagctgtgcttgatgaagagtattggacagcagcatggttaagggcagaaagtcactgggaggatcgaccgtacgacagatatgttgataactacaaaaggaaatttgccgagcaggaatttaatgcattaaaaagacggtgcaaggtgcaaaatggtgatagttgcgcatgcatcatcacggtgaggaaggagcagaaaaatgcaaagcactcagtattaaagagtgttgtaggaacccttgatttgaatatccgatatttgctacaaggggagacttatcccggggaacgtgtaaaggcccctcttttttgcagcatcaacagaacaccaccaagcaggtatggctacattgcaaacttatgcgtcatcaaatcagttaggcgacagggaattgcaagcaacatgatgtcttttgctattgaagctgcaaaatctaatggtttgacacaggtgtatgtgcatgtggacagaaataataggcctgcacagatattataccaaaaaatgggcttcgagatgttagacaagtggcctcatatatcttaa

SEQ ID NO: 67261 - DNA, 102 bp, Glycine max
  Peptide Sequence Number=SeqID_184039
atggcggcatcgaagcgatcatttggtgagctagtgtgtaagacgacgatatacttccaaatggactcattggcattgatggaagggaggccgatgagatga

SEQ ID NO: 67262 - DNA, 219 bp, Glycine max
  Peptide Sequence Number=SeqID_184040
atggcatcgaaacgatcaccaacgaatgctcgaagcccacggagttcagaaaagacttcattcatgagagcagaggaagcatcttgctgtggcggaggtgacggagtacgctcacgtgagaatagagtagatgatcgtggaaatgacaaggaaggagggactagtgctatggctgctctagatattttgtggcgtcgatgggcagcagcggcggtggag

SEQ ID NO: 67263 - DNA, 2049 bp, Glycine max
  Peptide Sequence Number=SeqID_184041
cgcaggagcgactctgccggttcccaacgtgaggactttctctgcttaagatcgagaaagaatttagaagaacagggtaatgataaggcaaatgaagatgactcagtgaagataaatgatgacgtggctgcggcggttgttgattgcgatgtgataacaccggaatccaaagcggaaaactcaggattcaatttaaaccttatagcagttaactctgactccgactccgcttttagggtttccaccggcaaccggaagcgcaagattcactcaaccggttccggatgcgagggttttctcaacaaaagaccggggaagaaggctgtcaagagagcaatgacaaacgattcagaagaacaaagtaataataacgcaaatgatgatgatgataatgacgtggcggtggcggttgatgaaaatgtgatgataccagagaacactggtggtgcaaacgttgtagcggataatagtgtacctttgcgtgttcgagaacgtcctagaaattccaatgcaagagagcgtggttccggttatgggaggaacgattacatggaacgattccacgacatagcgcgggaaaacgcgtcgcggtttgctttctttgcaccggaaggggaggaccatgaccggtcaccgccggtggaaccggagcgtgacgaaatcgaggattggcccggtcctttctccacagctatgaaaatcatcagagaccgagggtcgaaactgcaaaacgctgaagcgagttcgcaagcgagcttgtgtgagtctattaagtgggttcctaatgcgaagagagggaatgcaggtgttaatgtttcggttccgtcgttgcaagagatgtgccttaagattctggtgaagaatgttgatgctattgcttcgcttgagagtgtgcctgatgccctgaggcaccggcttagccagttgctctgtgactcgaggagaattaacggccactttctcgagcttcttgtgcgtggaacgcccactgagattcgattgagagattgctcgtggttaacggaggaacagtttaccgagtcttttcgaacgtgtgacacggaaaatttggtggtactgcaacttgaccagtgtgggcgctgtttgcctgattatgtagtagtttctactttggcacagtcgccaaggcatttatctagtttatctactctatccctcagtggtgcatgccgactttcagatggaggtttgcgtgcacttgtttcttctgctccggcacttagatccataaatctcagccagtgttcccttctcacatcttctagtgtatatattttggctgaatcattaaaatctcttctgaaagagttgtaccttgatgattgccaaggcattgatgctgcactaattgtgccagcactaattgagcttgaacatttagaagtgttgtcagtagctggcattcaaacggtttgtgatgaatttgtcaagaactacattgttgctcgtggacaaaacatgaaagagcttgttttgaaggactgtataaacttgactgatgcatcaatcaaagccattgttgagcactgtccaggattatgtgtgcttgatcttatgaacctgcacaaattaacagatttatctataggacatcttgcaaatggttgtcgtgcacttcatacactgaaactttgccgtaacccattcagtgatgaagcaattgctgcatttgtggagaccaccggagggtccttaaaagaattgtcacttaacaacattaagaaggttggttaccacacaaccttatcacttgcaaaccatgcaaaaaatttgcattctctagatctatcttggtgcagaaatttgacagacaatgcactgggtttgattgtggatagctgtttggcactgaggtcacttaaactttttggatgcagtcaggtaacagatgcttttctcaatggccactcaaaccttcagatccagataattggtttgaaaatgtctcctgtgttggaacatgtcaaagtgccagatcctcatcaaggtgctttgaattattcatcagtctccgtagatttggtataa

SEQ ID NO: 67264 - DNA, 693 bp, Glycine max
  Peptide Sequence Number=SeqID_184042
atggtcattgatcaatctctgtttttctctttaacaaaattacccagtcaaggtgtaccttttgaggacactattgttgatgactggaagtttgattattttagccatgatgcccgccgaatggtctgcaatgaccaggcgaatatgaccagcagattgcttgctaggtcattgacatttgactgtcacatcatgcattatataattgtccgcattttgctaccttgttcttctaacccggctcaagccttcgaggaggacttgattttgatgtaccgaatgcataaggcattatggaccaatgcacatcttccatatcctcagttggtcaccctttttcttcgtcactttcaaattcctcttgatgatgaatcttttgttcaagtcaagagatcttttgtcattgatgctggtgcagtaacttcatttggttaccgcaaggatcataatggacaatggcttaggaaacaggacttatcacatgagcgtattccgtcacctccatcacagcaagatgtttcctctgctttcatgaatgacgttctttctgaactccgtgggcttcgagcattcgttggtgattgtttcgatgtcatggatgcacgttttacaggaatggacacctgtatcactcgacttgaagacgatatgggtttcattcgccattgttttgatcccccggctgatccatag

SEQ ID NO: 67265 - DNA, 591 bp, Glycine max
  Peptide Sequence Number=SeqID_184043
atggccccgaggaaacttgcctcacagagatccaggaaggataaggcagtcgaaggaactagttccgctcccgagtatgacagtcaccgctttaggagcgctgtacaccagcagcgcttcgaggccatcaagggatggtcatttctccgggagcgacgcgtccagctcagggatgacgagtatactgatttccaggaagagataggtcgccggcggtgggcatcactggttacccccatggccaagttcgatccagaaatagtcctcgaattttatgccaatgcttggccaacagaggagggcgtgtgtgatatgaggtcctgggtgaggggtcagtggatcccgtttgatgcagatgctatcagccaactcctaggatatcctttagtgctggaagagggccaggaatgcgagtatggccagaggaggaaccggtctgatgggttcgatgaggaggccatcgcccagttgctatgtataccggggcaagattttgcccggactgttgccgggagacgggtgtttcatgattgcctaagagaggaccctcaaggcaatcctccattctcatccttttccagagccgcatga

SEQ ID NO: 67266 - DNA, 915 bp, Glycine max
  Peptide Sequence Number=SeqID_184044
atgggaggaaaaagtgagaagggtgaagttatggagtggtcagttgcaaatacaaaggctttcattgaaaaaatttatgagagagtgaaaaatgggcaattacaagggtcaaccttcaaaactaccacatgggaagaaattaacaaagacttgtttaagatgatccaaactaattatggtgtgaacaagttgaagtctaagtttaatcgtttgagacaaatgcattgtgatttttcaactttgctagtccgtacccaagtcacttgggaaatggaatccaacaaagtgaacgtccctgatgaagtatgggacgaattgattaagaaaggaagacattacaagaatttcaagaaacatggttttgagtacaactatgatatcctcagtgacatattcaattcaagcacagcaactgggaaactaagtcatgcttctactcaaaagccaccaaattttgatgaggagagagccatggaaggtgatttccttacaaaggggattcatattagtgtttctgatgatgagaaggatgatatcaaagggcttaggcacaaaaggaaggaaatattttcttcgggtgagcgttgccgtaaagagggaaaaacttctaacaaagagatgttagacaaaattgtaagcatttggagtaattcaatgagccaaaagacaacaacttcaagagctagagaagagcgatataagggaaagacttctcaagcttctcaagctactagtccaataagtgatccttattcagcaaaggcatgcatggaactattggacaacatgcaagatgttcccacttcagcttactttaagttgatggagaagtttacaagtgagcattggaggcaaatgttcatagtgatggatgcagagcgaaggaagcaattgataaaatctcttactgagtag

SEQ ID NO: 67267 - DNA, 1029 bp, Glycine max
  Peptide Sequence Number=SeqID_184045
atggcgcacaataacatcaactccaccaccatggatggcgtgcctcaccgagtcaacagcccgcgttacaccggttcgatgactcgtcgagctcactcattcaaacgcaacaacaacagcaataatgaaattgagctccaaataaactcacccagatcacccttggtttctgctgaaggctctgttttgaaaaggaatcagcatcatcataaggagaaaaagaacaagtttggccattgggtgttcttgctcttttgtggggaactatctgactccatcactagtcgaaatctaatggatcaaagctcccatggttatgcatatagggagggagcaaatgaggttgaacgaactctaaagatggtaactacaggggtaattgatagccaggctggcatggctgaagaatcaggtgtctggtctagacccaactatgacaatttcacccaatgtatagacctgccaagaaatcataaaaagctagatgaaaagaccaatggctacattctagtaaatgctaatggtggcctgaatcaaatgagatttgggatatgtgatatggttgctgttgctaagattatgaaggcaacacttgttcttccttctctcgatcacacctcttactggggtgatgcaagtggcttcaaggatttatttgactggaaacattttattgagacattgaaggatgatatccacgtagttgagacattaccacctgcctatgctgaaattgaacctttctcgaaaactccaatatcttggtctaaggccagttactacaagaatgaggttcttcccctgctaaagcagcataaagtgatctatttcacccataccaattccagacttgctaataatggaattccaagctccatacaaaagctaagatgtcgtgtaaattatagagcattgaaatattcagctccgattgaagaattcggaagcaaattaatatctagaatgcgacagaatgaaaatccttatctcgcgcttcatttgaggcaagttacaactctaatattttag

SEQ ID NO: 67268 - DNA, 1071 bp, Glycine max
  Peptide Sequence Number=SeqID_184046
atgtctttgaattcatctaacaatagctcaagtagcatagattctgaattggatgattatgacgatttaatggatttagtgttagttatgaccatcatggaatgtgaacatagttttattggtaaaactccatgtagggcatctatgttgactggaaaaatgtataccatagaattcttagtaggtcatgaaacaagatgttatgagaactttcggatgaaaaaagatgtatttatgaatttttgtgaaactttaaaggaagttggtaatttatgtgatggtaagaaagtcatcatagaggaagcaattgcaatgttcttgattataatatgtcataacttgcgtcatcaagtagttgctgaacggtttcaacctttattgcacacggtgaacaagtggttccagattatcctaaaagcagtttgcaagctaggcacgagcataattcatcaaagaaatcaaacaagtacacaccctcatattaggggcaatccaaaatactacccatacttcaaggattgcattggtgccattgatggaacgcatgtatctgcttgggctcctgcttctaaacaaactgcttttcatggaaaaagtgttggtgacacaaaatatcaattctatttggtcgactctggatttcctaacatgccaggctatctcgtccctttcagaaggaacaaatatcatttacacgattttcatgaaggatatggacgtccacgtggaaaagaagaattattcaattacaaacactctttattaaggaatgtcattgaaagatgctttcgagttttgaaagcaagatttccaattttgaaattgatgccaagttatcccattagaagacaaagattaatttccatttcttgttgcactatacataattttataagaatgcaaaatggtgcggatacactctttgtccaatatgctcaacaactcgttgatatggatgagcaatggttaagtgtagagcaacaaggtgtcaacgaaaatcaagaagctgaaatgacacaagttcgacaaaccataacaaatgaaatgtgggaaaattaccatagatcttaa

SEQ ID NO: 67269 - DNA, 852 bp, Glycine max
  Peptide Sequence Number=SeqID_184047
atggccgatctaacccacggcaaatccattgaccgcttaaaggaatctatcaaactcctttccacttctcaatcagacctggcttctaaagtcgattccatccttacccaacttgctacccttattcccacaccttcttctccaccccgcaaacaccacttgaaactagatgtttcccgttttaacggtgctgatcctatagggtggattttcaaaatttctcaattttttgagtttcatgacacacctaagcacaagcgcccgtttgttgcttccttttatatggatggtcttgccctcagttggctttggagtctcgtttcgctccttcattttatgaggacccttgaggctgtggcgcttgggaagttacaggtggaaaaattggaggactgtcgtcacttcaattgccctaaacctatcagcaacccccttccattacctctgcctccggcagagccacaacctccacccatatcatccgcaaccgctcctacctgttctcttgttccatcttctccagcagcacctcggccccgctatcgtcgtttatcccctgaagagatagctgactgtcacgagaagggtttatgctacaactgcgatgagaagtttggccccaatcaccgctacaaggctggtttcttccttctcatcgccgaggatgaaaccaaccaagaactgccacatccacagatcagttttaatgcgttgtccgaccatcccatctacgaggctcttcgtttgcaagactctatcaaccaccaccccattacgattttgatcaatggaggaagcacccataacttcctccagaccaaggtcgctaagttcttaggcctcccttcttga

SEQ ID NO: 67270 - DNA, 390 bp, Glycine max
  Peptide Sequence Number=SeqID_184048
atgttagctggcatagactatattgttgcacttcagagtgatgtatttctctatacttatgatggaaatatggcaaaggcagtacaaggccataggcacttcgaaaacttcaagaagactatcaatccagacaaggtaaattttgttaaactcgttgataagttggatgaaggaaaaatttcttggaagaagttcagctccaagggttgcatgtattggccattgtggctatgctgtctcagtacttctgtcttgagaaggtggaaatttgattgtacaaaagcttggttatttgataagttctatgtattggcctggatgatggacatgtttacatggggccaagaaaaagggttaagaactgagccactcagctgcattacaaattaa

SEQ ID NO: 67271 - DNA, 1995 bp, Glycine max
  Peptide Sequence Number=SeqID_184049
atgaccgattggcccatcccttcctttgttcgagctctttgcagattcctaggactcaaaggattctaccgcaagttcattaaagggtatgctgctattgcccatcctgtgaaccaattactccatatgggcttcttccaatggtcacctagtgctcaacaagcttttgattccttgaagagagccatgaccgaggcccttgttttggcccttctggattttgccttaccatttgttttggaaacagatgctttgggcgccactatggcttgcgcctccacttacattcgcgagttacatgctatcacttcagctgtgaagaaatggcggcaatatttattgggacaccctttcattattctcacggaccataagagcctcaaggatctcatgacgtcggtaatgcagacacttgaacaacaagtttatctctcaaaactcatgggatacgattatttgatccaatattgcattgaacgacataatgtggttgcgaacgccctttcccgttcggacggccagtgcttgatactttctgtccctcaattcgccttcctggacgagctccagcgcaacctatcttctagtgaggcattccacaatttggaatttcatcaaacatctgtcgcaggccatatgggtgttaccaaaacccttgctcgtttgctggaaaacttcttttggaagggaatgcgcaaggatgtcagaaattttgtagcacaatgcatcacttgccaatctacgaagtatgaaaccaaacgaccaactgatctgctccaaccattgccagttcccacagctgtttgggaggactttttccttgatttcatcacaggccttcctttatccaatggcaatacaattccgttattcttgttgttgttgaccgtttctctaaggcagctcatttcggtggtcttccaggccatttcacagctttcaaggttgctcaattattccttgaattggtctgcaaacaccacgagataccccgtagcatgcactgcctatcaccctgaaaccgatgggcagacagagatccttaaccgtacgctggaacaataccttcgtgcctttgtgcattttaacctgtcgagatggggaaaattcgtcgcattagcagaatggtcttatgacaccgctgtgcattcagccacaggacatgccaagctatgctacgaactctccaccgaaagctcctcaaagctcaaactgctatgtaaatgcaagctgacaaaaagcgcagggatgtgtcctatagtattggtgactgggtttatgttcgtttgcgcccctatcgccaaacatcggtctccgggcctttcccctgaagatacaacgtgggaacgctgggacgatctttctcggacatttcaccttgaggacaaggtgattctcccaggggatggcaatgttagtgatattgtgactacagacagcaacaaaaatggcctaagggaggaagagaccaacggtgctcaacttcaaaaacacatagatgccacgttgggtagtgggaacttgagggaggctgttaaactgccccctggtgaagatattaatgagtggctagctgtaaacactgtggacttctttaatcaagtgaatatcctgtttggtactcttacagaattctgcacgccaagtaactgcccttcaatgactgcaggaccaaagtatgagtatcgatgggctgatggtgttactataaagaaaccaatagaggtgtctgctccaaaatatgttgagtatttgatggactggattgaatctcagctagatgatgaaacaattttccctcaaagattgggggctccctttccaaccaatttccgagatgttgtcaagacaattttcaagcgactattccgtgtatatgcccacatttaccactcacattttcagaagatagtgagtttgaaggaagaagctcaccttaatacttgcttcaagcactttgttttatttacttggggtggagaaattattgcatga

SEQ ID NO: 67272 - DNA, 802 bp, Glycine max
  Peptide Sequence Number=SeqID_184050
ggggaatggagtttcacttgatggtgtaccatttgcaacaattacaatggaggacaatatggagatggaatgcgtgtttggggaaatagaggtcaaagaggcggttcttaaagatgatattatgaggtttatgagggagttccattcttatggtgttctacctaggggtggcaatccatcattcatcactttaattccaaaaacaaagtgccttttgggtgatagaaaactcctccatagtgtggttgtgacaaatgaggtggcggatgaagctaggaggagattgggcttccaagagaaatgggttaggtggatgagagaatgtttaagatcttgttctatttctgtcttggtaaatgaaaatcctactaaggaatttaacatccatagaaagcttagacaaagggatccattaactcctttccttttcaaaatggtagcggagggtttgagtgaaatgatgaggatgactactttaaagaatattttcaaggggtatatgtgtggaaatgtggaagttaatcttctccaatatgcagatgatactatttttattgcacaagtatctatccaaaatgtggaggggcttaagttgaatttttccaagagtatatgcggtacaattggtgtggatgaccttgagccatggggtaaaggacttgaggctattcaaagaagctctcctagcaaagtggaggtggaacttgttccaccaaccaaacactttgtggggagccatattgaaggcaaaggtggttttggaggggagaatcacgaatgtggtttgattatgggatactga

SEQ ID NO: 67273 - DNA, 1401 bp, Glycine max
  Peptide Sequence Number=SeqID_184051
atggtgaccataaaagcttctcacactgtggctccaaatcaaccaacaccccaaggtcgattatggctatctaatagtgaccaaaccgcacgcccggcccacacaccaaacctttacatctacaaagcaaaacacaacatcatcgaatatgacattgagaaaatgatagactctcttagcaaagttctagtgtactactatccagtagctggcagattgagcgtaacagaaagtggtcgaatggaagtggattgcaacgcaaagggagtgacattgatcgaagccgaaaccgcaaaaacatttgatgattttggagacttcacaccctcagactccatcaaggaagaacttgttccagtgattgattatcactctcaacctatagaagagattcctttggtattagtccaagtaacaagattcaaaggtgaccgaaaacaacaaggccttgccgttgcagtggctgtttctcatcctgtggctgatgggtatgcttggattcacttcatcaacacatgggcaaaggttaatagaggaggcatgttagatcttaatgacatgccatgtctagatagaactatacgcagatcatcgtcgttgtcatcaccgccaccgcgcttcgatcaccctgaattgaagcctctaccatttaaactaggcaaatctgacagcactgaagagcaaaataagaagacaacagctgctgtattaaaactcacatcagaacaagtggagatgttgaggaagaaggctaatgaaaatgaaaacctatcaacaaagcaagggtcaagatcaagaccttgtagcagatttgaagctgtggctgcacacatatggagatgtgcatgcaaggctcgtgaactagatcgcaatcaaccaactcttgttcggttcaacgccgattttcgcaatagactaacccctcctctcccgagaaattattttgggaatgcattggcggcgacagtgacaccagaatgttatgctggagaaatcacatcgaaaccgttgagctatgccgcccggaaaatgagagaagcggttgaaatgctcaaggaagaatatataagttcacagttagatattgcgttgggtgaggagcaattggagtccataaaggctttgttctcgagacaaggagagcgtaggaatgccccttttgcagggaaccctaaccttcaaatcacgagctggataaacattccactgtatgaagcagattttggctggggaaagcctgagcattttgttctgggatatgtgtgtccgtttgacagggggattattattcaaggtccagaaaatgatggttctgtcattgtcatcatgtatttccagatatcacatatgcaactctttaagaaattcttctacgaggatgtattcacttcaaggttgtaa

SEQ ID NO: 67274 - DNA, 186 bp, Glycine max
  Peptide Sequence Number=SeqID_184052
atggcgttcttgtgttttctcgctttaaataagtcttgggaggtggtgctagaaagtaagcagaaacttatagtctcaagtgagctacatgaagaagggaaggtggagtgtgacggcctagagaaaaggaatagaagtgaggtaccagagggggaagttgaacgatacttgcaacataagtcataa

SEQ ID NO: 67275 - DNA, 252 bp, Glycine max
  Peptide Sequence Number=SeqID_184053
atgatgctgatgacaacgacgatgatgacaatggtagcgataacaatagtgatgatggtgatgacgatagagacgacaatgatggtcatgatagcaaaggtgatggtggttgacgatgatagtaacgacaacaacaatcatgtgacaacgataaagatcatggcgacagaggtagtaggggtggttgatggcgacgatgattatagtggtagttgcatcggtggtcatgatagtagtcccatcaagaattga

SEQ ID NO: 67276 - DNA, 2772 bp, Glycine max
  Peptide Sequence Number=SeqID_184054
atggttgacggaacccgacttagcaaaatcgagaatgagttgtctcgtatcgaggcacaaaactcgagtttccaagagtgcatggcagcacaaatgacccaactcatgtctttgttacaaaagaagaaatcagatgatgaaaaccttgacgccgagtcaacgcactcgattttgcaaatcccggcgcgttattccaccacacgcatatccaccaaagatttcaagattgatcttcctaagttcgacggaatcaatgttgatgattggatttttcattttgaggagtattttgatgttgcacaaactcctttggagcaatgtatcaaagttgcgagtttttacatgataggacctgcctatgtttggtacaagtggatgattcataaaaattactctcaagattggacgatttttgttgatgcgttatacaaacattttggctcaaacctttacaccaacccgcaagaagcactcacagaattgaaacaacaaggcacagtgaaagaatatcaaacacaattcgaggctctctccactagagtcaatgggttgacaaaacaatggcttgttagtttctttgtggctggtctcaacgattacttaaagtgtcaattacgtacacttcgaacccctgccgcacacccagctacaaatcctatcaaccagctacctacttcgaacgctatcgcttccaataagccccacgaatcttcctccatgtcgaccccacagactcttgttgccagccaaacaacgaccaaacctccatacaaacgttttactggcacagagttgcgtgaacgatgctgtttggaactttgctattattgtgatgagaaatacaatccatcgcacaattgccaggccaagtgtcatatcctattagcacctgatgatctggtagatgtatgccacggcctgttggatgctgatgcaagtaacaatgcagccatcgagggaacgggggttccagacattagttttaactccctatcaagagaatatagtccttgcacggttcacgtcactaatattgaaccattcaaagtttttgtgggcagcgacgattttatatggtgcaacaccggcatctatgatgttccaattttagagcaaggcatttattttccgcttactgaatgtgatttttgcaaagactcagtgcattatttaggacatgtcatatccgctaaaggtctcactggttactatcgtcgttttgtaaagggctatgccaccattgcttttcccctgatggagatgttgaaatgcaacagttttcattggacttccgaatctgaaatgacattcaagttactcaagcaagctctgacttcgacaccaatactcgctcttccaaatttttcgcttccgtttgaggtcgagactgatgctagcactacaggaattggtgcagtgttgactcagcaaggtcatccattggctttctttagtaagaagctttcacgccgcatgagcaacgcatctagttatgcgcgtgaactctatgctattacgcaggatgttgcgagatggcaacattacttattaggaagaaaattcaccattaaaatagatcataagagcttgaaagagttgatgtcgcaacccgaactccttaagttccatgcacttcatggccagaacaagcttcctcctaattttgaggttcacaacggtcttcttttgtatcattcttgcctatacatcccacaggactcgcctttagtaaccaagcaatcagttaaaaaatatatggcgacatgtattcaatgccaacaaaccaagaacatcactaccaagtcgcaaggccttcttcaacctctatcgattcccactactccatggacagaaatttcaatggactttatcgtcgaccttccttattctaatgggttcacaacaatctttgttgtggtagatcatttaactaagacagcacatttcatgcctctcaaaacgggattcacagcaaagatcgtggctcttgaggaactgatcttcaccactcaacgacatatcatccacaaagcgatggctagactgaggttattgccatcttatacaccaagaaagacttcagtagacgaggaggattccatgttgatcaatcaacaagaaattcagaacgaactagaagctaatctgactagagcacaaactcgaatgaaaaaatgtgccgactctaatcaacttgacaagaatttcgaagtggaccaatgggtgtgggtaaaatttcacgcttaccgccaacaatctgctgctcgcagactcaactttaagctctctaagcggtattttggaccttttcagatcttggaatgcattggcaaggtggcataccaactagattttccatccaatagtcgaattcatccggttttccatgtttccttactaaaggcttactcaagtccaactcctcctgtgtccatcacatttttggtcgaatgggctaacgagccatgcaaagaagctacttggaagtcatgggatattctagtcaacctctataccgaggcagcctttgaggacaaggtccttttccgtgggagggtcactatcgtgaccaccgttgcaaccgctaccataatcgtcattgtcatcaaccgtcacccccattgtcacaatctttgccatcatgacctatgtcacccttgtttcaagaccatcatcgttgttgttgtcatgaacatcatggtgggagttgcgatgataatcatgatggtgatatatacgattgttatggacaacatgatgatgatggattaa

SEQ ID NO: 67277 - DNA, 1173 bp, Glycine max
  Peptide Sequence Number=SeqID_184055
atgacaaccggattgagaggtcgctcctacggtcactgttcttccctcccccctccctcttcccgtggtgatgtcgaagaggctagatctccagtgacggcggttctagttgtggcagcggaggaagtaccagttgtaacaagagccctccccttcggtgtaagcttcagacccgttgtcttcgtcacgaaagtgacctccggcaccacctcggacacctccggccaacacgagaatctcatgaccatgtataacaaagttctcagagccgagtttgagtttccaccatggttttcgcctgagtcaaagaagctaatctccaagattgtagtggcggatcccgccaagagaaccacgattttcgccataactcgcgtgttgtggttcgggaagggcttttcttcgttttccgctccggacttgtgccagttggagaaacaagaggcccttacagttacggaggaagaaaacaattccaagatgcctaagttcttcaacgcatttgagcttatttcgtccatgtcttttgggttcgacctctcgggatgttcgagagcaagaggaagacagcaacggtgttcacattgcgatggcgacgtgggggctgaggttccgcgtggcagaggtcaaggacttcaagatctgactgcagggtgcgacagaggggaggaagaagaggctgacggtcacggcggaggtgttcgaggtggcaccagaggtcactttcgcgacaaagacaatcgaaggagagggctcctgatacaaccggccatcgatctttcggtgaagttcttcaactgggtggagtcaccacatgaacactcccacttccaacccgtcgtcgacaacaccatcaatgctttccactgtctcattgagtcgaatcacaaggaccacccagatctacaaagtcaaacacgccatcaccccaaatctaacccaaacccgttctccatcttgctcttcaccaagatctacaaccccaacccttcacgttccctgtctttctccgcatgccccactacactcactccacctacgtcgtcacagttctcgcagtggaaggcttgggggagattgttattctttgctcatttttggatagtaacgataatttgtgaggagagaagtaaagggttgatggctttagtgcgaatggtgaggaggccttga

SEQ ID NO: 67278 - DNA, 264 bp, Glycine max
  Peptide Sequence Number=SeqID_184056
atgtcttttaatcagttctctgaagcatttggaaagttttatggccaatcaaagcatggagtgagcaatgatgcagttgaaacttctagagctcgtggaactgttcatgaaaactgtataaattgtattatgcctcttggggatcatggcacgttgataaggcgtttcagcacatcagtttcaagtaggctgcttttgctaatgcctactcctcgaatccacaggattggatggaagaattgttgtatgggatttggaaaatga

SEQ ID NO: 67279 - DNA, 270 bp, Glycine max
  Peptide Sequence Number=SeqID_184057
atgaggaatatcattaagaacaaggagataagtacatttgcacagttacatcataatctcggactaggggaactagtcactcatgaccagagtaaaactagcaatcttataaaaagtaaatatagagatatcaatagtgaatccaccacggttgtggtcggaagtgacgctaaagccttgagttattatggattgactatgaccctcttgattgaccacgatcatgatgagtttatcacgaccattatcggatccttaaccctattctag

SEQ ID NO: 67280 - DNA, 207 bp, Glycine max
  Peptide Sequence Number=SeqID_184058
atgaggttaaaggtttgtattaaagtagcagaactcaagcaacactgctgcaagatggagaaggttagtcttgaagtgaaagctccagaagagggtgatgagatgaaatgggttcttgattcttcagttgaccacaaagacagggttccactcagagcttcaactggttcttggaaagctgctctattcattattggtaaggactaa

SEQ ID NO: 67281 - DNA, 746 bp, Glycine max
  Peptide Sequence Number=SeqID_184059
atggctgaactcggaaacaacaacaacggcgccaacacgacgtcgtctaggttctccttcttcaaccgctccctcaccacgctccgcaacgaaccaccgccgcagaagccgccgcagctggaccgttcgctcacgaagctcgtcgaatccgggcgcggcggcagcgtcgtcaagcgcctctgcagcttcttcgaatccgcaaaaccttcctctccggaaaaacaacaaaatccaaagctcaaaccctcgaaattcatcgaaaactcaaactccgattccgcgtcgaaatcgctcgattcgccggcgatccgattaccgggaaccgaggatcggatcgtgttgtacttcactagcttgcgtggaattcgaagaacctacgaagattgctacgcggtgcggatgatatttcggggatttagggtttgggttgacgagcgcgacatttcgatggacgcgaattaccgtaaggagttgatgagcgcgttgtttggagagaataacaataacaacaacaagaagggacacgtggcgcttccgcaggtttttataagggggcggcacgtggggggtgctgacgtcatcaagcacatgtgggaggtgggggagctggagaaggttctggaagggttgccacggaccaaaggagggtttgtttgtgagagttgtggggatgtgaggtttgtgccgtgtgggaactgcagtgggagtaggaaggtgtttgatgaggatgaagaggtgttgaagag

SEQ ID NO: 67282 - DNA, 177 bp, Glycine max
  Peptide Sequence Number=SeqID_184060
atgaccagatatgtctggaaccttgaaggatcagaatgggtgcctactcttgttatccttagactaaaccgtgctgctctttgtgttcaatggagtccaaaagaatttaaagcaaaatgcgtaggagtgaaatctctacttccttctccacccactgcactattggattacacttag

SEQ ID NO: 67283 - DNA, 1640 bp, Glycine max
  Peptide Sequence Number=SeqID_184061
ctattgagactagcgagaggttgagctactttggaatagcaactagtttggtcctttacctcacaaaggttatgcatcaagaactcaaaacagcagcaagaaatgtgaactactgggctggtgtcacaactttgatgccactgtttggtggattcatagctgatgcatacttgggccgttactccactgtgctggcatcatgctttgtttatctcataggtttggttctccttactctgtcctggttcttaccatccttaaagccatgtggtgacacaaacatgtgcactgaaccaaggagaatacatgaagtggttttcttccttgccatttacttgatatctattggaactggagggcacaaaccctccttggagagctttggagctgaccaatttgatgaggaccatgatgaagaaaggaagcaaaaaatgtcatttttcaattggtggaattgtgctctatgcagtggacttattgttggagtgaccctcattgtttacatacaagacaacataaactggggagctgctgatattatcttcacagtggtcatggctttttcactgctcatcttcataataggaaggccattttatcgttatagggtaccaactgggagtcccttgactccaatgttgcaggttctttttgctgccatttccaaaagaaagcttccatatccttctaatcctgatcaattatatgaggttcccaagtataacagcaataatagaagatttctgtgtcacactaacaaactcaaatttcttgacaaggcagcaattattgttgatgatggaagttcagcagagaaacagagtccatggaacctagcaactgtaactaaggttgaagaaatgaagcttattatcaacattatccccatttgggtatccaccataccatttggtatgtgtgtagcacaaacagctacattcttcgtaaaacaaggtacccagttgaacagaaagataggtaacgggtttgagattcctccagcttcaatcttcactgttgctgccttgggaatggtagtttctgtggccatatacgacaaaattcttgtgcctgtgttaagaaggctaacacaaaacgagagaggaattaacattcttcagaggattggctttggaatgctcttctctattgctacaatgatagtagcagctttggtagagaaaaagaggcttgaagctgttgagagggatccctttaagggttcactaacaatgagtgtgttctggttggcaccacagtttcttattattggctttggtgatggtttcactcttgtgggtttgcaagagtacttttatgaccaagtccctgactcaatgagaagcctaggcatagcattttaccttagtgtaattggtgcagcgagtttcctaagtagtatgctgataacagttgttgatcacatgactaagaagagtgggaagagttggtttggtaaggatttgaatagtagtcgattggacaaattctattggctattggcagccatagccacggtgaatttgttcttgtttgtgtttgttgcacgtcgatattcctacaaaaatgtgcaaaagttagcagtggctgattgctatgaaggcaaaagtgattgtgagggtgcggaaactaaggtttag

SEQ ID NO: 67284 - DNA, 459 bp, Glycine max
  Peptide Sequence Number=SeqID_184062
atggaagatattttgagtagtatgcttagacaacaaaggcttcttagtaatcaattagagatgttgtttgagcatcctgaaatcatgcaattaggggccagtcatccacaagctatcaattgcgatttttatggaggagagcattcgatgatagttgtcatctttactccatggaaaattcttggtggggagcaagagttacacttttacaaacaatatgaagaagaaacactctctaatcttgagaatgtgttgatggaagaaaattttgtagaggttaaagcacatgaggatagtcttgtagaagagcatgattcaagagaaaaagaggaagaaaaaaaaaagagaaaggccttagatattcttcatcaatggagtcctttgcttcttgaagagcaatggcagcggaatggacatgaaagaaatattattggagatgccacttcaaggataagatga

SEQ ID NO: 67285 - DNA, 192 bp, Glycine max
  Peptide Sequence Number=SeqID_184063
atgactctcgggcaaataacatattgtggccataaaacatatgaacccaagtccttaatttctctcaagtgcttgatagccaaagaaattacatggcttatcaggaaaccatcaatccttagctccaaaatagcatcgactataggcacagtagtccttacaatatcgagctccaatatcattatgctttag

SEQ ID NO: 67286 - DNA, 177 bp, Glycine max
  Peptide Sequence Number=SeqID_184064
gaggcttgccatgcgatcgctgaaaggttggagcgtcatctcaacctagggatagtcacaccaggcacagagatacatgaggtcatcgaacaatgcctcaggattgccaggggtgtcacagaagaccgcattgtgtatgtgaggtctcgatgtaggcggcgcacggatcaaccatag

SEQ ID NO: 67287 - DNA, 126 bp, Glycine max
  Peptide Sequence Number=SeqID_184065
atggatggagttactggagaatgtactcagtcaagggatttgtttgccaagaggagacaattttctgaacttagtatgtgctcatggattaacccatctgagatattggagaacacattgggatag

SEQ ID NO: 67288 - DNA, 792 bp, Glycine max
  Peptide Sequence Number=SeqID_184066
atgtgtgtagaaaaaggtccagttgcatttaatcatgagcaatataatgggagccttcccactttgatcttgaggccacaatcatggacaaagtgtataatggttgatgaagatgcacagaaaaaagtcctctcaaaactcatagtcatcatgaatgtaggagcagaaagaaaagtcaagaaagtgaaatcttgtttctctcttcttttaagaatcaaagcgcaccggaaaaaagtctcaatatggagaaaggcgtgtgaaaagtctaggcaccttgaaatggtcttgacagatggaagggaggtcaaatttcagcttcctaatgggaatgctgcaagagtagattttaaccttaaagatttgaagaagtatgtgtgcttcaatttttgtcatgccagggttaaaccgccacaaggtatgctttcatgtctttggtatgttacacctattcatggattaaccatctctaactcactgtatggatcaaagttgctcatcaattatgaagttcttaatttttccatctacaaagagaggttgagttttgcatgtttgggtgaaccatcaaatggatctgacttttcagagcttgatcgctttttgtacaagtccaaggttctcaatctttcacgcatttgtgatgctgctgatggtgtagctgagattactaagccatcatgttataaaactcaagcaagtcaattagagttatctcaaattaaagatctcagacggtttgatcaaagtttacctcacatcaagccagagtttacctacatatatcaactttaa

SEQ ID NO: 67289 - DNA, 495 bp, Glycine max
  Peptide Sequence Number=SeqID_184067
atgcaagggctagaacgaacaacttgtcaatatcgaaaaacaaggcctgaaacatgttcaggagaagacgacgaagctgctagaataggtccggtgaactttcggcgactggagggcgacgcgtggccttcacacgccgaagttggcacgagactgtggcgccgcgtgacagcgcgtggaagggactttggccacgcgacttccaaggcgatcgcccacggcaacgcgaacggcggcgacaagcacggcgtgaatgacggcaacgcgaacggagaagacgacccagccagaaccgcgactgcgacttatactgaaatactggtaaatgctgggaatggccagaaatgcaaatatgtcttggagacgatgaaaagtcagaaaatggggcaaaatggggctttaccctccaggtgtaatagcagtgtgcgaatggcagcaatttgggctgcagattgcaatgtgacacacatgattttaaagtgctccacaaactga

SEQ ID NO: 67290 - DNA, 369 bp, Glycine max
  Peptide Sequence Number=SeqID_184068
atgaaaaaactacaatctgctttgcaagtgatgcaacttcagtttaaagaaaccaagttgttagttcaaaaggagcgtgaggctgcaaaaagagaagctgagagagcgcctgtcatacaggaggttcctgttgttgaccatgctttgttggagaagttcactagtgaaaatgagaaactcaagggagaccagtcagggtcacgatgttttgcaagaatgctccaaccatatgggatcaacataggcttaaaggagcactcaaacccggtgacccccaaggcctacactccgaagagttcgtcagggcctctccctcctgattcaggtccaacccctaaaatcattttagcacacaaacactgctcgtga

SEQ ID NO: 67291 - DNA, 384 bp, Glycine max
  Peptide Sequence Number=SeqID_184069
atgggcaaccggaaagttctttgccggaaaataagtggcaacctgaaggcagtggccggaaaacacgctgaaaaagacggcggcagaatgggagactggaaagttcttcgcagcaacgcaaaacacatcaaaaaatggactgtagggtgcccaaaatcgcaaaccaagcagtacttagaagaaggggcgacttcagcagtagaagcgcaacccaagacagtgcaccgtgcgttagagaaatcggtggacgacaatgctgatggtggggtcaccggccagaaaggtcatcagagctccagcggcagacaacagagaatggcagtggctgccggaaaaggggggaaatcaccgaaaagaggggcagcaagcagaaaggtcaactag

SEQ ID NO: 67292 - DNA, 843 bp, Glycine max
  Peptide Sequence Number=SeqID_184070
atggctgaggagggttttgagcactaccatgtcccacaacaaagtagaaggaacaagctgagagttttccctgagcaccaaccttattgtttcgttgaatcttcctccacttgccctactttagcctctctctacgatccttcgcttattattccttctgatttgttagcttgtgccacccaacaaggtggtggtggtgctgctgctaaggaacaagaaggttccaatttgatgatggggtttgttaaaggagcggttgtgaatggtgatgcaattcaagtcatcatcaacaacaacaaccctttataccagcttcagaaccttagggaatatggtgacacctacaatgatgggagtgaaatgatggtgttcaagcctgagcctttgtctttgtccttgtcttcccacagtaacagcactcatcattaccctctggaactgaatcttcagcgatatggggctgttaatccgggtttggttggaggtaacagtgaggtttcgaggaattctgttccacttggaccctttacggggtatgcttcgatattgaagggatcgaggttcttgaaacccgcacagcaattattggaagagttatgtgatgttggggttcgtggaatttacaccaccgagaagattattgctcctgatgcatcgttgatggaacctcctcgtgagggttttagtgctagtgaagttgttggtggggatgatccacttggggaatatcaaaattatggtaggatgaagaagtgtagactattaaccatgcttgacgagataaattttgtgcaggagtggattcttgattttagtttgtcagggttttctttctggccttaa

SEQ ID NO: 67293 - DNA, 297 bp, Glycine max
  Peptide Sequence Number=SeqID_184071
atgccaaaaatgctccttcccatatcttcttctttaaaaagctgggtgcaaagtgagctttcggtgaaggtgaaggggacagtgttcattgttgcggtggtttgttcgacgtcggcgacaaacgagatggacgaagatcaatggatgtatgacagtataatgtctgaagaagtttatatggattatcaaactgaagaagaatgtggtgtgaatgaaccacatgttgattgttcatatgcattcaatacttctcaggtgttcatgattgtgtttgacagccgagacgatgttttgtag

SEQ ID NO: 67294 - DNA, 828 bp, Glycine max
  Peptide Sequence Number=SeqID_184072
atgtcgaaaccatttagatgcttgaagaatgctattactgaccagcttcagttcatcaacaaggctccttttcagataagcaacagaaaggatgaatctccaaggttccacagcagtgataggggcactcacagccaaaggccagggtttcttgagcaccagcaaccagtttggcgacctcaaagaggactccctgagcgagctgtgagtgttctccgagcctggttgtttgaacactttctgcacccttatcctactgatactgacaagttaatgttggctaaacaaaccggtctatctcgcaaccaggtgtctaattggtttattaatgcaagagtaaggctttggaaaccaatggtggaggaaatacatatgctagaatcacaacaaggtcaaaagaggtcacattgggaagaaagaagtaagaaaaacctaagtgatcatttaccttcagatcacaactctgttgttactgagaatccatccacctccatggagaagtttcatgatgccccttataaacaccctagaaatgaacttgctaacaagcaagtgaggagtcaggagcagctgaatcagaccaacacaggcaatcagcaagtcatgggtgttggagtgagcaataatggggtgtctctcacacttggtcttcaccaaaatcatcacggtattgggttgtttgagccctttggaatgagtgcagctcaacgttttggcgttgcccttcagcctgagggctatgttcttagtagttttgaatcacaaaatcgacattttggaagagatgttattggaggagggcaattgttgcatgattttgcatgctga

SEQ ID NO: 67295 - DNA, 1374 bp, Glycine max
  Peptide Sequence Number=SeqID_184073
gccttaagggagctatgcttacagaacaaagcacctgatcctcactattcagttcaggatcaactactgtattggaagggcaggaccttgtctagaatagcctcgcaattctattggaaaggtatgcataaagatgtaaaggaattcgtgcaacaatgtttaacttgtcaacaagctaaaagtggcactatgctgccatcaaggttattacaacctctccctattcctatgcaaatttgggaagacctagcaatggatttcatcatcggacttcctccttctaatggcttcacagtgatattagtggtgatagatagactatctaagtatgcccattttttcactcttaagtctgattataatagtaaacaagttgctgaagtgtttgtcaaaaacatagtcaaattgcatggttttcccaagtcaattgtatcagacagagacaaggctttcactagtcagttttggcagcaaatgttcaaactcagtggcactacaatcaacttaacaattgcttaccacccccaatcagatgatcaatctaaagccttaaacaaatgccttgaaatgtacctgagatgctttacccatgattcccctaaggagtgggccaaattactgccttgggtggaattttggtacaacactgcctaccataatagcagtggcatgacaccttttaaagtagtggacctcacactgagtaaactcaaacagaatctaatcaaagctcaggcacacatgaaaaaatatgcagatatgaaaaggaggcaggtagagttcaacatgggtgatttagttttggtaaagttacagccttacagacaacactcagttgctttaaggaagaatcaaatgcttcctcctacaaccaagatacacccagtgtttcatgcttctcaacttaagccatgtaaaggagaccatcctcagtcgtatattccgttgccaattacaaatgatgaggtagatttagtgatccaaccagcaaggtttttgaaagaaagagttgtaattaaaggacaacaacaggtgcagcagaagttggtgcaatggcaaggatttgaagagaatcaagcaacttgggaggataatgcagctctgcagcaagctttttctgatcttaaccttgaggacaaggttcattttaaagggggaggcattgtaacaatgaaaggaagggcagaaaggacattggacaaggaagagggtgaagagcatgtgatggaagaagcaagggaattaaggagaggggcccgacccaaaataccaaattccaaattgaaggatttctattggcacaaggagagaatgatggcggtgggtggtgacgccgctgctgaaggcaatggagtggtcgttggaaataagtga

SEQ ID NO: 67296 - DNA, 270 bp, Glycine max
  Peptide Sequence Number=SeqID_184074
atgtccatcacatgccagaaaccacaaccatcattggcatccacaagaggcatgcgccacaaccatgagtcacataacaccaccatggcatccattgataaccaattactctggtatcgaagaaacaacaaaattggattgggtgaatcaacaagactgaccgaggagggtagcaatgatgactctagaaatggtgaagacaacgatagggttgcaaaggtagtcaataaagagtcaaaggccgaaaaggaggcatgcgaggaaccatga

SEQ ID NO: 67297 - DNA, 138 bp, Glycine max
  Peptide Sequence Number=SeqID_184075
atgcctatgaataagattaacctaagtcatcgagtatgtgatgtctcaatggggtaccaagaggatgtgttggctgcacaggtatggaactgtggcagtgatagagatatacttactaccatcacttcccaaggatga

SEQ ID NO: 67298 - DNA, 1722 bp, Glycine max
  Peptide Sequence Number=SeqID_184076
atgaagctattctcgttttctctagcatgtgtttttgtttttgcccttctagcttcttccctggcttcagcagctatcgtggaacacattttcaaagttcaaaacacgactatcaaacgtttttgcaaggagcaagtgattgtgacagttaatggacttttcccagggccaacgataaatgtccacgaaggtggcactgtaattgtccatgtattgaacgagggaccgtatgatatcactcttcattggcatggagtgttacagctctttagtccttgggcagacggtcctgaatatataactcaatgtacaattagacccagaagtaaatacacatataaattcaacgtgacacaacaagaaggaacagtatggtggcatgctcatgcatcatatttacgagcaacagttcatggtgctttcatcattaagcctcgttcaggccgatttccatttcctaaaccgtacaagcaaattcctcttatattaggagatttgtataattctagagttgaggatattactaccgaagcacaggccagtggcggaggaccaaacatatcttacgcctttacaatcaatggtttgactagcggccatctcatgaattgtactgaaaatgagacatttaagatgaaagttaagcaagggaagatctacatgctccgaatgatcaacgctgcactcaattacgacctattcttcaagatagcgaaccacaatttcacagttgttgccgtcgatgcctcctacaccgaccactacgtctccgacctcatcgtcattgcccctggccagagtgttgacgtgttattcacagcgaatcaacccactggctcgtactacatggttgcatctccttacgttgttggtctcgaagacttcgacgccaacgtagctcgcggcacggtcatttacgaaaatgccccgccatcgtcaaagcccataatgccagttctaccccccttcaacgacacggacacggcttatactaaattctacaatgtcataactagcaaagtgagggccccacactgggttcctgtgccacgtaaggtggatgagcacatgttcattaccattgggttcaacctagaattgtgtgattccaagaatcccaacaacgccacgtgtaagggtccaaatggtcacagattttctgccagcatgaacaatgagtcattttctgttcccgcgggtgtgaagctttctttgttggaagcattctataaaaacaagagcagtgtttacactagggatttccctgacaagcctccggttatgtttgacttcacgaatctgaacgacgctaacaatacgaaccttctatttgcgccaaaatcaaccagggctaagaagctcaggttcaattcaacggtggaggttgtgtttcagaatacagcacttcttgggggccaaaaccaccccatgcacattcatgggtatagcttccatgttttggctcaagggttcgggaatttcaacaggaaggatagggctaagtttaatttggtgaatccgcaattacgcaacactgttggtgtgcctatgggaggatggactgtcatcaggttccaagcaaacaatccaggggtttggcttgtgcattgccatatggaagaccatgttccgtggggactagccatgatttttgaggttgagaacggaccaactcctttaacttcagtccctccaccaccagctgatcttcctaaatgttaa

SEQ ID NO: 67299 - DNA, 569 bp, Glycine max
  Peptide Sequence Number=SeqID_184077
atggttgaatttgttgggttgattaaggttaatgtggttaaaggcactcacctagccattcgagatgtaatgactagtgacccttatgtcatcctttctttgggtcaccaatcagtaaaaacacgtgtcataaagagcaatttgaatccggtctggaatgaaagcctaatgctatcaattccagagaacattcctcctctaaaagtgcttgtgtatgacaaagatacattttcaactgatgattttatgggggaggctgaaatagacattcaacctctagttattgccgcaaaggcctacgagaaattgaatatcaatgagtccatgcagcttggaaaatttgtagcaagcaaggacaacacccttgttagggatggtatcatatctcttgatgaagggaagatcaaacaagaaatctcattgaggctacagaatattgagaggggtgagctagagcttgagcttgagtatgataatggtaaggagtacacttcaacacaattccccatgctttgtgaggaagcaggcattgagcaattaacagctccttacaccatcaacaaaatagg

SEQ ID NO: 67300 - DNA, 249 bp, Glycine max
  Peptide Sequence Number=SeqID_184078
atgcatatgatgattgatggatgccgtgacaactttttctttttggttgagacggatggcctgggcccctcacatgaaaggaaggatcctagagagaggcatcgaaggctaactgtgtcagcacgtggccatcaacatccacctatagagccaaagctagagccaaagccacaaacagtgacacgtgcatatgataggatcattgtacctccatttggaagaggtccagttgatgtgtcattgatctga

SEQ ID NO: 67301 - DNA, 489 bp, Glycine max
  Peptide Sequence Number=SeqID_184079
atgaaaaacgggtgttacacaagtgaaggaaatgggttttgtcctttgaagttgcaatttgttaaagccgttcatgtgaagctgtgtgtgagcagggctacgtgggcgtggaaggagggtgtgtataggaagtgggttggagtgatgatgatgtttttgcagcgtttagattgcatcccttatgtatgtctctctcgtaagggaagattgaagagtgtcatgagttttttggtgaatgagctgggctttgaggcttctcatgttgctaggtgttcggtggtgttgtccttaagctttgggaaacagattgttccgagggggtctgttgttcttgttttgaagtcaaaaggaatggtaaaggtgagcttgggtgggatatttaagtgtgatgaaaagttgttcttggataagtttatatatggtcatgatgagaaacaaactgaggagttattgaagttgtataaggataaaatgactcttgcagggtga

SEQ ID NO: 67302 - DNA, 300 bp, Glycine max
  Peptide Sequence Number=SeqID_184080
atgtcctcttgtacatttactatccatcccaatgtagctaccgcttgggcagccactggcagagtatgtaccaagtggagactacatttgctagatagtgctaggcgcaatgcagagcttgttgaacctcaaagctatactagagggcacaagtcatcatcagaccatataacaagctctccaattgctgcaggagggcttcgaagctgggtgcagcttagaaaggcaaaggaagatggctgccaagggcaacaggaagggtggcagaggcagatttttattgttttgacatttttttag

SEQ ID NO: 67303 - DNA, 927 bp, Glycine max
  Peptide Sequence Number=SeqID_184081
atgtcttgcatgcagcttgaggagcaagttgctgaggttcaaaagtactacagtaccatcaatgatcaagttaataatgccaaagacaaaagccaggagaagcatgttattggcaccaaaaggtcacgacaaggtggatcaagtaaggaagctaattcttcaaacacaatgaaagagataactcagcatagatgggcttggcccttcatggatcctgtagatgttgaaggtcttgggctgagtgactattatcagattatcgaaaagcctatggatttcggtacgataaaaaggaaaatggatgctaaggatggttctggttataagaacgtgcgtcagatatattctgatgtcaccctggtttttaagaatgcaatgaaatacaatgatgaaaaaactgatatccacattatggccaagacattgcgggaaaaatttgagaagaaatggctgcagctattacctaaagttgctcaggcggaaagtgaaaaggaagaagcacgtgcactgttgaaagcgaagcttgctgaagaagctgcttatgccaatatgacaaaggatataagacatgcgctgtgcgatgttgatgagcagttaaagaatctcaaagaaatggtgattaagaagtgcaggaaactatcaactcatgagaaactggcacttaagaaaaatttaaacagactgaatggtgataatctcctcaaggcaatggccataattcatgagattgacccaaccttccaacatgatgctccacaggtcgaccttgaccttgattgtcagagtgacttcatactgtggaaactaaacatgtttgtcaaagaagcactggaagatcaggacaaagctgttgctgaggacatggctgttaaccacaatgttaacactcaggaccagaaaaacaccaacaaaaggaggaaactgtga

SEQ ID NO: 67304 - DNA, 1236 bp, Glycine max
  Peptide Sequence Number=SeqID_184082
atgaaggagtcagagacaatcaatgagtacacaaatatgcttcttagcattgctaaccaaataaggctgcttggttctgaattttttgattctagaatcgttcaaaaaatacttgtaacctttcctgaaagatttgatgctactatatttgtcatggaaaatagcaaagatctatcaaaaatcaccttgacagaactacacaatgccttacaggctcaagaacaaaggaaactgatgaggagtgaagattctatggaaggagcattgcaagctaacttacaaactggtgaaaagaatagggactttcctccttgcaaacattgtaacaagaagggtcatcctcctttcaaatgttggagaagacctgatgtaaagtgtgggaagtgcaataaacttggccaccatgaaagaatatgcaaaagcaattctcaacagaagaacgatgcccaagcagtaagcaaacaagaggaagagcagcaactgttcgtagcatcatgttttacaagcagcagttcaagctctagtgattgttggcttgtagacagtggttgtactaatcacatgaccaataatgaagaactctttagatatttggacaattcacaagtatccaaagtcagaattggcaatggtgattacattactgtcaaagggaaaggaactgttattatagaaagtagcacagttgggcagctacttgagaagggattcaaagtcttctttgagaacaagcagtgcacgatcaaggatccgtatgacaatgaggtcataagaattaaaatgagaggcaagagtttctcacttgacctaatgaaggaggaacaagcagcttatacggctgctatgaccaacacagagacttggcataagaggttaggtcattttcatcacacgacaattttgaatatgcaaaagaaggagttagttcgtggcttgccccatattgagttgaatctaccaagttgtaaggcatgtcattttggtaaacaagcaaagcttccttttcaaaagaaagcttggagagctaacatgaagctgcaactcatacatacagatgttgtcggacctcataaggctccttcactaaataggagtaaatattacattgtttttattgacaattatacacggatgtgttggatctattttcttatgttcaagtcaaaggttgtaggtgtgttcttcaaattcaagaactggattgagaaccaaagtggcttgagaattaagttttga

SEQ ID NO: 67305 - DNA, 1096 bp, Glycine max
  Peptide Sequence Number=SeqID_184083
atggagatggttagatgtatgcttcctgagaaggaacttcccaaagaatattgggcggaggcaacaattgttgtatttttgttgaatagacttcccacaaaagtagttgatggaaatactccttttgaggcctgtggagttggaacgatgaaaaaaaatcagcaaactgatgatttgaatcaagaagggttagttgatcattctcctgttcgcaacactagattaattgctgacatatatcagaggtgcaatgttgctatgcttgaaccagcaggatatcaggaagcagaaaaagatcctaaatggaaggatgctatttgcaaggctagatacaatcagaatgttactagccattgcagcacaaatcaatggaagatttatcagcttgatgtcaagtcagccttcttaaatggcttcctaaaggaagaaatttatgttgagcaacctgaaggctttgatgcaaaaggagatgaagacaaggtgtatctattaaagaaggcacttgagtctactttatatgttaaaggtgacagtgataatttttttgtggtatccttatatgtggatgatctcttagtcactggcaacaacattgagcttattcaacaattcaaagaagacatgatgcaagtctttgaaatgattgatcttagagaaatgtcttatttcctcgtaatagaaatcaagcaaatagaaaatgaaatattcatttatcaacaaaagtatgtaaaggagattttaaagaagttccgcatgggtaactgtaagagtaagaacactcctatgtgtcaaaaagaaaagttgtgcaaggatgatggaacaactaaagtggatgagtttgaatatagaagtttggttggctgcttgatgtatctaacaactacaaggtcagatattatgaatgttgtaaactttctttcaagatttatgaattgtgctaatgagtctcatcttagagctgctaaaagagttttcaaatatgttaagggatctgtaagcttcggtgttaagttttgcctaacaccaagctttgagttgcaaggttattttaatagtgattgggttgggtctttagatgacatgaagaacactcctg

SEQ ID NO: 67306 - DNA, 2601 bp, Glycine max
  Peptide Sequence Number=SeqID_184084
atggaagcatacggtggtttcatgattgacgagaaagccgttagggttgagaacgctttccttgatttcctcaaaagcggaattagcagcttcaagtccagtagccatcggaacgaactttattacgaagcggagatcgaattgatgaagagcaatgactccaacaccatgttcgtcgatttcgaccacgtcatcagattcagcgacctcctccagcaaaccatttccgatgaatacttgagatttgaaccttatttgaagaacgcctgcaagcggttagttatggatctcaagccgtcaattgtatccgacgatagtcctgacaaggacatcaacattgccttctataacatgcccatcgttaaaaggttaagggaattgggtacatcagagatcggaaggcttgtgtctgtgacaggagtggtgacgaggacgagtgaggttcgacctgagcttctccaaggaactttcaagtgcctagagtgcggtggtgttataaagaatgttgaacagcaattcaagtatactgagccaacaatctgcacaaatgctacctgtagcaatcgaacaaggtgggtactgctgcgccaggagagcaaatttgctgattggcagagggtcagaatgcaggagacgtccaaagagatacctgcaggctcccttcctaggtcattggatgttattcttcgtcatgagatcgtggaacaggccagggctggcgacacggtgattttcacaggtactgtagttgctatacctgacataatggcattggcatctccgggagagagatcagagtgccgccgtgatgcttctcaacgcaggggttctacggctggaaatgagggtgtgagtggtcttaaggctctgggagtcagagacctcaactatcgtctagcttttatcgccaactctgttcagatttgtgatggtagaagagaaatagacatcaggaacagaaagaaggatgctgatgatgacaatcaacagtttactgatcaggaactggaagaaattaaacgaatgaggagcactccagattttttcaccaaacttgtcgaaagcattgctccaactgtttttggtcatccagatattaagagagctatccttcttatgcttttgggtggtgttcacaaatttactcatgaaggcatcaacctcagaggagacataaacgtttgtgttgttggagatcccagctgtgcaaaatctcaatttcttaagtatacttcaggcatagttccaagatctgtgtatacatctgggaaatcatcatctgctgctggcttgactgcaactgttgccaaggaaccagaaactggggagttttgtattgaggctggtgctttgatgcttgcagacaatggcatttgctgcattgatgaatttgacaagatggacatcagagatcaggttgcaattcatgaggcaatggaacagcagactattagtatcacaaaagcaggaatacaagcaacacttaatgctcgtacttccattcttgctgctgccaatcctgctgggggacgctatgataaatctaaaccacttaagtacaatgtggccctcccaccagctatactttcaaggtttgatcttgtatatgttatgattgatgacccagacgatcagacagactaccacatagctcatcatattgtgagagttcatcaaaagcgtgaaggtgctcttgctccagcattcactacagcagaactgaagcgttatatagcttatgcaaaaattcttaaaccaaagctttcgccagatgccagaaaactattggtagactcttacgttgctctccgtagaggtgatacaaatcctgggagtagggttgcatatcgtatgacagttaggcagttggaggcattaatcagattgtcagaggccattgcacggtgtcatttggacaatgaggtacaacctcgtcatgttcgtctagcagtaaaactgctgaaaacttccatcataagtgtggagtccagtgagattgatctgtctgagtttcaagaagaaaaccatgatgatggtgcaggtggtggcgatggaaatgataaaaatcgagatgctaatgaccaagtggggaatgatgcagcagctcagcaagctgccggaaatgctaatgatcaagtgggaaacgatgcaactcagcaaactgctaatgatcaagtgggaaatgatgcagctcagcaacctgctggaaataatggaaattcagcagatggatctaaaccccaagtgagaaaactcgttatgagtgatgaatattatcagagagttaccagcgcccttatcatgcgactaagacagcatgaagaggctgttgtgcaaggaaacggtttgtctgggatgaggcaaaaagatttgattcaatggtacgtagaccaacaaaatgagagaaacaactacagttcgatggaggaggtgcaagctgaaatttccaaaattaaagctattatagagagcttaattcggagagagggccatttgatagtggtagatgatgggcaagcagcagccgcagcagcagaacccccaggcgcaccaagaaattaccgaattttagcagtggctcctaattatgtcattgattga

SEQ ID NO: 67307 - DNA, 117 bp, Glycine max
  Peptide Sequence Number=SeqID_184085
atggatccaacatttggtgtatctgctccaaatcctaatgtcatagaggaggatttgaatcaactttggcaatccgtctatgaaaattccaatagggttcaaaaggattatgactag

SEQ ID NO: 67308 - DNA, 1206 bp, Glycine max
  Peptide Sequence Number=SeqID_184086
atggctcttagcatcaagaacagtgaaattgaatttgttgatcatgaaggtggagaagcattagcacatgcagatctagtttccaccatggacaacacaacaatgcaggagcgtgcagatcaaaagggtatcattagcactagcaagaggtacatcaacatcaacatgccccttttggtgattaactatgcatgtctctttgtgggttcactttcttctagtttgctatctaagtactatttcacccacaagggttcaagtagatgggtttcaacttgggttcaaaccgcaggatttcctcttttgatgatcccaatttgtgttccttatctctttaaattcaccaagagggtacccttcactgatttcacaccaagaatgttgattatctcaatttcaatcggtgttatgttaggattcaacaaccttttcttctcatggggaaactcctaccttcccgtttcaacctcagcacttttgctatcttcccaactactcttcaaccttctcttctctgtcataatagtgaagcaaaaaataaccttttcaaacgtgaattgtgtgatccttctcaccctaagctccatcctcctaggcttggactctagtcacgagagaccaaaagggctaaatcaaaagaactacttcattggattcttttgcaccataggcgcaggcttgatgtttgccttgtatttgccactaatggagaagatttacaagaaggtgaattgctaccaaatggtgatggaaatgcaagtgataatggaggctgcagcaacagcattggccataattggcatgacatgggatggtggattctctgagatgaaggtagagagccaaacggtgtttgacaaaggaagcagagtttattgggtgacagtgatgggaaatgtggtgacttggcagctatgtttcatgggaactgcaggaatggtattcctgacatcttcattgactgggggcatttccatgacatttttgttgtcaatgaatgtcttgggaggggttgtggtcttcagagatgcatttggtggtgtcaaggctgtgtccacttttctctgcatttgggggttctgctcttatgtctatggcatctacaagtacaaccaaatgggggaacacaaatttgctcaaaccaggaacaagaatattagtagtaatgattcatccactgagatgatccacattttgaaacattga

SEQ ID NO: 67309 - DNA, 468 bp, Glycine max
  Peptide Sequence Number=SeqID_184087
atgatcggtaatcgatacggcacgcttgcagcatatgatctctccacctggaatagcctctttttgacccaacttagcgctcccagaattttgagcagccatcttactgatgttgttgcatcatttgatcatgatcttcgcttcctcgtgacacaaggtgttatcctttggtctattcccctgttgtcataccctaattttgtctggggacaattgtttgtcaacatgcggacctttgctgaccaaattgaggtgcttaagactcatcgccgcgtaactcgtaaagttcgcgacgtttcagaaggaaataagccaaaaacacaaaaatgggggagtgaactgatcaatttagggggggtgcctagccctgggcctatctggaatattctaaagggaggttacttcaggtggaagctaagctcgcctgggcgagctgggcggcaaccacctctctcatttttgctataa

SEQ ID NO: 67310 - DNA, 594 bp, Glycine max
  Peptide Sequence Number=SeqID_184088
atgcgatctatttcctcttccgcattcaatgaccttgatgctgtttccgaaccctatgacgaagccttcaaaggggtcatgaaactacaccgtgggaaggtggtcaaaggagaagagggtgccgttgccgagcctcttagtgaggaggcattgactggtggaagtggtggtggctggtgcgactactccattttggaaattctagaggagaagtcgaagaggaagagggagaaaattgagaagtgcactggtgctgctgaggaagtgccttcttcaacagatgttgaggttcagaaggctgatctgatggaaaaggatcaaacttctgccgaggaagtgcatccttcaacaactattaaggttagggaatgcgattctgtggagttgcaaaagttggttgaggattctctagttaattcattggaagtgaatgaggaggcatcgattgaaagtagagatgcagatgtaccttgcccacatgttactaataacaatgaggctgatctaatagaaaaggatcaaacttttgtccctcataatgatgaccataggccaagtttaatggaaagaaatagcactgctcatatttacgag

SEQ ID NO: 67311 - DNA, 288 bp, Glycine max
  Peptide Sequence Number=SeqID_184089
atggtggatcctcttacacaccaagtgaagctatgtgattttggaagtgcaaaagttctaccattattccctagcaaaaatgcagtagaccagcttgtacatattataaaggtgcttggcacacccacccaagaggaagtatgttgtatgaatcccaattacaatgactttaggtttccacagataaaagcacacccatggcacaagttaaggcacggaataattgaagagctagcacatagatatagcaatgcattagctccgaagggaatccgcaaattgctatag

SEQ ID NO: 67312 - DNA, 615 bp, Glycine max
  Peptide Sequence Number=SeqID_184090
atgagctccatcattctagccttgaactctagtcacgagaagcctcaagggctaacccaaaaggactacttcatagggttctcttgcaccataggtgcaggcttgttgttttccttgtacttgccactgatggagaagatctacgagagggtttactgctacggaatggtgatggagatgcagctcgtaatggagatcgcggcgacggtgctggccaccggaggaatggtgtacaaaggagggttttctgagatgaaggaagaggctgatagggttttcgacaagggaaacactttttactgggtgacggttgtgttgagtgttgtgacgtggcagtgttgcttcatgggaactgcagggatggtctttctcacgtcttcattgactggaggggtttctgctactgctttgttatccatgaatgtgttggcagggtggttggtgtaccatgatgccttcaaaggttttaagattgtggctactgttttgtgcatttggggtttctgttcttatgtctatggcatgtacatcaaaagggagcaagaggaggaggctaaaaggaggaacagcagtggtggaactaccacagagttgatccctaacgggaatcgtatg

SEQ ID NO: 67313 - DNA, 162 bp, Glycine max
  Peptide Sequence Number=SeqID_184091
atgcagagtctcgaagctgtggaatgcgcctataataggaagatgaagcagagaggtcacatcatccagggtgatggtttactctccaacatgaagatggaaattgctagtttccttatgccacctctctacaaaagcggatataagtccccgatcgccagt

SEQ ID NO: 67314 - DNA, 315 bp, Glycine max
  Peptide Sequence Number=SeqID_184092
atgtattcatacattcacaaaaaggcacaaggaaaagttgcaaaatttgatttccatgggcagctagcagagctcaagcatggtagtgttgtgattgtagcaatcacaagttgtacaaatacatcaaacccaagtgtaatggttggtgctggtcttgttgcaaaaaaggctcatgagcttggtttgcaggtatgtgaccccagtggtcgctggtatctagcagacagtgggtctgtgcctggagatcttttacttataacaggcaaggcacttacccatatctttttgagttatgaaatttacacacttatttaa

SEQ ID NO: 67315 - DNA, 246 bp, Glycine max
  Peptide Sequence Number=SeqID_184093
atgtcgacaatgaacggaggagaagaagctcgaatgaaacaacgaagaaggagctccaatggcacagcgaaagcaaatgaaactgcgacacagggaagaagagggaagaagatgctctcattttcatctacactaagcattgatagaaaaatttcaaaaatacctttccgtaaggctcacacggattcgcagtccggattggcaatccgtaatctgtatgaacatacaaattacctattcgtatga

SEQ ID NO: 67316 - DNA, 183 bp, Glycine max
  Peptide Sequence Number=SeqID_184094
atggttattgactccattctgacatctcctcgtctcaagtctccatctttcaggaggcagtttaaaaaggatgaactgggggctagtggcacctgttctggtttgagtggagcgcagaaagcttcatgccatatggagcttgttaaggattctgtggccaagggtaaactgaaaattctttga

SEQ ID NO: 67317 - DNA, 363 bp, Glycine max
  Peptide Sequence Number=SeqID_184095
atggcaatgataggaggcattagccaagtggagggaagccaaaacagtgctaccatcgataggctcgctcattttgctgttgatgagcataataagaaagagaatgcagttctggaatttgtgaaggtggtaaatgtgaaacagcaagtggtttctggaatgctgtactatatcactctagaggccaaggatggagagaagaataaagtttatgagaccaaggtttgggtgaagccatggttggacttcaaggagatacaggaattcaagctcatcggtgatgccccttatgctgcacccagtgagtatgactgcatcctaactcctaaggtgttagcattatcaatgcacaaaattaattag

SEQ ID NO: 67318 - DNA, 2747 bp, Glycine max
  Peptide Sequence Number=SeqID_184096
gtttccctggtcctcgaaatccaggaactctttatcttgtgtatcattttggtgctctcgttgctatgcctgacccctctaatgttcctgcttccttagaagatgccattctcaagcttgcggctcaacaattgtccatgggtgagaccctacaaaaggtcacattccagctgaatgaaatacttcatcgtcttcctcccacgcttcccaacaccggccctggctcatctacccctgctttgtccccttcacccgcacaacatcacagaattaaaattgatgttcctcgatttgatgggagtgacccttctgggtggatctttaagatcacccagtattttgagtaccatgctaccccccgaggcagagaggcttaccattgttgcgttctatatggacgaccgtgctttggcctggttccaatggatgaacggaaatggccgattcacgtcttggctggtctttcttcaagcggtccagacccggttcgctccttctcagtacgaggaccctaccggcgtcctattcaagcttacccaacgtggtacggtggcacaataccttgccgaattcgaggaattagcgaaccgcatcatatgccttcctccacccttcctgctaagctgcttcgtgtcggggttgtcgccgaacattcaccgcgaggtccaggcccactagccactgacactcgtacaggcggtgggtctcgctcgacttcaggaggggaagctcctcgatggccgcaacacctcccgcaatcgccaccctcaacccacaaaaactcaccctcagcccacaccaacccacctctcccctttttcccccacacagaaccacatttcccccactcccctgcgttcgataccaaccccacccttgctaccaccacccacgcgtcacaacccttctcctgtgaaacgcctcaccccggaagaaattgcctctcgccgggagcgagggctttgctttgcgacgagaaataccacagagggcatcgctgcgcctctagggcatttcttctggtggctcccgagacgctgcgtttcatgggcttcactggagaccgacaggtcatcttgctggtggatgagttgggtctctccactcgcgataccaatcccctacgagttatggttggcaatggccaacaattggagtgcacgcgcgtatgtgaggatgtcaaggtggtcatccagaacactcagttcaccgttgacttgcacgttctgcccattgtcggtgctaacgtcgttttgggggtgcaatggttgaagtccctcgtccctgtcctcactgattataatactttatgcatgaagttcttccatgccgacacttttgtagaattaaaaggggacactgagaccactttgaacttcatctcctccacgcaattccatcagcccccttccatccaagatgatcctactccttctccccacattcaaactatccttgaccgttaccaccctttgtttcaaacacccaacacccttcctccgcaacgtgagacagaccaccgtatccatcttctaccacaagccacacctgtgaatgtccgcccctaccggtacccccatttccagaagcaggaaattgagaaacaagttgaaattatgctacaaaagggccttatacaacctagtaatagccccttttcatcgccggtcttgcccgtcaagaaacaagatggatcatggagattctgcgtggattatagggcgctcaatgctctcaccattaaagacaggttcccgatacctaccgttgacgaattgttggacgaattagggggtgctcattacttctcgaagctcgatttgcttcaagggtatcatcagatacgtatgtaccctgaagacatttcgaaaatcgcttttcgaactcatcacagacattacgaatttcgcgtaatgccgtttgggttatgtaatgccccttcatcatttcaggccacgatgaacgcgatattccggccatatccccgacgcttcattattgtcttctttgatgacagattggtctacaacgcatctatggcagaacatcttaaccaccttgaaattacttttcagaatcaagtcgaataccttggccatattgtgtcgtcagaaggggtgaaaccagtagcttctaaggtcgaggctatccttcaatggccaattcctcactcgattaaagcagttagaagctttttggggctcgcaggcttttataggcgcttcatcagaggttatgccaccatcgctgctcctttggttcatatcaccataaaagctcatttcctgtggacggacgcagcacaggatgcattcgagaaactaaaacaagctgtgtcgttggctcctgtgttatccttgccggattttgagcagccattcaccgtcgagactgacgcgtccggtgtggggatgagagctgtcttatctcagcaaggacaccccctagctttctttagcaagccttttcccccgaaactcctgagtgcatccacttatgtaagggaattgttttccgtcacgacggcggttaagaagtggaggcagtatttgttgggtcatcgtttcatcattgtcacggaccatagaagcttgaaagagttattaacacaagtgatacagaccccagagcagcacacgtatttagcgagattgatggggtatgactaccagataattcatcgttctggagctctgaaccaagctgccgatgctctctcgcgtatcccggatcatactccatcatag

SEQ ID NO: 67319 - DNA, 555 bp, Glycine max
  Peptide Sequence Number=SeqID_184097
atgtggagatatgctcatttcttgaagaagttacctcaatctcaattatatggagtatcagttcaatctcaagaagagatatactccttcctcaaaataaattatctcaattttaattatgtggaacaccgactcaatctcatgtggagatatactctccccttaaagaagttatctcaatctcatactgatacacaagataaagagttcctggatttcgaggaccagggaaacctccacacacgagatgaagaagaaggcttgatcccaagcacgatcctgcagcatcatcctcaggaacctcaggctcttaaacatagtctttcaggaagtatcatttggagtcaaccctttccattgcaccagcacctgccatgggtctgctggggtggccctcctataatcctggatagacaatggagagatgagaggttgatcgtgaaggaattggtccagcaactggaccggaatttcagactccgatgttccccggaattgcttcaacaccgaacaatgaaaaacagggtgaacacgagcgtttcccggcaactgtaa

SEQ ID NO: 67320 - DNA, 1305 bp, Glycine max
  Peptide Sequence Number=SeqID_184098
atggtaaccactgtggcttcttacaacgtcactccatatcaaccaactcccaatgatcctttatggctatcagatagcgaccaacttggggtcctaggccatgtagccaccatctacatttacaaagcaaaacccaacagcgacaccattgagaggttgagaaactctcttagcaagcttttagtgtactactacccagtagctgacaggttgagcttgacagaaagtggtcgaatggaagtgaattgcaacacaaagggagtgacgttgattgaagctgaaacaacaaaaacatttggtgattatggagacttttcagcgtcaggaggagattcccctactgctattgaattaacaaggttccttggtggtgaaggccttgccattggagttcttatctctcatcctttgactgatgcgactggcctgattcacttcatgaacagatgggcaaagctgactcgaggagaagaactaaaccctgatgaaatgccatttctcgatcgaacactactcaaattattaccaaatcaggcatcaacaccaagcgttaaactccaagagttgaagcctgcaccacaaacactaggaaaagagcagaaaaagagaagtgttgcattgctaaaactcacatcaagccagatagagaggctaaagaagaaggctaatgatcacccttcaaaagaagggtccagaccttatagcagatttgaagttgttgttgctcatatatggagatgtgcatctatggctcgtgctgaatctggtgagaattcaaaccaaccaattctagttcggtttagtgttaattttcgcaatagattgaaaccgcccctacctcagaattattttgggaatgctttggcaaaagtagcgacacctgaatgttatgagggagatatcatatcaaacccattaggattcactgctcaaaagataagggaaacatctcatgcaattactgaagactttttgaggtcacaattaaatgttggtttaggcaaatggcaattggacaacattagggcttttgtcgtgggacaacaacaccttataaatacgccctctgttggggatcataacatttttctcacaagcttgatgaccatggcagtgtatgaatcaaattttggttggggaaagcctgtgcattatggtttagcaagtctgtttcaggtaaatagggcaggaattcttccaagccctgatggagatggtgttattgttaacatatttttccaagaagcacttatgaagcttttcagaaagtttttctacgaggatttgtatgtatcctcattatag

SEQ ID NO: 67321 - DNA, 558 bp, Glycine max
  Peptide Sequence Number=SeqID_184099
atgttgagcaccttcaccatcaataacatcattgtcattgttgttatcattaagggactcaagagatgtgttaagtccaacatggggttcatggtgagcaatgatttgagctacaatgggagtaatcattttttcaacaatggtcatggcaatggtggcttgaatttctctcgtggaggttgcaatggtggtcgttgctatggaaatggtgatggccatggggacttcaatgaaggatccgttatgagattaacatcgagtcttgatatgaccgttgtctcacatctagagcgacttactggtggtggttgcgacaacgttggtggtggttgtggtagtggtgtcaatgacgatagtagtgacgatggcattgatggtggtgatggtggtagcaaggtcaatggtggtggtgatttcgatggcaacagtgacaatagtggtggtcacaacaatgacaatggtggtagtagcaatgcttttgatgatggtcatgacaatgacaatggtggtggtggtagtggttgtagtggtcatgatggtggtagtcaattattgtaa

SEQ ID NO: 67322 - DNA, 342 bp, Glycine max
  Peptide Sequence Number=SeqID_184100
atggtggtgaccaataatggcggatgcaatactgttgggaagggtcggagaggtgtcgacgacgaagatgagcagaaccttgcggtgattaaattggtggatctggtggctcaacacccatgcttgcccatcgtggtctgccatagcacgtgcgacgaccttgactctttatgctcctttctctccgctctcccctttctttcgtcctctactctagtctctcttaaactcattttcttccttgcgactaacggtggagcaccaaatgaggatgagcgatctcatatgatatttgtaactgatgcttgccttcctctctttgcttctggagaattcctttga

SEQ ID NO: 67323 - DNA, 153 bp, Glycine max
  Peptide Sequence Number=SeqID_184101
atgtacaaagataagtataaggataatttgacagattatgcacgtcgatcagacacctatgccaagagtcatgccaattacaagtttgaagagaaagcacaaggagctcaagcggaccttaaggggcaatcagtggatgccttgccaatctag

SEQ ID NO: 67324 - DNA, 222 bp, Glycine max
  Peptide Sequence Number=SeqID_184102
atgtttacccatgatcgcccaattaccttcatcattaggctcccactacaatgtcacaaccaccatatgcatcgtgcctccattgccatcatgctacaaccatcaacacaactcaattactacactgcaccaccaccactacttagttgccacagtttcactgcctccaccaacatgctgccaacatcactagctagctatcacattgccgaaaccacgaag

SEQ ID NO: 67325 - DNA, 450 bp, Glycine max
  Peptide Sequence Number=SeqID_184103
gagccttccataacaattctcagaaaattgcttaggaagatagattacaaagcactatactacacaaaagtatatatatttttaaagaaccagatagaaaatgtgaaaaataaaacctttaagttggtcattctcgaagaagtccttctcaagaacgcgatcgaacatcttggccaaggttttgttggattcaagcaacgagccattgggtatgttcttgtagaacctttcacaagcttcctagttgaatctggctgggctgcaaaccgtagcgtagattgtgaggcacaaaatgcaataccaaagtccaaacacacatcgtttgttcaggaccagaatcaacgtcatcatcatcatttcgatggcgaagtagttatgcatgcaagtttggggtttgtttgggaaattttggtggcaatggtggtgcccatggtggtgcagtggcaatga

SEQ ID NO: 67326 - DNA, 354 bp, Glycine max
  Peptide Sequence Number=SeqID_184104
atgcagaagcggtggtgtttggatggtggtggtagtgcgaatttggtggtgttgcgatggttggaagttttcgggaagaggacacaagaagcaatagatcgagggcacgagaagcacaacggacggagcatcgacgcttgctctacaagcccacttcaaatctccatccactgcgagcatacctacaccgtcatggtggtgtgcttctccccagtgcagttggatctcctctgtcgacgtctccaacactatccacatatggaggacctgcacgaagatctaagctcttctagatctacaaaacaaaaccttctagatctgagttcatctagatctacaaagcccaaaacttga

SEQ ID NO: 67327 - DNA, 1387 bp, Glycine max
  Peptide Sequence Number=SeqID_184105
atggtaaccattgtgggttcttacaatgtcactcctaatcaaccaactccaaaggatccttcatggctatccgatagtgaccaaatcggtgtcctaggtcatgtagccattgtctacatatacgaagcaaatcccaacagcaacaccattgagagattgaggaactctcttagcaagcttttggtgtactactatccattcgctggcagattcagcttgacaaaaagtggtcgcatagaagtggattgtaacgcaaagggagtgacattgattgaagctaaaacctcacacacacttgatgattatggagacttttcaccttcaaagttgaccgaggaacttgttccagatattgattatactccacccatagaggagattcccctattactacttcaattcacaaggttccattgtggtaaaggccttgccattggagttgttatctctcaccctatgactgatgcaaccggcctcactcagttcatgaatagatgggcaaagctggctcgaggagaagaactaaaccctaatgaaattccttttctcgatcgaacactactcaaatttccacaccagccatcatcacaacgcgttgatcaaccagagttgaagcctgtactacaattagagcaaaagaagaatgcaagatggagcggtgcattgttaaaactcaagtcaagccaagtggagaggctaaagaagaaggctaatgatgaaccttcaagagaaggggcaagaccttatagcagatttgaatctattgctgctcatatatggagatgtgcatctaaggctcgtgctgaatctggtgagaattccaattcaaaccacccaactatagttcggtttagtgttaattttcgcaataggttactgactccaccaatccctgagaattatcttgggaatgctttggcaagaacaatgacacctaaatgttatgagggagatatcatatcaaagccattaggttatgctgctcaaaagataagggaagcagttaacgcggttacgggtgagtatgtaaagtcacaattaagtgttggtttagggcaagagcaagtggatcacattagggcttttttcatgggacaaggacacggtacaaaaccggcgtatgctagggatcataacattctcctcacaagctggatgaacatgccagtgtatgaagctgattttggttggggaaagcctatgcaattcactttagcacatgtgtttcaacaagttgatagggtagggatttttccaagcccagatggagacggtgttgttgtctaccttaatttcgagacagcacaattgcaacttttgaagaagttgttctacgcggatatgaagaaagtgcttctcagaggtgttgctagtggaagtgtgctag

SEQ ID NO: 67328 - DNA, 1059 bp, Glycine max
  Peptide Sequence Number=SeqID_184106
atggcttctgtacaagtagataaaaccaccatagaagttgatgatttccttgtacgagagattgagaaacacagaatttcaaccatggagagcttgcaaaatgaaaagcaaattatggtggatccactttcactaaaaggttctattaaataccttgagaccaccaccaccatgcttccaactataatcacaacttcatcatccatcattttgcaccctccaccactacaacctccaaagccaagatttttaagcacaagtcttccaaattcagcgaactcatctcctcgctttgcttcaccactttccaagaagaaaccaaaaggagagagcccggaaccacaaagccaaggaagtaattttacacacaaacttcagcatttgctaccagaagtgcaattaaggaagagcaagtcatgtggtgaagcaagagcatttgctacctcagatgaatttgatcactggttgagtaaactaagtgcattggagcatgataagtggcaccatgacaacctctccaaaattgaagttgtcaaagaaagtccaaagagtgttaataagcttaagcacatgaaaacaacacatgctggatttaaatgcagtgctctatgcctttatctaccaggcattggtggcaaagtaaagccggttaaagcaagaaaggaagaatcagaaaagggtggtgcaatgtctcggacaatttccttggaaaaatttgaatgtggttcatggtcttctgcagcaatatgcaatgagattggagcagactccactaactcctactttgatctgcctatggagttaatcaaatgcagtgccaatgaagtgtattctcccgttgcttcggcttttgttttcgaaagagaccttaaagggattctgaagaatggttcctcaagaaacagtgttagaaaatcagacgcatcgcctcgccatgttcggttttctacatcatcttctgcatcacaccctgcctctccagcctcctgcatctctcctcgtttgaggaaagccagagaagatttcaatgccttcttagcagcagcacaaagtgcgtga

SEQ ID NO: 67329 - DNA, 441 bp, Glycine max
  Peptide Sequence Number=SeqID_184107
atgatgggaaaatccaatatggatattgagaagaatgagcatcttcaatggatgaacatgtcgctgccaagtagccaacatgctgtggaacgggaacatgaaaacagacatcaaggaagcttctccaaaagtggaacattaatcaaagacagtggcaagagaatgcaggatgaaggatccaaatgcaatgctctttgcatgtgttttccatgctttggctttggtaaagcaaagcctgttaatgcaagaaaaggaggcatcaaaatggatcactcagtgaatcatgtaatgcccagcacattttctttggaaaactttaaacttaattctacacaaggggaagggatagtaatccaggaaaataatcgtgaagatgactccttcagttcttactttgacctgccttctatagtattgaaatgcactggagatgatgcttaa

SEQ ID NO: 67330 - DNA, 465 bp, Glycine max
  Peptide Sequence Number=SeqID_184108
atgtcgaggatcttgagtggttgcgtgatgtttctttccctagtgtggaaggtgggatttgatttggttttgtacgagtttggagtagcccattcctgtggacaggtcaaaatgtggaaatgggggtttgagaagctggtgtacaaagattcaaagaaagggattagaagggatcgaaaatatgcagtgcaaccaaggagtttgtatgcaactggggttcacatgtcacaaaaccttgcaggaaagaccactcacaaaactgaagggaaaataatgtactaccactatcatggaaccatagctgaaaagagagaatcatgtaaaatgcttataaattcaacagaaatcacatatgacaaaaccccctatgtgttggacaccaccatgagggacattgctggtgtgatcaagaaatttgagctcaagatgattggagacaggctacaacacaagacacggcaatga

SEQ ID NO: 67331 - DNA, 913 bp, Glycine max
  Peptide Sequence Number=SeqID_184109
atggccaaagagcgagagaagaaactctacgtagccctactcggaaactacgccgccgaactcaaactcctcctcaccactctcctcctcctctgtgccgtcgccactctcctccagttcctcccttcccgcttcaccatctccgcctccgacctccgcgtctgcatttcacgcgtcactcaaactacccaaactatccctaactcaactaatgcgacgtcaccaccagtaacagcaacagcatcagcatcagcatcagcatccccactcgttgcatctttatcttccaccacttcaccctccccaccgccaccctcaccaccgccaccgtcgccgccatcgtcagagcaaatcctccccgacggaacaataaagcgcgtgttcaacccttacggctccgcagcttacaactttgtcaccatgggcgcttacagaggtggcctcgacacgttcgctatcataggcatcgcttcgaagcctcttcatgtctacgccaaacccacctacgagtgcgcgtggttctcactcgccggcgacaagaaaaaactttccaccaccgtcggttacaagatcctccccgactggggctacggccgcgtctacaccgtagttatcgtgaactgcacattcccgattcccgtaaacgccgacaactcaggcgggaagctcgtcctctttgcctccacctccggcggcggcgacgccagcttcaacaccaccgacagaatagaagctctcaccgaacaacctcgtaccctcgacacaaccttattctcctcgaagccgaagtacgactacttatactgcggctcctcgctctacgggaacctgaacccgcagcgagtgagggagtggatcgcgtaccacgtgaagttcttcgggccaagatcacattttgtcatccacgacgccg

SEQ ID NO: 67332 - DNA, 270 bp, Glycine max
  Peptide Sequence Number=SeqID_184110
atggttgggagcacacaaaggttcgagatgggggagaagacatcactagggtacaaatatgtttattcaaaatggggatacaaggtgtacaaggagagacgcttggtgttgcgagaacagaaaaataaaggtaacatttactatttggatgtacaagccttgaagaagaaccctgatagcaaagtgaagaagaaagtgaagtttcctattgttgtcgaagtgttgggagagactttcgttggagggggaacttgttcactctcaaattaa

SEQ ID NO: 67333 - DNA, 645 bp, Glycine max
  Peptide Sequence Number=SeqID_184111
atgaaggagaatactgatattgaggaaggagaggcttgctattataatgttgatgatgaagccaacattgaccccgattctttctcgtacattgatgagaagattcaacattttcttggtcattttcaaaaggactttgaaggtggtgtatctgctgagaatttgggtgcaaaatttggtggctatggttcctttttacctacccaggagcgctctccttgtttgtgttctcatccaaggactccacaaagaaaccacagctcaccagaacttagtatcaatctccacatggaggctgtgtctcataacacaaaagcatcttcaaatgggcttcctgcaaggcctgaaaatgcttctcatagttcttattcatttcgtgatttaaaagaagcttcagtaaatgattcagtgaagaaagaacaaggaatttcttccagtgatatagctgagaggtgcacttcgaaagatgatagtacaaaaaagacaggaaattcaactgaccaaaggccactgaagtttcgaattaaaatgaaatctaatatcttagcaccaaacaatgcagagatatatagtggccttgggcttgataactctccctcttcctcaatggggaacagccctgtggaaagtgaaggcatgccacca

SEQ ID NO: 67334 - DNA, 180 bp, Glycine max
  Peptide Sequence Number=SeqID_184112
atgacagaaggaatcacagacgcacagaaacagttagaggtagaaaatgtgagaaagaaagaggtgcaattgacggtggatgtgatgtgttggatcaataatggtgaccgtggagagacagagaatgttggagaaacatcaagtactacacacaagagtaggttgaagatgaataattaa

SEQ ID NO: 67335 - DNA, 279 bp, Glycine max
  Peptide Sequence Number=SeqID_184113
atgggagatacatgggaaactgcaaaaatgatgcctccagatgttagaggagagtcattagactggagaatggagagagacagactcaaaagtcaaaagggtatagaactttacaaaatagagaaatctgatactgaaaaagaggcaagtttgactacaaatctagctctcattgcactgacctcccttttcgatcttgcattcatcgatagatcagatttactggatcactattctgtagaaaaatatgaacggccgcaaaatcatctgatactttaa

SEQ ID NO: 67336 - DNA, 437 bp, Glycine max
  Peptide Sequence Number=SeqID_184114
tacggtgcgggggagcggatcgagatgacgccagattgagagtcgcgggtgaggttcacagagccgaagttgtcggtggcgcggccggtggtttggaggagcgtggtgatgagcttgccggagggggggagggcgcggaggtcggaccaggagaggaactggaggaggacgtggtagcgaaggacgtcggcgagggcggccggggagaggtggtggcgggagaggtggtcgtcggcggcgaggtaggcgttggggacggcgagaatggagagggaggagcggtccgagagatccgcagcgaggggcgtggcggaggcgaggagggaggtgaattgggagagctccggcacggtggagaggagggcggtgaggattggatggttgttgagtttgagagactgaacacagacatcaagtctcaagtgagctgtgaatga

SEQ ID NO: 67337 - DNA, 153 bp, Glycine max
  Peptide Sequence Number=SeqID_184115
atgccatatgcaaaaagacacgaaggagaggatggcgggtgtggaacgcctccactaacttctagaagctttcagaagagcttatcctcttccgaaacatccagatgtcctttattctctgttgaagctgaagatggcaacgaggaatactga

SEQ ID NO: 67338 - DNA, 507 bp, Glycine max
  Peptide Sequence Number=SeqID_184116
atggcgttttggcaccgaatccgaaaccccaacctcaaaaccctgtgcatccaattccaacgatgttacattcaccttccgcatgcttccacccccaaacccttccctgtggacattccacatcagaattcggtgtttcatggcagacccacaagtgttttcaataccgtgaggttcttcgctgcacctcttcaggtaaagcacaagaatgaggaggattcgggtgatctacggttgaatgagaaaatcaaagctccatatgtcaggcttgtggtggatgatgggcatcattcaatagtgccaaggtttgaagcattggagcgtgccaagacgcttaaacttgatttagttgaggttgataaaaatgctaagccacctgtctgtaaaattatggacttccacaagcaaatgtataagcggcaagaaagggaaaaggagcgtgctaaaagcaaggtacagtatgctatggaagttgcttgtgaaatttctttaattgcttttggttga

SEQ ID NO: 67339 - DNA, 213 bp, Glycine max
  Peptide Sequence Number=SeqID_184117
atggcccttaaatgcgaaaacaaaatccccggcaacggtgccaaaaacttgttagctctttggcaagtgtaccaaatcgctcgtagtaataatctctcggtgcaaaattgggcttgggccttcgtagtctcgctgagcgcaaagcctcgcgctcagcgccactgcgagcttagcgccttgtctgcttgcgcgttgggcgtgtctcgcacttag

SEQ ID NO: 67340 - DNA, 525 bp, Glycine max
  Peptide Sequence Number=SeqID_184118
atggggggtgcaaaaagtaagggaaataggggtgcagttagtaaagcagggggtgtagaaagtaagcagaagggaggtgcagttagtaaggaaggggtgcagaaaggtgagggctattgggccctaaggcccagtcacgcgcttgacacccctgtgcacgttgttgctggcacgcgcttagtgcgctcactgaggctcatgagtgcgcttagcgcgacagctcccgctaagcgcgtgcttcgtgtccactatactgcagcagcttgcgaagtagcgcttagcgcattcgcaggacgtctttcttctccccttaggcccttgctagggctcagcgcgctaatacctgttcagaattcaacagaaaatccagacctcaagcttacgaaaatgcagagcagaggaggaggtatagcagaaatgaaagaaggaaggaaaaagaatagtggtggaattctggattttaaaagcaattatgggacacgcgcccagcgggaggttgccgctaagcgctccaaggcctactga

SEQ ID NO: 67341 - DNA, 387 bp, Glycine max
  Peptide Sequence Number=SeqID_184119
atgaatgtttctaactggttttgctgttaccagggcaaggaaagtaaaacactgttcagttcaggacagaaaattaagaggtttggtgagctctgggttcctgggatgcatctttcaaagggttgtaggtgtgaagttgttttctgtttgtggttctgctgctatttcctattggctgccggtcaggtcactgaccccactgaagttgaggcattgaaagtcataaagggaaaattgattgatattaatggaaatttgagcaactgggatcgtggagacccatgtacatctgactggacaggggttatgtgctccaatacaacagtggacaatggttatctacatgttctacgattatatcttgaagttaaagcaaaatctgtttaa

SEQ ID NO: 67342 - DNA, 2349 bp, Glycine max
  Peptide Sequence Number=SeqID_184120
atggtgaaggaaaattggaaaagtgttaaggaagtgccaatgtttagtttgttgggggaaaagagaagagtgaataagaatgtacatagatggggggttgagtttctacttagatcaccatgccaccactttgacttgcccttcccctctggcattcccataccagtttttagacctccttcagctgaattaagtcaacttgataacaataacttcagtggaaatagcattccagaatcttatggcaacatgccaaaattgttgaaattgagccttaggaactgcaacttgcaaggaccaattcctgatttcagcaggatatcacaccttacttatcttgacctgagtttcaatcagttgaatgaatcaattcctaccaataagctgtcagacaatatcacaaccattgacttatcaaacaacaagctcaccgggacaattccatcctacttttctggtcttccacgccttcagaaattgtcaattgcaaaaaattcattgagtggcaatgttccttctaccatttggcagaacaggactttaaatggaacagagcaaattatcctggacatgcaaaataatcaatttgcaagcatatctggcactacaaatcttcctgcaaatgttacactgttgcttgagggaaatcctgtatgcttaaataataactccttagttcagttctgtggacctgaaggtgacaataacaagaatggaggctccattgttgtctgtcccagtcaaggatgccccccgccttatgaatacaatgtggactgtttctgtgctgccccattggttgttcattaccggttgaaaagtccaggattttcagatttccatgcatacgtgagagaatttgagagcttcctcacaaatggtcttactatacatactaatcagctgttcattgagcattttgcatgggaagaagggcggttgagaatgaacttgaaggtttttcctgaatatattggcaatggaagttttcacatgttcagcacaagtgaggttagtcggatcggagacttgttcagacaatgggacattcctgacaatgaacttttcgggccttatgaacttctggactttattctactggatctttacagggatgtgattatcccctcttcaagttcaggaataagcaaaggtgcactggttggaataatcttaggagcaattgtttgtgcagttacattatctgcaattgtttccattcttattttgagagtacgcttgagagattatcgagcactttccagaaggcgtaatgaatctaggatcatgataaaagttgatggtgtaagatcatttgattacaaagaaatggccttggctacaaacaattttagcgagtctgctcaaattggagaagggggctatgggaaggtttataaaggtcatcttcctgatggcactgttgttgccataaaacgtgcacaggacggttcactgcaaggtgagagggagttccttacagaaatagaattgctgtctaggctacaccatcgcaaccttgtgtctctgattggatactgtgatgaagagggtgaacagatgttggtttatgaatatatgccaaatggaacactaagagatcacctttctgcttattcaaaagaaccccttagtttttctctgaggttgaagattgctctaggatcagccaaaggtcttttatatctacacacagaagctaatcctccaatattccaccgagatgtgaaggccagcaatatattattggactctaggtacacagcaaaagttgctgattttggactttcacgacttgccccagttccagatactgaaggaaatgtacctggtcatgtatcaacagtggtaaaggggaccccgggttatcttgatccagagtacttcttgactcgcaatttgactgacaaaagtgatgtttatagtcttggtgttgtacttctggaacttctgactgggaggccaccaatctttcatggtgaaaatattattagacaggttaatatggcatacaattctggtggaatatctttggttgttgataaacgtattgagtcttatcctactgagtgcgcggagaaatttttggctttagccttaaagtgttgcaaagataccccagatgagaggcctaaaatgtcagaagtggctagagagcttgaatacatctgttctatgttacctgagtcagatacgaaaggacatgattatgtcattacaagtgactcttctggtacaatattcagttcagaaccttcatcttctgttataaaaactccttttatttcaggagatgtttcaggtagtgaccttgttagtggaagtataccaaccatcaagccaagatag

SEQ ID NO: 67343 - DNA, 645 bp, Glycine max
  Peptide Sequence Number=SeqID_184121
atgagtaaagaatacccaaggcctcactcgtgtacaacgttgatgacctcaatgggggcaatacaagccacaatctttgcactctgtattgagaaggattggagccaatggaagttgggctggaatattaggcttctaacttcagctttttcgggaattgtggtctctggattagttttaattgtcactgcttggtgtgtaaggcttagaggtccattgtatgcattggttttcagccctttgtcacttgttatagtggctatttttgcttccatgatgttggatgaaaacctatatgtaggaaggggtgctaattgtgtgtggcttgtacatggtgctgtggggggaaagatcaacacagcgtcgggaatgtctcccgcatccgctaccttcctcttcactcgactctcccgtagtacggattccgagaaggcacgtttcatgatatttgagaggggtccaagggcttttattgatgaaacagttaagttgttgtgtggactcactgttcaaggttcgtccacacagaatctgagccaatctgcatctgattatatcggcgagagagtaggatttttgagtagcttaagatattcactcgccacattgttggctcagaagagaaaatttggaatgaccaaatga

SEQ ID NO: 67344 - DNA, 1554 bp, Glycine max
  Peptide Sequence Number=SeqID_184122
atgacaactgtttttataaaatccaaggaaagatttagcagtggagctgaacttagaactccagtccagaccgaattagctaacccaagaagtcctcaaagggagacagtaaacaaaaccacacaattggataactctgtcactactgatcaactcagcaaagacacaagcaacaagaaaggtcacggaaatgccaatcatgccacagaatccacacaaaagtcagcatcgcagactagaatagatcatagcacagaagaagctcatccaagttcagatatcaaggctccacaaaatgactcacgagaaactaccgaggcaactacatccacgattgattcaaatctaaatgagatgaccgcagatagggaagagacgagcaaccaacagaatgctatggctaaaagcagtaatgatgagacagtgaatgaggaagaggaaagtaaccagcagcatgccgaaaccagttatgaggagacaatagaagaggcaagtaatcagaactatgctgaaagcagttatgatgatgagatggaggaagaggtagaggaaattgaccagaattgttatgaaactaattatgactggatcagtgaaatttctaggcctaggagctactgggaagagtgcaggcaagcatggtatagagagatgctagaaactggtactcaaaatgaggatatacggaggcttcttgaaagaagaacagtgtcaagtttcctttctagtgacttccggggtagaatggatagattgatggaatctcataggggaacacaaacacatctagtgaatagtcaagaccgtgaggaagacagccaaggattgatggcatttttacaagaacgcttgcattctacaagagcttctcaagatggaagtaatgcgagggaggaagaagatgagagtagaaatcaggatgaggaagaggaggataatacagatgagcaggagcaggagcatgaagaagagcatgaaaaggagagcttgataagtggttcatatcatgaagtcggcgattattctaatcaatcctcatcatggagttacagggacaacgaagctggtgatgatttcgatagagttgtttcttcatccccacaaccttatcaatctcaatctttctattcggaatgtcggcactcttcatccaccaatcatcattcaattgaaatggaactcatatatgatttgagagggcatatggagcaactttatagtgagatatctgagctaaggaaatcaataaagggctgcttggaaatgcagatggaattacaacaatctattaaacaagaggttcaaacagcttcagtcatgcaatgtaaacacaccattacagttaaaaaagaagaaaagaagtccaatgacacgactttaaagaaaggcaactgctgcatttgctatgagatgaaagttgactcagttttgtacaggtgtggacacatgtgtacatgtctcaagtgtgccaatgagttgcaatggaacagtggaaaatgtcctatatgtcgcgctaaaatagtggatgttgttcacgtatatgttgacagttag

SEQ ID NO: 67345 - DNA, 3738 bp, Glycine max
  Peptide Sequence Number=SeqID_184123
atgaggatttcaacgcttgaaattgttatcctcttgttcttttcttttgcactcttttgtgatggcaatgagagtactatgagagtgcttttggaggtaaaatcatcgttcactcaagacccagaaaatgttctaagtgattggtcagagaacaacacagattactgtagttggagaggagtgtcatgtgggtcaaaatccaaacctttggatcgtgatgactcggtggtgggactcaacctgtccgagtcgtcactcagtgggtcaatatcaacctcactcggtcgtttgcaaaacctaatccaccttgatctctcttctaaccgtctcagtggccccattccacctaccctctccaacctcacttcgttggaatctctcttactccactctaaccaactcacgggtcaaatccccaccgagctccactcgctgacgagtctccgagttttgcgaataggtgacaacgaactcactggcccaattcccgcgtcatttgggtttatgttccgccttgagtacgttggcttagcctcatgtagactcaccggtccaattccggccgaactcggtcgactcagtttgttgcagtatctgattctgcaggaaaacgagttgactgggccgattcctcccgagttggggtactgctggagccttcaagtattctccgccgctggcaacagactcaacgactccatcccgagtaaactgagtcgactcaataaactgcaaactctcaaccttgccaacaacagcttaaccgggtcgattccgagtcaactcggcgagctgagtcaacttcgataccttaatttcatggggaacaaactcgagggtcgtattccatcgtctttggctcaattgggtaaccttcaaaatcttgacttgtcatggaatttgctcagtggggaaattccagaggtgttgggaaacatgggtgagttacaatacctggttctctctgagaacaaactttctgggacaattccaggaaccatgtgttccaatgcaacaagtttggagaatttaatgatttcaggtagtggaattcatggtgagataccagctgagttgggtcagtgccaatcactgaagcaacttgatttgtcaaacaattttctcaatgggtcaatacctatagaggtttatgggttgctggggctaactgatctaatgcttcacaacaacactttggttggttcaatctctcccttcatagggaacctcactaacatgcagacacttgcattgtttcacaacaatttgcaaggtgatctccccagagagattggaaggcttgggaaattggagataatgtttctctatgataatatgttgtcagggaagattcctttggagattggaaactgctcaagcttgcaaatggttgatttgttcggaaaccatttcagtgggagaattcccttcactattgggaggctgaaagagttgaatttcttgcaccttaggcagaatgggcttgtgggtgagattcctgccacacttgggaactgtcataaacttggtgtgcttgatttggcagataataagctctcaggtgccattccttcaacatttgggttcctccgggagttgaaacagttcatgctctacaacaattctcttcaaggtagtcttcctcaccaacttgtaaatgtagcaaacatgaccagagtgaatctttcaaacaacacactgaatggtagtttggatgcattgtgtagctctaggtctttcctttcttttgatgtcacagataatgaatttgatggtgaaataccttttctcctggggaattcaccctcccttgataggctgagattaggtaacaacaaattttctggtgaaattccaaggacattggggaaaatcactatgttgtcattgttagatctctcaggaaattcactcacaggaccaataccagatgagctttctttgtgtaataaccttactcacattgatttgaacaataactttctatctggacacataccatcatggcttggaagtttgtctcaattaggagaggttaagctctccttcaatcaattttctgggtctattccactaggcctattgaaacaacccaagttgctggttctttccttggataacaatcttattaatggaagtctcccagctgatattggtgatcttgcatctctaggtatcctcaggcttgaccataataatttctctggaccaatccctcgcgcaattggtaaattgaccaatctttatgagctgcagctatcgaggaatcgctttagcggtgaaataccatttgagattggaagtctccaaaatctccaaatcagtttggacctcagttacaataatctctctggccatatcccatctacacttagcatgctgtcgaaattggaagtacttgatctttctcacaatcaactcactggagtagtgccttccatggtcggtgaaatgaggagcttggggaagcttaacatctcttacaataaccttcaaggtgcattggataagcagttttcccgctggccacacgatgcgttcgaaggtaaccttcttctttgtggagcctctcttggaagttgcgacagtggtggcaataagcgagtggtcttaagcaacacatcagtggttatagtctctgcactttcaactttagcagcaattgctctactagtacttgcagtgataatcttcttgagaaacaagcaagaatttttcaggagaggcagtgaattgagtttggttttctcctcttcatcgcgagcacaaaagcggacattgatccctctaactgtgccaggaaagagagatttcaggtgggaggatatcatggatgccacggacaatctaagtgaagagttcataattggttgtggaggttctgcgacagtgtacagagttgaatttcccactggagagactgtggctgtcaagaagatttcgtggaaagatgattatctgttgcacaaaagcttcataagagaacttaagactttagggagaatcaagcacaggcatctggtgaaagttctaggttgttgtagcaatagatttaatggaggaggttggaatctgctgatatatgagtatatggagaatgggagtgtttgggattggctacatggggaacccctcaaattaaaggggagacttgattgggacacaaggttcagaattgctgtgggattagctcatggaatggaatacctccatcatgattgtgtgccaaagatccttcacagggacatcaaatccagcaacatattgctagattccaacatggaggcacacttgggagactttggtctggcaaaaacactcgttgagaatcatgagtctatcactgagtctaattcttgttttgctgggtcttatggctacattgccccagagtatgcatactcaatgaaggctactgagaaaagtgatatgtacagcatgggaattgtgttaatggaacttgttagtggtaaaatgccgacagatgcagctttcagagcagagatggacatggtgagatgggtggagatgaaccttaacatgcaaggcactgcaggagaggaagtgatagatcctaagctgaaaccccttttgcgtggtgaagaggttgctgcatttcaggttcttgagatagccatacagtgcacaaaagctgcaccacaagagaggccaacggcacggcaagtttgtgatcttcttctgcgtgtgtccaacaacaagaagattgaagataaataa

SEQ ID NO: 67346 - DNA, 402 bp, Glycine max
  Peptide Sequence Number=SeqID_184124
atgttcagagccactgctttgcttctacaacgaaggagtagagagagtggaggcgcaagaagtgtagtagaagtaaatggggacgttgttgttgagatttttggtgagggctttggggtcattgaagttcatgaagtccatgacgagggctttgaggttcgaggctttggcgagggtttggagtgcaacggtgatgttttgcgtgctgtggcgggtgaattcgagggagaggatgtgaagggggagggagggggtgttaaagttgaaggggacgtggtggaacgtgatggcgggggtggtggcggtgacagtggtgatgtatctagcattagagtcgcatgcgatggtagtggtggaaggggtgatgggaggagtgaggatgagtatagtgatggaaagtga

SEQ ID NO: 67347 - DNA, 504 bp, Glycine max
  Peptide Sequence Number=SeqID_184125
atggaggatggtgttgggattatcacaaacacctttgaagggattgaagaaaaacctatcagaacattaagcaaggatacccatgatttctgcaccgtatggagaataagacaaagggtgtttgagttggttaaactcgcaactgagttagagcgtcgtattgctctgttatggaagcatgggaaggttctcgagggctcagttgaaggagattgctcttgggttggagaagagcgagcaaaggttcttgtgggtcgtgaggaccgagttggaaggggtgccaatggtggcgtggcctctctacgcagagtagaagatgaatatagtgattctagtgaaggaaataaaggtggctttggcggtgaacgagaacaaagaagggttcgtgagtgcgacagagttgggggactgagtgatgcaatcctacccccccaagggcattggatagaagactccaagaaaattgggccagagatgcaagaaaaggccctaaggttctcatga

SEQ ID NO: 67348 - DNA, 174 bp, Glycine max
  Peptide Sequence Number=SeqID_184126
atggtagcgagaccatgcctgctctttctgacactagcagctgttttgccaatgctgctggcgaaacaccctccacgtcaactggatcttgctaggagtcttggagctgctattatctacaaccaagataagccatgggatgaccataaaatacattctaagacgattctataa

SEQ ID NO: 67349 - DNA, 1299 bp, Glycine max
  Peptide Sequence Number=SeqID_184127
atggcatcttcccagattgaaatcgcttcttcatcgccttttggttgcgctttgagggaccgcaatcaccgcgaagcgtgcagcagggaaagcggtaacgtgaagagcacgcatcatcatcatcatgctaatttccaaagaaacatgaagaactttgtgatggaccttaacatgtgcatggctgtgtcttctgattcgaaagcaaatgaaaatgaaaacaacagcagcagcagcagcagcatcaacaaccaccggaaggctccaaaaaacaaacagctagagaggcttcttatcacacgagccaacccctttattaacaacagcaatgtcgccagcaatgaaacctcgttggcctcgttgatcagcccgagacactcgggccttctcgatcgatgggccacgaggcaggcttgccagatggtgtcgaatttggagaatgaggcggagttgttgtcgatggatggcaatgacatgcttccaaggacttctagttcctccgaggaggagtcatccttctcctcggagactcgaaatggaggtggtgcctcttctcttgttcagatatgggagaagaggctgaaccaatccagtgtctccaaacccaacacgccaagggagaggattggttcgacctcttcttccataaatgagaatgctaatgctttctctccggagaatgttaatgctttctctggggaggaacaatgctttgatggaccctcagggaacgaagaatcatttacatcttcttcgttccctgattgggaatctagtgatcagtccctttcgccaagccgcaggtcggagagtgacagggtcagggttgctgacatcataaagaaactaacttctacaagccagaatcagtgtccaacaccttcctttgctgatgacaatgaacatgaagggtatggtagcagcgtgacaggttctccttgtagagagcgtgaatgtgatcaacaacattcggagcagaaccgtagagttaattgttccttgcgaattagagggcgccgtgcgtacattgatttacttgcacagatggagaatgacaggcttggggagcttaacaacctggtagagcgtggagcagtctccaagttcccacaaagaggtcgcattcaggcaatgcttcgacttagattattgcaacgtggtgtggcagctaatgatcagccccgccagaaatcaacagcatctgaagtaaacaacagtcagccacatggatatgcaattatgcaattaaggtttgataatttcaagtcaagtgtaaactttcttgttcatttcgtgatttga

SEQ ID NO: 67350 - DNA, 1341 bp, Glycine max
  Peptide Sequence Number=SeqID_184128
atgcaagcatctagacctgtggtgcaaatcactttttatttccttttctatgtcgttctgagctttgaatctaatcgaaaattgaatttgcagatctggaagtatcggggaactgatgggatgcgtattactgctttggaacacttgcgcgttgatgtgcagacgtcggcagggaaaactgaaactgatgttttgttgacgggcagcacaaatggctcgatgagtttttctcaagttggaggggttgggcgtaatcatgatggtgggacaaaatggagggcagattgtgtgaagaattatgttaaagggagaacagatgagaataatgaggtgcttaagccagtttttaaacctaatcgagctgcactgcttatgtcctccagaatatctagtataagattgggtccaaagttctcttctcacgctgtcaatgatggtcatattgttggacgtgcattatttactacattgggatcagagacatcaggtggaacagtttatactcttgatcttgttgaaccattaaatcttggaccaggtatactgaacacatggagcggactggaggaaattgcatctttcaggggtaccatttggacatcagaatatgattataatagacatcgggctgtaattggtacaaatttgggagctgcttcagtggatctggaaactgggacaatgtcatggtttttacactgtaaaagtgatgtttttgcgcaacagattgttaattcgggaaatgtgattttatgtgggctaagaaatggggcaattgtcactgttgattctcgtgagagaagagaaagcctttctggtagacttattacccatcggataccatatgcatcttcagacaagaaagttgtaggttctaataaagaatggttcaagctcaaaggagacatatatccttctcataccattcggatgtcttcatctatttcctgtttggcatcacttcagtttgatgatcagtacttcttggcaagctcaatggatggatcgatgaaactttatgatcttcgtctacttcagaggggtgctgttcaatgttatgaagggcatgtgaattctcatactcgtatacagatgggcgttgatccatctgagagatttgttatgtcaggtggaaatgattgcaagctaaggttatggagtatcaagtctggtgaacttcttttcgaggacaagttctctgattccattatctccaccgtgtgctataaaacatatggacatagttttaaagcagaagaggaaaaccaatacaagtgcgactcgtctcagggtgcatggcttggatcatatgaaggactgttttatatgtgctggttatga

SEQ ID NO: 67351 - DNA, 417 bp, Glycine max
  Peptide Sequence Number=SeqID_184129
atggctggtgatgcagcatttccctcttacacttccacttgcatgatgaccttcttcttctctttgctcttagctcttcacttcgccatggccgtcccagaacgaagcttctcctctttagcttctataaaagaaggtgcaaagaagaggaacaccatggtagctgcttcaactgctagagaagaaggaagcacacaaaatctcaagacagaagaagccacaccaaaagataaccatgtttctgatcatctcttgaagggtactaataaagaaggaagttctcgatctccgcgacctccattggagaggcaaaacaagatcttcaatgctagtgaacatgaagtccctagtggtccaaaccctatttcaaacaggcttgctgaattagcaaataagtgcacgatatatgcaaactaa

SEQ ID NO: 67352 - DNA, 1506 bp, Glycine max
  Peptide Sequence Number=SeqID_184130
atggaaatgtttcccttgttgccttactttctcttatcatcccttgtttttcttctcacattcaagctattattttcccaaagaagaaaacacaaaaaccttccaccaggtccacctcctcttcccataatcggcaacctcaacctcctcgaacgccccctccaccgtttcttaacccgcacttcaaaaacatacggcgacatcttttctctctggttcggctcccgcctcgccgtcgtcgtctcgtcgccctccgccttccaagaatgtttcacgagaaacgacgtcgccttggcgaatcggcctcgctctctctcaggaaagcacatcttctacaactacaccaccgtgggatcctgctcctatggtgagcactggcgcaacctccgccgcattacctcccttgacgtcctctccacccaacgaatccactccttctctggaatccgaaaggacgaaacggagaggtttatacgtatgttggccaaggactcgtgcatggactatgcacacgtggagctgagttccatgttccatgacatgacctataacaacatgatgaggatgttatcagggaagaggtactatggtgatgagagtcagataaaggacgtggaagaggcgaaggagttcagagagacggtggaggagttgctgcaagttgcgggggtgtctaataaggcagattatttgccctttcttcggtggttcgattttcataacttggagaagaggctcaagagtattaataagaggtttgatacgtttttggataaactcattcacgagcaacgcagcaagaaggagagagagaacaccatgattgaccatcttttacatctgcaagagtctcagcctgagtattatactgatcagatcatcaaaggccttgttttggctatgctctttgctggaacagattcatcagcagtgactttagaatggtcattatctaatttactgaatcatccggaggtgttgaaaaaagcaagagatgaattggatacttatgtaggtcaagatcgcttggtaaatgaatcagaccttccaaacctattttaccttaagaagatcatccttgagacacttaggttgcatcctcctgctccactagcaataccacacgtgtcttcagaagacatcaccataggagaattcaatgttccacgagacactatagtgatgattaatatttgggctatgcagagagaccctttggtgtggaatgaagccacatgttttaaaccggagaggtttgatgaagaaggtctggagaaaaaggtaattgcatttggaatgggaagaagggcttgtccaggagaaggtttagccttgcagaacgttggcttgactttgggattgttaattcagtgctttgactggaaaagagtgaatgaggaagagattgatatgagggaggcaaattggttcactttgtcaaggttaactccattgaatgccatgtgcaaagcccgtccactcgtgaacaagattaatctgaagtaa

SEQ ID NO: 67353 - DNA, 1497 bp, Glycine max
  Peptide Sequence Number=SeqID_184131
atgtttcccttgttgccttgctttctctattcccttgctttcattctcacattcaagcttttattccaaagaagaaaatacaaaaacctgccaccaggtccacctcctcttcccataatcggaaacctcaacctcctcgaaaaccctctccaccgttttttccaacgcatgtcaaaaacacacggcaacatcttttctctctggttcggttcccgtctcgctgtcgtcgtttcatcgccctccgccttccaagaatgcttcaccaaaaatgacgtcgtcttggcaaaccggcctcgctccctctccggaaagcacatcttctacaactacaccaccgtagggtcctcctcctacggtgagcactggcgcaacctccgccgcataatcgccctcgacgttctctcaactcaacgcatccactccttcaccggaatccgaaaggacgaaacagaaaggttgatacgtatcttggccaaggactcgtgcatggactatgcacacgtggagctaggttccatgttccatgacctgacctacaacaacatgatgaggatgatatcggggaagaggtactacggtgatgagagtcagataaaggacgtggaagaagcgaaggagttcagagagacggtggcggagatgctgcaactcacgggggtgtccaacaagtcagattacttgccattccttcggtggttcgattttcagaacttggagaagaagctcaagagtattcataagaggtttgacacgtttttggataaactcattcacgagcaacgcagcaagaagaagcagagagagaataccatgattgaccatcttctaaatctgcaagagtcacagccggagtattatactgataagataatcaaagggcttattttggctatgctttttgctggaacagattcgtcagctgtaactttagagtggtcattatctaatttattaaatcacccaaaagtattgatgaaagtaagagatgaattagacactcaagtaggtcaagaacgcttagtaaatgagtcagaccttccaaatttgccttaccttaggaagattatccttgagacacttaggttataccctcatgctccacttgcaataccacacgtgtccttagatgacatcactattaaagaattcaacattccacgagacaccatagtgatggttaatatttgggctatgcaaagagaccctctattgtggaatgaacccacatgttttaaaccagagagatttgatgaagagggattggagaaaaagttggtttcatttgggatgggaagaagggcttgtccaggagaaactctggctatgcagaatgttggcttgactttgggattattaattcaatgctatgactggaaacgagtaagtgaggaagaagttgacatgacagaggcaaattggttcactttgtcaaggttaattccattgaaggccatgtgtaaagcccgaccactcatcaacaagattaatttgaaataa

SEQ ID NO: 67354 - DNA, 3000 bp, Glycine max
  Peptide Sequence Number=SeqID_184132
tatctcaagagaatgctgaagattctccaaatggcattattcaggttatgacttcctttcctatctctgggggtgttctaatatctcctctgcatgatagtttgctctacatgataaagaatgaaaaagttatcagagacagcaaatacttgtcttctcttaaaggtcatcaagatacttgttccatgtctactgacgaatcagattcttttgtgggggatgaacatttgaagaagaaaacagtgagaataatgagagaaagtgaaaaacagttggaattgaagcatacaaatggcaccttttctgagaaggatttgacattgcatacaaagaaaagattaggaaatagaacaccggattgtaaagatttcctctctaatgacttgaaacgtacacctctgtcaagttcaatttgtgatgctggtgaaacagctgaagtcactgctaaagcttttgaagcctccaaggactttaatgagagtggagtgcaaggcagaatggttcccgtagaagctttgaaggaggagtcattggagtcaatatctggtcaggattttgagaagactgaaaagcaaaatgcaggaaatgggtttatgaaaaatgctttagagcataaactggaaaattcccgcaaggataattttacagaccctatgaataataacatgcgtaatactttcatgaataagtttgaatctgatgcagtaaaacacaaggtagatcataagtatgagaaccatcagaaagtaaaggccgtgtctgagcggaagactaagtcaaagggtgatctgagtcctggaaaagctgaggctgttggaagaaaagatagctttggtggtactaataatgcaatggtaattgataaagggattgctggctttgacaatacttgtaaaagtaaaatgaataagtcaatgtcactgaagggcaaaaagttcagtaatagtaacggggattcattgaaagaaaaaaaatcagaacagaaagttgccagtgttgccagtattggtgctataaaaaacggtaacatcggtaatggaaaaaagagtgcatttgggactaaggtaaaggaaagactgagtggccataaagtggccaaccagttgctagctgggccatgcatcaaagatacttcagctgcacttcctattgctgaaaacaaccttgctccagagatgatttcatcagcagtaggagtgcctcaagttattgcggaagattgggtatgttgtgacagttgccagaaatggcggctactgcctaatggtatgaagccagagcatcttccagagaagtggctgtgtagcatgctaaattggctgcctggaatgaattcatgtgacttcagtgaggatgagacaacaaaagcactttatgcctcatatcaaataccaatttccgatggtcaaaataacatgcaaagccatggcactgaaactgcaattggagtgagctgtactttgcaatatggcctgaatcacaaaatgtccacttttgatatgttgtctgatcgagaaaagaagaaacatgttattaaggaaaagacaatgtcaggaagtaataatgatgttcttcagttcccaaattctgcaaagatcaatgttcaagtatctggaaaaaatagaagcttgaatgccatgaatcatcatcctgctgacttaaacccaatgaagaagacaagttcttctaaacatcttagcaggcttgacaacatgatagaagagaaaaacgtgcctaaagagaaagaaaagcaagtaaatgaaggtgatagaaagcatgctaagttgaaacgtaagatggatgctgatcaatataaattgggaactcctaagaaaccaaaagtcgaaaatgttttctatactgataagcaattgaatcctggcatggaccttgagaaggtgtctctatattcaagaaatggtttgccaacaaaagctagtgggaaggaaatgaggaagtatgatgaatattgtttatctgatgacatacaggacagattaccagtcactgtcaagaatgagggagatcatgctcaggtctcgtctggtggtgggtccttggatgtgaaaaacagaagtaaaagtggtttaatgaagaaaaggaaattgaaggagcatatggatgatgaaaagcataacaactcatactcctcgcatggtgaaaagcagtatggtgaagaaggcaatgcaagtgaaattaggaagcaaaagaaatacagaattttgagtaaagaggcaaaattagtaactgaaggtgatgataaattgagtaaagatgggatgaggcaagtttgcttgtcaggcaatagggaccaaatggctgttgggacagaagtaagatttgttgataaaggcaaccagccaaggaagcataggaaaaatgttgcatctcttcatgcttcggacagtattgatcaattgggcaagggtttgggctctagaccgctttcattggcagcaacttcaagctcttctaaaatttcagggtctcataaagctaaaaccaactttgaagatgtgagaggttcacctgttgaatctgtcacctcgtcacctctgagggccttcaacttggataagaatattttggcaataggagacacttcagtgaaagatgatgctacaaaaggttacctctcttcagtaggttcaaggagaagtgttgataatagggagggaaagctatcagtaaaattgaaggcgggtagaatttcgcatgacttacatcctgcatcccacaaattatcttcaatagaggctcggtttgaggatgctaaagacacagccagggtccaagctaaaaaatcttctgaactaaagaataatcatttgcttgaagctggtgttcatgttgaacagcctggttattgtgctaatggtatacgttatgaggagaaagtaaacaaggacaaccaggaaagtgaactttcttggcagaaatctggtaaggtttcatcattgcaccgcaaggagatgggcagaaagtctggttctcatgttg

SEQ ID NO: 67355 - DNA, 535 bp, Glycine max
  Peptide Sequence Number=SeqID_184133
atgtttttggtgggcagttctgcattaaagatagcaaggtctatacctttgacccagaaacaggcgcgttagagtacttggctgatgatattgaaaattgggtgaaaattctcctcagtgattatgaggtacttacgggctatccgttagcgcatcaatggcaaaagcagaacggtcagctccctgccgggaagcgtttgttacctaaggtgccgttcgtactgggtggtgaatttgtgctggataatttgtacttggctgatgctgtagaggggatgagatttagagctgatatagccagtcaaattaaagaactaccggacggaacggcaatgaagaaacgatttacggaagaacagatcatcggggtgctgaagaaggccgaggcgggggccaaggtggccgaactgtgccgcaagcacgggatctcggaggccacttactacaactggaaggcgaagttcggcggtatgaccgtctcggacgcccagcgactgaaggagctggagcaagagaacaacaagctcaagaagct

SEQ ID NO: 67356 - DNA, 189 bp, Glycine max
  Peptide Sequence Number=SeqID_184134
atggatagtgctcacgcgatagtggaaaacaaaggtagcggtaccaacatgtcctttaacctcggcgaagatctcaactacttagtcttaccatactctgatgaggaaaatttgaagggagcagcaagcgttaagttatactttgacttgaagcattttgatggcaactgggatgaggctgagatgtga

SEQ ID NO: 67357 - DNA, 1334 bp, Glycine max
  Peptide Sequence Number=SeqID_184135
atggtaaccactgtggcttcttacaacgtcactccatatcaaccaactcccaatgatcctttatggctatcagatagcgaccaacttggggccctaggccatgtagccaccatctacatttacaaagcaaaacccaacagcgacaccattgagaggttgagaaactctcttagaaagcttttagtgtactactacccagtagctggcaggttgagcttgacaaaaagtggtcgaatggaagtgaattgcaacgcaaagggagtgacgttgattgaagctgaaacaacaaaaacatttggtgattatggagacttttcagcatccaagtcgaccgatgaacttattccaaaagttgatgatactcaacctacagaagagattcccttactgctactgcaaataacaaggttccatggtggtgaaggcctttccattggagttcttttctctcatcctttgactgatgcgactggccagattcacttcatgaacaaatgggcaaagctgactcgaggagaagaactaaaccctgatgaaatgccatttctcgatcgaacactactcaaattattaccaaatcaggcatcagttccaagcgttaaactcccagagttgaagcctgcaccacaaacaccaggaaaagagcagaagaagagaagtgctgcattgctaaaactcacatcaagccagatacagaggctaaagaagaaggctaatgatcacccttcaaaagaagggtccaaaccttatagcagatttgaagttgttgctgctcatatatggagatgtgcaactatggctcgtgctgaatctggtgagaattcaaaccaaccaattctagttcggtttagtgttaattttcgcaatagattgaaaccacctctccctcagaattattttgggaatgctttggcaaaagtagcgacacctgaatgttatgagggagatatcatatcaaacccattaggattcgctgctcaaaagataagggaagcatctcatgcaattactgaagactttttaaggtcacaattaaatgttggtttaggcaaatggcaattggacaacattagggcttttttcatgagtcaacgacaccttataaatacgccctctgctggggatcataacatttttctcacaagcttgatgaccatgccagtgtatgaatcagattttggctggggaaagcctgtgcattatggtttagcaagtctgtttcaggtaaatagggcaggaattcttccaagcccagatggagatggtgttattgttaacatatttttccaggaagcacttatgcagcttttcaaaaagttgttctacgaggattt

SEQ ID NO: 67358 - DNA, 664 bp, Glycine max
  Peptide Sequence Number=SeqID_184136
gtttgacactgcacaaagtcttgtgtcaaggttccttcagctttcttcttttttcgaggacgagggtgagagccccgtcgagtctgatgaaacaaaaagtggggagaagcctctacttttgcccattcgaagcttgaaatctcgcttatctgaagaagatattgatgttcaatctctgaacatctcaatgagttctaaaaaaagattttcaagctattcgaatagaaaagcagaagttgaagctattgatgctgatgatgtcgatgctgaagttcagtctcaaaaaaggtcaacatcttccaaaagattttcaagcaattcaaacagaaacacaaaagttgaaggttctagagctgagaacaagaagaaagagagtgtggtgcttccttctcccattccatggcattcaagatcaggaagattggaacataagcaagaagaatttgacgaagcctctaacatgatgtttccttcttcaaaggaggaatctcgccctgtgaagtctcaaccttcttgcgcttcttcgcgagacaattccatgtctttttctccttctttctcattggaatctcctgcgaagaatgcagaggattcagtgaggaagaagggcttctacaagtcttgtcctccaccacctctgccaccgccaccaacaatgttttag

SEQ ID NO: 67359 - DNA, 651 bp, Glycine max
  Peptide Sequence Number=SeqID_184137
atgttatttgatcatgttgaaatcatgcaattaagggcctatcacccacagcttgtcaattgtgatttttgtggaggagaacatttcaatgataattgtcattcttactccatcaaaaattcttggtgggagcaagagtttcacccttacaatcaatatgaaaaagaaagactctctaatcttgagaatgtgttgatggaattcatggaaacttcccaagctagcttcaaagccaatcaaaactcaattcaaaatcttaagattcaagttggtaagttagtaaaagaagtggctgaaataccttttttggtcataagggaagaaaattttgtagaggttaaagcacatgaagagagtcttgtagaaattcaagagaaaaagatgaagaaaaaaaagaaaggtgaagagagtacacaacaacaatgggacaagttctcacaatctctaactaagaagcgaaaatgcaaggaagatgtgttctatgtgactttcaacaagaaatccttcagtgtcattttttccttaatcaccaacacttctcttgcaatgatatggaagacgtttcaggaatacatgactttcatggagtctctagctaagaagcgaaaatgcaaggaagatgtgttctatgtgaccttcatgccaacttga

SEQ ID NO: 67360 - DNA, 369 bp, Glycine max
  Peptide Sequence Number=SeqID_184138
atggaaaggagtaagattcacagaagctacgaagatgttgagaaacacatgtatcgagcatgctatcacttgcagggaatggatcctgcatgtgatgagaggggtaaagggaaacaacttgttggaatcttagggaaacatagtgacaaagtgaccgtggatccaagtgttgggaatgttcaggttgtggaggatagatggtcggtgaaacttcacgtgaatctacctaaataccatagaagtggagacttctatactcagacacaagagcagaaacactttcaaccttatggaaacaagttatatggaggatcatcaaagtataagagacatcaggccctaagtattgcttacctgggagaagagtaa

SEQ ID NO: 67361 - DNA, 255 bp, Glycine max
  Peptide Sequence Number=SeqID_184139
atgaaacaacaattaaaaccctacactgctcttggaatagtcgtgggtgctcaaagctcaaagctttctacgctgccagttaacaagttgattgtgctttatgtggttttcaagcttgacgagagttacacgccgagcaaagtttccatccttgcttgtggtggttttcacaacttgaaggagattaagaccgtggaactcgtgaggccaactgggtgggtttatctatccttgtctggagcttatcctaggtaa

SEQ ID NO: 67362 - DNA, 180 bp, Glycine max
  Peptide Sequence Number=SeqID_184140
atgcaagggaggcaatcagatagaatatcaaatgaagcccgcgagagagtagaggaaaggaacaataggatgagttataagggcaatgctggcatatataatataaaaatgattcagctttttgctgccttccaggagccagaagtagaaatttgtgcaaccatgaggtctacctattga

SEQ ID NO: 67363 - DNA, 222 bp, Glycine max
  Peptide Sequence Number=SeqID_184141
atgcaaggccaccacggggatggcagcggcagtgcagaagaggtgtggcgacccaaacgaaaaaatgaagaactagaggagattggccaaggtgcccaccatcgagataggacggaacgaagtagtagatcaagaaaagacagaaagaagaaagaaagaatgtggaagagaagaaggggagaggaagggaggagagggaaacgtgagagaatgagggaatga

SEQ ID NO: 67364 - DNA, 744 bp, Glycine max
  Peptide Sequence Number=SeqID_184142
atggcaattgtagggacatgttctacacattcccttttgatgactaagaataaagtagataatgtggactttccaggaccatcagaactaaaggagataaagtcacccaatgtgatccagcagcagaagaaaagggtaaggtttttggtaccagagagtccaaagattgacacatgtgtaatggaagagttggaggaggtgatggaagcctgggagactggggtagcttacattataggacagacacacatgagagcaaaatcagggtctaacatgttgaagaaaataggcattaattcctctggtttttcattgccaagattgttaggacacgagggcatagaaaagaaagccaaatttaatttatgttcatggaagcagagaatggaactatcattgtttgaggatgataacttgtatataaaattgttttcagacttcagaaatcctttaggattccacagtataccaaattttccagtaacaccacctagaagacaacaaattcatgtccacaatgaggatatgggaaggcttagagagattttccttcaaccacctcaaagagccacattccaaacaaacacacaagctcccccactagtagaaatttccaaatcaacagctttcagcaagcttaagaaagtagtccatgaccctccaccaaagaggtatgctaggagggtgagcttatattacagaaacaatgctgcaaagccttggaaagagaaggagaaagaatag

SEQ ID NO: 67365 - DNA, 360 bp, Glycine max
  Peptide Sequence Number=SeqID_184143
atgtcgcgccttgcattcgttgaatcttcatctcccgttttagccagccattggatgtttgcaaaaaagaagaacgattctgacacagatgaagatgacaaccatgatttggacagtgcagtcgccaacacagtgaatgatgcttcttcttcggtgtttggtcctaacactgaacaaaaagaactatatgatcaggcagtgtctccaattgtgtatgaagtgcttgagggctataattgcactatttttgcatatggacaaatcgagacagggaagacatacacaatggaaggaggtgcaagaaagaagaatgttgaattttcgagtgatgttagtgtcatcccaagagctgtgaaatag

SEQ ID NO: 67366 - DNA, 252 bp, Glycine max
  Peptide Sequence Number=SeqID_184144
atggcttcctcttacgaccccgttattcttgttactctgctgcaagcatgtagtggtgaaatcgtaacgtttgttctcaatggtgaaacttacctagggcaaggttgccgccaagctattagggttattggacatgattgctggcataacatcgttgcttctcttgggttcaccactgaagagactgatatattggagggatattgtgatgagattgttcattcacctccaccgccattggtagagccttaa

SEQ ID NO: 67367 - DNA, 405 bp, Glycine max
  Peptide Sequence Number=SeqID_184145
atggttgtcatcttcatctgtgtcagaatcgctgagttcaataaccgaacccaaagggggcaccaaaacaacgccatttcttggcctcctctcgatgacaatcaaatgtgcgaggcgcggttgacgtcgacgatagtgtggtggggctctagcgagatgctgacaatcgacgtgagctctaacaggacgacaacaacattgtcctcgttgtcgtggcatgcactgttctttttagagatagatagacagaaagggataccagggtggtgcgagagtgatgaatatatgggtaatgttacaacacacagtggacgcaagagtgagagatttctaatttcaaaaatgccacagcctagcctactaagacggtctttacaagtaaccgtcgtagtcgagttcatttga

SEQ ID NO: 67368 - DNA, 762 bp, Glycine max
  Peptide Sequence Number=SeqID_184146
atgcaaccccaaagggaagcacctgaagatatggtgtgcaaggacaagttcttaatccagagtacaaaggttcctgccgaaacaatcagtgaagatgttacttcccgcttgtttgttaaagatggaagtaaatatatagaagaaaataagctgaaggtgatcctaatctgcccacccaattcaccagatctctctcctattaatggagatttcaagaatgggcttgaccatgaaaaagttcagatatatagggagccaaaagaagaagcaaggttgaaagtgtcaaaaaataaggagttgaatatggtcaaggatttagaagaattgaagccacaaaaaaagttagaggttgaagtgccaaaagatctggatttcaacaaaataaagaatgcagaggagttgaaaccagagaaagcagtagagttgaaagtgtcaaaacttctggttttgaacaaagtaaagaatgtagaggagctgaaaccagagaaggcagcagagttgaatgtgtcaaaagttctggatttgaacctcgtaaataatgtaaaggaactgaagccagaaacagaaacagagttaaaaatgtcaaaagatctggagttgaaaacagtaaagaatgctgaggaattgaagccagaaaaagaaacagagttaaaaatctcaaaagatatggagttggaaacatttaaaaatgttgaggaactgaagccagaaaatgaaatagagttaaaaataacaaaagatagggagttaaaaatcttttaa

SEQ ID NO: 67369 - DNA, 396 bp, Glycine max
  Peptide Sequence Number=SeqID_184147
atgtggttgcagtcacgaaagcgcaggccagtttgcgacaaagacgaactcagtagtgttgatgtagtaaagaaggagataaccaagcttttgcaagctggaatcatttatcctatctccgacagccaatgggtgagtcccgtccaggagcatgcctttcatccagtgcaatgcccccgaaaattgcatagaggtgtttatggatgtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 67370 - DNA, 2709 bp, Glycine max
  Peptide Sequence Number=SeqID_184148
atggcagagaacacacgttgtcaagcttcccttcatgaaatggaagaacgtctcagcagcagaatgaaatcaagatttgtcgagctcggtgcttccatgcaacaaacaatacacggaatgtttcagcagaggcaacaagattctccagcagcaagcaatccacctagaggattggagaatttgccttcttggaatgaatatcagatcttgttacttgattgttttggacatgtttatgaagatcccatggcggatttaatgaagctcaggcagacaggatccatcatagagtatcatgaggagtttgactcaattgtattaagagtggatctttctgatgagcgtcaacttagctgctttttaggaggattaaaacaagaggttcaaatgattgttcgaatgtttcagccaaattctgttcgaaaggcttattcccttgcaaagatgtatgaatcttccttctccaatacacaagccaaaccatttgtcaagaaccagaaatctttctttgttcctaaatcacccctacttccaaaccctcctagatcaaccaatcctttaaccatcaatccctctaccaaaccacaaacacctaagcacctaactcccacatacatggctgaaagaagatcgaagggcctatgctacttttgtgatgaaccatttacacctgaacatggccttacacataagagattgcagatccatgtgttggaaattgaagatgaagaagagggccctagacctcaacaacctgatgctaatgtggaaccatctggtcttcccccttgtcgagttgaccatgatcacaagattcctttaatgcaaggagctaaccctaccaacaagaggccttataggtatgctaaacaacaacaaaaagttattgatggattgattcaagactatttaaagtcaggaattatacagaagagtgacagtccttatgcaagtccaatggtattggtgggaaagaaaaatggggcctggaggctttgtgtggattatagggatctcaataaggcaactatcaagaacaaattccctataccattagtagaagaccttctggatgagttgcatgggtcaaccattttttccaaaattgacttaagagctggttacaatcaagttcgaatggatgcagctgatattcacaaaactgctttcagaactcatgcgggccactttgaatacttggtgatgccctttgggcttaccaatgctcctaccacatttcaagggctgatcaattcaatttttcagcattacttgagaaggttcttacttgttttatttgatgatatactcatctacagtagaagttattacagaagatttgtaagtcaatatggtgctattgcaaaacccttgactgatatgttgaaaaaggaaaattttagttggtcttctacagcaaaagaagcatttcaggaattgaagcaaaggctagtagcatcatcagttttggccctaccagatttttctaaggaatttgtggtggaggtggatgcttctggcctaggcttagtccaaaaatggaggcactacttactccccaagaagttcatcattagaactgatcatagaagtttgacatacatcctagagcagatattgtccacagcattccagcaaaaatggttagtaaagttgatggaatttgatttcaacatagagtataaagagggtcgagaaaatgtggcgacagatgctttatctagacttgattcccctaagatcatggcattacaggcagctcatttcatggccttatcacatccttatactgctgcgaatgtggcccaatgcttcctggataatgtctttaaattgcatgggtttcctgacaccattaccagtgatagggattctatttttgttagccacttttggaaggaatttatgtccttgcaagggattcagatacaactctctacagcttatcacccacaaactgatggtcaatcagaagtggtgaataaatgccttgaaacatatcttaggtgcatgtgtagtgactctccagcacagtggtttaagtggttgcctcttgctgaatggtggtacaattccacttaccatagcattattaaagcaagcccttatgagattgtgtatggccaagctcctcctgttcatttaccttatcttctgagggaatctaagattgctttggttgatagaagtttgcagaaacgtgaggaaatgttaaagttactcaaattccacatgaaaagagcccaggacagaatgaagcaacttgcagatagaggcagatctgataggagttttcagattggtgacttggtttatgtaaaattacatgcttatcgccaagtttcagtgcaggccagacccaatgcaaagttggcccctaagtactatgatccatttccagtagaagacaagattggtgctgttgcatacaagcttaaattgcctcttggatcaatggttcataatgtcttccatgtttctcagttaaagaagtttaatggtactgctactgctgggaactttagtccttcacctttattggatacttctcagaaggaacctgcagctatcattgacagaatgacagtcaagagaggcaatcgtgctataaccaaagttttggttcaatggaagcatcagctacctgaagatgcaacttgggaattcttttatgacttgaaacagaagtttcctcactttaatccttga

SEQ ID NO: 67371 - DNA, 699 bp, Glycine max
  Peptide Sequence Number=SeqID_184149
atgaatgctcaatgtagcactgataataagactatctcccggcaaaacctgactcaggattttaagggagaaaacaaagctaatctcactgaatccagagttggggaatccaaagttctcccatctgcagtggatgaagtaaaaagggaagcattgaatgtgagttctagaactgtacctcagtatcaaaagggaggcatgtctaatgagcgtcctgtccatgtttctggcaatgatgatttggccaagtcaatgagaaattatgccgatgttagtaacaatgctggagttaattatagttctggaaattttgcacctgatcagcaacttactttgtcaagtcctttgagaactaattccagccaaactgctactggcaccctggaagaagccgcaaaactaaaagatagagcagataattataagaactccgggtttgactttgaaagcaatgagacatactttcaagctggtttgaagtttctgcatggagcctctcttttagaaaattgtcataatgagagtagcaagcatggggaaatgagtcaaatgaaaatttttgctactgcagcaaaacttttcaattattggtcgaatgcgattttggttgttaaaaataagactgaagtgagtgtcagctcatggcatcttggttcattaaatattggaataaacacaagtcccacattggctagatag

SEQ ID NO: 67372 - DNA, 507 bp, Glycine max
  Peptide Sequence Number=SeqID_184150
atggcagctgctgctttggcatataaatgcatggaggtggcatacatgagagtggtttactgtaaaaattctagtactaacagagatcgacatgagttgcaatcaactcttcaactggtttttcaaggcgaatctccttcatcttctgcatccgatgttgataaccttaacaatcagacagcagcggataaggctactttgcccaggggtactaatactcatgttgctatcaaccaagtcatatctgctcgaactcgtccaaatttagtcaggcttcttgattttactcaggacatacattttgcaatggaggcttctagaaaatgtcagagcacttttgtgcttgctaatgtgatcatgcaagaagcatggaagaaggactgtatagcttctattagaagcgctattgatttcagcttccaggatgtagatgagcttgtacgtctggtttggactgccacaaaagccataagtcacgctggtcttggtggtactagattatcttga

SEQ ID NO: 67373 - DNA, 967 bp, Glycine max
  Peptide Sequence Number=SeqID_184151
cagaggactacacgtcctcaccttcagaggaaaacacgtcctcgccttcagagggctacacgccctcgctttcagaggattagacgtcctcgccatcagagggctacacgtcctctcctttagagggcttcatgtcctcaccttcggaggacttcacgtcctctccttcagagaactacacgtcctcgccttcagaggactacacgtcctcgccagcaaaggactacacgtcctcgcattcatagggctacatgcccttacctttagaggaattcacgacctcaccttcagaggactacatgtcctcgccttaagaggattaaacttcctcaccttcggaggactacacgtcgtcgacttcagagggctacacaccctcgccttcagaggattacacgtcttcgccatcagaggactgcacatcctctccttcagagggcttcatgccctcaccttcagaggacttcacatcctctcctttagaggactacacgtcctcgccattataggactacacgtcctcgccttcagaggactacacgtcctcgccttcagcgggctacacgtcctctccttcagagggctacatgccctcagctttagtggacttcacgtcctcgccttcagatggctacacgtcctcgccttcaaaggactacacgtcgtggccatgacaggactacatgtcctcgctgtcatagggctacgtgtcctcaccttcagaggactacacgtccccccctttagagggctacacaccgtcgccatcagaggacgacacgtcctccctttcaaagcactacatgtcctcacctacaagtcctcgccttcaaaggattacacctcatcgccatcagaggacttactacacgtcatcaccttcaaagggcttcacgtcctcgccttcagagggcaacacgccctcagctttagaggactacatgtcctcgccatcagatggctacac

SEQ ID NO: 67374 - DNA, 737 bp, Glycine max
  Peptide Sequence Number=SeqID_184152
atctggcgcagcaggaggtgcgcgagcagcgctacctgcaggtgatcgcccagtacgagcgggccgagctcgacctgcttgtgcaggcattcgcgcacttggtgatgtcctacgagttgcgcgttgaggcggcagactttggcgacgtgctcggaagcacattcatgatgctggacatgggcaacgctggcgccggtcaattcttcacgccgtatgaggtgtcgcgtctgatgggaaacatgatgatgggcgatggccaggcgctggtcgacaaggcaaacgagcaaggattcctccgcgtgctggagccggcctgcggcgcaggcggcatgctgatagcggcagcacacgcgatgcacgaagccggcctgaaataccagcagtgcatgcacgcgacggcgatcgatatcgatcagcgctgcgtgcacatgacgttcatccaactcgcgctgctgcacgtgcctgccgtggtcattcacggcaacggcctgacaggggaatgccgtggccagtggttcacgccggctcatatcctgggcggttggagcgcacggcttcggcgccgggaagcggaagagagcgctcgagcgctcttgcaggagccggtggccaaggtagtggcgcatgttgacctgggtgccgatgacgctgatgtgcccaaggccgagcagccgctgcaggtgattccgaaggcgattcgccaagctgccgcagctggccagatgtcgctcttctag

SEQ ID NO: 67375 - DNA, 1101 bp, Glycine max
  Peptide Sequence Number=SeqID_184153
atgcatcatttgctgcagtcattggaacacaataatgcaggacacactttccagggtctggcacctttcctgcgcatgaacctgaatggttcagacttgcgcgcacatgggcaatcgctgctggtacaggccaaccaggatcaggaaaatgccatcctgtggatgaacctggccacggtatttttatgcctcaagatgcgagacatgggattagccatccaggaacaggcgctctcactacaacgcctctacattcgcccagccaattgccggcctgcaaagtttcgcctgctcatgatcatgacgcccggtgatctttctgaaaatacaccgattgattgcttattggaaaacagcccggtagaactgctctattactacgcgacgacagagcaacctctgccatcacctctaccggcccacgatgccgtaatggtcgggctatcagatagccaggccaaccgtgcgctgttgctggcggttcaagccagcctggagggacatacaaaaccggttatcaacccaccgcacttgctacccaacgtcaaccgcgatcaattgagtacgctgttacagggagtcgccgggctggatatgcctcgtactcaccgcctctcgcgcagccaggtagtgacacgtttaagcatgggcaaccacaatagccacaacaatccggatgcattaccaggctttccattcattatccgccctgttggttcacaagccggtaatgacctggcaaaagtcaccagcacatctgaactggcagagtatttaagggcagtccccagtaccgatttctttgtatcgcgctttgttgactacagcagccaggatggccagttccacaaatatagaatcgccatgctgcacggccaaccatttatttgtcatatggccatttctagccactggatggtgcattacgttaatgcgggcatgtacgactctgccgaaaaacgtgccgaagaaggccagttcatgcaggacttctccagtttcgccacgcgccatcaagcggctttggccgcaatctaccagcgtttgcaacttgactatctgtgcatagactgcgctgaaacagccgatggtgacttactg

SEQ ID NO: 67376 - DNA, 559 bp, Glycine max
  Peptide Sequence Number=SeqID_184154
cgaccaacgatcattggcagccatcgggatcaacatcggcgctcggcttctcctcccgatagagccggaagagcttcttgtggttcacgaggaggccttcgcgtctgagcagcacatgaaggcgtcgatatccaaagcggcggcgttcatgcgccagcgccttcatccgctcgcgaaggtcatggtcatcgctgcgcctgctttccgccttgctgcgggcgtcaccactaatgggatggtccgcctcgtcctcctgccgcatcatgaggcggccaacccgaaggaggttgcaatgtcacagcgcaatatgccgcgcccagcggctgtctacggaattgatattggcaagaacatctttcacgttgtcggtctcggaagcgatggcgtcccagtccagaaggttcgtttccgacgcgacacactgctacagttcttcgaacgcgcagcgccggcgatcgtagggatggaatcgtgtgcaggatctcagtggatcgccaggaagatgcaggcgttcggacataaggtgcgtctgatccccgcgcagttcgtgaagccctac

SEQ ID NO: 67377 - DNA, 1218 bp, Glycine max
  Peptide Sequence Number=SeqID_184155
atgccgatagcgccgccgacgctgcccagaatcgtttccatcaccgtccagccaaaaaccggcgtcgttgacgtggctcagcacgatggagccgccggcgatgcagatagccagcgcggccagctgcccgccgttcagcccgagctggctggtgaccggcagcaccaggccgacggtggtcagacaggcgacggtggccgagccctgaatcacccgcaccatggcggagagcgcaaaggcggccacggcgatcggcaggccggcgccgatcatcgcgtcacccagcgccggccctacgccggaatccaccaggatctgtttgaacaccccgccggcgccggtcatcagcaggatgatcccggccggttgcaccgcggcggagcagatggccagcgtctgttcgttgctcatgccgcgcggcttcgccaggccgtaaatcacgatcaggcaggccagcagaatggcggtgaacgggtggccgataaactccagccactgctgcagttgcgagccgggggtgaccagccgcgcgccgatggtcttcatgccgaccagcaccagcgggcacagcaccagcgccaggctgaagccgaacgacggcagattgcccttggtcaacgtcggctcgttctcttccggtggcatcggccagttgacgaagcggctgataaagctgccgtacagcgggccggcgatcagcatgccgatcaccgccgccaccaggccgatggcgatcatccagccgaagtcggccttcatctgcgaagccagcagcatcggcaccggccccggcagcaggaaggaggcggcggcggccacgccggcgaacagcggaatggccagcttgacgatattgccgtcggtgcggcgcgccacggcgaacacgatgccgatcagcagcaccaccgccacgtcgaagaacagcggcagcgcgcagatcaggccggcgatgccgagcgcgtagtgcgccttgctttgtccgaatcgtttcagcaattgcgccgcaatttgatcgagcgcgccgacctcatgcaggatcttgccgaacattgccccgagcgccaccacgatcgccaggaagcccagcgtgtcgcccatgcctttttgcatggtgtcggcaatatggtccagcggcatgccggagaagatgccggcggcgatggacaccagcatcagcgcgacgaaggcgtgcatgcgcgccttcatcaccaggaataa

SEQ ID NO: 67378 - DNA, 219 bp, Glycine max
  Peptide Sequence Number=SeqID_184156
atggtggtgaataggagtagggaggagaaaaatagaagaaaaaaatttgatgaaggcactataatggatggaactaacggtgatgtagctgttgatcattaccatcgttatcagatatttgcttgcataatttgtctcaagccgcaagccttaaaatacacaatctacttaaatgtgaatttttttcaaccaagttcacatgacatacggattaattaa

SEQ ID NO: 67379 - DNA, 177 bp, Glycine max
  Peptide Sequence Number=SeqID_184157
tctctgtgtgtcaacgggctcgcttgcctctggctgagaaaaggtgcggataaccataaggtgcggataaccataaggtatctccgcatgtcatcgaactcgccgtctttggatgacaaagggtgtgtgcgggttaccgtcgagtgtctccgcatgccaccagactcttgggtcacg

SEQ ID NO: 67380 - DNA, 675 bp, Glycine max
  Peptide Sequence Number=SeqID_184158
ggtggacccttgggtactagtaccttagccttcggagggctgcacgcccttgccatcagaggactgcacgtcctcgccttcagagggctacatgccctcgccttcagaggactacacgtcctcgcctttagagggctacacgccatggcctttagaggactacacatcctcaccttcagagggctacacgccctcgccttcagaggatttcacctcctcgccttcagagggctacacgccctcgccttcagagggctacacgccctcgccttcagaggactacacgtccttgccttcaaagggctacacgccctcgccttcagaggactatacgccctccccttcagaggactatacatcctcccatttagaggactacacgtcctctcctttagaggactacacgtcctcaccttcagaggactacacgttctcgccttcagaggactacacgtcctaaccttcagagggctacatgccctcaccttcagaggactacacgtcctcgccttcggagggttgcacgtcctcgctttcagagggctccacatctacgcctttagagaactcaagttccttggccacccccctgatctgatgcaatcctaccccccaagggcattggatagaagactccaagaagattgggccaaagatgcaagagaaggccctagg

SEQ ID NO: 67381 - DNA, 636 bp, Glycine max
  Peptide Sequence Number=SeqID_184159
atgcactattctcccgaagccctcaccgcctttgtagaagccgccgccagcggttcgttctccgccgccgcccggcggatgcgtaaaagccagtccaccatcagtaccgcgatttcgaatcttgaaaccgacctggggttgactctcttcgatcgttccactcgccagccgacgctaaccgcgcagggcgagcaggtgctgggctatgtgaaagcaatactggccgccagttcgcggctggatgagctcgccagttcgttatccggcaataccgaaccgcggctgaccttcgtcttgtcggataccctgcacccggatgtactggaggatttgctggaacagttcgatcggcgttttccgcataccgagtttgaatgtctgattggcgaagatgaagacgtggtggatctgctgcaaaaagagcgcgctcaggtggggcttatcgaagcccgggacagctatccgatggagatcggcagcatgcgcctgccgttgcaaacggcgatggggatttatgttgcgccggggcatccgctggccggtcagggacgggttttctgggatgatctgcacggctggcgtgaactgcggcttagcacttatcttgagagcgcgccggatccttcgcgcggccag

SEQ ID NO: 67382 - DNA, 205 bp, Glycine max
  Peptide Sequence Number=SeqID_184160
atggagatggagggggagattaagaatctcatcatggtatggaccatagctccagctacaatgtgttactgccacagaattgggaagctaatcccagaaggcacatcaagactcatagccctattcccagccatagtgatcctccttctcctccctctaagactcatctccattcaccttggaggcccttcttctttcttccttg

SEQ ID NO: 67383 - DNA, 213 bp, Glycine max
  Peptide Sequence Number=SeqID_184161
atggtggctgtgggtgatggagaaagtgcttgggacgttagaaatggctttggaagaaagaaagaagaagaaatggtgtttttcctaagctacacgaaggcaaaggctgaaaacgctcaagtgagaaatggtctcggacacgaaaacctcccgcacactccagaaatcttctcaaagatcccaaaggtcagatcgtggacaagtgtcttgtga

SEQ ID NO: 67384 - DNA, 336 bp, Glycine max
  Peptide Sequence Number=SeqID_184162
atggggatgaaaggcaaattgcccccttttgggcacttttacaaactatttccccaaatagggttgtttttaaagtttttcatgcatgggtctgttttggacgtaaagggcatgcatgcaaaagcaaatcgccaattccattggcgattttccctatccgtactggactcgccagccccattggcgatttcgccatgcatggggagttgccagtcaaactggcgagttccaagaaggagggcgcaagctagggttttagggtttcatttggcaagcttggcaggaggagggttgcaagggttgcagtctggacgtggaactcgccattcccactag

SEQ ID NO: 67385 - DNA, 357 bp, Glycine max
  misc_feature (91)..(91): n is a, c, g, or t
  Peptide Sequence Number=SeqID_184163
atgccttacctcggatatgccgctgaggggcaggcgttttgcggcatacccctgccaaacactttggggggccctcaatatcgcccacaancacaacccttgcattttgcggtaggaagagtccctcctgctatgatggaaagggagaaatttgatcatatagaggagtggctgagggttattgaaagaggcagagattatgcctttgctgacatggcagaactgtgcctagtgctcgatgtcattatccctctgaggttcaaggtgccggattttgataagtacaaggagactacttgcccgaagaatcacctgaagatgtacaaacaagaaaatgggggcatactcaaaaaatga

SEQ ID NO: 67386 - DNA, 513 bp, Glycine max
  Peptide Sequence Number=SeqID_184164
atgactaccttgacccagatatggatgacactgctgcatagcaatgtcttgccgagcgaccacaactttgacctccctctgcctaagtgtcagttggtgtatgccatcctgacgcagatgagcattcacatggcccaagtgattgctgatgtcatttatttgtttgcaggaatggcgcctactaggcaccctctggaccaagagaagtccaacagggccttggggtttccggctctgatcacgggcctctgtcagtcctacggagttcctatcacccccagcaaggtaatccgaccactgatcacccgagccttcatcgagaagtactgcacgcctaggcaggcgcagggcaacgcacatcaggacgcgggcgcaccgccaccacctcggcaagccgattcggttgggccactgtgcgtggagcgtctcagtcagcagggccagggttccgccccttttgtatgtcgtaccccagagcagtttggggctgaggtcgcatggcctggtgactag

SEQ ID NO: 67387 - DNA, 708 bp, Glycine max
  Peptide Sequence Number=SeqID_184165
atggcttcggtggacacattcgagagtctggtcaggagacttgctttctacctcggcaatcaagccttatctaggctattgcttcagaggggatgctccgtaggtctgaccgtggccattgctgtgctttttggggacacgccatcagtagggaataacatgatggacccctcggggtcttccggttcgtcaggagggggtgggtctgaatcctcgtggacgggtgcccttctatcttcggaaacgctttcaggaacgggatccgttaatcagcccgcggagggaatgcctgttcctcccgcaaatccggtcgtggagcaagccggtccggcaaatccggaagataccactgaaatcataggtggagactctattgactcgataaggaaccgcctcttacagtcatacgggaatccttcggcggagcaaatctctcgcgcctcgtatgacgccgatgatctctttcaggttaaagtggagatcataagggggatgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaagtttttcgaagacctcgacctttagaagatgcaaattctactacttaa

SEQ ID NO: 67388 - DNA, 273 bp, Glycine max
  Peptide Sequence Number=SeqID_184166
atgtatgtttttattcaagaaaaagaaaagctaagtgtggaaaggcaacccagcctcattacaagcctagtaaaagtccttcggattcaagtttgggtgttcttgactgtatgtgtccgtgaggctttggttgatgatccttccttgatatccgtcattcctactaacttatctcagctgtgtttcataataatcatgttcctgtctttgaaaaactgcatgtcttgtgagaagttgttgatggaaacattgaatgccattcaagtcatgtga

SEQ ID NO: 67389 - DNA, 249 bp, Glycine max
  Peptide Sequence Number=SeqID_184167
atggtgttgaacgccaattacagtgcaaagcaaggaaccattcaatgttttgatcaggaatacgaaagataccaaaaaggaggggcaaaagggctagcctctagctcgcctgggcgggctttcagaagacttcagcctgaaggaaccaccttgtctaggcatggaagggagatgtggaagaggttccaaggttcagaaagtgagggaattgagagaagagagaaagaacaagaagaaaggagagtgtag

SEQ ID NO: 67390 - DNA, 249 bp, Glycine max
  Peptide Sequence Number=SeqID_184168
atgttcaagaccccttggctatgcatttcggctattttgggcaaaaaaacacgttttcgtgaagaaaaatcgagtcgaagtgattccgtaacgccttccgtaagtgattctgtggaaattcttcatcgttcctcgtcgttcttcaccgttcttcgttcgttcttcattcttcaacggttttcttttcttccgtttttgacgtgctttagtcatttacttaagtcattctctcacctaatcaaaagataa

SEQ ID NO: 67391 - DNA, 369 bp, Glycine max
  Peptide Sequence Number=SeqID_184169
atgaaactggccaaatacaggctaaaggcccaagtggagaaggacgaaggcccaagtggagaaggacaaagcccccgagtggagaaggatgaaggcccaagtaatccttgtggcgtctaccctgacttatcttccttcactggaagtggcgtcaaccctgacttatcttccttcactggaagtggcgtctacccggacttatcttccttcaccggaagtggcgtctaccctgacttatcttccttcactggaagtggcgtcgtccaaaaactctacagcctgtatcaaacgatccgccccgttctatcctatatgtcgcgacttcacaacgaccgatgtcggctattgtattttctattcaattcctga

SEQ ID NO: 67392 - DNA, 1632 bp, Glycine max
  Peptide Sequence Number=SeqID_184170
atgactgtattcgcctttggccttgagttaaagggcgaactgtgcgacacagaagggcgaaaaagcacatccggcgcaccgcccggtaaaaaacgcagaataaggagatcggctttgttgttatcaccgcacagagggcgctggctggcgctgattatgctgctgttgccgctgctggcgcaggcgtggcagccggaacgcagctatcgcttcagcattttgcacaccaacgatcatcacggccacttctgggccaacgcgcagggtgaatatggtctggccgcgcaaaaaacgctgatggatcagcagcggtatgatgtgcaggcgaagggcggcggcgcgctgattctgtcggcgggcgacgtcaacaccggcgtgccggaatcggatgtgctgaacgccgagccggacattcgcggcatgaaccttatcggctatgacgcgatggcgctcggtaaccacgaattcgacaaaccgctcagcgtgctgcaaaagcagcagaaatgggcgaagtttccgtttcttgccgccaacatttatgccaaaggcagcgataagcgcctgtttaagccgtgggcgatattcaatcgtatggggctgaaaattgcggtgatcggcctgaccaccactgacacgctgcgcatcgccaatccgcaaaacgtggcgcagatcgagattcgcgatccggtaaaagagacggaaaaagcggtggcggaactgcgcgccagcgacaagccggatgtaattatcgcgctgacgcacatgggtcactacgacgacgggcagcatggcagcaacgcaccgggcgatgtggaactggcgcgcagcctgccgccgggcacgattaatgtgatcgtcggcggccattcgcacgatgcagtgtgcatggcaaaagagaacgtcagcgtggcggattatcagcccggacagccgtgccagccggatcgccagaacggcgtgtggatcgtgcaggcgaaagagtgggggaaatttgtcggtcgcggcgatttcaccttccgcaacggtgagctgacgctggataactatcagctgattccggtcaaccttaagcacaaggtgaagaaccttgatggcagcgaaacctggctgccgtatcaggaagcgatagcgcagaacggcgcaatgatgaagctgctgacgccgtatcagctgcgcgccggcaaacagctggcggtcaacgtgggtcgcagcgacagcgtgtttgatggcgaccgcagcaaggtgcgctttgaacaaatgccgctggctcagctgatcctgcgtgcgcagatggcggctactcaggccgactttgccgttatcagcggcggcggtattcgtacctcgctggcgcagggcgagatcagctggcgcgatctgttgcagatccagccgtttggcaatcaggtggtgtccgtgacgctgacgggcaaagagctgctgaactacctggcgacggtggcgaatatcaaagccgattccggcggtttcgcgcagttcagcaacatcagcctggtggccgatggcaaaagcgtcagcgcagtgaaaatcaatggcgagccgctgcagctggataaaacctatcgcatggccaccaacagctttaacgccagcggcggcgacggctacccg

SEQ ID NO: 67393 - DNA, 924 bp, Glycine max
  Peptide Sequence Number=SeqID_184171
ctgcgctgtgccgcgccgatcgcggtgcgcttgcaggatgaccttgcccattgggccgatacgccggtgcgcagcatcgagctgctcgacaccgtgttctatcgcgagcgccgcgcctacctggtcggccgcgtgttcggtgagcatcgcttctcgccgtgcgtgatcgcgctggtcaacgacgagcgcggcctgcgcgccgatgcggtactgacccggcgccgcgacgtggcccatctgttcggcgtgtcgcgcagctatttccaggccaacctgaccacggtcggcgacgcggtggtgttcctgcgcagtctgctgccgggcaagcccatcgatgagatctacaccgtgctgggccgcgccaagcagggcaagaccgagcgctaccgcaccttcttccgccacttcaacgagcacccgcaggagcggctggtgcatgccgaaggcacgccgggcatggttatggcggtgttcaccctgcccagctatccgctggtgttcaagctgatccgcgaccgtttcgtatggcccaaggcgatgtcgcggcagcaggtggaagagaagtacgcgctggtgttcaacctcgaccgcgtcggccgcctgctcgatgcacagccctatcgccacctgcgtttcccgcgtgagcgcttcgcgccagcgctgctggaggaactgctgcagcaatgcgcgcagagcgtgcgcgtcgatggcgatgaggtggagatcgcgctgtgctatgtgcagcgccgcttccgtccattgaacctgtacctgcgcgagcagggcggtgaggcggtgcgcgcggcggtactcgactacgcgcaggcgatcaccgacatggcgcgcaacaacatcttccccggcgacatgctgccgaagacttcggcgtatcgcggcacgtcgcgccgtgttctacgactatga

SEQ ID NO: 67394 - DNA, 1185 bp, Glycine max
  Peptide Sequence Number=SeqID_184172
atggagagaaaagatggactttggcactcaacgcttagacccaaagatttgtggaaagaaggtgtgctaaggattgatcccttctcttattcaccttctgagaccttgcaagaagaatatgtacatttgttttccaactattttggaagagccggttatataagggaatttcctttaaggaatccctcttctccaaacctcaacaacatcatctttgaacactcaccatctaatgggaaggtctaccctccaagagctatagtctggagaagcaaagagtctagggaatccttaagcatagaagacatctaccttgaagatcctgagttgagtccaactttctcagattgggagttctcatattatggcatgcacctatatttgtgcctgaaccaatataaagaagaaataagggcaaggaaagcctcctttagatgcctacaaagactaaacgtgcatttacctttcatatcaggctcccagtttctgtgttttgcacactctgaaactaagttccaattaggaatggacaagccaatgttgattcctaaggcagattgctacaaagggaaaaagaagttgattgaagatgataaagatgcaccccctacacgctatgtcaaagcaaaaccaaatagactcttcaaacgtgaagtagctgtactgcatcagaatgagcttacaagtaggaattggcaagctctccaaaggtattacaaaccaggagcccactgctctggtctagaacctgaagagaagccaccattaaaaggagttcatcacaagacaggacgttgttatcaaactatcaatcgtaatcccttggtggttgattcaccatccaattgcgtttgtcaatggaagaaagactttgttgttgtgtctgagagaaatttctcattcactgtagagcttccaaactccacattcaccttcattcatcaagtccaacccattattgaagaagtgaattctaattataaggctcctactactattaaagataccgccatggaagtctatgatggtcctcctccatcccaaaaatatgtacattttcttgagaaaacactgctcagaaccacagagtcacttgttgaagctctttatgatagggctcatgctaaaataaaagccaaaagatggaaaatgcttggggaattcttattttataagcttttttaa

SEQ ID NO: 67395 - DNA, 770 bp, Glycine max
  Peptide Sequence Number=SeqID_184173
ggctatacaccctcgccttcagaggactacacgccttcgccttcagagggctaaacgccctcgcccatagaggctttcacgcattcccctttagagggatacacgtcctcgccttcagaggaaaactgaacgtccttgccttcagaggactacacgtcctcgccttcagagggctacacgccctcgtcttcagaggactacacgtcctcgccttcagagggctacacaccctcgccttcaaaggactacaaatcctcaccttcagaggactgcacgttctcgccttcagagggctgcacgtcctcgccttcagaggcttacacgtgctcgcctcgagagggctacatgtcctcgccttcagaaggctacatgccctcgccttcacaggactggatgtcctcgccttcatagggctgcatgtcctcaccttcagaggactacacgtcctcgccttcaggggactgcacgtcttcgccttcagagggctacgcgttctcgcctttagagggcttcatgccctcgccttcagaggatgggacatcctcgccttcaaagggctacacaccctcaccttcagaggactgcacgtgcttgccttcaaaggtcctcgccttaagagggctacacgtcctcgccttcagaggattgcacgtcctcgccttcagaggactgcacgtcctcgccttcataggactgcacatcctcgccctcagagggctacactccctcgccttcagaggactgcacgtcctcgccttctgatcgaggcc

SEQ ID NO: 67396 - DNA, 609 bp, Glycine max
  Peptide Sequence Number=SeqID_184174
gacatatttgctgctggaactgatacttcagcatcaacactagagtgggctatggcagaaatgatgagaaatccaagagtgtgggagaaagcacaagctgaattgagacaagcttttcgagaaaaggaaataattcatgaaagtgatcttgagcaacttacttatttgaagttggtgatcaaagagacattcagggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataactttaactatctcccttttgggggaggaagaagaatatgcccaggcatgacattgggtttagctagcattatgcttccactagctctactactgtatcacttcaactgggaactcccaaacaagatgaaacctgaggaaatgaatatggatgagcacttcggattggctattggcaggaaaaatgaattgcatttgattcccaatgttaatttatga

SEQ ID NO: 67397 - DNA, 525 bp, Glycine max
  Peptide Sequence Number=SeqID_184175
atgtcttgtataacagaaatgtttgcatctttggaatatcaagatgaccatgctacactgtggtcatttgttacaataaaggaaaagataggagatgggggtggtagtaggatgtggagttgtaatttttgtgaaaaagttgtcaaaagttcatactttagggttaaagcacatttgcttagaatttgtggtagtggaattgctacttgtccgaaagttactgatgcatatttggttgatttgaggagggtttttgaagaggctgaaaatagattaaagtctaagaatgttcctttacctactgacaaaaggactccaacaccaccaattggggttacacagtggtacatgacagtgttacacaccgggacaagatgttgttccacgcgcggggcgattgtgggaagatgtacgatagccagagttgaggcacgtgcacacacgagggttaatgacgccgaattccacgatggtgttagaagaaaatgtcgtcgatttgtcatttctatgacggtcataatatga

SEQ ID NO: 67398 - DNA, 372 bp, Glycine max
  Peptide Sequence Number=SeqID_184176
atgggagttgggtctaacagaagggctagtccctcacagcatggtgaaccaaggtccaaatcgctactacgagagcacactgggaaatgcacatcaatggaatctctagttcttcaactccatgaaatctcagctatcaaatttggcaatttcaagctcaagtctggcatctcctctccaatctacatagatcttcgccttgctatatcttatccttctgtcctccggaatatttctcaaacccttatttcttctgtctcttccacttcatttgaccttgcctgtggtgtcccctacactgctctgcccattgccacttgtgtctctgttactcagaacatccccatggtcatgcgcggcaaggatgcatga

SEQ ID NO: 67399 - DNA, 1096 bp, Glycine max
  Peptide Sequence Number=SeqID_184177
atggcctctcctccttcttatgatgcctttgcttcttctgagattgccacagaagcaaatgctttgctgaaatggaaagccagccttgacaaccaaagtcaagcttctctctcttcatggaccggcaataatccttgcaattggcttggaatttcatgtcatgactccaattctgtttccaacataaaccttacaaatgctggattaagaggtacgtttcaaagtcttaacttctcattacttccaaacatcctcattctgaatatgagccacaactttttgtctggaagtattcctcctcaaattgatgccttgtccaatctcaacactcttgacttgtccactaataaactctctggtagcattcccagtagcattggtaatctgtccaaactttcatatcttaatcttcgtaccaatgatctctctgggactattccttctgaaataacacagttgattgaccttcatgaattgtggctgggtgaaaatattatcagtggaccccttcctcaagaaataggtagattgaggaatctgagaatacttgatactcctttttccaatctcacagggacaatcccaatctctatagaaaagttaaacaatttgtcttatctagatttaggattcaacaacctttctggcaacattcctcgggggatttggcatatggacctaaagtttttgtcatttgcagataataatttcaatggttccatgcccgaagaaattgggatgttggaaaatgtaatacatcttgatatgaggcaatgcaatttcaacgggtccattcctcgtgaaattgggaagttggttaacctcaagattctatatcttggaggtaatcatttttctggttccattcctcgtgaaattggttttttgaaacaacttggtgaacttgatttgtctaataactttctctctggtaaaattccctctacaattggaaacttgagcagtttaaattatctttacctttatagaaacagcttatctggttctatcccggatgaagtgggaaatctccattcacttttcacaatccaactgttggacaacagcctctctggaccaatcccggcttccatag

SEQ ID NO: 67400 - DNA, 321 bp, Glycine max
  Peptide Sequence Number=SeqID_184178
atggatatcaaaggttggtgcaattctggcaggagaacaatccaattggggaagagttacaatgagattgagcatataaactcgctatcagccactggaacaagcaataagttgaggtggaaattgttgtggatgaagctcaagaaagagaagaagaagatttttgagtctgcatcatcctttcaggtcccttatgatcaatacacttactctcagaatttcgatcaagggactgcacttgatgaaccagataatctttctagatctttctctgttcggtttgctgatccttccattgtacttgtgaaaagaaaagggtag

SEQ ID NO: 67401 - DNA, 921 bp, Glycine max
  Peptide Sequence Number=SeqID_184179
atggcgacgagggtccaccaattcttcgacgaactcgaagcgaagaaaaccattctggcgaaatgcaccgacctcttcaccaccctctccacccacttctcctccctccaacactccatctccgagaaatcccaatccctcgattcaaacctacaatctctcgattccctctccaaagaaaccctcgaatccctccaccgccgtgagacctccatccccgagcgcgagtccgccgccgccgcccgcatcgaggagcagagggaggccgcgctcgccgacctccgcgccacgcatccacctgaccccgacctctccgccacgctcaaatccctctggcggaagatggacgcccccgcgctactgcgcttcgtggtgtccaagcggaaggagtcggcgtcgctgcgggcggagatagcggcggcgatggcggaggcggtggacccggcgcggctggtggttgaggcggtggaggagtttctgaagagcaaggtggccaagtccggggtgacggataagaggtgggcgtgcgggcttgtgattcaggcgctgatggtttcggagtcggagtcgagggaatattcaagaaggatcgcggagagagccgtttcggttgtggaaatgtggaaggagcatttggatggagaatccgagagtggtgctgccgaagtggtcatgtttctgcagatggtcgtttgtttcggcttgaggtctaggtttgatgatgagtatttgaggaagctcgttatgcagtttgcttctagaagggacatggcaaagcttgctgcttccttacagttcggggacaagatcatagggggtgctagatgttattccaacattgtacatttctttttcacttgcactttatcgtactacgagtcagcaacaattgagttctttctgcatttcgctagcaattaa

SEQ ID NO: 67402 - DNA, 303 bp, Glycine max
  Peptide Sequence Number=SeqID_184180
atggaagttaatgagaaatgtgatgtgtatagttttggggtcctagcgtgggaaatacttttaggaaagcaccctggtgatgttatatcatctttattgctatcatcttcgtcgaatggtgtgacctcaacacttgataatatggcattgatggagaacttggacgaacgtctccctcatccaacaaagcctattgttaaggaggtggcatcaattgcaaagatagcaattgcctgcctgactgaaagtccacgatctcgccctaccatggagcacgttgccaatgagcttgaaatgtcatga

SEQ ID NO: 67403 - DNA, 447 bp, Glycine max
  Peptide Sequence Number=SeqID_184181
atggggttggaagaatctaggcagagaaagaagcaggggagcaagaacaaggagattgctaatataacaaaggagaggaaccacactaagagaaagaagatttccaagtttgagaatgagcctagagtggttcttcctcttaagcatagttcaaaggttcgaaatcacaatgaagccaaagttttggcacaagtttctgcgtgctctaagagttgtagtaatagccgaagaaaatgtggtagtggtcctagtgggttaagaacgagctccaatttgccaactaagcagaagaaattaaaattggccaagaggttcacttaccaagcacgtaaagttgaagggaagcaaggagtagtagtttgtcccaggatcgggacacatgaaacaacctactccttgcttgcacggccaagtgctaagtgccaaatgcgaatacttaggatatga

SEQ ID NO: 67404 - DNA, 171 bp, Glycine max
  Peptide Sequence Number=SeqID_184182
atgacaaaagggagagctttaaggctgaaaaacaataatccacgattatacaagactggtagtttgttggttggactgtgtaaaaagactcatttaagaggatggatctcatacttaagactctgtttaaaaagaattaaatcttttatcacttggatcaataagtattaa

SEQ ID NO: 67405 - DNA, 399 bp, Glycine max
  Peptide Sequence Number=SeqID_184183
atgtcagattttgcaagtaccttcaacaactaccatttgaacatcttccatggttgtggacaaaattatcaaacaggcagaatgtacaagtctctaattcagcagttccaagaggttaaatggagatacttattcaaaggtaacatggcccgtccgagagcccgctttatcctttggatggcttgtcatgagagaatggcaactaaagatagattaatgcgatttggaatgctcaatgatgatacttgttgttactgtaaagaaaaagagaccattcaacatattttcttccaatgtaatgtgttgagtcaattttggaaacacacccttaaatggctagaggttccacattctccgggtgtttggaatgaggagttggattggattattaagaagtga

SEQ ID NO: 67406 - DNA, 480 bp, Glycine max
  Peptide Sequence Number=SeqID_184184
atggggacaacaccaaatccatgtgaaaaagatcatgctgaagagttcagatggcaaggcattcgaggtggacgaggcagtggtgttggagtcttagacgataaagcatgcatgatcaaggatgactgcaccgacaatgcaaaggtgatccagtactgcaagaagcacatcgaggctgcgaatcctgaagacaaaccctctgaggacgatctcaagacctgggacaccgatttcgtcaagttttgcaaagtcagagaaaaaaacataagcaagaagaaggaggagaacttcgacaccgtcattgtcgtcgcaaccatggagttcacagctaccaccacgactctcataaagaagctctcaaataatggtggatacgatgtctccaatagctccacgtacgacggcgtcttcgccactccgatcatgccccgcactttgagcttttcctctcagttcagcgactaccacgagattttctga

SEQ ID NO: 67407 - DNA, 801 bp, Glycine max
  Peptide Sequence Number=SeqID_184185
atgaagggctcatccaaagtgattatgggtgcaaccttggtaatggtggtgacccttgcagtggtcctagtccttatatttgtgctgctagctgagctctactgttccctcttactccggcgtcgccacctcagaaacagaaactccaacaacagtactattcccaccgccagagccaatgcttcaccttctcacacagacacagcctcactcccccaacaacaacagtctccaccattccgcagcatttatgcacaaggagtcctccaagctccaagaagcatccttctccctgcagtttcttgcaaagaagacaaagctgggccaaggaagcagaagcactattctcaacttcttcaaatccaaatccaaccccaagactcaaattcaagcccttccccaccaccatccctcatatccatagcaccctcaagatcaaatctttgtcatgatgatgataaacagtcttgcaatggcggggaaaaacaccttgtgtacatttccaaccccatttatgagagccaagggagtggagcagacaccccatttgagacaccggacacttcaccttcgcgcttggaaagaagtggttcttctgaggaagatgatgcagcagctgaggcttgtgttactcactcaccatgtaccccacctttgacgccaatgaagaagctccctgcagaggcttcctccgtttctctaagagacgcaaggtccttggccacttcatgcagtgattcacgtagcaacaatggtctctcttcatcctccgcttccccttgtacctctccttcatggtaa

SEQ ID NO: 67408 - DNA, 546 bp, Glycine max
  Peptide Sequence Number=SeqID_184186
atgggggcagggaaaacaagtttggttcttagatttgtgaaaggtgaattttccgagtaccaggaatcaacaattggagcagcattcttcactcatgtgttgtctttaaacgaagcgactgtaaaatttgatatatgggacacagcagggcaggaacgataccacagtttggctcctatgtactatcgaggtgctgctgctgccattgttgtgtatgacattacaagcatggattcttttgtacgagcaaagaagtgggttcgagaagtgcaaagacaagcaaattcaagtttgacaatgtttttggtggctaacaaggctgatttggaagacgagagaaaagtcagatatgaggaaggtgaggaatatgccaaagaaaatggcttgtcttttcttgaaacttcagcaaaaaccgcacagaatgtgaatgagcttttctatgaaatagcaaagagattggtgaaagctaacccttcacgtcaaagtggaatgaagctgcataccagacctggagaaacaagaagaggattcttgtgttgtacttaa

SEQ ID NO: 67409 - DNA, 306 bp, Glycine max
  Peptide Sequence Number=SeqID_184187
atggcgctacatgcactcagtgacggagcaacaaatttggactttcccattagattgaaggtgtttggtcacagtggtggtgagaacacgcaacgcaaacaaaaatgcatggcaaagggatctcacaatgttacaaaggtgcggtgggggcagggccaaggggacgtgcgtgtagatctaaagttaggagcggtgcgtgacactattcggacaatgagtgacacacgacgttattgtgatgacattgggatcactaagtttagatctagacggaggtggtggtgcaaggcgttggtgtggtggtga

SEQ ID NO: 67410 - DNA, 2394 bp, Glycine max
  Peptide Sequence Number=SeqID_184188
atgttggacggaatactcggcagaggcttcaccgctaaatggttcgcactctgtgctctgtttgatgaagaaagtgtggttatgcttctcactacgataaacgtgttttcctctgctgctttttttgttttcagcaaatcgttgatcaaattgaccaagagtcggatcgatgtgatacggaggaagagaagagcgacagagaagtttctgaagaaagatattgctgatctattgctcaacggtctcgatatcaatgcctatggaagggctgaaggacttgtggttgagttaacactgtcctcttgctatggtttcgttgagcaatgctgtgagtttgtgttgaagcatctccctgcgatgcagaaactgagtggttgccctgaggaatgtaggatggctgtatcgtctctgatgtttggggctgcaagattttctgatttaccagagttacgtgaccttaggcaaatatttcaggagagatatgggaattgcatggaatgttatgtcaatcaagagtttgctgcaaatttgaatttcaagttttctacattggagaacaaggtcagcttgatgcaggagattgcatcagagttttcaataaactgggactccaaggctttcaaactgaggatgtcgagatcctctgctactgcacagggccacaatgcatgtgtgcctaaccatgataaaccatcacatgggaaggattttacccaaaaagaagtaaggaatgatgtcttgttagagaaaaactgtgatcttgccaataatgagtgcagatttcagaatggcaaggaagctgttgtcttaaacagacttgaccacgatcttcattctaaatccacactccctggaaatggcttcaagccactaaatggtcatgaagttcttcggaaaagggatggccatgataattcaggaaggcaagagattactgttgagaagagtgacaaaggctgttggaaggagggtagtatgctaaaaccgattggacatccatctcagcagaaaacagtggaacaatttgaaggtggttccaagctgcagtatagtagggggaatatcacccctccgagagccaaccagggtagtatgctaaaactgtttggacatccatctcagcagaaaaatgtggaacaatttgaaggtggttccgagcagcaaagaagtagggggaatgccacccctccaagagaaaaccaggtcagtatgctaaaatcgtttggacatccatctcagcagaaaatagtggaacaatttgaaggtggtcccaagctgcattatagtagggcggatatcaccccttcaagagcaaaccagggtagtatgctaaaatcaattggacatccatctcagcagaaaacagttgaacaatttaaaggtggttccaagctgcaagatagtatggggaataccacccctctaagagaaaaccagggcactacaacttctaggaagtcttctagtcatgcggggtcgcgcttcaagagtaatgtgaacgagtcatttgctgttaatcatgttggcctacctgggactgataaatccgagagagaaaatcaaagggatgaaacacctacactgaagccctgctacagtaatgtcattccgcctccatatcttaaacatcccaattctaagcagcagagcagcacacgtggagccaatatgatatcttcacttactgacagtggtggcatctctacatatcattcagcacatgagaagcctgatgctgcttctgtgttggaaaggaggattcaaatagatttggatagttctgaccaggattggcagggcaatagacatgagagacggagcaaacagagtcgtgaaaaagaaatctccgaagaagtccctgtggtgaaaccaagatctatgcggcgaaggcagtcaagatcacgactacctggttactacgatgccactaatgaagactctggacttaatagaaaatcaaggagcagaagcaggagacgagatgaatcaagacgtggtctgaaagctatgcttgatgatgagcggtatcaaaatgcagaagaggaaaggataatagataaattactgatccattatagcaaaaagccatccgtccttgtgcctgaaaaattaaaaagaaactctaaagtccaccatgcccatgactcaaccacggaattgctgcagaatggaagcggatatggatctgatgagacaccagagatggttagtcatcatgcatcacgatcattctctcttcctcgtgaacaacacagagaagcggaaattaagaagaaagtatttactcgtgctgctacatttgagcctgttagatcactggaagctcggcatgtgcatcctaagttacctgactgtgatgatctagcagctaggattgcggccttaagagcatga

SEQ ID NO: 67411 - DNA, 1236 bp, Glycine max
  Peptide Sequence Number=SeqID_184189
atggagtacttgaaggaagtggaaggaaaaactgtgcatgattatcttgaggtaaagatgggtaaaatgacaaagccaataggtgtggaaggaccagtgatagtgggtgctggtccatcagggcttgctgcagcagcatgtcttaaacagaaaggcattccaagcctaatccttgaaagggatgattgcttggcttcaatgtggcagctcaagacttatgaccgactatgccttcatctacctaagcaattctgccaactccctctaatgcctttcccccaaaactttccctcttatccaaccaaacaacaattcttggcctatctcaaagcctatgctgaccattttgacataaaaccagctttaagcaagactgtgatcagtgccaactttgatcatagatgtgggtactggagggtgaagactcaaggtgtgaaaaaggaggagacagaatatgtttgtcagtggctgatagtagccactggagagaatgctgaagaggttgtgcctcaaattgaaggaatgagtgagtttgaagggcctatcttacacactagctcatataagagtggtagtatgttttgtgggaagaatgttttggtggttggatgtggtaattcaggcatggaagtttgtttagatctctgcaaccatcatgctcgcccatcccttgtggttagagatacagtgcatatcttgccacagcagatgtttgggaaatcaacttttggtttatctctgagcttgctcaactggttccccatgcgtcttgtggacaaatttttacttcttatgtcacatctcattctcggggacacagctcaatttggacttaatcgtcccaaaattggccctctagagctcaagaacttgtgtggcaagaccccagttttagattttggcacacttgctcacataaaaagtggaaaaattaaggtttgccgcggaattaaacaactagcacaacacaaggctgagtttgtagatggaaaaatagaggatttcgatgtgatcattctagcaactggatacaaaagtaacgtacccacatggttgaagggcagtgacatgttttgtgagaaggatggattgcccaggaaacctttcccaaatggatggagaggtgaaaatggactctatgctgtgggtttcactaaacgtggccttcttggtgcatcttttgatgcaaagaggattgcaggagatattgaacattgttggaaagctgctaattaa

SEQ ID NO: 67412 - DNA, 450 bp, Glycine max
  Peptide Sequence Number=SeqID_184190
atggagttacaacaaatcgatgtaaaaattgcgtttctccatggaagattagaggaagatattttgatgcaacaacttaaaggttttgagaagttgaagccactactcagtagtgaatttgagatgaaagatatgggagttgctgaaaaaattatgggcatggagatcaagaaggatcaagtccagaagaaatcgaacctagcacaagcagtcaatgttgtgagtaggtatatgggtaatcctgggaagaaacattggcaagatgtgaaacatatatttagatttggatgcaaggagatctatgactgggcacggattcacaattggaaactttcttttcagttggaagagaatactttagcccataatgactttgtccactacggtggcagagtacatggctctggtagaagcaacaaaggaaggaatttggttgaaggacctgattag

SEQ ID NO: 67413 - DNA, 1060 bp, Glycine max
  Peptide Sequence Number=SeqID_184191
ggaaggtacactattgaaggaacatcttgatgaactaaactctattttgatggagctacgcgacattgatttcaagatggaagatgaagatttggaaatgattttgttagcctcttttcctcccttctatgagaattttatgagttcttttagtataggcaaggattccattacacttaaagaagtcaaaatgacatcagaaaatgatttggttctagttgctagtgagcaactacaacaacattatgaaaaatgtgtattggacttaggtttttcttattgtatgtgtccacatagactttggtttgtgacatatgagaagaagactggtggtaacatcctcatggataatgatgctccttgtaagtctgttggtataggttttgcacaaatcagaatgcatgatggtgttgttagaaacttgattgaagttcatcatgttccagagcttaagaaaaatcttgtatttgtggatgtcagggatttaaaaggtttttcttattgggttgaaggtggagttatgcagggaaccaatcaagaaaattcgtacatccttcggggtcacatgagtgaaaaagttctgaatattttgagcaagcaaggcttgctcgaaaatcacaagatagaacctcttaagttttgtgagcactgtttctatgggaaacaacattgggtgaagtttccaaatgttgtgcacacaacaaaggccatgttgaattacgtccattttgattgctgggggccttcgagagttccatcactaggacgggaaagggcaagacatcgtactatatgctatactccacaacaaaacaaagtagttgaaagaatgaacatgaccttgttggaaaaggatagatgcacaacatgttatctcgtgaaccactcactgtctactgccatagacttcaagacctttattgaggtatggtctaacaatctaactgaatactcattgttgaaggtcattctaagtaaagatgtcttctttgacaaactcgctatgatgggttctaaatctgatgaagatttgggcaaggctaaggatgtcactaagtag

SEQ ID NO: 67414 - DNA, 342 bp, Glycine max
  Peptide Sequence Number=SeqID_184192
atgaagttttcaagaatcaagtttcaagaatcaagatcaagattcaagactcaagattcaagaatcaagaaaagaatcaatcaagataattcaagtggagggtacatccacttagttgttcaaagagaacaagggagggtacatcccttgtggatctttgcttgtaaaggtttttacaaggttgaaaagaaatctcaaggaccaaagaagaacctactagtcgatgggggtcgtgattgcagagcaagcgatagctcattcacaagtgatgccaagcatgtgatgagagggagagaaagagctatggagagtgcaagagcatgtgtagtgtttcgtgagtga

SEQ ID NO: 67415 - DNA, 522 bp, Glycine max
  Peptide Sequence Number=SeqID_184193
atgggcttcagccctaaatggatcaaatggatggatggctgcatcagaacaacttctatgtcaatcctcgttaatggaaacccaacagctgaattcattccacaaaagggaataagacaaggggatccattagcccctctcttatttaatattgtggttgagggcttaatgggtttaatgagagaagcattaaaagaaaacaagtacaaagggctattggtgggaaaagatggaatagaaataagcatcctacacatccatgcaaaagtgaaggtcctcaaggcaatactaaggagttttgagatgggtgactttgataaagtcaaccctaaactcaattccttagtcacactacaaagaaggttcttatggggtggagacatggatagccaaaaaatttcttgggtgagctgggagacagcatgtctatcaaaaaaaaaaagaggactgggaatcagagacttgaccaaattcaaccaggctctcttgggaaagtggaagtgggatatatttcatcattag

SEQ ID NO: 67416 - DNA, 1449 bp, Glycine max
  Peptide Sequence Number=SeqID_184194
atgtctggcgtgccattaccctcaaaccttctgcctggtgatggaagccctgaatggtttagcagagcagacaatgcatggcagctaatagctgcaaccctagttggtctccaaagtgttccagggctcataatcttgtacggtggagcagtgaagaagaaatgggcagtgaactcagcattcatgtcactctatgcttttgcatgtgtgtttttctgttgggttgtgtggggatacagaatgtcttttggtgatgagcttcttcctttctggggaaagcctgctatgtcacttgaacatacttaccttttcaagagggcctttttgggggcattcccaaatgccacaatggtgtatttccagtgtgtctttgctgccatcactttgattctcattgctggggctgtgttggggcgcatgaacttctatgcttggatgttgtttgtgcctttgtggctcactttctcatacaccttcacagctttcagcatatggagttctagtgggtttttgaccaaaatggggataatagactactcaggtggatatgtgatccatttgtcttccggggttgcaggattcacggctgcatattgggttgggccacggctaaacaaggacagggaaaggttccctccaaacaacattcttctgatgctggcaggggcagggctgctgtggatggggtggacgggcttcaacggaggagatccatacacagtaaactcggatgcttcccttgccgtcctcaacacccatgcttgcactgctaccagcttgctcacttgggtcatccttgatgtcctctttttccgaaagccttctgtcattggagctgttcaaggcatgatcactggcttggtttgcataacccctgctgcaggtgttgtggagggatgggcagcacttataatgggagtgttatctggctcaattccatggttcaccatgatggtggtccataagagatcaaagctactgcagaaggttgatgatacaatggcagtgttccacactcatgccattgcaggaaccctaggaggactcctcactggactctttgctgatccaagacttaacaaattgttctatggaactgatggtcaatacgttggtttcttttatggtttaggttcgaagaaggtcagtaccgggttcaggcaaatgggggtccaaatccttgggattatctttgttatctttgtcaatgttatcagcacaagtttgatttgcctcttcattagaatttttgttccgttgagaatgtctgaagaggatatggagataggtgatgaggctgctcatggggaagaagcttatgcaatctggggtcagggtgataagcttgaaaactcaagttctaagtatggaagttcattatatgatgatgttgaagctggtggccccaagaagaagcgtggcggcacggttgagatgatgtcgaactaa

SEQ ID NO: 67417 - DNA, 312 bp, Glycine max
  Peptide Sequence Number=SeqID_184195
atggtgcatggtcttcctccaattggaatgccaaagcgattgtgtgttgaatcctgtgagtccaagcaaccaagaaattccttcaagttacaaatcagatccaacgaaaagcttgaggtgatattttcaaatgtttgtggccccttagaagtcaaaacattggaagaaaaatgtggatttatctcagagaaaaagagtgaagtgtttgatatattcatatataagggagtcattggagagataccgactaaacctctcatcatatacctcgacaaagggcatttttgcttggtaatgacaagcacagaatga

SEQ ID NO: 67418 - DNA, 165 bp, Glycine max
  Peptide Sequence Number=SeqID_184196
atgaaggctcgagagggtgatgggcagcagcaacaccgacgggtttgggacgaagcgatgcaacgcctaagagtgaaggtgatgagagtgatgagcgtgaacagggaaggacacttattagggttaattttaatttgggataaaggagaacatcggtttttataa

SEQ ID NO: 67419 - DNA, 375 bp, Glycine max
  Peptide Sequence Number=SeqID_184197
atggggaagaatgtagacgaaattcaaaagaacattgatgaaatgaaaaggaaagaagtcctagccattcaagaattcttgaaacatcctcaagaacatatggatgcaaattccactgacgatggagttgaatatactgaaacactcaaaccagtagtacagaggactgaattgcccaattttgatggaagtgatccaattggttgctcaggcagaagagtatatcaatattcaaaacgcaagatcagagaaggaggtgcctctggcctgtgtaattgctcaagatattttccagaagtggagcaggaatccttacgtccaacttcccactatccatcaaacaatataggttggagattatgtgcagcagtttga

SEQ ID NO: 67420 - DNA, 1191 bp, Glycine max
  Peptide Sequence Number=SeqID_184198
atggcaacaactgtgactctttggcttacgacatcaaactttggcttcgcgatattccgtgctcatgacacttgtcaagctgcgtgggatgaggtaaagagtctttacaccaaggactctcaatgcttatatgggatttgccaaaacctcacgagtgtcattgctgctagacaatttgatggtacaatggttgactatttaggcaaagtcaatggccttctgtttgattttaatgaactcttgcccttgacttccactcctgacgaggaacttgaacaactacaatccttcttcatgttattagctttgtatggaccacttactgagtattcattggttccggatcatattttgggctctccaaatattcccaccatcaattctgcatggtccacattgctgcttgtactggccaaaccatttgttgatgtggatgtgcctccaccatatgttgactcatctgccttgtggtatgaggagcgtcaggattctagtttcactgcttctattgcagacacaacggatattgggtcacaaacacagtctcagggcattggtattgacttaagttcgggttggacgattggcaccggatgtgagttacatgggctttatcaacttaacacctttgctcatgctggatttgtggtggattctcttcttttcatccatgctcagtggggtcatcctagccttgccaagctacaaaaaatggaggccaagaccctagtagccaacccagtccctgaaaggggctcttatcgttctgttcctgctggtgctactgctgtgccacctccccgaattgggaagagagagggtgagaatgaagatgagcagcaagtcaatgcaaagaagcataagagacatgaggttgcagaggagcaaaggattatggatgaaattgtttcagatgattcctttgaagattttgaaccagataagaatcctgaagctaaaaaagactccctcagtaaacaggagaagaaaggcaaacctgatagtgctaactgttccggttctttggagtcattggctgatggttctgaggagggtaaacaccaaaatcctaagaggatcgatctaatgctagatagaagaaattttaatcaaagtcaaatctctctagagtataacaatggtcttgattcttacagaagctttgatgaaggcatcacaaacactgagtga

SEQ ID NO: 67421 - DNA, 303 bp, Glycine max
  Peptide Sequence Number=SeqID_184199
atggaattggctaaatttgcattgtcaaataagggtgatgtagcagtctatgtggaacacaccatgtcaactattgaatgcatagagcaacttgataatggcactgttagtgggaagaaacaagaaaatggtgaggatggaaaaaatatggatgttggtgtgtttaatgaaatagggatgatgatgatgcaattccaccccagggcattagatagaagactccaagaagtttgggttagagttacaggaggaagctctagggttctcatgagtcgtagggtagattttagattcatggactaa

SEQ ID NO: 67422 - DNA, 1401 bp, Glycine max
  Peptide Sequence Number=SeqID_184200
atgtcggggtgtccgacacatcctcagccggattttgggcaaaataatcagttgaaagctcggaaaaaatcacaaggtaaactagagggaaaatcattgaaggagttttatggtagctggtctccttcatcaactacatctggacaatttcagaatcagctggtgtcttcagtcatacagtcttctccctcttcaattcttgggcagtggaatgagcttcaaggacctgagacactataccaggacatcacaaatacatatgtgacatcctctgcatatgggaaccttacaaatacatattcttctatgtcaatgctaccacaggctcagtcaggagttcttatgcgacagcctctgctttctcgctatgaagcatctcttggtgttatgaatcctgtgagcaagtctgtggacttagttaagcctcttacaatgactccccaggaaaaaattgaaaaattgaggaggcggcaacaaatgcaagcaatgcttgctattcagaaacaacagcaagaattcggccatcaagttcctagcactaataaatcaatgaatgaaaaatgtgccatagaaatccatagtcaactctgtgatggggctgatcctgaaattgaagatttaagaacagctctagatccaccaactgagcaagatgattctaatacaatgtctctggcaattgatgatcattttgttgaagacaccatactgtacatgcttcaggatgctatatcaaagttagatgtcaaaataagactatgcattagagatagcttgttccggttggctcaaagtgcaatgcaaaggaattatgctaatgatacaagcagtacaaacaacactagcagagaagaacttaaagttgctgcaagagaagaaagcaatagccaaaacagtggacagactcagaatgttttaagtggtggcaattcaaagaacatatttatcttctacggggttgatagaaagattttacaagacatgtatgatggggtaactactggcatgaaaactcctagaagtgagactaaggatgttcctataaggataagatatgctaggattgctgatgttgaaaccaagacaaatcccattgatcgaactgtggctcatttgctctttcataggcctttggagttaactgggaattatcctgataagcttgagtcacctatttctgctaagatacaatttgaaagcagagaagctaacatggagaagtttcatatgggatgcttgccagatgaggacttgaaaagtaatcaacaattttctcaccaagggcttgaggcccagcctgaggaccaatttaaaaacagtcgttgcatagacacctcagagaatgcttctaacaatgttctagctgatgctggagatcaggtgcttgaagccttgcaatga

SEQ ID NO: 67423 - DNA, 1233 bp, Glycine max
  Peptide Sequence Number=SeqID_184201
atgtctcattcttcatgtctcactcttgttttactgtgtctttacaacatctgtttctcagaggctctcaagagtggcttcagtgtggagatcatccatcgtgactcatcacgatcaccattctatcgtgcaacagaaactcaattccaacgagttaccaatgctgtgcgtcgttccatgaaccgtgccaatcatttcaaccaaatttctgtctactcaaatgcagttgaatctcctgtaacactactagatgatggtgactacttgatgagctattcacttggaaccccaccattcccagtttatggtattgttgatacagctagtgacataatctgggtgcagtgtcaactttgtgaaacctgttacaacgacaccagtcctatgtttgatccttcatattccaaaacctacaaaaatcttccttgctcttctactacatgtaaatcagtgcaaggtacctcttgctcctctgatgaaaggaaaatttgtgagcacactgttaactataaggatggatcacactcacaaggagatcttattgttgagaccgttactttaggttcctataatgacccttttgtccattttccaagaactgtgataggatgcatacgtaacactaatgtgtcatttgatagcattggtatagttggccttggaggaggacctgtgtcccttgtgcctcaattgagttcttcaataagtaagaaattttcctactgtttggcaccaatatctgacagatctagcaaactcaaatttggagatgctgcaatggtttctggggatgggactgtctcaacacggatagtctttaaagattggaaaaagttttactatctaaccttggaagcatttagtgtgggaaacaatagaatagagttcagaagctcctcatctagatctagtggaaagggaaatatcataattgactcaggtacaacattcactgttttgccagatgatgtttactcaaagttggaatcagcagtagcagatgtggttaaattagaacgtgctgaggatccacttaaacagttcagcctttgctataaaagtacatatgataaagtagatgtaccagtgatcacggcacattttagtggtgcagatgtcaagttaaatgccctcaacacctttattgtagcaagtcatagggtagtatgcctggctttcctatcaagtcaatctggtgccatctttgggaacttggctcagcaaaacttcttg

SEQ ID NO: 67424 - DNA, 147 bp, Glycine max
  Peptide Sequence Number=SeqID_184202
atgttgaaaaatacgaaaaatgaggatacattaagcaaaaatggcaacagaaaggaagaaaaagaaggaattctgaagcaggcccagcccaacagtggcgctaagctcgcatcaggcgctaagcgagcaactacctgcagatgctaa

SEQ ID NO: 67425 - DNA, 207 bp, Glycine max
  Peptide Sequence Number=SeqID_184203
atggaccatgtatcaagaagcgtaacacctaagaagcaacaaccatcatccactataggttgcttaagggagctcactgaggctgatgatgatgaagatggtttggtgtttaggaaactaaaagttgcatccccttcggatgagacccatgtgcctcaagtgaagaaggtgaaacctacaccactagttcttccttctcctacttaa

SEQ ID NO: 67426 - DNA, 212 bp, Glycine max
  Peptide Sequence Number=SeqID_184204
atgagttccaattccaaacaaaatcatctcacagagatagccaaggtcgacgatgcttatctctctgctgtgtttcttagttctagctgggttttcccagcaattctaaatgctgctattgaagagtttgggctggcgtcgacacgtggcatgagactagtcagtggcaatttgcaggtagcagggcttctcagctttttcagggtagcagg

SEQ ID NO: 67427 - DNA, 174 bp, Glycine max
  Peptide Sequence Number=SeqID_184205
atggaagagcttgtgaaaggcattggggaagaggaaataaagaaagcaaaatgggcaagattggtgaaatgcagaatttatgaactcgctaagccacaccacgcgctgggcgagccatccgctaagcacactatcctctggctaaccgcgcagaaaaatctggaagaaggatga

SEQ ID NO: 67428 - DNA, 3468 bp, Glycine max
  Peptide Sequence Number=SeqID_184206
atggctccatggctttcatgggagaaacttcctagttcaggcagtcaaggaggtccttcccctgaatggattagaatattctggaaaagttttaggggctcacaggaagaattatcccttttctctgattggcccctaattcctgcttttcttggtaggccagtcttgtgctgtgtaagagaacgacatctggtattcattcctcctcctcttttggaacacccaacatcgacaagtgggatttcagagagagaatctgctgaaagttatgtgagtggggttagggtgtcaagggataatacttctgaagctgagttggctgagtcctacatttccgcttttgcaagattcaaaaccagttatccctggttgttgcctatgttaaaccagtgtaacatacccatatttgatgaggcatttatagactgtgctgcttcaaacagttgtttttctatgcctggtcaatcacttggccatgttattgcatccaaactagtgggagctaagcaagctgggtattttattgaacctactaatctctcaacttcaaattgtgatgcacttttttcacttttttctgatgaattcttctccaatgacttttactatgcacaagaagaaattgaagttttgcgttctctccctatatataaaacagttgttggttcttatactaagttgcaaggtcaagatcagtgtatgattccttcaaattcatttttaaaaccatatgatgaacattgtctttcttatgccactgattcaaatgaaagttcatttcttcgagctcttggagtgttggagttgcatgatcaacagatcttagtacgctttggcttgcctggctttgaggggaaacctcagaatgaacaggaggaaatattaatttacatttttaaaaattggcatgatcttcaatcagatcaatctgtggttgaagctttgaaagggaccgcatttgttagaaattctgatgagttttcaacagatatgttgaagcccatggatttatttgatcctgttgatgctatattaatttctatattctttggtgagagaagaaaatttcctggagaaaggttcagtacagatgggtggcttcgaatactaaggaagcttgggcttcgaactgctactgaagtagatgtaataattgaatgtgccaaaagagttgagtttcttggaattgagtgcatgaaatcaggagatttggatgattttgaggcagacacaatcaacactcgttctgaagtttcaccagaagtgtgggcattaggaggatctgtagttgagtttgttttctccaactttgctcttttctttagcaacaacttctgtgatcttcttggcaagattgcttgtgtacctgctgaactggggtttcctagtgttgattgcaagagggtgcttgcttcatataatgaagctattttgtctaaagattggcctctagcatggagttgtgctcccattctatccaaacaacacactgttcctccagagtattcatggggacctctgcatctacggagtcctcctcctttctgtacagttttgaagcacttgcaagtaattgggagaaatggaggggaagatactcttgctcattggcctattgcttcaggaatgaacatcgaggaatgtacctgcgagattttgaaatatttagacaaagtttggggttcactttcttcatcagatgtggcagagctatgcaaagtggcctttctgcctgttgcaaacggaacgcgccttgtggctgctgatgctctttttgctcgtttgatgattaatttgtctccatttgcttttgaacttcctactgtatatctcccatttgtaaagattcttaaagatttgggacttcaggacatgctgacactttctgctgcaaagggtcttctattaaatcttcagaatgcttgtggatatcagcgactaaatcccaatgagctccgtgcagtgatggaaattttgaatttcatttgtgatcagattgtggagcagaacacattagatgggtcaaactggaaatcagaagccatagttcctgataatggctgcagacttgttcattcagcatcctgtgtctatgttgattcttatggttctcgatatgtcaaatgtattgatacttccagaattagatttgtccatgcagatcttccagagagagtctgtattgtgctcggcataaaaaagttgtccgacgttgtcatagaggaactggatgagaatcacacactacagactttaggttctctggggtctgttttactagtgaccatcaaacagaagttatcaagcaagtctcttcaaactgctgtctggagtgttgttaatagcatgagcagctacattccagcattcaatagcttttcattggatacaatagaattcttattgaactctactgcagaaaagctgcaatttgtcaagtgtcttaaaacaaaatttctgctcttgcccaatttagtagttgttacacgtgcaggcaaagatttcatcatcccagagtggaagaatgattcggcacatcaaacactttattttatgaaccaatcaagatcccgtattctagttgctgagccaccaacttatatttccctttttgatctcattgctattatagtcagccaggtattaggctctcctatcatattgcctattgggtccttatttggttgtcctgaaggatctgagattgcagttgttaatgttttgaaactttgctctgataagaaagaagttgaacccgttaatgggagcagcaatatggttggcaaggaaatattgccacaagatgcacgtcttgtgcagttccatccattgaggcccttttattctggcgaaatagtggcttggcggcctcaacatggtgaaaaactgaaatacggtaaggtttctgaagatgtaagaccatctgcaggtcaagctctgtacagacttaaaattgaagtttctccgggggatacacaaagtttcctttcatcacatgtattttcatttaaaagtgtatcagcaagcagtcccctaaaagaatcattggtgcatgaaagccctgtattaggcagtaacaggccccatgttgatttcccagagagctcaggaaggggagaaagctacgctaaggtgcagcctgtgagagatcagtctggcaaagtttcagctgcagaactggtgcaggctgtcaatgaaatcctctctgctgctgggatcaaaatggacgtggaaaagcaggctctacttcaaagaacagtaaatttgcaagaaaatctgaaagagtctcaggcagctcttgtgttggagcaggaaagggttcaaaaggctacaaaagaggctgatacagcaaaagcagcatggatttgtcggatgttcttctgcagtgtcaaggtgtcccttttgtcggcttcaggttacaaaagctatcagaatttttcgtccataatatctccaatgcttttatga

SEQ ID NO: 67429 - DNA, 1683 bp, Glycine max
  Peptide Sequence Number=SeqID_184207
atggctaccaagctcttcttcttccacacgcaaacgacgtcgttgtggaagccaagaaggttggacgacagcgtggtgacagcactgtgcaagtccttcagagagggacgaagctgggaaagcataacccaggagttccgctccctgcacctaaacgactcgtcggtcgaacacgtcctgtcacaactcaccgacgcaaaagccgcgttgcgcttcttccactgggccgcaaaacgcaacaacgacaacaacaccttccatcacaccactcgctcttacaccatcacaataaacctcttactaacgtcaaactcactcaccgactcgcgcgcactcctcgaatccctcgccactcgcaacacagatccaggcgccgcacgtgcggtggcggcttctcttctcgacacgtatcacgcggtttcaacctccgtcgctcttcttgcggttaaccttttaattcaaacctacgcgaaggcgaagttaacggacgtcgccttcgacctttgccgttacgtcgaagaagagcgtggattctcctcctccgtcagcgtcgttagtttcaacgtgttgcttcacgcgcttcagagatctgagaagtgcggcggttccgtttgggaggtttacgagttcatgattcggagaagggcttaccctaacgcgacgagtttgagaataatgatcgatgcgatttgcaaggaaggtgaattgcagaagattgttgacacggtggatcggattattgtagggaataatgattgttctcgttctcgttttcgttctcctgcgatgattgtgaattgcggtttgatgttgaggattttggggaagggacgcgtggcgaaatcggagagcgatgatgtggtcgttttgctgaagaggctgttgcagaagaatttgcttcatgagaaggttgtgtattctctggttgttcacgcgaaggttgtgtttggggatttggattatgcgtggggattttatttggagatggtgcagagagggtttgaggggaatgcttttgtttacacattgtttattggagcgttttgcagagaggggagagttggcaaggcgattggtttgttgcgtgagatgcaaggaaaggggttgaggccttacggggagacgtttgagcacattgtcgttggttgcgctgccgcagaggattcagagcagtgtgtgagtttttttgaggagatggtgagggttgggtttgtgcctgcttgtatggtgtttaataaggtggtggagaggctgtgtgagaaggggaaagtggagaaggcgaatggaatgctgactgtgttgttggagaaagggtttttgccaaatgatgttacttatgctcatttgatgcagggttatgctcgaaaggaggaggttcaggaagttttaaagttgtattatgaaatggagtacagatgtgtgagtcctggattgtcggttttcgggacgattgttcagtgtttttgtcgttgtgggaaggttgaagatgcagagaagtatttgaggattatgaaagggcgtttggtgaggccagatgtgagtgtgtaccaggcgttgattgatggatacatgaagaagggggagagtgctagggctcttcaccttcgtgacgagatggcttctttggaggctttggaggcctttggacatgttgagtttgcaacagctgaacaagcagtatag

SEQ ID NO: 67430 - DNA, 507 bp, Glycine max
  Peptide Sequence Number=SeqID_184208
atgagattgggtgaggaggcagggaaattgattctatttggggggaaaagaggggatgcattagaagaatctgtggttggggagggtgaggttgtgattttggaagaaaagaagcgggataccacccaggagcaagatgggtctgttcgatatatagaggtactagcagacaacacaaacatggtgatccaaaggagttttgtaggtatgagggagccaaagaaagtggcagaacaggtgtgggaatttggaaatgatattagggtgataggaaacaaacaaatggtgatcccgatgtgggagaatatggaaggaaaaaaccatattgcttgtggaagaggtgaggggggaggagtatcaaaagtgggccttggtgacaggcttaagaagcaggaagtgcaaagaatggtggttgatcataaaccagatcttatatgtttgcaggagacaaagcttgaagaggtggatagtaggttgtgttgcttgttgtggggctcatatgattga

SEQ ID NO: 67431 - DNA, 1085 bp, Glycine max
  Peptide Sequence Number=SeqID_184209
atgcatgtaattgatgtgaatttatattcagaaggaactacagtcattgatagatggcttgttgtactctgcctgggttctggacaaacaagaaatatggctcttgataggcggtatcttgcgtacaacttgactcctgttgccggaatagcagcacttatatccagcaatggtcatcatgccaatgtttactcaaggagctcaattatggcccctcttcctttgtctggttgtataaacatgcctattactatcttaggttgtttccttgtgtgtcacaatagaggtcgttatctctttaaataccaagacagaggggcttcagccgaaggacactttgatgctggaaatcaattaattgaatcttggaacagagaggtgatgtcttgcgtatgtgattcctatgttgaaatggttttggagattcaaaagctaagaagagatattccaagttctataattgattctagtgcctgttctgcaatcagcctctctttgaaggcctatggagataaaatctactccttctggccacgttcttgtgagaggcatgttctgagtgaccaacttggtaatcacgataacaaccctccaagtacaacggcagttgttcttaaagctgactgggaatgccttaaagattgggtaatacatccattttattctcgtattgttgaccttccagtatggcagctgtactcaggaaatttggtcaaggctgaagaaggcatgtttctttcacagccagggagtgggttgattggtaatttacttccagctacagtttgcagctttgtaaaggagcattatcctgtattttcagtaccgtgggaattggtgactgaaatccaagctgtgggtttttcagtgcgagaaattagacctaaaatggttcgggatctcctaaaagttccttcaaaaccaattgctctgcgatcagttgacttgtatatagatgttcttgaatattgcttgtctggttttcagcaagcagagtcatccagctcagccagagatagtgatcctgctagtaccaatgtttttcaagaaactgttaacaacggaatcacttcttctcagctggg

SEQ ID NO: 67432 - DNA, 657 bp, Glycine max
  Peptide Sequence Number=SeqID_184210
atgttgtcccctcttatgcgtagtcattcagtggctacccttttgttaaaatggtttggcttcaatgttgacggccacgactgtgacagccgtaacactcgtgtcgacgaagctcagcctgtgtcagccatggttgtggtggaggtagtggcttcggtggtggtggtggatgtggtggcagagcaagaggttgtgactgcaagaacgacgggtgcaagaaggatcctgacagagataaagcaagagaccgtgactgcgaatgttcctctggccgtcacaggagagatgaagccggcatgctcgagcatacgtgacttcattatggagcttccatgggaagctgccatgaggagcgatgctgactttggtgcgggactagttggcatgggtgcggggcatggaatcgaagtcaatataggaaggggagccagcataggggtatctgtcggtggtgactgcaccaaagaagaaaacgaggagcgttggctaggtaccatgcctcaaggcggtccaagctggatgaggaaaggtcgacttctgccattggagggcagcagggaaggggcaagtgggcttagtgtggttccttattggtcgggtaattgttatgtctcctgtggtgctgctattgctatcagaatgggtctttacagttag

SEQ ID NO: 67433 - DNA, 852 bp, Glycine max
  Peptide Sequence Number=SeqID_184211
atgtcagaaaaatattactccattattcttcctttctctttcttcttcaggagattgccttggtctagaatgcaaggtggtgcttcggctaacccaaaactagtcaaccctcaccgacgcccaccacaaccttaccatccgcctagatgccatccaggagcaactccatgctctataactccaaccacccccacccctcaacctcttccaccttcaccctttcccaaccatcctcgtccatatatcaaactcgaggtaccccgtttcgatggacaaaatgccatgggatggatctttaagatctccagttggttccaatggatgttgcggaacagcctcattatgtcgtggtcctcgcttcttcaggcccttgaatcacgctttgctccaacgttctatggtgacccgaaaggcactctattcaagctcacacagtggggctctgttaatcagtacctcaatgagttcgagaggctttccaatctcatcatcggattaccaccctcattcctccttaactgttttatttcggggtttacgctggagcttcgtcgggaggaggacaaactagaggaccgttgccggatttatcttcctcgacccctcaacaatccaccacaacctccgcaaacaccaccccctacaaatatacttccagccctttcaccacgtccccttccttcacctaaaacccaagtcaagcgcttcattccgaatgagatggctcacaagcgtgaacctgaattatgttacaattgtgacaataagtggaacccaactcatagatgcaaagctcgcttcttcttgctcatagctgatgatgaaaaggccacccttgaccctcctccataa

SEQ ID NO: 67434 - DNA, 355 bp, Glycine max
  Peptide Sequence Number=SeqID_184212
atgcctgagaatccactgcaggccttgtttcataacatcgaacaagtctcaagctttgttcaacaccatctctctaatttcataggcattcatttccagccatcaggaccccatagtggctctctcttatcaatctcttcctctaccaaagccccacttgcaaaaactgcatcttctgtacaactcggtgatactgctgtcaagtttctgcaactgggcaacaataactctaatagcaaagggaatagtaaaattgtcttctttagaaagactatgaatgagagtggaggagggggtggtgcagcagatctccaagctcaagattaccatttttttggaatggctgaaagttcag

SEQ ID NO: 67435 - DNA, 165 bp, Glycine max
  Peptide Sequence Number=SeqID_184213
atgcggaaattgattaaggaaaggatggaaaataaggtggttaatttcatgggtcttaataaggtggttcttggcataaaatggatgaatgggatgatcaagggtgaagatgaaaggaaggaaagaatcactctttccagcgagggcaacacacaaaggttgtga

SEQ ID NO: 67436 - DNA, 1500 bp, Glycine max
  Peptide Sequence Number=SeqID_184214
atggatccctcacatccctttctttcttttgaaggcatcgttataaatactccattctattcttcatttactctccccaacgcaacagagagagagagagagagaaatcagaaaaacaaacccaccagggaccacgtcctcccacaccacctcacccatcattacactatcgccatggtcgaaccaaagtcccgaaccgtgggcgacaccgagcgaagctggtgccgagccgtccgcggcggcaccggcatcgcggtcctcgccttccgaacctcaatcccccccgacatctccatgctccaaacctccctccgaacactccaaacctcccacccgatcctcaggtcccgactccaaaccaacgcaacaacattctccttcctcacctccccaaccccttccatcaacatcttaactctaacgctccctactaacgtcaccgaccccctcacccacatcctcgagctcgagctcaaccgcaacacgtggcacgactccaccaccgaagaaaacgtcttcttcgccaccctctacgcgggccccagcaccaacacctgggtggtcgcactgaggctccatgtctccgcgtgtgaccgcaccaccgcgctgcttcttctcagggagttatttaccctcgtggaagagaataataataagagtctcattaatcagtatcctcaggaagcaacgagtttagctattgaagatctattgccccgtggtaagggcaagaagcccatgtggacgcgcgggcttgacatgcttaagtactcgctcaactccttcaggctcaccaacttgaagttcgtcgacgccaagaatcccaggttttctcaagtggttaggttggaactcaaccaaaacgacaccaaagaagttctagcagggtgcaagttgagtgggattaaactgtgtggagcactggttgcagctggattaatggctgtccattgctcgaaacgaagctccaggaagtatggggttgtaaccctaactgattgccgatccagtcttgaaccatctctcactgacaaatttggattttaccactctgccattctaaattcccacgagatgaagggaggggaaaccctatgggacttggcaaagagaacatatgaagcatttgcaaactcaaagaaatgcaacaagcacttctcggacatggctgacctaaatttcttgatgtgcaaggccatagagaacccgggcttgacgccatcgtcatctttgagaacgtcgatcatgtcggtgttcgaggacacggtgttcgacaatggtggcaagaagcaaagggagattggggtggaggactacatgggttgcgcctccgtgcatggggtggggccctctatcgccatttttgacaccattagagacgaaagcttggattgtctgtgtgtctatccgacgcctttgcactcacgggagcaaatgatagagtttgttgaaaaaatgaaggttattctcatcgaggctacaaagacatgcaagaaatga

SEQ ID NO: 67437 - DNA, 162 bp, Glycine max
  Peptide Sequence Number=SeqID_184215
atggggaggtacaacaagcaaaaaggagcagaaataaaggaaaaaaagaagaaaatcagaagaagcccagtccagcaaggcgctaagcgcgaagacacgcccaacgcgcaagaaggcaaggcgctaagcgcgagacacgcgctgagcgtgcggtggcactga

SEQ ID NO: 67438 - DNA, 180 bp, Glycine max
  Peptide Sequence Number=SeqID_184216
atgtacatttgggaatgtccaaccgaagcaatgctttctaggctgcatgaagtcgatgtggtacttggattatttccaacgcaccccctcacgccaagcacttcctgggctcggggcgtgaacaacaaatggtgggtgtttgtcaccacaaagcgaggactagcggaagcatggtcctaa

SEQ ID NO: 67439 - DNA, 375 bp, Glycine max
  Peptide Sequence Number=SeqID_184217
atgacagtgggcaaacagcctttgccagggagccaatctgccccttcccgtgcctctcaaggtgtgtatgtcccttatcacaaggagaggcctagaatatgcatacacttctcaatctgtaaaatttgcctagttcctatggtggacaaaatacctggtggagctagactgggttttatcaccattggagatgggaaaactgaagttcttgtgcatattgattgcttggtttttccacctactgagaattctgctccaatttttcgtgccattagaaatggtcccttgaaggataaggcaccaccaggtgagcccagaatcatgagaagccttcttcaagctcttcagaagtccgttgaaatcgccagattgtga

SEQ ID NO: 67440 - DNA, 240 bp, Glycine max
  Peptide Sequence Number=SeqID_184218
atgaaagcaatcgagcgttcgaaggtcaccgtcaccgtcggtggctcgtgtggtggaggtgctgctagatcaattttcacaattcacacttgtcgcaacctacccttcggtgggagggggacgccaggctcacgggtgcgccttccaagaaaggaaaatgcgcggagtcgccaccaacgtttatttgagaaaaacgtcggaaaaattgggaaaagacgtggtctacgaacttttaagtga

SEQ ID NO: 67441 - DNA, 693 bp, Glycine max
  Peptide Sequence Number=SeqID_184219
atgggtcaacttcaacggcaagccttccgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctattcctcattagctagaatttctaaaatattccaaatcttggcgaaggaattagaccaccaaaagcaagtcaaaaatggggtggtcgggataccgagaaaatgtttggaggcaaaagcaagaatcttggcaggtagaaacgaatgggccccgttcatagacgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacacgttcgaccggggatgtggaaagagcagcgcaagaattgtttgttgtgcactggctttctatgtaggcccgtctatccgctacaaggtcaccgctcgtgcgtcgaaaaaggaaaggcgaattgggaccaactcttggctagcatggaggggcgtctgttaa

SEQ ID NO: 67442 - DNA, 129 bp, Glycine max
  Peptide Sequence Number=SeqID_184220
atggccgaccagcaggctaacaaatccaaagccaaaggtaagcaaagtattaggacgcacctagttgctcatgatcctgggaatttaaataaaacaagcgcaagctcggaaggtagcaagataccttag

SEQ ID NO: 67443 - DNA, 195 bp, Glycine max
  Peptide Sequence Number=SeqID_184221
atgactaaaaatgttagtcaatttgtcagattgattgtgaaggaatgcattgattgtatctcacttctcgctaagccaatctgccggcttagcgagccatccgctgagtgcaccactcctacggctgagcgtgaggaagaatctggaagaaggatgagctggacacacgcgctaagcgagggctcatcccgctaa

SEQ ID NO: 67444 - DNA, 261 bp, Glycine max
  Peptide Sequence Number=SeqID_184222
atggctttgctgtacatttactttcattggcagaatttcttagagaccgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgaggtatgtgcttggattcttactgctttgcttttattaagttga

SEQ ID NO: 67445 - DNA, 417 bp, Glycine max
  Peptide Sequence Number=SeqID_184223
atgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactagcgtttttaaacacctttataagcggatccacactgaacaaattatcctaagagatgttaaaggagtttgtccttatattgaaccttgtgattccaaaactcagaagagcaatctggggattgctcttgttggagttggttgtgaacaaaacaaggttgatgttagggtggacaataagcttcgaaagactagtgaaatagtacttgggttgagtggagcctacatagactaa

SEQ ID NO: 67446 - DNA, 282 bp, Glycine max
  Peptide Sequence Number=SeqID_184224
atggttagcagcaatgatagctatgtaacaaaattgtgtcagtatcaattcgattcaattagaggcgcattaatctattgtcaatactttttaaatagtctaccaatatttcccaatgaaaacagatacccacaggcccagcttgttgaagtgaatgcacattgtttgttcagtaaatggttctctgaaagtggcaagctgataccacactgtattagtgccttacttaaaagtggaatcagacaaattatctgtagtttcctggaagtgaatgaccattga

SEQ ID NO: 67447 - DNA, 546 bp, Glycine max
  Peptide Sequence Number=SeqID_184225
atgggtgccaagcacctcacaaggaccaaagaaaggtcgcatgtcatcaagcaaagagtcgcgggtgaccatgacttgtcgttcccggattttcacaaattgcctaatgatgggtgccaagcacctcacaaggaccaaagaaaggtcgcatgtcatcaagcaaaggtccccggacgaaaactagtgtatgacactaatttcgctcctctcggtttgacgagagtcgcgggtgaccatgacttgtcgttcccggaatttcacaaatcgcctaatgatgggtgccaagcacctcacaaggaccaaagaaaggtcgcatgtcatcaagcaaaggtccccggacgaaaactagtgtatgacactaatttcgctcctctcggtttgacgagagtcgcgggtgaccatgacttgtcgttcccggaatttcacaaatcgcctaatgatgggcgccaagcacctcacaaggaccaaagaaaggtcgcatgtcatcaagcaaaggtccccggacgaaaattagtgtatgacactaatttcgctcctctcggttga

SEQ ID NO: 67448 - DNA, 232 bp, Glycine max
  Peptide Sequence Number=SeqID_184226
tggtgtctcctctctctcttccttctccattccactgccattcatctttcaagaagcaaaggaatccattgatgaagaagatcctaggcctacaagctccaatggagcttacatcaatacgttgatacctatgttagtcctttgtccacacaaatgtcgcctaatgtcatcggagaagaagaagctgacgacgttcatgctaatcataatgatcacgatgaaggagaattaa

SEQ ID NO: 67449 - DNA, 678 bp, Glycine max
  Peptide Sequence Number=SeqID_184227
atgtctgcagggatcatcgctaaagatttgtatatcaacgaatccaataatcaaggaggaactgcatttaacatggataaattcaaagcgaatgatcctgaaatgcaaggatatattaacgaacaaagaatgcagcaaaaaacgggtttgaaaacaaccaaccaaagattgcttgctgctaacagagctccaaactctgcaatggttcagaaattcagacttcctacagaagttgaatgggaatatgcagcgcttggtatggctaaaaacagagaatataaccaatatcttggaaagaagccggaaattgaaagattaagaggtaccaaaggaagagacagaggaatgttccttgaaaacttcaaaatgggtagaggagattactcaggtatcgcaggttggaagaatgacggttctgcaagaacttcagatgttagacaatatccgtctaacgatcttggaatctatggaatgtatggaaacgtgtctgaatggacagcggatgtttacagacctattattgatgaagatttcagtgacttcaattactatagaggaaatatgcctcaggctgttgtaaagaacggagacggaacttacaaaatggtagatgaaggaagcattaaatatgatactttagctgacggaagattagtttacagaaacttaccttggaca

SEQ ID NO: 67450 - DNA, 775 bp, Glycine max
  Peptide Sequence Number=SeqID_184228
atggtcttaaagcggatgcgagaaatagaagaaactgaatcgcaaaaagttggtacaaacactattgagcttggcttgattttaaatgcagttacaaaagaacgcgtggtcgatgctaaatccagagtgcaatttttactagacgaatctataagcagttctagctatgatgagtggaaggccccattattacgacttagcgctaagcacaagttgtttcaaaatgacatagaaggagcactcaaggattttaaacaagcacttaaagcttgcgatgagtgtgcatttggaggtcttcgtggtgagatagcaagagacggattcgcaaccgagctgatcttaaaagggtttatccaaaataaccaagaaatttattaccgcaatatgttggcctttatggaatggcctgaaggacatgtttcatttgaaaatgccgctgttgaatgtgaggagtttttctgggataccctttatcaaccatactctggcattgcgccaatagtctgcatttcaaaaaaacaatatcaattaatcattgaagaaactacagaaatcatatttcaagcagactggaatgggttaaacgaatggtttaagaaaaacgctaaacaatatcgcaagttaaatattaaagatgccagacgaaatagcattttgctttcatggttaaagctttaccaaaacctcaataaaaacaagtatcgattgagtttggaaattgcacacgagctggcaagtgagttggagaaatatgaagcaatgcttgaaaactggc

SEQ ID NO: 67451 - DNA, 306 bp, Glycine max
  Peptide Sequence Number=SeqID_184229
atgtcatttaggacttgtgggaaagcttgggctgagcaaatgaggaaaatgagtgaccaaaaaaatgcttatgcattgctggttatgggaaaggtagtacatattgggttctggacgtttttagcagatcccaacggtcaacatcttggaggggttgatggggacccggtgctgagaggaacgaggataagggctacgtgggggtacgtgagctcagttgaaggtgggcaactggggatggtgggttcatgtttgatttgtgaatgtgggagagttgatttgcaccatcgcccgatcatcacctag

SEQ ID NO: 67452 - DNA, 201 bp, Glycine max
  Peptide Sequence Number=SeqID_184230
atggataaccacttgggtatctccgcctgccccctaacttcacggccacttgggtatatccgcatgctaccagacttttgggtcatgatagcaaaaggtggggtggtcgacaaaagcaaggcttttgctcctacgtatcctcaattcatgatgtggaactcagaccaacgtagttcttgcttttgtgatgtgcgagactaa

SEQ ID NO: 67453 - DNA, 354 bp, Glycine max
  Peptide Sequence Number=SeqID_184231
atgttgcggaactttacggattacgcaatgatgcttgtttcgagggttccgatgggagcaaacaaggttcaaggactgaccgcaacaagcaacggtagcttgtggtggccagcggtggtcgtgagtggtggaggaggattttctagggtggttggaattgcgcttagcacacttctcgggctaattgagagttcaaaagttgttattttgaaaatccaaactgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 67454 - DNA, 339 bp, Glycine max
  Peptide Sequence Number=SeqID_184232
atgagcgtgataagagggattgctttcctcttcgtctgtatctacgcaatttcccgcttcttttcctcgcgtcctcctttccttctttcattctttgttggctcgcagggatatcgattactggtcgtaaggggcgggatatctggttcagcagcagatcctaattacccttctggtgactccgtaactcattgcttcctctcttttcaaagcttgtgggtgctctgcttcaagagtctagtctatttatcatttaacggattgccgagcggagaagcgttaactactgggatatcggggagttcctctccagctactggaacttccctcgctacatga

SEQ ID NO: 67455 - DNA, 159 bp, Glycine max
  Peptide Sequence Number=SeqID_184233
atggctaccattgcattattgagtagatataggaggtggtgtctaatatcggatgtgcagcaagcgggttttgtagctgatttaggggtggcctttgtggatgattgggcgttcttggctgatcggatgtgggtaatgagaaaggttgatattggctga

SEQ ID NO: 67456 - DNA, 366 bp, Glycine max
  Peptide Sequence Number=SeqID_184234
atggcgaacgaatatcagcaagagccctttactcggcttctgaaacaagagaacggaccgactctaactaatccactcctaataacaggaaggctaaaggcagacctcgtcctactaaaggaaagggctctttctattccgagttggcctgcaccggtcctatcctattcgattaggaaactgatgattctagagcaagtgacatccatatcaaatcctccagaagttatgctcaacaggaaagtcattaagaagtgccacagcactattgctattgatcggacattcacaattgcattacctgaatggaatggcagcagtcttcttagtcccaatccctgcgcattcaagaacaagcccatctag

SEQ ID NO: 67457 - DNA, 294 bp, Glycine max
  Peptide Sequence Number=SeqID_184235
atgacagtggcgagcgcgcttttcgggattcacaatcccttggaattcaagcaattacctgctggaaaccagccgattccggcccggaaacgttgtccggcgttcagcctcggtcacccgccggcggtcagagcgccaaacgcggcggcagcgaccagtcgatcggggcctggccgcggcgctgcaggtactcgttggccatcgagaaatgctggcagccgaggaagccacgatgggccgacagcggcgacgggtgcggcgcattcagcacgcggtggcggcgggtgtcgatga

SEQ ID NO: 67458 - DNA, 213 bp, Glycine max
  Peptide Sequence Number=SeqID_184236
atggctaagcacatttttcaagtccaagctttgtggacaagtgatattaatatattttttagaagagagacaaagctaggaaggaaacaaaccaagagagtgaacatagagacagtgagaaaaatgaaccatatccatatctctgatgctgtgtttgatggagcaaaggacatgactgacatatgctggtcatggcctcacgggtcaggctag

SEQ ID NO: 67459 - DNA, 321 bp, Glycine max
  Peptide Sequence Number=SeqID_184237
atggttagagaagatttgaaagagatatgtgttttggatgattgtaaaatgcgtgccaaggaaaaagaaaaacaaaaagaaaaagaaaaagaaaacaatcagaaaaatgaaaaagaaaaagagaaggttgatgaggagaaaaagaagagcaagagtgaggtttcaagagagaaaaagaaagagattacttcagctgaaggaaaggaagtaccatatccattggtaccttccaagaaggataaagagcgacacttagccagatttcttgacatcttcaagaagttggagatcactttgccttttggagaagttctccaatag

SEQ ID NO: 67460 - DNA, 225 bp, Glycine max
  Peptide Sequence Number=SeqID_184238
atggctccgagaaagcttcttgcaaagagatccaggaaggacaaagcggctgaagggaccagtgccgctcctgagtatgacagccatcgcttccggagcgctgagcatcagcaacatttcgaggccatcaaaggatggtcattccaccaggagagacgcgtccagctcagggacgatgagtataccgacttccagagggtgtgcgggatatgcgatcttggttaa

SEQ ID NO: 67461 - DNA, 230 bp, Glycine max
  Peptide Sequence Number=SeqID_184239
tgtctgtcacctccagcaagggcatcaggccccctactaatcgagatttcatcaagaagtactgcgcccccaggcaggcacagggcgaaacaccacagcagcctggggatggccagcagcgggcaacagacgcaccgccatcacctctagagttcacctcatctcatccacaaaaagccatcaagcgtccagctcaagacgttaaagaagcgctactaggaggcaaccta

SEQ ID NO: 67462 - DNA, 625 bp, Glycine max
  Peptide Sequence Number=SeqID_184240
gggttgcatcaattacaatctcgtcctcgctataagacaacttggttaccctaggagaggggtgccattagaggaaggcctcataccttttattacacgaggtttcgatagcaccaacgcgggggtgcttcagaaggtccacaaggcatgggaaatgtcgcaaaggaaggacaaggaacttaagtggagtagcaatgggcccatcggcgattaccataggtggttgaaagcctacgcacaagatctagattggctcttgagtttgaggaccactaaggggatggaggttgaaactctggaagaagatgaagaggtgcaggccctcaagacagaacttgagaaagcccaaatagtcaaagaaaagttcaagtcagcagctgttaggatccgaaaggagaacgccaaactgagaggcgtcaatatagccaccaccaaggccttggagcaagagaccaagagggcccgtaaggaagaacatggccgaaacaaattccgaggggctctgtggggcagtaacagtgagcttaagctccgaagagaagaaagggaccaatcgcgagtagacagtttgattctgaaggatgaattgagggtttgcctaaggtccaagaggagtttgtcttag

SEQ ID NO: 67463 - DNA, 243 bp, Glycine max
  Peptide Sequence Number=SeqID_184241
atggagcgttatctacagctcttggttcgccagcaggtgaccaaccaccgagggcagggtttcgctccttttgcgtgccctactctagagcagtttagggctgaggtcgcatggcccggagattggcccgaggcccaggcaggggaggcacctgtaggatcccccggcgatgcagaggaggcccgtatggatgaggagatgacggacttgctcggtttcttaggaggaagcggagccacgtga

SEQ ID NO: 67464 - DNA, 101 bp, Glycine max
  Peptide Sequence Number=SeqID_184242
atgggtgcaagggatgaatcaatcaagcacaagaatccatggcatgctcattcaggtccagtgcaggagtgcctgctgatgaatcctgtggaagtggccag

SEQ ID NO: 67465 - DNA, 609 bp, Glycine max
  Peptide Sequence Number=SeqID_184243
atgacctggcccgcgggcagtccaccttcaatggtcgaaatggccgagaccagctacatcctgcaccacgccaccgcccattcgctggtgctgatggatgagatcggccgcggcacgtccacgtacgatggcctggcgctggccgacgcggtggcccgccacctggcttaccagaaccgctgctacacgctgttcgccacccactacttcgagctgaccgcgctggccgatgagcagcacgaaggcggccgcagcggtattgccaatgtgcaccttgacgcggtcgagcatggtgaggcgctggtgttcatgcacgcggtgaaggacggcccggccaaccgcagcttcggcctgcaggtggccgcgctggccggcctgccgcgcgcgaccgtggcgcaggcgcgccgtcgcctggccgagctggagcagcgcggcggtgaaagccatgccgccgagttggcgccgcaggcactggatgccccgcagcagtttggcctgttcgccgcgccgaccagcaaggcacaggaagcgctggcgacgatcgacccggacgaactgaccccgaagcaggcgctggaagccctgtaccggttgaaggcgctgctgtaa

SEQ ID NO: 67466 - DNA, 525 bp, Glycine max
  Peptide Sequence Number=SeqID_184244
atggactctagaaagtccactttaggctatatcttacttttagctgatgatgcgatctcttggagtagcaaaaagcaaacaattgttacatcatccactattgaagcagaatttattggttgctacaaagctacatcacaggctaaatggttgaagaattttttttctgctcttgaagttgtaaactctattgaaagaccattgaaaatattttgcgataatttggttgcagtattcttctcaaagaataataagaatggaagtcgaagcacaatttcttctcctcagtcctcacggccacgactcaacttttcttctcctcatggaacgcgtcccttcatcaatccctctatgtcacacgcctccgcgccaccacgcaagggggtttggttggataaggttgatgcaatcctccctaggaagggaccagtcaatagagccatgagcaagaggctccaagaggattgggctagagctgctgaagaaggccctaaggttctcatgaacctcagggtagatttctga

SEQ ID NO: 67467 - DNA, 526 bp, Glycine max
  Peptide Sequence Number=SeqID_184245
atggaaggaaggagtcctcttctcatgtggaggatacccaaacattccgctgataggaacgagggaatgcaactaccgcaagagcccttgaacaagagaccaagagggctcgcaaggaagagtatggccggaataaatttcgaggagctctgtggggtagcaatagtgaactcaagctgcgaagggaagagagggactagtcgcgagcacatagcatggagcttgtctcagcgtttatgcgagacggagaccaacatgctagctatcatcgccaagtaccaagaagagttaggtctagccacgacccacgagcatagggtcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaagccaaggcaatggcggacacctactccgcccccgaagaaattcatgggcttctcggctatt

SEQ ID NO: 67468 - DNA, 420 bp, Glycine max
  Peptide Sequence Number=SeqID_184246
atggccttgaggtttccagcattgatcacgggcctctaccagtcgttcggggttcccggcacttctagtaaggtgatctggccgccgatcacccgggccatcattgagaagtattgcgcgcctaggcaggtgcagggggatgcgcctcaggccacagacgcaccgccaccacctcatcaggctgatcctgctgggtcattaggcatgaagcggtatctacaacacttgggccagagttttgctccttttacgtgccctactccagatcagtttagggttgaggtcgcatggcccggagattggcccgaggcccaggcaggggaggcgcctgcaggagctccgggcgatgcagaggaggcccgcatggatgaggagatgacggacttgcttggtttcttgggagggagcagagccatgtga

SEQ ID NO: 67469 - DNA, 484 bp, Glycine max
  Peptide Sequence Number=SeqID_184247
agggctacatgtcctcgccttcagagggctacacgccctcgccttcagagggctgcatgccctcgtctccagagggctacatgacctcccctttagaaggctacacgtccttgcctttagagggctacatgccctcgccttcagaggactgcacgtcctcaccttcagaggaccacacgtcctcgccttcagagggctacatgccctcgctttcagaggactacatgtcatccccttcaaaggactacacgtgggctacatgctcttgccttcagaggactacacatcgtcgccattagagggctacacggctacacaccctcgccttcagcgagctacacacctcgccttcagaggactacatgtcctcacctttagagggctacgcgccctcgctttcagaggactacatgtcctcgccttcagagggctgcacgcccttgccatcagagggatccacgccctcgcctttagaggactacac

SEQ ID NO: 67470 - DNA, 300 bp, Glycine max
  Peptide Sequence Number=SeqID_184248
atgtctcctaaggcatcgggaatctccctacggggaggaaggagtacaggcaaaggagccagactggctcttccagagccaaccatcaagaaatcatcaacctcttctgggtcaccaacccaggctgggtcatctacccagaaaaccaatttagaagggtcatcaacccagattgcctcaatcaaacctgagccatccactcaggaatctcccaaaccggcaaccgccaaacaaacatcggccgactatgcatggccaattgaaacccttcaggcccttcaagacatggatggaacctga

SEQ ID NO: 67471 - DNA, 801 bp, Glycine max
  Peptide Sequence Number=SeqID_184249
atggctcgcaccaaaaaatatggagagatgacatctaaggtgacacccaaaattgcatatatgatttattttgttgattctaggattcccataaagagtagtcagcacagggcaactttgtcgctcatggatgtcaggctgccatttggcgaccagagcactccggtcgtgttcatgctactaaagctgctgacacaaaaaatcagggacgagctggggcagccaatcactaaaaaagtgactcgacaactaatgttatccttcagccagatgcagtcccagggactcgtactgcctcctgagcctgaggttggtccttctgttgcctatgtaagcacaaagggaagttgtgtcaaacccttagggcgggacccagacatgggtgaatcaaacaaatttgggttgtatgttgatgacaatcctccccacttggttgtccttggaagagttaatgaggggtcaaaaactatccacaatgtccctttgggaaatgatcaagtgaaggtcagtgttgagaaagttagagatgctaatgctcatgtccctgtacccactcacgagggagctagggaaccatcaaaacctatagataggctggaacctgatgacgataccctataccagatgacattgacaatcttgcagcttttcctcaagcatatgttggtgtcgtgggattcaactatgttttgggtgtataatgatggcgtccccttgtacataaagaatgaagagctttctaaaatagcacacggtattcaatgtctcaacatctctgttatacaaatgtggattctgtaa

SEQ ID NO: 67472 - DNA, 336 bp, Glycine max
  Peptide Sequence Number=SeqID_184250
atggtccatgacatctttgtcaaggtgaagctggaagtaacaaggatatcaacaatcctaaacgtgtttggcagtagacgaagcaatgatgtaacacgatccatcttttgccccaatttttgcaagatggttacttccatgcttcaacttgactcgatgaaccttttcgtaaaagcgcgagcttggttcaaccccataacccagggaatggcaattttgattgccaatacttcatcaacatttcatagggatgaaagactcgggaatatgcatgctatgcatgggaaatgtaattatgagactgagatgtccaaaggaacatcctttcttagttaa

SEQ ID NO: 67473 - DNA, 858 bp, Glycine max
  Peptide Sequence Number=SeqID_184251
atgaatactgatcaattaacgacgcaggtggcagaccagttgggcgcgcagcagcggctgctggtggcgttcagcggcggcctggattccagcgtactgctgcatgtgctggcgacgttgcgccgctggcgtccgggaatgcaactgcgcgcgctgcatgtgcatcacggcctgagcgccttcgccgaccgctgggttgagcattgccgcagccgctgcgccgactggcagatcccgctgacggtgacgcacgtgcaggtggacgcccgccagggcggcatcgaagcggcggcgcgcgcggcgcgctatgccgccttcagcgccgcgctaacggagggcgaagcgctgcttaccgcccaacacctcgacgatcaaagcgaaaccttcctgctggcgctcaagcgcggcagcgggccggcggggctgtcggcgatggcggcgcgcaccgcgttgggcgagcacctgctgttgcggccgctgttgggttgctcacgccagacgttggaaaactacgcgcaacgccacgccctaacctggatagatgacgacagcaatcaggacacgcgcttcgatcgcaatttcctgcgcttgcaggtgttgccgcagctcaaccagcgctggccgcacttcgcctcggcggtggcgcgcagcgccggcctgtgcgccgagcaggagcagctgctggacgaactgctggcggaaccgctgcaaagcctgttggcggcggatcgctcattggcgatcgacggcctgacggactgttcgccggtgcggcgcttcgccttgctgcggcgctggatcgcgttgtttaacgtcaccatgccggcgcgtgagcagcttcagcgcctgtgggaggag

SEQ ID NO: 67474 - DNA, 234 bp, Glycine max
  Peptide Sequence Number=SeqID_184252
aagctagaaagggttcatgtaggacttcaagaagaagagagaattcgtaatgatctgaaggataggtatgctgcagcaaccggtgagcacaagcactgctattctctgttgaaagcttttcaggtggtgccatggtgcagagttaagcttgtttatgatcctttgtgggtgataattctgtgtctatctgataaggcatcggttgatttaagaattgtattgttgaattggtag

SEQ ID NO: 67475 - DNA, 918 bp, Glycine max
  Peptide Sequence Number=SeqID_184253
atggagcacacagtctcaaactcaagcagtgtcgagcagattctgaatcttctctacgcagccggctacgtcgacgccacaaatcccgatgcgccgccgtctcagaaaatcgccgccggcctctcctggtgcatcgccgccataacgcaagatcttgataccgatgctctttttcctgtaattcagtggcttgcgtcacacattcggcaaaatcaagaacactgtgtcaatgaggttcatcatgctgaaaataccattgaagtggatgagtgtagaacttcgattcaggcattaagtggcaacttggatgaactgaatcagcggaagatgaatgttgtgaagcaattatatattctacaagagagaatcaataaggagggtgctgattctgcagtacagaagttgctttctttactgacatctttgaagaatcttgaaaagcaggaaaaatactttcagtccaatcgtgatgctaaacactcagaacttcaagatgatattagtgaattagagaggaaaataacaaatgacagtgataatgagaaccttcctgatgaactacatcattcatttggtgaattagttgaaaaagtcaatttgatgaaaaagcaacttgctgctagactgagggatattgtggtattaagacgacagattgatgacctaccgtgccaatcagaagtcatccagtacgaacgccggctctcagaactgtatgcacaaatccagggaaaacatcgacaaactcgtaaatactatgctacctacaatgctctcttggaaataaaagaattgatgctaaaggaaacatctttattgaattcgatcatttcccagtttcaagaggcctttagtagcactgatggacgtataaaacttgttcattccatggaaggaattgtcaagggaagtcaacag

SEQ ID NO: 67476 - DNA, 321 bp, Glycine max
  Peptide Sequence Number=SeqID_184254
atggaatgcaacaatggtaacattgtcctattgaccactactttggcaaaattcaccctaaacgacatcgacgaactgaatttcttcaacatgaaccttgtcgacggccttgtacatataatacttgttttgtccggtgacgaaaacaatgacgactatgacgacaacggtgatggtggtgtcgacgtcgatgacgatagctgtaatggtggcagtgatgatgataaaaatgatgatggtgacaatgacaatcataaagttggtgatattagtgccgatggtagtggcgatagcagactagaaatgttggtggtggcatga

SEQ ID NO: 67477 - DNA, 297 bp, Glycine max
  Peptide Sequence Number=SeqID_184255
atggcaaaaggtgcagaagatgatgttagtctttgcgcgtcaacgatcttgtttgcccctggttggcgaaaggtgcgggtaatcataaggacgacagaaggtgcaggagacgatgttagtctctgcgcgtcaacgagctcgttttccccctggttgacgaaaggtgcgggtaatcataaggtcaggacgatagaaggtgcaggagacgatgttagtctctgcgcgtcaacgggatcgtttgccccctggttgacgaaaggtgcgggtaaccataaggtaaccccgcatgtcacctga

SEQ ID NO: 67478 - DNA, 1077 bp, Glycine max
  Peptide Sequence Number=SeqID_184256
atgtgcgtatcactacgctacgcgggctgggttatctgctggagtgtgagccgcatgaaatggggtaaaccgcagtcgctgtatgcccaactgctgctgtttctcggcctgccgctggcgctgttgtgggggctatcggcattcaatagctacgtgagcgcgctgcaggcggcgacgcaggcctacgatcgtacgctgctctcctcggcgcgcaccgtggcggagcggctggtagtgcgcggcggccatctggaggtcaatgtgccctgggtggtgctggacagctttgaactcaacatgaacgaccggctgtattacaaggtggtcgacccgcaggggaaagtgatctccggttttgacgatctgccggcgatgccgccggccacgtcacgaacccagctctatccggcgctggcatggttttatcataccgaataccgcggccaggccatccgcgtagcgcgcctgctgcagccggtcaacgaaggcggcatcgtcggaatggcggagatttatattgccgaaacgctgcagtcgcggcgctggctggccggacaactgctgttttcatcctgggtgtcacagggcttattagtgctgttgacgttggtactggcggggtggctactgcgccgcgttctgcggccaatgcgtcagctctcggcgctgatggtgcgccgcgaacccggcctgctgacgccgctaccggaattgctgccgtggtcggaaacgcggctgctgatcgtggcttttaaccgctatattgaccgcctgcgggtgatgatctcccggcaagagcgctttagcgccgatgcctcccatcagttaaaaacgccgctggcggtcctgaaaacccaggcctcggtggcgctggccagcgacgatccgcagctgtggcgcgagagtttgcaggccatgcgcgcgacgctggatgatacgattttactcaccgaacgtttgttgcaactggcgacggtgaaacgccgggagcagggcgagcaggcttttgtcgcggtcgatctgcaggaggtcgtgcaccatagctgtttttcgcgtatttgcccaggcgcgcagtaa

SEQ ID NO: 67479 - DNA, 720 bp, Glycine max
  Peptide Sequence Number=SeqID_184257
atgatggggaatgaaggcgtaattgccgttgaaaaggcgctcgctttactggattgcttccggcccggtaatgacagcctgacgttaactgagctggcccagctttcgggataccacaaaaccaccgtttatcgcttaatgaattcgcttgagcgtatgaactacattatccggcatgatgatggcacctatacgctcggccaccgtctgctctatctcggcaagctttatgagcaatcatttcagcttgcgagaattgtacaaccggaattgcaggcgctgtctcaggcctccagtgaaagcgcgagctggtatgtgatagagggcggccaacgcctgtgtttgttccgcgccgaagcgtcagagggattacgccatagcaacctgcccggcagtcaatttccactggatggctccgctatcagcaaagttttacgtcattggggactgggtgaggcgctttcggaagacgaagaaacgctgccgttctatacctctggcgcgcgcgatccgcacaccgcggccttcgcgatgccggtttttggcgtccacgataaccccatcgcggcactggcgctgacaggaccgtcatcgcgtctgactgcggaccgcaaagagagcggcctcggccagctaatgcgcgagacggccaaccgcctgtcgatcaagttaggagccagtaaatccttctgcgaaacgttttacgatataaaagaataa

SEQ ID NO: 67480 - DNA, 627 bp, Glycine max
  Peptide Sequence Number=SeqID_184258
atgcctgcatcacaacagaaattaatcaatgtggatattgagcgcgttagcgcggaggaggtccgtcaggccgctgaatatcaggcggcgattctcgccgacgtggccggacgacgcggcacattacatggccgtatcaagccactggcgccaaacatggctgtggccggcccggcgattaccgtagaggtccgtccgggagataatctggctattcacgcggcgatggccgtcgccaaacctggcgatgtgttagtgatagacggcaagggcgatctctcctgcgctttactgggtgagatcatggccacgcaggcgcaggccagcggcatcgcagccggtcttaatccgtgtggtcccaccaagttcattcctggccgggtcaatcatgctatttcggtcgcgggcgccgcggtgcaggcgggtgacctggtggtaggggatattgacggcgtggtggttatcccccgcgatgaagtaggcaccatcattgagctggcgaaaggtaaactggaaggggaagtcaaacgtctgtcggctatccacgatggcgatcttcgcccacactggctggagaatgcgttgcgtcaggcgggtatgctgagcgaaggggaggcattgccatga

SEQ ID NO: 67481 - DNA, 561 bp, Glycine max
  Peptide Sequence Number=SeqID_184259
atgtccattcaaagatggaccaatcaaccatcattggaggagttacaaaattttctcacaaatcaagaagcttttatgcaacaatcttcatcatcacctgcacaagaaactgaacttgttctcatcttcaaagggaagacacgtagccaagacaacgaggaggtagaattgaagagaaatagtgtcaaatatttcagatttggcagatcaggtcatatcaaaagaaattgcagaactagactctttaaagtgaatgcaacatacgaagaaaatgaagatgactcatttgagtcatttagatgggaccaatgcttcaccatcgaggataggaggattggacagaaggagataccagtaaattacctagattaccagagagaatggatcttagactctagttgctcacatcatggacaacccttcccttgtgttcaggaatcctttacaacaagagaccctcagtctcttaaccctttttcagaagtaaaaagaaaagaagaagaaatctctcttgaaagagacagattgtacaatgaagatcaatcacaattccttatttga

SEQ ID NO: 67482 - DNA, 522 bp, Glycine max
  Peptide Sequence Number=SeqID_184260
atggcctctggcttaaaatgggactggaagactgaggaggcctgtggtaatcgattaccagcctgtgtaatcgattacacagaggaacaggccactggtaatcgattaccagagatgaaaagcctagagataccccttttaattgcatgtagtggttatgagacgcattgtgttgctaccgcaatcgtgatggcggcgcagctaatccatgatcgagtggagatggagtgcctagagggagcttgggagaccctcgaaggcaacacgaggtgccgatttcgaggcacgattcgatttacagctacttcattggtgcatccagatgaacccgcgcgcacgcttcagcgtattgtggagtggatactacccacgcctacaccataccgtctagtggagccagtccaagtgatcgaggtaacgtcatccgaggaagaccctgaggaggatctagaggatctacctcctgagcctgctgtggatgctcttgactttctagagggtgatgaggacccactccctgag

SEQ ID NO: 67483 - DNA, 501 bp, Glycine max
  Peptide Sequence Number=SeqID_184261
atgactttcatggccgagaaagggtttttcgcgagaagttatttaaaaacatcaacatcgggacgcgcactgtctcctgagcctgaggttggtgcttttgttgctcatgtcaacacaaatgaaagttgtgtcaatccctcgggacaagaaccaaacatgggtgaatcaaagaaatgtgggttagtttatgaggggtcgacaatcgtccacagcgtccctttgggcaatgatcaagtgaagttctatggtgaggaagttcaagatggcaatcctcatgtccctataccgactgaagagggagttgagggaccgacaaaacttgatgatgatcccctataccaaatgacattgacgatctcacagcttttcctcaagcctttgaatatgaatgagactagtatgcgagcgggaaatgtctctatgtatggattccttgagccacagtctatacaaagatctaggcaattgcaatttgaatcagaggattatattaagaaatga

SEQ ID NO: 67484 - DNA, 648 bp, Glycine max
  Peptide Sequence Number=SeqID_184262
atgaaggctactccaacagtaggaaaaaaggctctcgctaaggagaatcatgagacaaaaaagtgggtgagaaggaggactttcacctacccacaagggatagtggaagacttacttgttaaggttggaaaattcattttcccaatgaactttatgattctagatatagatgaggatgaagaaataccaattattttgggacaattcttcctcaacataagagggtccttgattgatgttagggaagggaaattgacttggcagctaggtgatgaagaggaagtatttaaggtgtttggcactgcaaagtgttccttctcctcccctttctacaattttgtgcaagccattaataacatggaattcattatggctaagtttcactcaagtgtggagatatactcattcctcgaagaagttacctcattcttaataatgtggagcacaagctcaatctcatatggagatatatttcttcctcaaagaagttatctcaatctcaattttgcgaagcaccaattcaatctcatgtggagatatactccatctttgaagaagttacctcaatctcttgtaatatggggcattaggtcaatctcatatggagatatactccttcctcgaagaagttacctcaatctcttataa

SEQ ID NO: 67485 - DNA, 345 bp, Glycine max
  Peptide Sequence Number=SeqID_184263
atggagaaggtaccctggccaggaaccctgccttctctcgagagaaaaggtgggggtcccagtgctcaggtacctcagcaggtacatgatgcatcttctgaggccaccatccctgagccatttatttttgaagcaggtgagacacagccagcagaccctcctacactagtgcatgagatgccagtagacccgtctacaccattacttgattttccagaggacccttctacactagtcctgggattgactaccactcctccgacaactcctgtgctacatcttacagatgaggaggacaatcaggatgaggatactcaatcacaggacctgtcacaggaattttaa

SEQ ID NO: 67486 - DNA, 165 bp, Glycine max
  Peptide Sequence Number=SeqID_184264
atgaaagtatttacatcaacgctagttacgctcactcagcctggaggtgaagatggtgcacttagcgagttggctttcactcagcgcctctatacaactcatccttcttccagaatttccatgcgcttagtggatgatgcgcttagccagaagatgagtggctga

SEQ ID NO: 67487 - DNA, 378 bp, Glycine max
  Peptide Sequence Number=SeqID_184265
atggcaaaacaagctaaactggtgttttatgttcaagatccttgtgatgaaaggcacatgactacaccaccgatctccctttctcctcctaagtcaacacctttaccatctacgtcaaagaaaactagtaaagcaacgcggctcagatcattggctactagacccatcaggatggagagaccggtgattcatgtggatcctaccactgggaaagctgatggtgcccataaaaacgaattaaggacgtatttggggatcgccgctcaagacaaaactgagtttgatattccaaaagcgtcagaccaaaggacaaagaagaaaatccttaagatcgtaggagagcgatggaggcagtttaagtcagatttgacctcctaa

SEQ ID NO: 67488 - DNA, 807 bp, Glycine max
  Peptide Sequence Number=SeqID_184266
atggaggaaaaacaaaagaaacgattggagcaagcagcccaattcgggagcacaaaaacaaccgttgatcctccatctcccattggaagacacgtgaagtggaagatggcttgcaccaaaaaatttggaaagatgacatctgaggcagcacgtgaaattgcaaataggattgaaatagtccgtaaactcacacagtattttattgactggaagattcccctgaagagtagtcagcacagggcaactttgtcggccatggaagtcaggatgtacttactgctaccattggaatatcagagcactctggttgtgcccgtgttgctggagccgggactcgtactacctcctgagcttgaggctggtccttctgttgctcgtgtcagcacaaagggaagctgcgccggtcccttgggagtttatgaggggtcagcaactatccacaacatccctttgggaaatgatcaagtgaaggtcggtgttgaggaagttcaagatgttgatgctcttttccttgtacccatcaagagtgtacattggcaactggtcattatatgtcctaaggacgatgttgtcgcctggttttgttccatgcacaataagtctaagaactacttgaaaggaattattaatagtgctttgaagggattcaatgatattcaaggaagtaagtccaaggctactgctaaatgcattctagttaaatattttactgatccaagaccattggaaccaaagagattaaagacaatttgtattcggtgtgcaagatgttatctcagagttaaaaatgaaacactgggtgtttaa

SEQ ID NO: 67489 - DNA, 453 bp, Glycine max
  Peptide Sequence Number=SeqID_184267
atgagatttaccttcgttgatttcaaactcttcaaaatcgtcatcgtcttcaaagaggtcaatcttgacgtccttggtggctgcttttggttcgtggccatggatggtctcgcaccattgaccacggatgtctgggtccagtccgaggacgaacccagtccacaactaggcaagttacagttccttggagcaatagacgtagatgttgccgatggcagcgatgtgtgggcatcggtgcaacttcgacaagtccaggacaacgacaattccaaaggcggtgcgaacaggcttggcatggagattggggagaagggtctcgcgctcggcaatggggagcaccacctgagagcccgtcatgcgctttgtactagcccttgcccgccgcggagagttgcgagtgatcatgagagtgagaccaagatcctagagtggaagcactgtgagagtgagtaa

SEQ ID NO: 67490 - DNA, 183 bp, Glycine max
  Peptide Sequence Number=SeqID_184268
atggtgaagcgagcgtgtgggaatgttagttcatggatctttcttcttctggacaagtatagatgtgtgtcatgggaaagcacaggacccatgtgtgataataagggcttttggaatatggctggctggctccctagtgagggcataggaggggaaggaggaataggaacagctcatagatga

SEQ ID NO: 67491 - DNA, 159 bp, Glycine max
  Peptide Sequence Number=SeqID_184269
atgtcagtgaaaaatctcgtcgggcgcctaggagtatatgacaagacaaaccacacactagcaagtcaagtcactctcacaaggcttaaaggagcactcaaaccgggtgacccacaaagcctacactgtgaagagtccgtcagggcctctccttcctga

SEQ ID NO: 67492 - DNA, 654 bp, Glycine max
  Peptide Sequence Number=SeqID_184270
atggccaccaagcccgccaagaagaccgccgcgacccccaagagcgcagcggcccggaaacctgctgccgccgcaccggccgcgaagaagaccactgcgccgaagaaggccgctgcggtgaaggccccggcgaagaaagcggctgcagcgaagaaggcgccggccagaagcgccgaagccgtccgcgccgaaaccatcgcccgcaagtcgctgcgcaagccgtcggcaccgggtgtggaagagctgaagtttggtatcgagagtgccttcgagcgccgtgccaccttgaccctgcacgagctggaaggctcgaccaagccgctggtcaaccgcgtgatcgacggcctggagagcggtgagttccgcgtcgccgagccggatgaccagggtggctggaaggtcaacgagtggctgaagaaggccgtgctgctgtatttccgcgtcaacgacatggcggtggtcgatgcgcgcccggcgccgttctgggacaaggtcgaatcgcgcttcgccggttatgacgaagcgaagttccgccgcggcggcgtgcgcgtggtgccgggcgcgatcgcccgccgcggtacctacttcggcaaggacgtggtgctgatgccgagcttcaccaacatcggcgcctacgtcggcgaaggcaccatg

SEQ ID NO: 67493 - DNA, 522 bp, Glycine max
  Peptide Sequence Number=SeqID_184271
gctttgggcttcgatggctgcttgaaagacgcagattgggaagttggctatggtccgtcgtgcattgtgcagacgactgatggcttacgttgccaagagggcattgtgagacaaaggaaagggctgaaaaggatgaccgggctagagtgctgttaccaccggaagaaatgccatgatgctctcttgtggcaattgaagtggaacttcacttcaaggggatgtgatgtctggtgtggcgaaccgtcatcactactgcaggagagagctgcaatgagactcgctgcggaagactcaagcttcgtagttagggcaaagtactggcatgctgctattggtagactgatgaagtcacaaaggctgaattggaaaaagtcggataccttcataagggtttggcatgagttagcgggagactctgtgacggctcactggttggtgagaacgctggatgaaaacgaagttgctagaatgctgtttcgaaagggccgttccaaggggaggcgaaccctccagtttgcttga

SEQ ID NO: 67494 - DNA, 510 bp, Glycine max
  Peptide Sequence Number=SeqID_184272
atggtattcacggtgagagatggtgagttgtatgggctgttttggtttggaatatatggaaacagaggaactctaacaggaagagctttactatgtgaggctgttgccttcatcaaaactcaaatccttctccttcaaagtgcctataagattcaggatgttaaatcccttgttcgtgctgaaagatatggtttccaaagccattttcctttagagcaaagaccaaccagttctagaggaaatcaagatatcacatggcagaaacttagaagggatcctctctttatcgaggaagatgaggttgtggggcttgatggccctagaggggtgggaaaaaccactcttgccaagcaagtttatgaccaggtgcgtaacaatttcgagtgccatgcgttgatcaaagtttctcaatccttctctgctgaaggattgctgaggcatatgttgaatgagctttgcaaagaaaaagaggaggaccctcccaaggatgtttctaccatcgagtcgtga

SEQ ID NO: 67495 - DNA, 441 bp, Glycine max
  Peptide Sequence Number=SeqID_184273
atgaagaaggtgatgcaaccgccacccacggcggagcatcaccttcttcgtcgccatctccgccgtggtgcgcacaccgtgaagcacaaaaaagcacatgacttcccacgtgggagtcacacgtgtgagaatacgggtaaccatgagattccacctacgaccccaaaagtcttgaagggatgtggaaagtgttgtttggggttgatggggagggaagctatggaaatgaaatggagaatgtttgggggtgatagtgcaagagggccttggttgaaggagaaaagaatgagtttgaaagtgccaagccaaacaaggaagaaggtggtggggccacctaggtggaaggaagagaggttgaagggaagggtggggaagaggttgagaatagggaggaggaagagaagcctcatgaagccttttggtattctagaagctatgtaa

SEQ ID NO: 67496 - DNA, 654 bp, Glycine max
  Peptide Sequence Number=SeqID_184274
atgaggggagcgccaacagaagagagtctctcgcccttccttgtgagagattttggcgcgcaaagtctcaaggttatacaaagagtccacaaggcgtggagaagtccgttgaggaaagacaaagagcttaggggcgtccgtaatggcgtcatcggtggttatcatggatggctaagagttcatacagctagggaaggcaagactcgccaaagaaaagttcaagtcagcgctacacacatccggaaggagtgcactgagttacgagaggaaaacgcggccactgcaagagcccttgaacaagaaaccaaaagggcccacaaggaggaacatggccgagttaaattccgaggagctttgtggggtagcaacaatgagctcaagctccggagagagttagctgcttgtgcaagatccaagaggagtttggctcaacacttggaagccacggagcaaagcatgctagctatcatagggcagtacaaggaagagttgaaccagtctgtgacccatgaacagaagctggtagaggatttcgcacaagtgtacgccgaaaaggaagcaagagggagggcgattgatgcattgcatcaagaagcgactatgtggatggataggttcgccttgaccttgaatggaagtcaagacctcccgtga

SEQ ID NO: 67497 - DNA, 264 bp, Glycine max
  Peptide Sequence Number=SeqID_184275
atgacgttagaagaactcaaagccaaaccaagttcaagtacacttataggagaaaaaaaatataggagacatattggagcactattttatccacccagattattcatgcaccatgcagtccctttcaataacttagatcaagtacatcaccccacaatgggccccataatgatcacgcaaaaaaaagatgtactgaaagacaagttctatgacaagactaaagcttcacggaggtctccacccaaagaaagttacatggtatag

SEQ ID NO: 67498 - DNA, 960 bp, Glycine max
  Peptide Sequence Number=SeqID_184276
atggcccgcaccaagaaaacaggggagatgacgactgaggccgcaaaggaaatcgttgacaagatcgattcctttgaggagcaggcatcacagggatccttcatcccccatggacgtcaggatgttctcaccgctgctattagacatccagagcaccctggacgtgtccgcgctgctagagctggtgtcaccatcaggcaatacttcgaatcagctccacggacatcccacagctcttcctcgttgcctcttgaagaattgcagcagctgacccagcaaatcagggaccagctagaagagtccaccatagagaaagtgactcggcagctcatggcatcattaagccagatgcagtcccagtttcagtgggcagctgtgtctagaaaattggcagttgtgtttagaggagtccatttaactttgtttcatgaatgggaagttgtgtctccgacaaaaccacctcaaaagccgcattcggggatcgatgatccactttatctgatgacattgaccatcccagagcttttcttaaggccttaccaggttacatgggatgccaccatgttcaaggtttttaatccagacttcccgctctacataaagcacaaagacctctccgaaatcgcacacggtggtcaatgtctcagcatatcagtgttacagttgtggattctgaatttgactgaaacaagtatgcgagcggggaattctgatttgtatggattcctcgagccacagtccattcagaggtctgggcaaccgcagtttgaggctgaaagttacataaagagttggatgcagagttcaaaacgcgatgtctaccttcgagcctacctgaatggcctaaatcaaaggctcctgctaggtggattgtcgtcaagaccattggagccagagagattaaaggcgattcggatccagtgggcacagtattatctccgagttagagttgagagctag

SEQ ID NO: 67499 - DNA, 360 bp, Glycine max
  Peptide Sequence Number=SeqID_184277
atgtctgccaatgtgactgaattacaaaaaattgatacggtggtgggtaaaggccgtgaagccgagattggcttcaacgtgacggtacattacaccggttggttgtatgacgcgaacaaagaggaccacaagggtcagaagtttgatagcagcctggaccgcaactcgccattcaatttctttttgggcggtggccaggtcattcagggctgggatgaaggtgtacaaggcatgaaggtaggcggcaaacgtaccctgattattccatctgacatgggctatggtgcacgtggcgccggtggcgtgattccacccaatgcagcattggtgtttgatgttgagctgctgggtgtgaagtaa

SEQ ID NO: 67500 - DNA, 372 bp, Glycine max
  Peptide Sequence Number=SeqID_184278
atgaatgtgttggaaaaggagactcaacttcttttggcccaaacagaattgaacaagataaataaacagctacaaagtgttgagaacacaaaatccaaaactctttccgagcttgataaggccaaagtgacacttcaagaactgagaaagaagctcaacagtgttagggaatctaagcaatcatcaatagaagttgttgaagctgtgaacaataaggccaaacaacttgaacaagcactatcccaaaaagctataggatatgaagcatggaaacaagaactagagcatgaaagaaaggagtacacaacaacagtgaaggaagaaagtagatgcttccaagaaacaactcaacaaaataaggcaatattttga

SEQ ID NO: 67501 - DNA, 545 bp, Glycine max
  Peptide Sequence Number=SeqID_184279
tctccattccgtcaactagaggcaagcaagcccgttgacacgcagagacatttcatggttatccacacccttgctatccagagacaatcaagtccgatagcatgcggagacaactcatggtcatccacacctttgtcatccagagacaacaagtctaatgacacgcaagcgaacatgttgatgcacggaaacaaatatggtcatctgcaccccttgtcaaagattcagtgtctattgaccgggactactttagtccctccttttgccatccagagacaatcaagtccgatggcgcacaaagactatagtggtcacatgcttttgtttttccgagactatcaaagtcccctttatcatccagagacaagcgagtctgattgtatccgggacgataatgagacaaacatagtcttattcttccctggtcaagagattcaatgtctgttgaccaaggctactggagtctcccctactatctcaagacaagcgagcaccaaggcttttgctgatgcacctgatgtcttttatgctctttcttttgacag

SEQ ID NO: 67502 - DNA, 306 bp, Glycine max
  Peptide Sequence Number=SeqID_184280
atggaagtgaatgtgaacaccgcaagtgacgaaaacagagagaaatctaaactccgaagcagcggcgatgtaggcgaagtcaaggcccaccttggagacgatgtggaaggggagggtgagggcatcgaggatgaaggagataaaggaggtggtgtcgtcgaaagtctcgacgatgacctcgccatcgcggtgggggacgtcatggcagtgatgggtttgaagtctgtgagcatgaggtttgatcgagatttagagttgacacgatggagggaggtgacgagggaagggggaagtcgtggttggtga

SEQ ID NO: 67503 - DNA, 877 bp, Glycine max
  Peptide Sequence Number=SeqID_184281
atgtggcatgagttggaagatgaacatttgttgaactgggtatgtgaaaggatgagggtaaggttgcggcaccagaggaattctaactctcataccaatgtgtctagtaccatgtctgatagtcgaggcagtgagaataaaggaagtttgggggagcaaggagagcaatctcttgatcttggcaaagttgaaaaggagagagttagacagattgttcagggatggatggaaaatggtattagtgatcatttatctaatgtgagtcagataaacaatagtcggagagcaaaatgtcttggagaaatggagcgagaaagggtaagaaatatcagtgaattggtgcaaatgattagccagcagagaggttcgcgtgggagccggagggatgctcaactacatgaaggtgctcaagctgatcaagcccacgatgtagtagctaataatgatgagagtcagccagagcatgttcggtgggacatgtcaaggttgcgtcgaagacaagctctagttgatttgcttgtgaaaatagaaagggaaagacaaagagagttgcaaggcttgtttgagcaccgagctgtttctgattttgctcatcgcaaccgtattcaggatcgcatcttgacgcggtacaacgagagtgcggaggtgggggagatgagggcgcgtagcagccaccagatgaagaaaacgttgaactggtgggatctgatgtggctcgggatctgggcggtgatcggcgccgaaatatttgtgctcaccggaatcgaggcaagggaggtggggccggcggtggtgctgtcctacgtggtgtccgggttctccgccatgctctccgtcttctgctacatagagtttgctgtcgaaatccctttcgctg

SEQ ID NO: 67504 - DNA, 1296 bp, Glycine max
  Peptide Sequence Number=SeqID_184282
gagtatcatgtcatggtggagcatgagaccaggagaaaattgaaatgtgcacgagttgataatggtggagagtatcatggcccttttaaagcatattgcaagacatatggaattaaacttgagaagacgcttccaaagacaccacaattaaatggtgtggaaaaaagaatgaaccaaacaatcaatgagagagttcggtgtatgctatctcatcccaaactccctaagtcattctggggagaagctgtgaagactgttgtggatgttatcaatttttcactgacaagtcctttggatggagagatcccagaggaaatttggtcaggaaagaaggcgtcatacaactacttgaagaaagttgttagaagcagagatgttgtgttcttcaaggaccataccattgaagatttgaagcagtcaaagaaacctaaacgtaaggtcaacactgatcatgattcattccccgtgccacatgatgttttaagggaacaaaacctattgagccagaagttgttgaacaaccttaattgcaacgttccaccagagatagatgaaggagagcctcaaagttatgaagaagctatggcaagcaatgatagagaagaatgggttaaagccatgcaagaggagatgcaatccttgtatgagaaccacacatatgacctagtggagttgccaaaagaaagacgagccttgaaaaataaatgggtgcatatgctcaaaactgaggagaatagctcaagaccaaggtataaggctcgaattgttgtcaaaggatgcaatcagagaaaaggcattaattttgaaaaaatattttctcctgtggtgaagttgtcatccattagagttgtcttgggtatagttgcaagcctagacttggagatcgaacaacttgatgtcaagacaaccttcttacatagagatctagaagaagagatttatatggagcaactcaagggttttgaagtttcgggtaaagaaaacttagtgtgtcaactccagaagagtctttatggtctaaaacacgcaccaaggcaatggtataagaagtttgactctttcatggctcaacacgatttcaagaagactcacactaaccattgtgtatttataaagacgtatgctagttgtgatttcttcatacttctactttatgttgatgatatgttaatcgttgggcataataagaagaaaatagctgcccttaaattagcagtgagaaaatccttcactatgaaagacttgggaaccaacaatgaaaatccttgggatgaagatcactccagatggatctaa

SEQ ID NO: 67505 - DNA, 268 bp, Glycine max
  Peptide Sequence Number=SeqID_184283
tgttgattttgatttgcttgctaagccaatttcccgacttagtgagccatccgctgcgtgcaccactcttgcggttgagcgtgaggaagaatctggaagaaggatgagttgtacatgcgcactaacgagccagagtcacactaagcgcgagagcaccaatgagacacacattcttcttccattcttcttattcaatgagatagactttgtaatggattttacaaagatagtggaaatctcaagtgggttgcttgagtactggacgtag

SEQ ID NO: 67506 - DNA, 282 bp, Glycine max
  Peptide Sequence Number=SeqID_184284
atggaggattcttctcaacctatcaaagtggtgattgtggaggtgagacacgtaccaggcatgtgtctccaccccatcttagtcgagaagcttgatgatgttgtgctgatcagtcactttggtgattacaaatggaaactcacaaaaggcaatatgattgttgctcgagaaaagaaagaaggcaccctttatgtcatgcaaggaagaatatgcaagggagaggccaatgttgcccatgtgactcaagcatggagttgtggcatagacgacttggccatatga

SEQ ID NO: 67507 - DNA, 1257 bp, Glycine max
  Peptide Sequence Number=SeqID_184285
atggcctccaggaagcgtaagagcattggggcaaggccaactgctcagtatgacactagacgcttccattcgcttgatgcttggaaccgttatacaaataacgtcttacgaatgagcattttgctagagaggaaggtagagatatatcacatagagtttgatgacttcaagacagagttagagaggcgtaatcttcacaaacgcctcaccaacttggttgatgggactattgatgttgctttggcgaaagaattttatgctaatctctacagctctaaggatccttcaccaaagcaagccagagttagaggccacttggtgaagatagacgctgacagcctcaacacatttctagagactcctgtagtcctagaagagggggagacattacccacctgctctaggtactataggttaccatcagaccacagagagattgaggctgctctttgcatacaagggagggggttcattttaaatgctgagggccatccggggaggattctcaggaaggatctgactaccttggcccaggtgtggagtgttatctcttactctaacctggcccctacatctcatacatcagaccttactgtggacagagccaacttgatctttggcctggtctctcatatggacatgaacatcgacgctctcatctcaggacagatgacttccattacccagtctaactcttgcagacttgggtttcctgctttgattatcgccttatgccgagctcgaggggttgtctctgacagcctcacatttgagcgcctaagtccggccattaacttggcctacatcaggaagaactgttggaatgttgatgatctaacagtttctttccgaggggctaggagggtgagggcgaggccagctgatattccatctacttatgcagctccaacacttaccccaacatctacttttgcagctcctttagtcccagctcatgtcgactctcaatgctttgaagccatgcttcaatgtcccacaacccagctaccccaacaggtacatgatgcttcatctgagaccaccattccagagccattcactcttcatcatgaggcagacctctcctcaccacagcctgtagctgacccttccactcccagacttgtgataccagaggacctgaccacaccagtcctggcactgaacacctctcctccagctactgcagtacttcacttgatagatgaggaggatactcagactcaagatacccaggatctgtctcaggaattttaa

SEQ ID NO: 67508 - DNA, 231 bp, Glycine max
  Peptide Sequence Number=SeqID_184286
atgaaaaataaaaatgttaaaatgcaaaacaaccacgaaacaaaacccttcccgcaaaagggtgatgaacacaaaaacaaaaatgacaatagcgaagcgcaaagagtggcaatgaccaacgaatgtcgagaaacgttcgctacatgtggagggggggttgatgatgagaacgagggagaccccgattggaaaatggagggaatacaaagatacgttcttggaccacagtga

SEQ ID NO: 67509 - DNA, 436 bp, Glycine max
  Peptide Sequence Number=SeqID_184287
atggatgccaagataactttaatattgcgccatggaggaagattcactccacgtgccaatgatggaaaggttgaatatataggcagagaatttgacgtttgggaggatatatctgcaaattacatgaacacatttatcctatgtgatctgttgcaagcatgtaagaagtatagcaggataggagattgtttttggttgattgataaggacttagattttaatcatgggttaaggagttgtacaacaaatggagatatattatacttaatgaaggatgctttggaaaatgagaatgagataaacgtttattttcatcataaagtatatccaattccagaagaagtcccactgatgttggacttgaaatgtcatccaattccaaaagctagtaatgaggatgatttagatgatgtacctgttgcaggccataaggaag

SEQ ID NO: 67510 - DNA, 635 bp, Glycine max
  Peptide Sequence Number=SeqID_184288
atggcctcctctggacctgttttttcattctccgggaccccaaccatcaccactgcaaagctgaactggaaaaactacccttcgtggtctgcttccgtggagttgtggttccttggtcaaggacaccatgaccacttggagaaaacctcagattctgtttcagatgatgaaagacctgaatgggaaaagcttgattatcaactgtgtgtcatgttatggcaatcagttgagccggatatcttggaaatccttcgatcatttaaatcatgtcgttccttttggaagaaagcccaagaaatctttgccaataatatccaaagtttgtttgatgcaaccatgaaagttacagccctcaagcaaatcagtcatgacatgatcgctcatgtgggtaaggctcgagctgccgtggaagaactgaaaaagttccttgtagctgattcattagaagaagtgaataggaaacttgacaagttctacatggttcttattttgagaagctttcattcagactttgatcatgtgcgtgatcaagtacttgctggagaccagattccatcgatggattccctcatcactaggcttctccgcgtgcctcatttattgaaggatgagaatcctactgatggagtggagac

SEQ ID NO: 67511 - DNA, 1111 bp, Glycine max
  Peptide Sequence Number=SeqID_184289
atggcgagcaaccactccagagctcagaagaaagccacgacttccaagagaaaacaaggtgaatgctctcaagctactctcaataggatggatgcatggttcaccgatgaaagcaagaagaatgattataagatgatttatgctgtgaagaatgaagtacccgatctggacatggttgtagtctgcaaattcgaacaaatagttgatgggtacaacaagatgcagacctataggggaatgcttcttgacccatcaaggaatttgaggaatctccttggagtaggtggtctgacagtaaaggacagaatgcttgtgtacctcattacctacattttcactctaaggtcaagtaatcatgctcaggtaactaacagtgatctgcagatggtatacagtctgaaattaggtatcaagatgaatttggtacttttgattgaagacattatgttaaagagacgtcggttagtggactacaaatttccttatgtcgtgcttgcctcaagattcattgactacttcaatgtcgatgtatctaatgagatagtggattttaccaaagcatctagtgagattaccaaaaggcatcttaagaagcttggaatgaggtttgcagaccataagtggattatggctggagagccaatagtaggaaactcggaacatatggatgaagaagttgaagctaaagctctacaagagcctgcacatcaatggagtcattttgagtctctcatgattcagaagatggacgctatgcttcacctccatcaagagcactcagctgaagttcacagtttgctggagaacatcactactcggctggaaaacatagaaaatagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 67512 - DNA, 237 bp, Glycine max
  Peptide Sequence Number=SeqID_184290
atggatatctgggaaataacaaaagctctttgccacaagagacaccattacactgggccaatcgtgctgttgtttggggagttgctacgtgcacctaacaatattgctggggcacccagcaaacagctgtctccggaagacccttcttatggaaacatttcggaagacccttcctccggaaaattccggaagaaccttcttccggaagaagaaggtgtgattccgaaagaactctag

SEQ ID NO: 67513 - DNA, 636 bp, Glycine max
  Peptide Sequence Number=SeqID_184291
atggttccttaccttgggcaccaggaacctttatttattagtgatgaatatgccctagagatgctttaccaggttagcattgctagtgatgttgaaaatgcatttggaacatggttggatgattctagttacatatctggttcgcaatctggaagtgtccttagcataaagcaccgtaccgtcaatcaaagagtgttcaaggtgtacatatacaaccaaacagccgagaagaggatggatgttgttgctttatctggtgcaccgcttactcctttacacagggactatgttgttatggttcctagggaaagtgggagaaggaaagatttatggatcgcacttcaccctaacttcaagtcaaaagccaaatatgctaatgccatactgaatggaattgaaatcataaagataagtgatagtgatcatagtcttgcaccaatattccagttgagaagggagcaaaggaagaacaaagttccacataacatggaaaaaactgaagtggagaacttctcatatactcccatcaaattccactacaagaagccacaaaaacattcaaccagcagtgacctcaggtcattgtcatcaattcacataagcagagatcaacatagccaccagcaacttcagtga

SEQ ID NO: 67514 - DNA, 423 bp, Glycine max
  Peptide Sequence Number=SeqID_184292
atggctaccttggggctggagatttcggttgaatctgcctcaagtgttattttgaagatgatattatcatttgaccttgcttttgctttgattccgctcctaaagttcagtagcagcaaagtgactagcagcacaagcattgaagagccttatttaccaacaacgacgggtgctcgagccaccgtcgttgaaacctcaaagaacaatgacggtgtcctcaccaccgacgttgacatactaccaaacaacgtcggtggtgagcccgccaccgatgttgacaggaaacaaaacaaatacgggtgttatgcatacccgacgttgatatggacaacaacaacgacgagtcttgctaacccgacgttgaaatggaccaaaacaacgacgggttctctaatatgtgcatcgttgaatccttttttataa

SEQ ID NO: 67515 - DNA, 489 bp, Glycine max
  Peptide Sequence Number=SeqID_184293
ggttcccaagaaattcgtatcaccatccaagagcaatgctcagaaatgtgtttagaagctagcaaggcctttaaggagctaggatcatcaatcagaacaatgactatgtcatcatcttcagacacacatgttgcaaacgcaaaagctgcagttaagagcctcaagacattgctccaatcaagttcatggaaagaaacagaccttctatcactcataccagctgcaacagtggcttcacttctgattgatattattgaattcacggagaaaatagcagattcagtgaataaccttgccaccctcacacattttgaagttgtagatacagataaatccacaacaaaagcacaacaaccatcacaatcatctccacactgtgaatgtgctgaaccgggtcccaagactgatcataatagcctccaactcgttattctgattgaggactcagcgctagctgtgtcagatagtgaaaaatcaaacagagtttga

SEQ ID NO: 67516 - DNA, 135 bp, Glycine max
  Peptide Sequence Number=SeqID_184294
atgtctaagaaattatatgggaagtggtcattcaatggcactctgatgcacttgcatgcgatatcgattcaagaatggttacaagaaaggagaggagatacaccatatgtattgactgtgaaagctcacatttaa

SEQ ID NO: 67517 - DNA, 153 bp, Glycine max
  Peptide Sequence Number=SeqID_184295
atgactcttattttgagatgttgctatagatcacttaagaggcctacttatttgaaaaattatagggaaaatggttttgcatctgcattagaatccatcaaagaaatgactattgaaatggatatagagctcaagttcaatgaaaaacactag

SEQ ID NO: 67518 - DNA, 1061 bp, Glycine max
  Peptide Sequence Number=SeqID_184296
gcgacctgttgaaggtttttggcatcattgtggtatcagagcttcgacctcacacctgtgaagattatcaatggcggattacaatactagatcgcaaaaagtttgaagattcaatcaaagaaacattgaaggagatgagcgaaaatattaggaaaattgcagattgtgtatatgggcaagaaactcacgtttcagctcttaataatcaaaatacagtgcttatggagaggctgaaccaggagttctttgaaattgatggaacacttgcaaaaatgaagatgaagttggcatctatcaacctagaaggacgcacttcatctgggcatcaaaatttcgttagatttcgacctgaagctgaggtgatttcctgggaaacttatgttgcagatttgaaagaaagatttggagaaaagcataaagatttgatgtcaaaactgttatccttgaagcaatcaggtaaagtttctgactactatgaccaatttgattactggggccataagtgcaagaagaaagagtcatttgtgattgaggtcactgaactgaatgatgtggagggagatcaagagggttttgtagaagaaatagaagaaaataaggaagatgagggaaatccacagatctcagtgtatgcaattgatggtgtggctgcaaaaagttaccaaactatgaagggtagcaaagaagttggattgcaaagtggaagagatgggtccagtgtaagtggatgtggcaattgggggaagtctaaagtgtgtggctatatgcaagggcctgacatggactttacagggcaccaaggaacctacctcattacccctgcaagaactcatgatcataggattcctttgaaggaaggagtgtctacaatcaatcctagtaactatccattttcatctccaattgtacttgtgaagaagaaagatggatcttggagaatgtgtatagattataggaagctgaacaaaagcactgccaaagacaaatatcttatacttgttatagaggagctgcttgatgaacaacatggtaatggatggctttccaagattgatctctga

SEQ ID NO: 67519 - DNA, 279 bp, Glycine max
  Peptide Sequence Number=SeqID_184297
atggggtgttacaacctacatccaagccaatcagaaggcctcgtcgacgtccttgttgttgagcagattcagcatcggcttctgcccttatgccaccaacaacgagaaaaggaagaagttaaacgacaccactttgaagacaaggagcttcttggctacgtcaacgccagcttcgctagaggagcgattcttgaggctgcgctggcccggggtggtcagggagaggcccacaaagacagtgatcgtgaagaggaagttcatgttcaccaagccgcaacg

SEQ ID NO: 67520 - DNA, 213 bp, Glycine max
  Peptide Sequence Number=SeqID_184298
atgtggcaccatgtcagtgaaaaacctcatcgggcacctaagaggagaccagtcagggtcacgctgttttgcgagaatgctccaatcatgtgggatcgacacaggcttaaaggggcactcaaaccgggtgtatttaaccccaaggcctacattccgaagagtccgtcagggcctctccctcctgattcaagtccaacccataaaacattttag

SEQ ID NO: 67521 - DNA, 306 bp, Glycine max
  Peptide Sequence Number=SeqID_184299
atggctgaattagtattcatgataagtgcatggtgtatgccgaaatcttctccattacagcaggtgctggtggtactgatgcacaggcttctaggtgtcacgtgcaaaaaggttttacaatgtgactgcatcctacagaactatgaggaacctagcatgcaaattgagatggtgcacattgcacaagatctaatcactactgcaaaaaagacatttaacgacggttataaaaaaaccgtcgtaagaaagtcatcctttctaaggcggttcttagctaagaaccatcttagaatgtatgctttctaa

SEQ ID NO: 67522 - DNA, 192 bp, Glycine max
  Peptide Sequence Number=SeqID_184300
atggctcaaaatggagtgaacaatcaagacgaggcagagcaaggtggctggccgacatttgcagcgatgcatgcagacgaaggttgggggctcaagcttaagccattttgttttgtgctaaggcaaaaaacaaacagaatgcaaacttgtgctcccaaggttggtgatgaagccaatttttttctagcttaa

SEQ ID NO: 67523 - DNA, 846 bp, Glycine max
  Peptide Sequence Number=SeqID_184301
atggtgccaagagaaccagcattacctactcgatcagtgggtggaggctttatgaaccaaaatatgggaaaagctggggaggacataaagatgggcaggaaaatagtgtgggacatgggtgctcaaatggatgataacagagctcaaataaacaatgatcgcgtgactataaaggatggcgaattgtctcctgaaattaggacaacagtagatgactcggaccatgctggaatgcatcctacgcaatctagctggggaagaaaaagtggaagctgggaaatgtcccttgaagtcctggctttgatagccagggtggggaaccaaaccgtgtcggtggggaagtttagaagcacattccaaacctccaatgttgagaagcattcaccaagaagagaaaaacaaaaactcagaaaccaatatctgcatgctaaattaggagtattgtttgcagaggtgtggcaaaagctttggactgagagattttcacaagaggaggaaaatctcatcattgaacttcatgcaatgctagctagggaaaagagggtgacgttgcgagggagggcttcactgcggggaacttggaaagcgcttcgactccacctcacacatgcgccagagcaaagctcttcactgagggaaggcaaagtggtcgacatcgacagagggcagccagggaagttcgagagagctcaagaggtagactgtactagttttctggttgcgtgtgaaggagtcgttcaaggtttaggcatagggcttttaacttgttcggagaatgacgatggattgccaccaagacacattctaaggcggttttcaataactgtcttaggatgtgcgtcgtaa

SEQ ID NO: 67524 - DNA, 381 bp, Glycine max
  Peptide Sequence Number=SeqID_184302
atggctcctccttccatcactattatgcctttgcttagtgctggtgcggcgaatacgagtacttggtggccccgcctcattcttcttcagcttcaccagttccaactccagctatcttgcaatggatgctgtcttcctcctcttctcacccagtatctccctagatcacggcagatcggcgttcataattcgatcaacaaaaggatgtcactgagtcatccttccctcatagtgatgcagagtactcgttgccctaaagcgtctcacataagcctccaaatggtcgtagtcagccttcagctttttgagttcctcctcatggcatcactccatctccgtaatatgtgtttagagttgttggagagtgtcattgtctattag

SEQ ID NO: 67525 - DNA, 384 bp, Glycine max
  Peptide Sequence Number=SeqID_184303
atggcggacgatgagcaccagaacgtgaattcgcttgctgatctaccagctacaacgaaagcatccaaatctgggctcacacattctctcacaatcaagcttgatgagaagaattttctcctgtggaacacgcacatgaagtctaggacaagatccacaaatacttcaactctcgcactcaaatctcgtgctcgtcaattgagatctgaactcaagaacacgaagaaactctcaagatccgtcaatgaataccttatgcgcatcaaatcgattgtgaactcactcgttgcggttggtgacatggtttctgaacaagaacaagttgattcaatccttgagggactgccagaagagttcaattcgtctcctcatgatggtgtatag

SEQ ID NO: 67526 - DNA, 903 bp, Glycine max
  Peptide Sequence Number=SeqID_184304
atggcatgcaccagaatgcctttccaagcaattggccataaaaaaaaatctgttcgccaagcagctgctgctagcaaaagacaaactgttgaaaggaacaaatatggacaacctcctcctatagttgaatcctcaccaccaccgccgccaccacggccagttcagcctccagagctagctcctgtggaacctcccatggtgaagaaattcttgcatcaaagtgttgaagctcattttaaggagttgctccctaggaagtttcatcttaagagcgaggtgaagctagaacccggggaactccaacaatttcaagacaccattgagaaaagaaagacttcaatggtgcatggtactcgggtgagatatgatgtagttaccataaacaaattcctagggactgattttcaagatcccaaggcacaaagttgtaattacttcaagttaaaggacaaagatgattttgacccaaacaagctagctatggtgctttgtattcctggaaaatattttgttaaagaaaaggagagcaacaaagcatacaaattcaagaggaatgcattaaggacaatcagtcagatttggatgtcctttgcattctcaaacattgctcccaccttgcacacttccaacctcaacaaacaacacgaggattcaactgacaagcctttaggatttctcactttgatcactgctctttgtgcccatcaaaaggccaaaatgggcggggatggtggacccttttcaatgaaaattgtggttgtaccagaggaaggaaatcagtctcatcatgatgaggaatgggctaaagtgtcaaatgcaagagagaagggtgttaaaggtgctaatgatgatggaccaagagaggaaaaatatgggtgtgctagtgtttttggggccaactga

SEQ ID NO: 67527 - DNA, 486 bp, Glycine max
  Peptide Sequence Number=SeqID_184305
ggtacatcctttgtgatacaagtagagggtacatctacttgggttgttgtgactgagaataagagagggtacatctcttgtggatcagttctagtggagggtacatccactaggttgttcaaagagaacaagggagggtacatcccttgtggatctttgcttgtcttagttcttcttttgttaacgtctggccgagatccaggcataattccacgcaatgcacatcctccagagccagaaggattagatagtaatctagatgttggtgctggtcaaactcctcaattgcggttgcctcactttaaggaggttgaggtgaatgggatccctattaaggtcaagtattgtgatacttgcatgctctaccggcctcctcgatgctcgcactgctcaatctgtaataactgtgtggaacgaatgttttgggggaagagtagcttaatcccattgttaagtgtgacagagatggttttgagtcagctttga

SEQ ID NO: 67528 - DNA, 1618 bp, Glycine max
  Peptide Sequence Number=SeqID_184306
atgtcaatgccaatcgtggaagaggtcgtggtaaaggccgtggccgaggtcgtggcaaaggtcaagctcaaaatcaaggcaaagtcaaccatgaatcaaaactcacgcggtggttaccaagcaggaccttccaacaggcctcagaacttcaacccttacatgaggcctactgcacacttggccatgcctcagccctatgccatgcctaatatggatcagttctccaatggagcttggtaccctgattctggtgcctcacatcacctcacctataatcccaacaacctgtcctacagctctccctacactggtcaggaccaagttgtgatgggaaatggtcaaggtgtgtccattcactctctaggtcaatctcaatttcattcacctaatgaacctaatgtgaagctcactcttaaagatttactccatgtgcctaatatctctaaaaatctgttatcagttagtaaatttgcccaagataacaatgtcatatttgagtttcatccttatcattgttttgtcaaatatcaggattctaaacaagttctccttgaaggcactgttggagctgatggcctttatcagttcaagcctttcaagtttctcaccaacagtggtgctgcctcaaactcagattcaagctcaatgtctagttccagtcaattttctgttttcaatactcctgtcaattgtaataacactgtttctgttatgcaaaatggcaatgtatttcaaatgtggcaccttaggctgggccatgcccacaccagtgctgttaagaacattctaaatctgtgtaatatacctttttctaataaaactgcaactcttccttgcactttctgttgtatgggcaaatctcatagactgcactctcctttatccaatactgtttacactaaaccgtttgaagtcattcactgtgacttatgggggccagctccctttgtatcctactatggctacagttactatatcacctttgtggatacttataccaagtttacttggatatacttcctaaaagccaaaagtgatgcacttaaagcctttactcaatttaaagcacttatccaaaaccaatttcaagcatctattaaggccatacaatctgattggggaggtgaattcagagccttcacagccctgctcaatgagttaggtatccaacacagacttacctgtccacatacctctcatcaaaatgggactgttgaaaggaagcacagacacattgttgaaatgggacttacactactctcacatgcagctttacctttaaaattctgggatcacagtttcactcaagctgtatatctcattaacaggttaccctccagtgctatcccactgtttcagtcaccttaccatgcattgcatcaatctcaacctgattattctcagatcaaagtgtttggctgtctctgttttcctcacttgagaccctataacaaccacaaacttcaatataggtccagtccatgtgtctatctaggagtatcacctcaacataaaggtcacaagtgccttgatgcaactggtcgaatttacatctccaaggatgtgatatttcatgagtctcaatttccctacttgtctctatttccttcatcatcca

SEQ ID NO: 67529 - DNA, 1637 bp, Glycine max
  Peptide Sequence Number=SeqID_184307
tcttttcccattttcacttgccgacaaggctgagcattggtaccatgctattcctcccaacattcctttgacatgggatgaactttgtgataagttcttgcataaatttttccctcaatataaaatcaatcaaaggaagacaactattgctactttcactcaaggagttgatgagccactttgtgaagattgggagcaatttaatagtctattgagacaatgtccaactcatggccttgatgatggaggtcaaattaacactttcttggtggggaacaacaacaaccatggtcggaagcaagatgtcggttcatccagtagaccaccacctcatggtaatcaagctcaacaaggtcgacaatatcaacctcttcatcaagaccatacttctaagttggaggatactctcaatcaatccatgcaaatctctatcaccaaccaaaagaatacaaatgcttctataaaaaaccttgaggtgcaaatgggacaaattgccaaggaaatggaaaagctcaaaagtggatcactctccgccaacactcaaactaatcccaaggatcaatgcaatcccatcaccacaaggagaggtacgttggtaggtgacttgagtagagagaaaaatgagcaagaggttgcagttgaagaaatcattgaggatgagatgagtaagagtcaaatagctaaagaaaagaagaatgtggtagtgaatcctcctgccaaggatctcccatatccacatgcttttacaaggaaggacaaagaaagtgccttcttcctaatggatttgccaccaaaactccaagatccgggtagcttcacaattccaataactattggagatctcaaggtaggtaaaactttacttgaccttggagctaggattaatctcatgcctctctccttattggcaaagattggtgatcttgatcttaagcctacttggataaccctccaattagcgggcatctccattaagcgtctatatggtgttcttaaggatgcacttgtcaacctcttgccttcatcttactccaatgaatacattctagtggttgttgattatgtttcaaaatgggtggaagtttttgccactcctaaaagtgatgccaaggcagtcatcgaatttcttaagaatatcttctcctactttggagttccaaaagtgttcataagtgatggaaggactaaattttgcaattcacaactgaagaaagtcttggaacattacaacgttagacacaaaatagcttctccctaccattctcagaccaatggccaagccaaggtatccaatagagaaatcaagaaggtccttgacaagactgttgcttcttcaagaaaggattgggctataaagcttgatgattccttatgggcctataggactgcattcaagacgccaattgacttatctcctttccaaattgtgaatggaaaatcttgtcatctttcggtggaattggagaataaagcctattgggctctcaagcaaaaagtgaaggcctaccatgataaaaagtggctcaagttgtttcctggaaaattgaagtttaagtggtctgatccttttgtgatcaaggaagccataccttatggctcacaacaattcttcatctcaatgactcttgaggtcttca

SEQ ID NO: 67530 - DNA, 603 bp, Glycine max
  Peptide Sequence Number=SeqID_184308
atggcttctaggagacgccgaactggaccaagccaaacatatagagaggattccacctgggattcctctcggttcgctatagagacggcatggcaccgatatcaagataacgttcatctctggaacatccttccgaagaggaacgtagagctcgccccagggatgtatgatgagttttatggcatgctccacaggcgttactggcacaaacgactaaccaggcttccagagaagcaaatcgatgtggccctggcgaaggagttttactccaacgtctatgatccggaggatggctcgccgaagacgtgcatgttgagggggaggaccattcaattcgacacgcagatgttgaatgagtttctggggaccccagtcatcctcgttgagggggagcagctgcccacttactcccagtacctccactcttacccagactataaggccaatcgcggccaagttctgcacaccaagagggcaattctagctgaatgtcgagggagcgtcgtggaagattctgcagaaggacctcaccaccttggcacagacttggagtgtgctttcatacatcaacctctcaccgacctttcatacatccgacattaa

SEQ ID NO: 67531 - DNA, 207 bp, Glycine max
  Peptide Sequence Number=SeqID_184309
atggtcacgagcatctctgagtatggatggccagaaaaatccagcctaaagtatcctgacagctgtcctatctccactgtaatggcctccataagatatggtgatgtagctctatgtggagcttgtaggccttggatcttcttcatcaatggagtcctttgcttcttgaagatcaatggcagtggaatggagaatgatgaaaagtga

SEQ ID NO: 67532 - DNA, 483 bp, Glycine max
  Peptide Sequence Number=SeqID_184310
atgccacagatcctttccagtctgacccgtggctacccctaccaacaatgcccttttagggggcatttggaagagcttttatggagcttatttgagcttatgaatatggcagaggaagcacagaggttacgcaaaagaagaaaggctgaaaagcgtttactggatatgcaaagaaggcaaaaagaacgcattgaagaagtgagagagacacagaagaaggatgaagaagttatgaacctgaaagagcaattgcgggttgaaatacagaaggggcttaatcaattggagatgcgatgccatgatatgccctcactgcttcgtggcttaggaatacaagtgcatgcagcctataaacgtgccttgcttaagtttcatccagaccgtgcatcaaaaactgacgtacgtgcacaggttgaggctgaggagaagttcaagctcatctctcgctggaaggaaaagtttgcgatgacttcatgtcactaa

SEQ ID NO: 67533 - DNA, 384 bp, Glycine max
  Peptide Sequence Number=SeqID_184311
atgggtttctttgccaagcctattcaaaatgactgttcatacaggattcagaaatggttcaattggttctggtcgcattgtccgagacagtgtggggtgttatgttattttgttggggtctcaaaaagccctgaccttaccaaagccttggctcttcactggggtctccaattactgctgcaacgttatgtggaagtagttggagttcaatctgaacctccactggtagtatactgtttcaaggaaaaggaaggcaggccaaacttagttataaatttggacgaatgtccattaacttgcaagactggaaatttttatcattccacatatttagtagatggaattgtcttaagcggaggttatgcagtcctcaaactcaaataa

SEQ ID NO: 67534 - DNA, 1404 bp, Glycine max
  Peptide Sequence Number=SeqID_184312
atgggaaaacatgtctcaagagagcactttcaacccagggcgtgttctgggaagaaagagaatttaaaacataccgtgtttattgatgtagatgatcaagttgatgatgtggatgtggatgtgacgatcatagattacgaagagttcatgtctaaattgcatggatctagtgcgccgagtacagacagggtatgtacgccacagagtgttattagcattgatgatgacgacagcgacgatgaaagtgatgatgcagagattcccggagttgttgctggaggtgttggggaattggatagcgatgcctgttctagtgaaaggtcttctcctgacccaagtggcatgcggaattctgtacacgtggatgttgatgatgatagtggtgtctgtgaaaaggtgactgaatctgacaagctaaaaagtaggaaagcaagttctgcaaatggtattggcggatgtcgccatggtattgattggggtgacagtgagtcatcagagagtgattgctctgattgtgaactcatggatcgtgaacagtgggaaaagatttcacttaagagaaagcgcagtgcgtttaatgatcaaccttgttatgatgagcatggtagttcttctggattacattgtaataataatgtatacgttgatgttgatgaggaaaatatgactgaagagaatgctggaggcccagcatattctggtcccacccatggtgaatatgttaaggagaatcaatcttccttttctgttagaggtgatagtcaagtagataatcaatcttcctttcctgttaagggtgatagtcaagtagaaaattttttcatggattctgatgagaaagccgagtgggaaacttttaaatcttctttgtttgaatctacagaggaaatgaaatcattgcatcaaagttctgatattgagcatggaagaagtactagaagcaaagatttctctacctacacccagtataataataactacaatttctgtagagctgttactggtgtttcaaggagccaagaagcatgtgaaaggcagtttagcaatactggatctacactgaagagcaacttatttgatttgaattctgaatgtgcctctgatgatgaaggacaggttaattgtgatgggcttgcttcaagtgatcaagattgtggtcttattgcttcaaatgatcaagattgtggtcttactgcttcaaatgagaaagatataattaatgaaagagaaaagcttaaggagactgatgaatataaacaagcaatggaagaggaatgggcatctaggcagcgacaattgcaaattcaggtgcttatatatgataatcctggtggggagcccttccaaagcaacccttcaatttatgcccttagatgcattggtccttcaaatgtgagtgcttag

SEQ ID NO: 67535 - DNA, 999 bp, Glycine max
  Peptide Sequence Number=SeqID_184313
atggcaccaaaaaggagtgaagctgttgtgatccctggaatcaacactgaagatgaggccaagaatgtcttccctttcttccttgagaaatttagttcatggcattatgatcaatatgccttgttatgggggattgcaaggcaaaatgatgttaatatgagaggcaccatcaaagggaaagaagtggtgatcttgccaacaaccattgttgctacgtctagttatgttgaagaaggccttcaaggacaggttcaaccccaagcaaatgaaaacatgctcaagcgattagaagaaatttatggagcaccagaatctgtctccataaaagtaatgaaggagcagctaaaggcatggaaagagttgatgatgtctgaaaagcccataaggttcatagaactctttcatagacttaactacagactgatgaagccagctgaacaggaagccacaacatggattttgccttcaagaccacctattcagaagcaacaagacattaaagtgcatccaaatcttcacaccatatggtatcatggtttcaaaggatacagagttctggaatggcaaacttgcaacaaagtctggaaagaaagtgaaaatgaagctggaaaagctcgatctcaccaagatctagaagacagaaaggtgtatcctcatggtgcaagcatatggaaaagtagagaggctaagtttgctgggatgcatttcttaactcccatggatcttcagcagttgatgggtctcatttgtgccctcaatgttgttcttccatgggattgcaccaagattggagagatgtttcagacaacgaagatcatcttggaggcacttgaagaaagtttgaattttcaagactgggagttatcagaccatggacttgcgcttagaatgaagctatttacctataaagaagagatcaaattaaggcaagcttcatttcatagaattcaaaagctaaacactcatttgcctttcatgctggggtcacaattgatgtga

SEQ ID NO: 67536 - DNA, 222 bp, Glycine max
  Peptide Sequence Number=SeqID_184314
atgacgactgcccaggatgcatatcagacatctctggcagcctggacttccggagatccgggaattactcagcttaattgggatgctctttacaaaaggaatgggcaacaggcggcaggaacgtattacgggcagacgggacgaagggctttatattatctggttgatgatgtaagctactcaacatccagcagggaaggattattcagtgggatcctctag

SEQ ID NO: 67537 - DNA, 399 bp, Glycine max
  Peptide Sequence Number=SeqID_184315
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaaatgggtacctgtacccgaaaccgacacaggtgggtaggtagagaatacctaaggcgcgagacaactctctctaaggaactcggcaaaatagccccgtaa

SEQ ID NO: 67538 - DNA, 282 bp, Glycine max
  Peptide Sequence Number=SeqID_184316
gttatgccactcaccagacaccctctagacccggatatgtctaacagggccctggggtttccagcattgatcacggacctctgccagtcattcgaggtgcccgtcacacctagtaaggtgatccgaccgccgatcacccgtgccttcattgagaagtattgcacgcctaggcaggcgcagggtgatgcaccacaggctgcagacgcaccgccaccacctcatcaggctgatcctgctgggtcattaggcatggagcggtatctacagcacttggctcgctag

SEQ ID NO: 67539 - DNA, 294 bp, Glycine max
  Peptide Sequence Number=SeqID_184317
atgggggagagtaaagactgtggcaggagacaagatgaggagttggatgagcttagtttaagtgtacaaagaataggaggtgttggacttactatacatgaagagctccttgcacaggaaaagattattgatgaactgggtaatgagatggacagtacatctaatcgcctagattttgtccaaaaaaaagtggcaatggtcatgaagaaggctagtgcaaagggccagatcatgatgatattgggtttgctggcgctgttcattttcctctttatcttggttttcttcacctag

SEQ ID NO: 67540 - DNA, 320 bp, Glycine max
  Peptide Sequence Number=SeqID_184318
atggcagaggtctccacagaggccattgcctccctcacccagtattatgaccagcctttgaggtgtttcacctttggggacttccagttaacactcacggtagaagagtttgaagagatcctgggatgctctctgggaggaaggaaaccgtatcttctcttagggttttatccctccttggctagaatttccaaaatagtcaaaatctcggcacaggaattggaccgggggaagcaagtcgaaaatggggcggttggagtaccacggaaaggtttggaagcaaaggcgagaaccttggccagtcaagacgaatgggctct

SEQ ID NO: 67541 - DNA, 357 bp, Glycine max
  Peptide Sequence Number=SeqID_184319
atggcaatatatgaagcacttggttcctttatgctatggtcattggacaacattgttgcagaccttgccagtcatcaaggagttgttaagggatataagaaggcagtccagcaatcatcatcgaaatcccaggttttgcttccttttgtgatgatcagtgttgctggtattttagatgatgttcctgtacatgcaaatattaagggtggaattgtaaattcttggaggagagataatcaagcttataatgaggaaggtgtgaggccaggcatagagaaatggcagggaaattctagccttatccaaatgtcgatattcctcctcaaccatatgatgcttggcatggtcctcctgtaa

SEQ ID NO: 67542 - DNA, 582 bp, Glycine max
  Peptide Sequence Number=SeqID_184320
atgaagatgcacaaaacaataacgaggacccctaagggtccatacatcatgttcaaatccttaaagacaaatactaactggatgacaaacgaagaacgatgtaaaagtggattatggtcgcaattcgatagcgcctcggcctcgtttttctcttctttctttttcttctctctgatttctcttaatttctctcaatgctggaccttggaacccaatactcagcctccctcacgcctatttatagcaaaagatggcattaggggcgagctggttacttcacccctaagtcttttgggggcccaggcgagccagggttcagaaaaatgcccgaaatggcctttttgcccctcccgttggaaacagaggacgtcgagtcctacgaagcacaaagacaaggacattgagtcctataaaagagaaaagacgttgaagtctttgaaatgttgtcgcaacctacccttcggcgggagggcgacgcgagggctcacgggtgcatcttccaagaaaggaaaatgcgcggagtcaccgccaacgtttattcgaggaaaacgttggaaaaaccagaaaaggtgtggtctatga

SEQ ID NO: 67543 - DNA, 156 bp, Glycine max
  Peptide Sequence Number=SeqID_184321
atgtgtaaaacaattgatagaggtgcaaccaacccgtcttgtgattctttacatgggattggaggtcctatgacaaggtccaagactaaaaggatgaagagaattataagcaattgggcttggatccagaattgggctgaaccagcttggacttga

SEQ ID NO: 67544 - DNA, 570 bp, Glycine max
  Peptide Sequence Number=SeqID_184322
atgaacgccgcgaatccgaaagaaatgatccgcatccgcggcctgcagaaatcctacggcgaccacgccgtgctgcgcggcatcgacttcgatgtgctgccctcgcaggtggtggtggtgatcggccccagcggttcgggcaaaagcaccttgctgcgttgctgcaacgggctggaagtggcccagggcggcaccgtggagatctgcggccagaccttgcagaacgaaggcgagctgttgcccgaggccgaactgaaccgcctgcgcatgcaggtcggcatggtgttccagggcttcaacctgttcccgcacctgtcggtgctggacaacgtcaccgtcgggccgcgcaagctgcgcggcatggggcgcgacgaggccaacgcgctggccgaggacctgctgcgcaaggttggcctggcgcagaagatgtcggccatgccggccagcctgtcgggcggccagaagcagcgcgtggcgatcgcccgcgcgctggcgatgcagcccaaggtcatgctgttcgacgaaccgacctcggcgctggatccggagctggtgggcgaagtgctgcag

SEQ ID NO: 67545 - DNA, 279 bp, Glycine max
  Peptide Sequence Number=SeqID_184323
atggacattggtgaagaaggacaagatattgttgacatgatcggagaaagcatgaaagaatgtgatggatttgatgagtcaacatatgatttgggggagaatgaagatgttgttggagagaaagctttggaagagtcaacaaatgattttggagaggacgaacatggtgatgggaaagaagttttggaggctgaagacaatgttgagtatgtgagtgaattggaagatagtattgataaggaagaaaatcaaattttaatggtttggtggatgtattag

SEQ ID NO: 67546 - DNA, 387 bp, Glycine max
  Peptide Sequence Number=SeqID_184324
atggaagagattcaaagtccttctagcaatacattgaggtctgcaaacaacataagaatcgatgtgctaaagaatgaccttcaaagaataaatcagattcgtagaaagatgaccaaggaagcatgcatgagtttgggaagaaatatgttttcatcacatatcggtgaagaaacaagaagctacgaagtggaagaaggatatttctcaagatttgaggcagaacattttcaatgggtcgtgccaaatattgaagagttgggaggattgagttttcaatatgctttaggtgatagtcataggcaacaggcggaagtcaaagtggcttgggaaaatgttagaaagaaaggagaaaaagagcttggaaaaccccatgtgactatctcgtaa

SEQ ID NO: 67547 - DNA, 633 bp, Glycine max
  Peptide Sequence Number=SeqID_184325
atggcaattgagaaaaagaattcaagaggagctgcaaagaaagaatttgattcggttgatatgagattgaggaaggctttccgtgcgtggcttgcacaggaacaacaaaagaatcctcagttgttttcgttcctcgaggatgacgacactgagattttgaagagcctcctcagaagaaaagacaaaagaaagagagaagaagaaggcacgtccatgaaatgtgctagcagtagcagtgatgaattgccaagtccatttaaagaaaagattcaagaaatgaagggatgtgaggtgaagttggtgatgcagaagaaactctatgagtcagacttgaatccaaaccaaaaccatgcctgcttctctatcaagattgccaacaattttttgacacaaaaggaggagtcctttctagaggaaaacaaaatgcttgctggcatgcacgtcattgtgttggatccttctcttagagactgcaacatgtgtttcatgaagggttcaagaagctgcttctacaacttgaccaatggatggaaccaaattgtgcttcagaatgatctcaaactgcatgatatactgcagctttggtccttcagagtctcctcttatctctggtttgcacttgtcaagctgtga

SEQ ID NO: 67548 - DNA, 522 bp, Glycine max
  Peptide Sequence Number=SeqID_184326
atgttacggaagcgcctcggcttgaattttcttcacggaactaattttcctcatctatttcgagagagagagagagaagtgcctaagggggctgaacccttttctacttcacttctccccctatttatagaaaattgggggagaagcttgccacccagctcgcccaggcgagcaaggttgcttcctccagaagcaacagccttctggaggaatcttctggagggcccaagtgggcctgttacggaaacttacgaatttcgtaacgatacttgttttctttccgtaatgttacggaaccttgcggattacataatcatcccctttttgacttacggaatgttacggaacctcactgtttgtgcaacgatgcttccttttgatttccggtgtgtcacggaatttttacggattgtgcatcaatattttcttttgatttccggcacgtcacggaattccacaaattgcctaatgatgggtgccaagcacctcaaaatgaccaaacacaagttgcatgccacctag

SEQ ID NO: 67549 - DNA, 771 bp, Glycine max
  Peptide Sequence Number=SeqID_184327
atgacggtggggcattcaccgattgttcaggagctcatgaggaggcagaatgtggaggaaggtggtaatggggagggtgtggatggtgatggtggtggtggtggtgttggtggtggtggtggtgatgagggggatggtggcaaggtgaagaggaaagggggctggtttaagtttatgagtttgaagagtgttgtggtgggtcagaaagagaggcggagtggggatgagagggatacgtcgtcgtcagagaaggcgggtggccggaggtcgagttcagccacagatgatagccaggatggtggtggtttggttcatgggggtgagagagtgagggttaggcagtatgggaagtcatttaaggaggttacagggctttatagtagcccgaagattcaggctcatgagggatccatttggtgcattaagtttagtttggatgggaggtatcttgctagtgcgggtgaggattgcatgatccatgtttggcaggtttttgagtcagagaggaagggcgagctgttggtggagaaaccggaagatgggaatttgaacatcatgtttcttgtgaatgggtcgccagagccttcatctcctggcatggacaataattcggagaagaagagaagggggaggttgtcagttagcagaaaatcgttgagcttggaccagttagtggtgccggaaactgtgtttgcactcactgaaaaacctgtttgctcctttaagggccatctccatgatgtgcttgccctttcttggaccaagtctcag

SEQ ID NO: 67550 - DNA, 1020 bp, Glycine max
  Peptide Sequence Number=SeqID_184328
atgggatttgatcaagcacctctgctcaagaaaatgttctacaaagtcaagatcaagagtttagaggtcaccagtttacaagaactggggcaattgatgggtgggttagtggacatagtggcgattgacgctttcctcgcctttcaccatagcaaggaaagcccggtcgtcgctatcttggccgacatatatgacacgttcgaccgaagatgtgagaagagcagcataagaactgtctgctgcacaccggccctctatgtttggttgagttcaaacctcttctgccaagaaggaaggcacgcctgtccgctgcaatgtcaccgctcgtgcaccgaaagaagagaggcgaattgggaccaactcttagctaacatagaaggagcatccatcaactggttcccccgttggaaagaaggaagaactgggattttattctcatgcggagagtttccaaatgttcccttgatggggacaaggggttgtattaactataatcctgtgctcgccataagacagctgggctaccccatgagaggagcatcgtcagaggaaagcctcatgcctttcatcgcacggggattcagtgaccccaacgcaagggtgctccaagaagtccgcaaagcatgggagatggtgcaaaggaaagacaaagaacttaggggaaacagcaacgggatcatcagcgactaccgtaagtggctgagagcccgcacacgaggcttggattggctcccaaagctgagaaccgctaggaaggaagaggccaaagctccgaaagagagcaaagaggtacaagccctaaaagcgaagctggagaaagcccaagcagtcaaggaaaagttcaagtcaactgttgtcagagtccaaaaggagtatgatgaactgaaagacgtcaacacggccaccggaaggaagaacatggccgagacacgttccggggagctttatggggcagcaacagcgagcttaaactccaaagagaggaaagagaccagtcgcgagtcgaaggcatggttttga

SEQ ID NO: 67551 - DNA, 1944 bp, Glycine max
  Peptide Sequence Number=SeqID_184329
atgacagtgacgatgagtggagaagaagaagctgcggtgggagttcagatccaacagaagagcagaatggtgctcccagatttcctccagagcgtgaatctcaagtacgtgaaattaggttaccactacttgatctccaacctcgttaccctattcctggtccctttgatcctcgtcacgctaatccaggtctctcagaccaccgacctccgccacctctggctccacctccagtacaacctcctcaccatcctcacctgctccgccgtcctcgtcttcggcctcaccctctacgccgtcacctgcccacgccccgtctacctcctcgactccgcctgcttccgccccgccgaccacctcaaggcccccttccggagcttcatggatcactcccgcctcacgggagacttcgaggagtcctccctggagttccagcggaagatcctcgaacgctctggcctcggggaggaaacctacgtccccgacgccatgcactctattccgccccagccctccatggccgctgccagggccgaggcggaacaggtcatgtttggtgccttggacaacctcttccaaagcaccaacataaaaccaaaggatattggtatccttattgtgaattgcagcttgtttaaccctaccccctcactgtcttccatgattgttaacaagtacaaattaaggggtaacattaggagctttaatttgggagggatggggtgcagtgctggagtcattgctgttgatcttgctaaggaccttttgcaggtccataggaacacatatgctgtggttgttagcactgagaacattactcagaattggtactttgggaacaagaaatccatgctcattcccaattgcctttttcgcgttggctgctccgtgctgctgctctccaacaagccggcggatcgaaggagggcaaagtaccggcttgtccatgttgtgaggactcatcgcggtgcggacgacaaggcattccggtgtgtttaccaggagcaggatgatgcagggaagactggtgtttccttgtctaaggatttgatggcaattgctggtggagcattgaagaccaacatcacaacacttggccctttggtgctgccaattagtgagcagcttctgtttttcgtgactctgctgatgaagaagttgtttaaggctgatgtgaagccttacataccggatttcaagcttgcttttgatcatttctgcatccatgccgggggcagggccgtgattgatgagttggagaagaacctgcagctgcttcctgagcatgtggaggcttctagaatgacccttcatagatttgggaacacttcctcaagctccatttggtatgagttggcttacattgaagccaaagggaggatcaagaagggtaacaggatttggcaaattgcttttgggagtggtttcaaatgtaacagtgcggtttggcaggctctgagaaatgtgaggccttctcctaatggaccatgggaagattgcattgataagtatcctgtgttgatgattccgcttaagtgtggcggtggtgatggtatgctgtcgatcttgggtttgacctcgatgacaccgacattggtgatgtggcggttgacgtcaaagaggcagagcctgaagaggatcttggtcgagaaaggggggcaatttgtggcttccagatctaagaaaaagagcgagacttgttgtcactgcggcacggtaatggcttgtgatggtttgtggtgttggttagtggtggatttcctggagagcagcgactttgacatcggggtcctcatcagtggtggctcgtggcgccaacaattggaggacggttgtggaagaaaaagtggtggtggtggtggtggtgatgttgttgactgtgctttcgaaggaggtgaagtgttgttcgcaatttccaagtgggagagaaggggacagggatag

SEQ ID NO: 67552 - DNA, 744 bp, Glycine max
  Peptide Sequence Number=SeqID_184330
atggaaccttccacttcttcctacaaggccaatgccattatatccaaacttcaaactaccactaatcaacagaggggtgatgaaccaactgttttaattgcagctgacacaaagaggagaagacagcaagatagggaagcgatattagccaagagccaaggctctccaagcaagagagagggtctctctgctccccaaattccactaaggatcccaaaatcgatgatcctgaatcatatcattacagaatcatatatgacagaatgtcagaatctgatactctggcgcttatttagctgctctcatttttttccttatgcagaagccattttacaaagactccttgttgatgactacctaaaggatgctgtgcccatgttattaattacctctgaccaagtggcggtgtatgaaggtgtgattagggaaaagccaactagcaaagaagaagctcgacaattcttgaaagattattctggaaagcttgctgcaactgtgggatctgtactagttactaacctcaaaacaggactgagaaaaggagatttggatcgtgtagacgtattattctcccctacctttgctatcttggttgatgagggaattactctcaatgttgctggagggctgataatagagcatcctttaatatttccatatgtcaaagaagtggttgggacaaccgacagtatgatgggactccccaaagctctgactgaaaaactgttgaaggaggccctgtag

SEQ ID NO: 67553 - DNA, 165 bp, Glycine max
  Peptide Sequence Number=SeqID_184331
atgtcgcggaactttacagattatctaacgatgggtgttaagtacctcaaggcggttaagcgaaggttgcatgccaccaaacaatggtccccggacgaaattagggtagggtaccctagaaatgtaggatttttcagcccttgtattttagggcacctagactag

SEQ ID NO: 67554 - DNA, 843 bp, Glycine max
  Peptide Sequence Number=SeqID_184332
atgacaatcataacatatctcagatttagtccaaatttggagtgttgggacttgggaagggcaaaaatgggaatgacagaagaatttgaaacttccttgcaagtgctccgaggctttgagactgatatttctgttgaagtgaatgaaattaagagggctgttgcttcaacaaacagaagaactacagttcgatttgcagacctcaaacaaagaagatattggcttcccttaatgattggaattggactgcttattttgcaacagctttctggaattaatggtgttcttttttattccagtacaatctttcgaagtgctggaattagttcgagtgatgcagcaacattcggagttggtgctgttcaggttcttgccaccagtttaactttgtggttggctgacaaatctggtcgccggcttctccttattgtctctgcatctggaatggcttttagtctcttagttgttgcaatctcattctacgtgaaggctagtatatcagaaatttcttccttgtatgggatactgagcaccttgtcgctggttggagttgtggccatggttattacattctctctaggaatgggagctatgccatggattataatgtctgagattcttccaataaacattaaaggcctcgcgggaagtgttgcaacactttccaactggttgttctcctggttggttacattgacagcaaatatgctcttggactggagctctggaggaaccttcaccatatatgcagttgtatgtgccttgactgtagtatttgttaccatttgggtccctgagacaaagggaaaaactattgaagaaatccaatggtctttcagatga

SEQ ID NO: 67555 - DNA, 225 bp, Glycine max
  Peptide Sequence Number=SeqID_184333
atggcgagcacaatattcgatgacgagtcttgtgaaggtactaataccgaggaccctgccgttgattttgaacgagaagcaaataggcttgaggttgaagaagatgaaggtatggaattccccgccgagctagaaatgatggttgctcaggaaggccgagagatgaagccgcaccaagaagaaacggaagtcgtaaacttagatgttgacaatgagaagaaagag

SEQ ID NO: 67556 - DNA, 390 bp, Glycine max
  Peptide Sequence Number=SeqID_184334
atgatcgtgaaaaggttattagttgaggcctatggatggtttttgaccattatttggcggtgcgaccttgggttccatactttgtgctctagtgacggtggtgggtactccgatgaaagtggatatgaggatggtggatgcaacacaagggaggtttgtgacctaaacatgcctagtaagagtgcaccaagaaaccctagcacaaaatctagtaatcaaggaaaagacgcgattcatgtggagacaaatcaatatgattggggatggaatatcaaagggaaatataatggtagagatatgaggaaggaaaacaagtttaacgtattggggaatcatgaaaaagagcaagaggcctggaagaaggttgaagaactagagcaacatgcttag

SEQ ID NO: 67557 - DNA, 438 bp, Glycine max
  Peptide Sequence Number=SeqID_184335
atggcaaagatatcattagctttggtatttgcattggtggtgactgtaccatttcattcagttatgggtcaggatgatgcatggaaaagtataatagaccaagcaaaagatgaagcaagcaaagcaggtctctctgaagatacaatattcggggctgagaaggctataacagatggttctgccgaaaaggttgctgaggatgccttgggtgaaggatctttggatgattgggttaaacaagccaaagatatgaccaacggtgaaagttcaccctctggggcaccagaagatttaccagatgatgaagaagaggacaatcttctagagacaccagaattggcaccaaaaattgcaccatcaaaggcacccgtaggagcaccaacagatgcaccatctgccgcaccccaagcacaaactccctctgcaacaacattataa

SEQ ID NO: 67558 - DNA, 192 bp, Glycine max
  Peptide Sequence Number=SeqID_184336
atgaatgaaattagggaatcaaattctccagcatttagacactactttgtggataacaggataacagtgacaatgttgtctcaaaagcaagtagagggaagcaatggtcacaacttcaaggtaagaaaacatgaaggctgcagcacaacggaagaagaaagggagcatggtggttcgttttggaatgcgtga

SEQ ID NO: 67559 - DNA, 2172 bp, Glycine max
  Peptide Sequence Number=SeqID_184337
atgtttcaacctttcacaagctcctggatactagattcaggagcaacagaccatgtaacttgttccctgaataaccttcattcgtttgaacgcatcaacccagttacagtaaagctccctaatggtcatcatgttcatgctactcactcaggcactgtgcacctctcaagaaccataaccctattcaatgttttatacatacccacgtttactttcaatctcatttctatttctaagctagtatcttccactaattgtgcattaatcttctcttccacctcatgcatgctacaggatgcaagcaatcgtatgaagattggtatagttgaagagagacatggcctttatcacctcataccagaccagacagacaaagccatttgctcgactattattcaccctaaatgcaatattatccctatagatctttggcattttcgaatgggccatctctcaacagaacgactacaatgtatgaaacctcattaccccattctgcaaaatgataaaaactttgtatgtaatacgtgtcattatgcgaaacacaagaaacttccctttttctctagcatttcacatgcatctcatatttttgatttacttcacatggatatatggggtccttgctcaaagccatctatgcacgatcacaagtatttcttaaccattgtcgatgatcattcgagattcacatgggtacatcttatgcacactaaggccgaaacccgacacatcatcgtaagcttcattgcttctattgaaacacaatataatagaaaaatcaaaatgataagaagtgacaatggacctgagtttctcatgcccagcttctatgcctcaaaaggaatcatgcatcaaaccacatgtgtagaaacgcctgaacaaaatgatcattttccgcaaatcactgaaacacaacactcacacttagaatccagtacacctctcccgggatccttttacaatagtcaatatgacccaactatagaaactacacaaccacagcccacgatacaagaacccgcagatcacacttccttacaacccacttcaacgaatgaacttgcttcctcacaacgaaccaaacatgaacccagacgttcaacacgaaccaaacacgcaccaacctacttacaagattaccaccatgatctctcttcacacaatactgatgcttcaacgagttctcggtatcctctaagctcggttctttcttactcacgactgtcacccacacacaaacactttgtcatgtcaatctcatccacagtagagccttcctcctatgccgaagcttctcagcatgactgctggattaaggcgatgaatgctgaactacaagctctgcaatccaacgacacctggagacttactcctcttcctcctcataagaccgcaattgggtgcagatggatatataagatcaaacatcgagtagatggttccatagaaaggtacaaggcacgtctagtagcaaaaggctacacacaaatggaggggctcgactatcttgatacattctttccagtagcaaagctaaccacggttcgtctcctccttgccctggctgcccttaaccagtggcatttaaggcaattggatgttaataacgccttccttcatggcgagttagatgaagaagtttatatgcagcgttcactctatggactcaaacaagcgagccgtcaatggttcacgaagttatcgggtcttctaacatctcatggttttaagcagtcccattcagaccattccctttttctacgtttcactggctctattaccacaatactcctagtatatgtggaagatattattttaactggaaacagcgactctgaaatacaagatgtaatcatacttcttgatcaagcattcaagatcaaagacctcgggaatttgaaatacttccttggtctagaaatcgcacgttcttcttcaggcatccatttatgtaaaaggaagtatgctttggacatattatccgattcgggaatgcttggttgtcgaccaaatgcaactccaatggattactccaccaagctacaagctgcaacaggcaccccattatcagcagaagcttcttcttcctaccgaaggctcgtcggcagactcatatacctcaccaatactcgtcctgacatcatgtacgccgtgcaacagcttagctag

SEQ ID NO: 67560 - DNA, 1785 bp, Glycine max
  Peptide Sequence Number=SeqID_184338
atgtctagtaacaatgcaacagatttggagattccaattccaagctgctgtaaagttaaggaccaacatcttaaatggccatctgataatcctaaattgtttccaggaactgtattttggacaaaacttagacacagttacataggtgaaacttcaagatggaaaaacaacagcaaaaccccctatgatgcatatcgcgtcgcgaacaaagtgaatctcgagtatgaggcttgggaagtccaagaccaaacgctcctcacatggcttcaatcaacattgtcgaagtcagttctctctcaagtcattggctcgattcactcgtatcaagtctgggataaaattcatgagtacttccatatgcagatgaaggcgcgtgctcgccaacttcgcactaaccttcgctccaccttccttgacggcaagacgatgcgtgagttcttatcgcatatcaagaacattgttgacgaacttacaggcgtaggctatccagattatgcaccagtgatctctattattgaaagcaagttcgagactcctcttgtcgctgaagttgaggctctccttcttgcacatgaatctcgagccaacagattttgtaaacaatcatttgctccctctatcaattacactcaagggtacgtgctccctaactcaaatgatactagcactcgcaataattctaatggtggatatggtcgcggcggtggaggtcgtggcaacaatggtcgttgtcgtggcggcggtgattcaaattatcatcctcatgagtctcttgtgctctatgatcctaagactctacaagcagtgcagattattactcctagtgccatgcttactagtgtctcttctacaggtgctgcccattctgcatggatccctgactcaggtgcatcatttcatgtcatcgatgagcctcagaacatccatcagctaggtcactttgagggtctgaaccaaattttcgttggaaacgatcaagatttgcatattaatggttctggtgttgttggtgttgatggtctatattcctttcctaacctaaagcttcaagagccatctgtgttgttgtcctctgcaattaaatcaccttcaagttctgctgatttgtcatctagctctagggttgcttttaattctagtgatacaatagggtgtaaatgggtttttcggatcaaagaaaatgcggataggtccatcaacaagtacaaagctcggctagtggccaagggctttcaccaagtccatggttttgactttcatgagacattttatcctgttgttaaacctatcactattaggcttatcattactcttgcccttactaataattggaagttatttcagttggatgtaaataatgctttcctcaatggccttttagatgaaacagtttacatgctgcatcctccaggatttgaagttgaagacaaatctcttgtttgtaagcttaacaaggccctttatgagccgaaacaagcactaaggcagtggtttgaccgactaaaaattactttgattcagtttggatttcaagctagcaaatgtgatccatccttgttcatgtataagcatcaagctcacactatttttcttctagtatatgtggatgatattatcatcaccgacaactcaccttctctcatccagcagattacaactcaacttaattatgcattctctctcaaacagctaggtcaattggactatttcttgggtattgagatcaagcatatacctgataggtctcttctcatgactcaaagcaagtacattaaagacctttga

SEQ ID NO: 67561 - DNA, 1182 bp, Glycine max
  Peptide Sequence Number=SeqID_184339
atggcatctcagaaaagagaatccattgcttcttcatcttctcagctcaaatatgatagatacaaattttcttcccctaaagcatgggatcgctacaccaacaacatgttcggcagaaagatcattcctgaaagaaaggtgcagctgtcatttaatgactttgaggaatttcaaggggagttaaacaggaggaactggcataagaaaatcgctaatttggaagagggaagcatagatgtggcacttgtaaagaagttttacacaaatgtttatgatcacgaagacaagtcaccaaaacaggtcaaggttagaggacaatggattccatttgactcagctgccgtcaactcttttttagaaacaccagtggtcatagaggaaggagaaagtcttccgacatatgcaagatttgtgttgctaaggccaaaccagcaagagttagcagcctgtttgtgtatcccaggcaagggatttgaattgaattcagacggattacccttgaagattttaaggaaaaatttgactacttttgctcaaacttggagtgtcttttctttttctaacttggcccccacctctcatacttctgacatcaatttagatagagccaagttagtatatgcactcatacagaagatggatatgaatcttggttccttcatttctagtcagattacactcagagcccagcatgactcgtcgaggcttggctttcctaccttaatcactgctttatgcaaagcccggggagtccgctctgacttcctgaccttggagagcttgagtcctgccattaatttagcatacattaagaagaactattggaatcttgatgatccaacagtaactttcagaggacccaggaaggccagggagatcccagtgattcctcctgcacccacacagattccactaccagctcctctttctaaaggtccagcaaattttattttcactcctcagatgctgcactccatgctccagagcattcataaagggcagtccatcatcatgcagagccttcagggcttgggcttgccctccattatgagcaaggaggagtttaacgcacaagtggcctggccaggagaccagccttcttcctctggagagggtgaggcctctacagctcaggagcctgtgactgaggagccaccagcaccagcaccatcactagtgtaa

SEQ ID NO: 67562 - DNA, 798 bp, Glycine max
  Peptide Sequence Number=SeqID_184340
atgagcatcaaggttttgaagtcgctggccgcgttcgccctcggcgccgccgtattcgcccagcccgcgctggcccaggacaagccgctgaaggtcggcgtcacggccggcccgcacgcccagatcttcgacgtagtcaagcaggaagccgccaagcagggcctgaacatccaggtgatcgagttcaccgactacgtgcagccgaacgtcgcgctggcctcgggcgacctggatctgaacagctaccagcaccagccgtacctggacaacgccaacgccgaccgcggctacaagctggtcagcatcgccaagaccgtgatcttcccgatcggcatctacagcaagaagatcaagtcgctgtccgagctgaaggacggcgcccgcatcgcgctgccgaacgatcccaccaacggcggccgcgccctgttgctgctgcaggccaatggcctgatcaagctgcgtccggaagcgggcctgaaggccaccccgatcgacgtcgtcgaaaacccgaagaagctgcgtttcatcgaactggacgccgcccagctgccgcgttcgctggacgacaccgacgcctccgccgtgaataccaacttcgcgttggaagcgggcctgaacccggccaccgacgccatcgcccaggaatcgcccaactcgccgtacgccaacgtgctggtggtgcgtgaaaaggacaaggatcgtcccgagttcgccaagctggtgagcatctaccacagcccggccgtgaagcagttcatcgagaccaagttcaagggcgcggtggtcgccgcctggtaa

SEQ ID NO: 67563 - DNA, 531 bp, Glycine max
  Peptide Sequence Number=SeqID_184341
atggcgcgcgcggcggtgatcaggcccggatcgacttcgcgcatggcgttctcggcgatgcgcgccatgaacgggatcgcggccaccgacagcggcacgatggcggcggtggtgccgatcgaggtctgcgccaccaggcgcgtgaacgggatgatggcgaccatcaggatcacgaacggcaccgagcgggtggcgttgatgaccgcgcccagcgcgtggttgacggcctggttctccagcatgttgccgcgcgcggtgacggtcaggatcacgcccagcggaatgccgaccagcaccgcgatggcgctggccacgcccaccatcagcagggtgtcaagcagcgacgtaataagcaggtcgatcagttgcggactcatgggcaatttcttcatcggtgatgtctcgggcggtcaacgcggcgatggcgtccctgaccgcggtgggcgtgccttgggccagcacgaacatcgtgcctacggccacgccctggatgtcttcgacgcgcgcctgctccaggcccacgtcctttga

SEQ ID NO: 67564 - DNA, 459 bp, Glycine max
  Peptide Sequence Number=SeqID_184342
gttgagcccaaaaatcctgctgtgggttatactgatgatacaaattcaaatgatgttcttccaaagtttgctagaagggggctcaatttttttgagacgcaggaggagagtaatgagcaaaacagtggaagcaacaacactttgtctgagtctgaacgcgtgacaaaagctgagacagaaattttggccttgaagaaagccattgccaaattaaaagatgaaaaggaagctggcttgcttcagtatcagcagagtttggagaaaatgtctaatctcgagttagaagtgtctactgcacaagagaattctcgaaaactcgatgagcaagcaagtaaagctgaagctgaagttcaagccttgaaggaagcccaaatcaaattacaggctgaaagtgaagctagtcttcttcagtaccaagaaaaagtgaaaaaacagaggaccctcattttcaaacagtga

SEQ ID NO: 67565 - DNA, 237 bp, Glycine max
  Peptide Sequence Number=SeqID_184343
atgacatgcgcgtgtcttccctgcaacgacaattaccaaacatcaccattaaaagaaattacatggaacccgcgacctttcttcaacagtgaaggagcttcaatggaagaaggggtagggcttcaatgtcaaagaaagcgagggttcaaacgaaggagcaagcagaaagggagggttcaaacgaaggagcaaggagcaagcagtctagggttcaaagcaatctcgaaagctagctag

SEQ ID NO: 67566 - DNA, 1272 bp, Glycine max
  Peptide Sequence Number=SeqID_184344
atgccattcaggagcattgtgcgtgagctcaaggagattggagagggcattagcaacatgtatagaagaggaggagaagccaagcatgtgcatcgccatggaaaatctcacattgcaccagaatgttccttaccaccaccaccaccaccaccaccatcatcatcatcacagagccggtgggctaatttgccacctgagttgctattggacataattcaaaggttggaagccagtgaaacttcttggcctgcacgtagagcacttgtggcatgtgcctcagtttgtaggttgtggagagagataacaaaggatgtgatcaagacaccagaacagtgtggtttgctaactttccccatatcactgaagcagcctggtccaagagactctccaatccagtgttttattaggagagaaagaatgacttcaacatattgtttatatctcggtctgagccctgctctttctggtgatatgagcaaactgttactggcagcaaagaagattagacgggcaacatgtacagaatttataatatcattggttgccgatgatttctctcgggcttgcgacacttatgttggaaagctgaggtctaattttctgggcaccaagtttacaatcttggatggggagcccccgcatgattcttcacttccactgaattgcaagttgcagcaaagagtccatctgaagcaggtacttcctaataaggtttctgctgctaactacaaagtggccacagtatcttatgaactcaatgtcctccgaacaagaggtccaaggcgaatgcggtgtatgatgcacttaatccccatatctgcaatccaagaaggagggaatgcccctactcctttgaagtttaccaattatcttaatgattacgcatctaccaccatcccagacacaaaaggaaagaaaccagaagttgttgagtttgactcaactggcactgataatactccagaatcaatccagagggcaagggaaccattgattttgaaaaacaaagctcctagatggcacgaacaactgcaatgttggtgcttgaatttcaagggaagggttacagtggcctctgtgaagaacttccagcttgtagcagctgctgaaccatgccaaaatgtttcagctgcagaacaagaaaaagtgatactacaatttggaaaaattgggaaggacatattcaccatggattaccgatatcccctgtcagctttccaagcctttgcaatatgcttgagcagctttgacacaaaaccagcttgtgaatga

SEQ ID NO: 67567 - DNA, 1389 bp, Glycine max
  Peptide Sequence Number=SeqID_184345
gagaaggttgttgttggacttcccaagaggagagggaagataaggtacaagatttacgggctcgatctctcggatcccaagtgggcacaagttgctgataggatccatgaggcagagcaggtgttttggccgcaggagccaaaaccgatcactgggaaagcgaaaattgttaccacgaagattctgttgtcgaaggaggaggaggaggaggaggaggaggaggatggtttgcaaagcctgttggctgagtgggtggagcttgtgcaacctagcagggtggaatggatggatttgctcgacaaattaaaagagcataatcctggtttgtactttaaggtggctgaaatggtattgactgaagattctttccaaacacatgtatctgactactctaggcttattgatatctatgctaaagagaatcgctttgatgatgttgagagaatgttaaagaagctgaatgaaaatggtctacaagtagatgcttcaatagccagtactttggtcctcatgtactgcaagagaggtgatcttgcccatgcaaaagaagcatttgaagtcttgacgagcctgggcttccaaccagacgcacatgtctacaactcaatgatcacagccttggtgaataatggccagcctaagttgggtgagaaattgatgagggacatggatgatagacatattccaatcacaaaggacatatacatggcattgctccgttctttttctcaacttggtgatgctgtaggagctgaacgaatttcaaacactatgcaatttgcaggaatccagcagggtatggatatggagacatccaccctgcttattgaggcaagtgcacttgctgttccttgtaaccctgatcaggcaagaagccattttgactacatgataaaattggggcataagcctgatgataggtgcaccgctagcatgatttcagcttatgagaagaaaaactacttggacaatgctttaaatcttctattggaattagagaaggatgggtttgagcctggggttgccacttattctgttcttgtggactggttgggtaagttgcagcttgttgacgaggcagagcagcttttaggcaaaatagctctgctgggcgaggctcctccctttaagcttcaagtgagtctttgtgatatgtatgcaagggctggaaatgagaaaaaggcccttcaaagcctaggtgttctggaagctaggaaggatgaattaggtcaagctgagtttgagagaattttaagtggccttattgatggtgggtttcagaaggatgcacaaagaataagtcagatcatggaggcacagggttttgatgcatcaagggttaagtttaaactttcaaaacctgtctcaagagcaccgagttttagatga

SEQ ID NO: 67568 - DNA, 225 bp, Glycine max
  Peptide Sequence Number=SeqID_184346
atgaaggtgtgtgaacttgcatcgcggttgcctctggtggatccagagtgcatcaaaagtagattggaatgcttcgagggatcactacaccaagtggaggaagcaaaagtggcatctgtaaaagatatcaaaaaacagaccaaagtattcaaaaaattggtgatgcaattggctgttgagagagagtgtcttaataagcagtttgtgaataacaataacaactaa

SEQ ID NO: 67569 - DNA, 1851 bp, Glycine max
  Peptide Sequence Number=SeqID_184347
atggcacaaagaagcaagtcatttcgttttaggatcccatggctatcagtaccatctgaatcattcgctcgtcgtacaagagaaagaccaaaatcccctccccactcagacacaagtgtgcctattcatagaccatctaagccttctgtgatagccccttcagagttatctcctcttagtcccacgaaaactgaggaagccccaagagctgaacctcaaaaagagtcaccaccccatccaacacctccaccatcaacttcagagagcattgagtccccagtgaaggttcaacctaagccaaaacctctttctccacagcctccacttcgaccttcatctcatgcagactctccatctcaggttcatgttgcaccctcatcccccaaaactcatttggcctcagataatggagccatgaaggtgccaaagcttgttgctgaagaaaccactcctcctgcatcatcttcctctgagcaagaaaaggaaaagatggtcttgtctgaggcaaaaccccaagaagatgagctgaaggtagaatcaccattgagaacaatcaccaagtcaccagaaacatcttttcaacccgagaggatgttgacacatcctgcaggcattgaacaacaagtttcttctgtgcgctcttcatccccagtttcaaaaactgaaccagccactcattcatcgtctcctttggcctcaaaggacatcaaaaccgaagaaaccactcctcaagaagaaaaagagaagatggcagtgatagttccacaagaagaaaaaacaaagataaagtcacctttgaaaaccatccccaagtcaccgaagacctcttctcaacctgagaatctgtccacacagcctacaagaattgagcaaagatcaacaacaccaaaaaacaagtcccttcaacctgaagaaaaggagaaagtggtgcaggaaaccaccaaggcacgaggaaaaggcaaagacacaaccataggacaaccaagtgaacaacacaccatggcatctgcctcaggaacaacattatcatcaacaaccacaacacagactaaagattcattcgccaaggcatttcgtggagataagaagcatcatggagcacgagaaactgtgcagagaaaaataatgtttgccacaaccaaccccattgggaaggacacaagagttgtgagctcaacagatgaaggaggcacaaagaatgtgtcaagctcaagcatatcacctgaaaaaactgcttcatccagtggtgaaaaggctcctccactacaaaaaggcatcaaagatgatatcacaaagtttgttcacaaactaacagcctctgtgcaccctacacaacacatggatgacaaacagtttagtgtcataactttggctggtgacaatagaggagccacaatgcacttaggttctgagtcagctaagaaagagggttcagttcacatacaccgagcctacaagagtgatcctgaagataccaatgaggtgaccactgatggagaagaaaacactaatgaagaagatgaagaggtgggaatggcatatgtcaacagcaacatacaaagtattaataactcactcatgtttcatggttcaatcactgaaagagaccctggtgttcaagtgactcttcctcaaaagcctgctgaacccatcaagcccgatgataagcccaatcccggcttggaaactcagaggactcagttcaacatcaaccgggctgagaagtcaacataccagcccacggttggaagaagcatcagaggccctttccttgaaccaaatgacaaacctcgccgtcacggttgcaacttcagctgtgacaaggatatagaggacattgagattctgtga

SEQ ID NO: 67570 - DNA, 594 bp, Glycine max
  Peptide Sequence Number=SeqID_184348
atggtggaccgcggctctttatgggggcttgttcttaaatctaaatatggggatgtgcttgattctccaaatgtgaggcaatctcagatggaatccatttggtggcgggatattatggatgtatgtggggacaggagggaacgatcatggtttaatgataatatcacttggaaggtgggtgacgggaggagaggtggggtgttggctgaatggtgtttggagtggtgtctagcatggttctcttgggagttaccaatagtggaggcttttatgagggacaatgagggtggcaactttatgcataatgaggccgataaagtgttgtggaaaagagtttcaataggggatttctctgtcaaattggcatatgattttgtgtcatttgatctttctcttgttgaaaaaatgttgacattgtggaacatcagaaacagtatcatctttgatgggaaaacctgggatttggattatgctttggagatgatcaaatacaaatcttgggcatggctggaagcaaaggtggaagcatttcatttctctttttctgaatggtattcaaaccccagggtgtgtcttcaaacttcacggatttaa

SEQ ID NO: 67571 - DNA, 1122 bp, Glycine max
  Peptide Sequence Number=SeqID_184349
atgggagcagagcccttgtctaagaacaaggttgcacttgcacaagctcccttcgttctggggctccaaccttcagcacttgttgaccacgtggcacgtgtggattggtccttgctcgatcaaatcctcggtgaacatggtggctccatacctgttgagcttggagagcttgaatacatactgagggaggtgaagattcatgttatctcatgccatgacaatgacaatgacaatgatgatgattatccttcttctcacattaagaccttggctggaggaagtgttgcaaacacgattcgaggactgagtaatgggtttggaatttctagtggaatcattggggcgtgtggggatgatgagaaaggtaagttgtttgaccataacatgagctccaatggagttgacctctctagactcagaaagaagaaaggacacacagcacagtgtgtttgtttggttgatgacttgggaaaccgtaccatgcgaccctgtctctctaatgctgtgaaagttcaggcagaggaattgaccaaagaggattttaaaggctccaagtggttggtgttaagatatgcaatacttaatttggaagttattaaagcagccattcttttagcaaaacaggaaggtcttcttgtttccttggacttggccagctttgagatggttaggaatttcaaacaaccacttctgaagctactggagtctgggaatatagacctttgctttgccaatgaggatgaggcaacagagcttctacggggcgaacaaaatgctgatccagtaactgctgtagaatttcttgccaaatactgccaatgggccgtagtaacactgggtcctaatggatgcattgctaaacatggaaacgagattgcacgtgtcccggcaattggagaagcaaaggcaactgatgcaacaggggcaggggatctttttgcaagtggatttttgtatggagtgatcaaaggtctgtcacttgaagagtgctgcaaagtgggcgcatgcagtggtgggtctgttgttcgctctcttggcggcgaagtcactttgaagaattgccactggatgtacaaacaaatgcaaataaaggatcttcccacgcctgagatatccaaataa

SEQ ID NO: 67572 - DNA, 324 bp, Glycine max
  Peptide Sequence Number=SeqID_184350
atggtttttgcttgttacactaacaccattgttgtatggggaattacatgctttacaatatctacaaggggactttgtgcaagatttgaagtactagatgaggaaccaggtgatgatgaagaaagcagtggccaaagacaatacaagcttcccatggcaaatatcattccttttcccaagagtaatgatccttctagcgctcaagatttccctcctggaagacatgttttggcggtctatccaggaactactgcactttataaagcaacagttgttcaaggccatcgcagagtaataattctctcattttccttagtagagtga

SEQ ID NO: 67573 - DNA, 243 bp, Glycine max
  Peptide Sequence Number=SeqID_184351
atggaagtcactgttgttgttattcatgatgcaaatggtacacttgagaatgctatcagtcaaaatgatgagattaaagaatatgtggattgcagagcattgtgtcccgacgtccttcagcacaaggttcctttaagcacttcacctagccatctgctcccccgaacacaaggttcaagatcatcacaggatccaaacacaaacagcaaaccgggagtgagttatcacattcctaactactag

SEQ ID NO: 67574 - DNA, 640 bp, Glycine max
  Peptide Sequence Number=SeqID_184352
gaaaaactgttggaaccctgatgatctaacaattactatcagaggggccaggagagcgaggacaagaccagttgaggccccttccatatctatagctccttctccagcatgtaccctagtagctccttctgcctcagctcctgcagattttcagcgttttgaagccatgcttcaaagcatccatcaggggcagattatcttattacaaagtttacagatggtggcacctccagactttattccttcagtagagcagtttaatgagtgggtagtctggcccggaactcagtcttctcttcacagggaagatgaaggtcccacaacccaggtaccacagcaaatggaggatgagtcatccgagattaccactctagagcccttggtcagaaggaagaaggcagatcaaacacaagaagctgcagccacttctgagaaatctcttgaggccacttttgagcctttagaaccagtggcagatacaacttcacttcagcaggcagcaaacccttccattcctgagaatcagactacaccagtcctgtctccgaacacctctcctatagctacccctgtgcttcacttaacagacgaggaggatgttcacacacaggatactcaggaccgatcacaggatttttaa

SEQ ID NO: 67575 - DNA, 180 bp, Glycine max
  Peptide Sequence Number=SeqID_184353
atggaaaaaggtcaaagatcggcgtattttgaaaatgagggttcgggagtcatttacgcacaacaaagggtgctgaacccttcatacttagcctccttcctatttatagcaaaattaggggaggtgcttgccacccacccaggcgagctgagctggttgctttctgatgaagctttctaa

SEQ ID NO: 67576 - DNA, 858 bp, Glycine max
  Peptide Sequence Number=SeqID_184354
atggttgtaaacaaacgtccccggacgaaattagggtatgacatgaaggatttaaggaaaataattctttggcactcaaccatcaaaagatcaagaaggtttcattgcctagaaagaaagcgtccaaaagcttctctaaaatccttaaagctaaaaattcttctaatgaagaatgaggaagagtttgatgaagatgaagttgccttcatctcacaaaagatttacaagatgttgaaaaacaaaggcagatctagatggaagaactcttcaaaaaaagttcttgaaaaaaggaaagataaagacaaaagtttcgtactatgctacgaatgcaagaaacctagacacttcaaatctgaatgcctagaattggagaagtcttcggacaagaagaaacactacaagaataaggaaaagaaaggtctcatgagcacttgggaagatttggacaacacctcgtttaatgaagatgaagaaaatgccaatctatatcttatggtatatacaacttttgaagaatttgaatcagaccaagaggatgagcttacaaaaacttgtgaaaagatttcaaaaagttgtccaaagatcataaggaacttgaaaaaagcttacaaagtacatgtttcattggacaagtctactcatacatgtgatgcttatgaagcttttaaggaaaaagaatccatgctacgtcttgagaatgagacaattgccaaagaaaaatatactctattggagaactttcaggagttggaagacaaattgaaaggtctacaaaaggatctaaaggaactaaatgaacttcacaatcatcaaagtgaagatagatatggaatgttcacaagcacacaaagattatga

SEQ ID NO: 67577 - DNA, 309 bp, Glycine max
  Peptide Sequence Number=SeqID_184355
atgagcaagagagtgagagaagcatgtgagagtcatggttatttcctcttgatatgtgacgagatcatccctaaggatgtacgtggagacatgtttgatggtatgaaagagttgtttaatttgcctgaagaaacaaagcagcaacacatatgttcaaagccttataggggctacaatggcaagaactctatcattcccctctgtcaaagctttgggatggatgttcctctcacagcttcagctgaggccttcactaacctcatgtggccccaaggaaacacccctttctggccacgcactgcacactag

SEQ ID NO: 67578 - DNA, 432 bp, Glycine max
  Peptide Sequence Number=SeqID_184356
atgcatggagagactgtgacaagcgtgtcctctactgggcaacgcgagattgctgcaaacacggcaagcaatagggtgaagaacgaagcatgttggaagaggcaatgcgttgtgatgggagtggcatccattattggactagaaatgtgcaattcagtggcaatggcccacgaagcaattgaaatcaagaccatgccatttagtaaccaagtagtatcaaatagcaattcttacggtggcgccaaatggagcgagaaaagaatgtgcccaccttggcaaggcaattcgctcgaaacgatcgtgccggagaatcttccccggccgtcggcacggcggagatacgaggctgttcgttcctcctccaagactgcgccgccgctctccgccccgatcatagtccaaagcaacaagggcagttgcttctccatgtga

SEQ ID NO: 67579 - DNA, 1871 bp, Glycine max
  Peptide Sequence Number=SeqID_184357
ataaagggaatgaaagtcgtagaaatgtgtcctctagaacactgtcagcaagagtgggtggcattggtgcaagtgaacacaacaagaaacgagggatggttcttcctttcacacccctttctatcacttttgatgaaatcagatattcggtggagatgccacaggaaatgaagagccaaggcattcttgaagatcgacttgaactgttgaagggtgttaatggagcttttagaccaggagttcttacagctctaatgggtgtaagcggggctggtaaaacaactctaatggatgtattatctggaagaaaaacagcaggttatattcaagggcaaatcactatttccgggtaccctaaaaggcaagaaacgtttgctcgcatagcaggatactgtgagcagactgatatccactctccccatgttacagtctatgagtctttggtttattctgcatggcttcgcttaccccctgaggttgattcttccaccagacagatgttcattgaggaagttatggagctggtagagctgacttcattaagagaagccttggtgggattgcctggagtgaatggcctatccacggagcagcgcaagaggttaacaattgcagttgaacttgttgccaatccatctattatattcatggatgaacctacctctggccttgatgccagagctgctgctatagtaatgagaacagtgaggaatacagttgataccggccgaactgtggtctgcacaatccaccagcctagcattgatatatttgatgcttttgatgagctacttctgttgaagcgtggaggtgaggaaatatatgtgggacctttaggccagcattgttctcatctgatcaatcactttgagtttattcatcaagttacttcagaagcacaagaagcagctcttggagttaacttcgctgaaatatacaagaattctgacctatataggagaaacaaggccttgatcagggaacttaccacacctccaacaggttccaaagacttatacttccccacaaagtactcacagactttcttcactcaatgcatggcttgcctttggaaacagcacctatcatactggagaaatcccccatatagtgcagtgagacttttattcacaacaatcatagccttattgtttgggacaatattttgggatattggctccaaaaggcaaagaaaacaagatctatttaatgcaatgggatccatgtatgctgcagtcctcttcattgggatacaaaatgctacatctgtgcaaccagttgtagccattgagagaactgtcttctatagagaaagagctgctggaatgtactcagctttaccatatgcatttggacaggttgctattgagatcccatacatattcatacaaaccctcgtgtatggagtcatagtgtatgctatgattgggtttgattggacgttcagcaagttcttttggtatctcttcttcatgttcttcacctttttatacttcaccttttatggcatgatggctgtgggtctcacaccggatcacaacgtagctgctatagtttcctttgggttctacatgatatggaacctcttctcaggattcgtcattccaagaactagaatgccagtgtggtggagatggtacttttggatttgtccagtgtcttggaccttatatggattggtgacttcacaatttggtgacataaaagaacctatagatactggagagactgtggaagagtttgttaggagttattttgggtatagagatgactttgtaggcgtagctgcagctgtgcttgttgggtttacactgctttttggatttacctttgccttctcaatcaaggcattcaatttccaaaagagatga

SEQ ID NO: 67580 - DNA, 2358 bp, Glycine max
  Peptide Sequence Number=SeqID_184358
atggaaagtggtgaactgagagtggcgagtgcacgcatagggagctccggcgtgtggagaagcggcagcattgacgtgttttcagggtcttcaagaagggatgatgatgaacaagagcttaaatgggctgcaattgagaaactccccacgtatctacgcatgactaggggaattctcactgagacagaaggccaacctacagagattgatataaacaaactttgtccacttcagaggaagaacttggtggagaggctcgtcaagattgcggaacaagataatgagaagttcttgttcaaattaagggaccgcattgatcgtgttggacttgaaattccgacgattgaaatccgttttgaacacttgaatgttgaggcagaagctcatgtgggaagcagggcactacctacaatctttaacttctgcatcaatttgtttgaggggttcctcaattctcttcaccttattcccagtcgaaagaagccattcacagttcttgatgatgtcagtggaatcatcaagccaaaaagaatgacattgcttttaggccctccaagctctggaaagaccacattattgttggcactggctggaaggcttagtaaagatctaaaattttcggggcgagtttcgtataatggacatgggatggaggaatttgtgcctcagagaacatcagcttacataagtcaaactgatctacacataggagaaatgacagtcagagaaacattggccttttctgcaaggtgtcaagggatcggaacccgatatgagatgctggcagaattgtcaagaagagagaaggctgcaaacattaagccagatcctgatcttgatatttatatgaaggcggcagcactagaaggccaagaaaccaatgtagttacagattatataatgaagattttgggactggaagtttgtgctgataccatggtaggggatgacatgattcgaggtatttctggaggacaaaagaagagagtcacgactggtgagatgctagtcggaccagcaagagcacttttcatggatgaaatatcaaccggtttagacagttctaccacattccaaatggttaattctctaagacaatctatccacattctgaatggaacagctgtgatctctcttctccagccagcaccagaaacttatgagttatttgatgatataattctcctctcagatgggcaaattgtgtatcagggtccaagggaaaatgtgcttgagttctttgagtacatggggttcaaatgtccagagaggaaaggagtagcagattttttacaagaagtaacatcaagaaaagaccaagaacagtattgggcaaataaagatgagccatactcctttgttactgttaaagagtttgctgaagcatttcagtcatttcacgcaggtcgaaaactcggtgatgaacttgccactccatttgacatgtccaaaggccaccctgccgtgttgacaaaaaacaagtttggtgtttgcaagaaggaacttttgaaagcctgtgtgtccagagaattcttacttatgaaaaggaattcttttgtctatattttcaagatgtggcaactgattttaacggggttcataacaatgacattgttcctgagaactgagatgcaccgggatacagaaactgatggtgggatctacatgggtgcattgttcttcgtactaattgtgattatgttcaatggatactccgagctatccatgtccatcatgaaactccccgttttctataagcaaagggaccttctcttttttccttgttgggcatactctctgcccacatggatccttaagattcctatcaccttagtggaagttggtatttgggttgtgatgacttactatgttataggctttgatcctagtattgaaaggttcatcaagcaatactttctacttgtttgtatcaaccaaatggcatctggactttttcgatttatgggagcagttggaaggaacatcattgttgcaaacacagttgggtcatttgctttacttgcagttatggtcatgggtggatttatcctatctagagttgatgtgaagaaatggtggttgtggggttactggttctcgccgatgatgtatggacaaaatgctctagctgtgaatgaattcctcggaaagagttggtcacatgttactcctaattcaacagaaccattaggagtaaaggtcttgaagtcacgtgggattttccccaaagcatactggtattggattggagttggagcttccattggatacatgttactattcaacttccttttccccttggccttgcattatcttgaccgtgagtatcttacagtacacgtacctttcaatttgtga

SEQ ID NO: 67581 - DNA, 318 bp, Glycine max
  Peptide Sequence Number=SeqID_184359
atgtccaagacagcgaccacatgtttcggcagagacgcatcgcagtttccgtcaagtaacatgtttgctgcggccggggagggtatatgggacaatggtgccgcgtgtgggaggcagtatcaggtgcgctgcatcagcgctgcggcacccaggacttgtgttcctggccagacgattcagatcaagattgttgatcgagcgcaatcatcggtttctaggccttccctaggtggaacttccatggtcctctccgtcactgccttccaggccatcgccaatgtttctgcgtcattcattaacattgaattccagcagtaa

SEQ ID NO: 67582 - DNA, 247 bp, Glycine max
  Peptide Sequence Number=SeqID_184360
atggccgcaacctccgtagtgcccgctcggatccgcagctcacacagcgtgctgcgggttatccatgccagtgatattacagtgacacaaataatcaccagttttaacgggctgcgtgtgttcggcatcatgccttcttctccttgcctcgcggcgggcctcgggttgatggatatcgactcggggcttttctctttgtacctttcgcagaagctccagagacaaagatccagagcacccgcccgca

SEQ ID NO: 67583 - DNA, 456 bp, Glycine max
  Peptide Sequence Number=SeqID_184361
atgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttagatcatatagatggttggtatctaagataa

SEQ ID NO: 67584 - DNA, 642 bp, Glycine max
  misc_feature (8)..(8): n is a, c, g, or t
  Peptide Sequence Number=SeqID_184362
atggcccncgaaatctaccctaaggctcatgagaacccaaaggctttctcttgcatctctagcccaatctacttggagtcttctatccaatgcccttgcagggtaggattgcatcagcctttggtgatccatttcaccagggacattaccactcagaggtcccaaggcttccaacccttcacagcaaagacgcctgcacccttcccttacaaaagtgataaggtagtgccatggaaatatgtcgtacaagggcctggcaaaagtggcatgactcgtagtggacgtattttcgctgctccaaaattattggcaaggtcaaaagataaggggaaggtgaaggcagatataggcgaaagggacagggcgggtccaaccgtaaatgataaggcccctgttggaaaaattgtagaggaaggagatgactttcgtaagagggagatatcagctaaggaggctactgaatttctaaggatcattcaacatagtgaattcgaagtgattgagcaattgaacaagactccagccaagatctcttttttggggttactcatgaactccaaacctcatcgggtgctgatggtaaacattttgaatgaagcccatgtagcacaagatgttggacaagtggcctcaataacttaa

SEQ ID NO: 67585 - DNA, 216 bp, Glycine max
  Peptide Sequence Number=SeqID_184363
atggtgattgtcgcaacctacccttcgacgggagggcaacgcgagggctcacgggttcgtcttccaaaaaggaaaatgcacggagttgccaccaacgtttattcgaggaaaatgtcggaaaaaccggaaaggcgtggtatacgaactttaagcgtgaaaggttcgggagttctatttgtgcacggggaaggaaatcagacctacgcagttctttga

SEQ ID NO: 67586 - DNA, 780 bp, Glycine max
  Peptide Sequence Number=SeqID_184364
atgtcaagggaagagctcaattctataaacaagactggatttgtgcaatctgttctggcgttagatggaaccttgagcacagtggaaacattggcatctactgctatatgtggagttgttcactcaatattaggtggccaacctttgttgattttaggagttgctgaacccactgtcataatgtacacttacctgtacagtttttgccaaaagacacctgaactaggtggcaagctctttctgccttgggctggctgggtttgtgtttggacgggaatctttttgattctgcttgcaattttcaatgcttgcacaattatcacaaggtttacaagaattgcaggggagttatttggcatgctcataactgttctcttctttcaagaggctataaagggattgataggcgagttcaacacgccaaagaatgaaaatccttccttagtggaatttcaattccagtggctgtatacaaatggattactcgcaatcattttctgttttggactacttgtcactgcccttaaaagcagaagagcaagaacgtggcgatatggaacagggtggctacgaggatttattgcagattatggggttccaatgatggtagtgttatggactgcactatcttatgctgtaccaggcaaagttccagatggtgttcctagaaggctcattgctccccttccctgggatgctgcatctctctatcactggacagtagtgaagggtgtaggtgttcaacattgtgaacagcaagcagtgatcattttagtttag

SEQ ID NO: 67587 - DNA, 1563 bp, Glycine max
  Peptide Sequence Number=SeqID_184365
atggcagttgcacgggatattaaggggaggcaagaacgcgtagttgcagttatcagcaattggacaactatggctggtcaggcgtatgaggcaatgagcaatgcaggatatttggactcaaatatggttgtgattttgaatgatagccgccactctttacttccaaaaattgaggaggggccaaagacatctgtcaatgccctatctagtaccctgagcaagctccagtccagtaaatctttccggcgatttagagaagctgctaagggtgtcacgaaacgaattggtagaggtatgcatgagttggcagctaaagttgatgagtatgctcgtggtatgatgggtcctctaggttctactctttttgaagagcttgggttgtactacataggcccagtggatggacacaatattgaagatctcatatgtgttctgcaagaagtagcttccctggattcaatgggacctgtcttggtacatgtgataactgatgaaaatcagggagatgataacagtcagaaaagtgatatgtcagatgagcagaaaaatgaaggttttgttaaatctgatttgttagataatcctgtttggcctcaaacatatggcaattgctttgtggcgactttggttgcagaagcagagaaagacaaagatattattgttgttcatgctggattaacgatggagccatcacttgaactgtttcaggaaaaatttccggataggttttttgatgtgggaatggctgagcaacatgcagtcacatttgcttctggtttggcatgtggtggcttgaagccattttgtgtcataccttcgtcctttctacaaagagcctatgaccaggtggtacatgatgttgatcaacagagaattccagtgcgttttgttattacaagtgcaggattggtaggttctgatggtccccttcgatgtggagcatttgatataaactttatgtcatgcttaccaaacatgattgtcatggccccatctgatgagcttgaactcatgcacatggtggctactgctactcgtatcaataatcagcctatctgctttcggtatccaaggggtgccctggttggggaaggctacactataggtgatggaatccccatcaagataggaagaggaagagttcttgttgaaggtaaagatgttgctttcctaggatatggatcgatggttcagaactgcttaaaggctcattcactccttgcaaagcttggcattgaggtcacggttgctgatgcaaggttctgcaagccccttgacattatgcttctgaggcagctttgtaaacaccactcttttctagttactgttgaggaaggatctattggaggatttggttcccatgttgctcagtttattgcagttaatggactgctcgatggaagaattaagtggcgaccaattgttttaccagacagatatattgagcatgcatcaccaaatgaacagcttgaccaagcagggttgagtggacatcacattgctgccacggcattgagtttactaggccgtacccgtgaagctctcctatttatgtgttcgtga

SEQ ID NO: 67588 - DNA, 471 bp, Glycine max
  Peptide Sequence Number=SeqID_184366
atggaaaggttctcatttctattggtgctcttttgttgcttccatgttgccttctcctttactcatggagcagtgatcaatggagagtttgagcttggaccaaagccacaggacatgaaaggcacggtggtgaccgggggtccccactctatacccgggtgggagatctctggcttcattgagtacataaaatcagggcagaaacaagatgacatgttgcttgtggtgccaaatggagcttatgcggtgaggcttggcaacgaggcctctattaagcaaaatctaaaagtggtaaaaggaatgtactattctatcacgtttgtagtggcacgcacgtgtgcacaagaggaaaagctaaacgtttctgccgctccagattgggtggtgctcccaatgcaaacggtgtatggtggaaatggttggcatgcctatgcatggtctttccgtgcagattacccttcagtagacatg

SEQ ID NO: 67589 - DNA, 655 bp, Glycine max
  Peptide Sequence Number=SeqID_184367
atggtggcgtttaggaagtctgagaagagacgtttcggcgttgtcggggtgggagggggagtggagaggtgttttaaggaaatgaggtggggcccgacgtcggtgtattgtgaaggggtggtgtttttcccgctgaaggtttggcccgtggggaaggtgaacggtgttgagggagtggcgggcttgggggcattgagggaggaggatggcaaaactgatcaaggtgacatcatcaatcacaggcccacacagcgaagcgagatcgtcacttctcatgttgtagaaggcacctttacactttctttgcctacatatgcttcaacactcagtgacccttcacaggaattgccagcgtctcccacagcaaagaaaagggtgtatgttttgccaggaatggttctggctacttgtgcaatggcactttcttttcctcctattagctccacggctcttttccctttgggaactgagaaatggtccgagtctatgtatctaacagcttttagggactccaccatccaccctggcaggggagagtgttcgatgtggtctacaatattgggcgggataagcacacccgatgatgtgttaggaaacacatatggtccttcttcaaatccaccgttcttcaacacgttctctgtttgtgttgaga

SEQ ID NO: 67590 - DNA, 1098 bp, Glycine max
  Peptide Sequence Number=SeqID_184368
atgggaatgctctcatttctgttggtgttctgctgcttccatgtcaccttctcctttacggacggatcaatagcaaatgcggagtttgagtttgggccaaagccacaagacatgaaaggcacggtggtaactggtggtccccacgctatacctgggtgggagatctctggcttcattgagtacttaaaatcaggccaaaaacagggtgacatgttgcttgtggtgccaaatggagcttatgctgtaaggcttggcaacggggcctctattaaacagaagataaaagtggtaaagggaatgtactattctatcacgtttatggtggcacgcacgtgtgcacaagaggaaaaactcaacgtgtctgtggctccagactgggtggtgctcccaatgcaaacgttgtacagtggaaatggttgggatgcttatgcatggtccttccaagcagattattctctagtagacatggcttttcatcacccaggaaaggaggaggatcctgcttgtggaccaatcattgattctattgctctcaaagctctgtaccctcctagaccaactaacaagaacgtgctgaagaatggtgggtttgaagaaggaccatatgtgtttcctaacacaacatcaggtgtgcttatcccacccaacattgtagacctcagcgaccactctcccctaccggggtggatagtggagtccttaaaagctgttaaatacatagactcagaccatttctcagttcctctagggaaaggagccgtggagctaataggaggaaaagaaagtgccattgcacaagtagccagaaccattcctggcaaaacatacaccctttcctttgctgtgggagacgctggcaattcatgtgaagggtcactgagtgttgaagcatatgtaggcaaagaaagtgtaaaggtgccttatgagtccaaaggcaaaggtgggtttaaacgtgcaactctaaagtttgtggctgttagtacaagaacacgcattttgttccttagcaccttctacactatgagaagcgacgactttgcctccctgtgtgggcctgtgattgatgatgtcaccttgatcagtcttcgcaaaccatag

SEQ ID NO: 67591 - DNA, 816 bp, Glycine max
  Peptide Sequence Number=SeqID_184369
atgtcactggagaatgagatgcaaagaggaggaggtccttggatgaatggtgatggacctcagagcattggcggtggagcgaacgatagcgccaccgctgtacacaacactttgatgacagcagaggagcaaggcggaaaaaaaggagaaggagctttgcccaaccagcaaaccgtggattaccctagtttcaaactcgttatcgtcggcgatggtggcacaggaaagacaacctttgtgaaaaggcatctcaccggagaattcgagaagaaatatgagccaaccatcggtgtggaggttcacccattggattttttcacaaactgtggaaagattcgattttactgctgggatactgctggacaggagaaatttggtggcctcagagatggatactatatccatggacaatgtgctattatcatgtttgatgttactgcccggctaacatacaaaaatgttcccacctggcaccgtgatctttgcagggtctgtgagaacatcccaattgttctttgcggtaacaaggttgatgtcaagaacaggcaagttaaggcaaagcaggttacattccacaggaagaagaatttgcagtactatgagatttcagctaagagcaactacaactttgaaaagccattcttatatttggccaggaaacttgcaggtgatcctaacttgcacttcgtagaatctcctgcattggctccaccagaagttcaaattgatttagctgcacagcaacagcacgaggctgagcttcttgcagctgctagtcagccccttcctgacgatgatgatgaatcttttgagtag

SEQ ID NO: 67592 - DNA, 291 bp, Glycine max
  Peptide Sequence Number=SeqID_184370
atgactaagaagaagaatcccctggtgtttatggatgtgtcgatcgatggggatcctgttgaaaggatggtttttgagcttttctatgatgttgctcccaagactgcagaaaactttcgtgcattatgtacaggagaaaaaggcatcagtccaaatactggaaaatcactgcactacaagggttctttcttccatcagatcataaaaggttccattgtgcagggtggagattttgtcaatcgaaatgttgtccgggttgccagccttgttccatttgcatgtttcctgtga

SEQ ID NO: 67593 - DNA, 2369 bp, Glycine max
  Peptide Sequence Number=SeqID_184371
ggactgctggagaaagcatatatggttcaaagttcccagatgagtcacctaggctaaagcatgatgctactggccttttatcaatggcaattgcagaccgtgacacactcggttcccatttcattatcactttgaaagctgatcatcatcttgataggaaacatgtagtctttgggaagcttgtgcaagggcataatgtattgaagaaaattgaagaattcggtgatgaagaagggcatccaactgtaactgttaaaatcattaattgtggtgaatatagcgaggattctgatacagaatctttggaaactgatagtgattccgagtcagatatgtcctcatcatcttacatgagttcttctagtgatgacaggcgaaagaagagaaagagatctaagaaagataaatatagacggggaaagagaaaagataaacgtcgtgacaagaggcgaaggaaaaaggataagagatcaaagcgtaaatcaaaaagggaatcgggcagtgactcagatagtgagagtaacagtgacaatagctctgaaggtgaaaatattggtgctcaacataaagggcttaagcgtaaagataattctcagaaaaatgctgaaacaaagtctcccttggttgcggagaaagatttgcctcctgcgcatcatgaaaaggaggaaatgggtatgctagagaatgaggaaaaattgtcaaaggaaaacggagagcgacgtaacaatggcattggaggagctgactatggatctgacagaagtgaagagaggcagcctgacgttatggatgatcattcaggcaaaactaggagtcgaagcgtgagtcctaagcgacccatgagtaagagtatgagtattagtcccaggaggagtgcgagcaagagcccaagtgttactccaaaaaggagattgagcaaaagtcccagtgttagaagccctcctccatcacagaggagtttgagcagaagtcctgccagaagcatcagcaggagtccgagcagaagcatcagtagaagcccagtaagaggcaggaatgggagaagtgtcaatagaagtccagtgagaggcaggaatgggagaagtgtcagtagaagcccagtgagaggcaggaatgggagaagtgtccgtagaagcccagtgagaggcaggaatgggagaagtgtccgtagaagcccagtgagaggcaggaatgggagaagtgtcagtagaagcccagtgagaggcaggaatgggagaaatgtcaatagaacccctgtgagaggcgggaatgggaaaagtgtcagtagaagccctgtgagaactcgttctcttaaaagtgtcagtagaagccctgtgagaactcgttctcttagaagtgtcagcaagagccctgtgagagctcgttctcaaagccaccggagcaggagttctcctagagcaccatcaggaaaaactatcagcagaagccctgtaagagtgttgagaaagagtataagccgcagtccagttagatcacctgcaagaagtttaagcagaagctctggctgggttccttcaaagaaaagcatcagccgaagcccagtcagagcacctagtagaagcattcgccgtagttattctagaagtcctagccctgttcgtaggacaaggacacctcgtgggagaagtgtgtcaaggagcgtatcacctgatgcttcaccaaagcgtatcagaaggggaagaggtttcagtgaaagatactcttatgcaagaaggtatagaaccccctcccggtctcctgtgaggtcataccgctacaatggaagaaatgaccgggacagatattctagttacagaaggttttcccctaggcgtttcaggagcccaccaccgcgtggaagaactcctccaagttctgtcattgtgttcaataatgttagcggcatgattatatttgaaaacctgtatgtaggtatcgaagcaggaggagcaggacaccatctgtttcacgcagtccacgatatcgagctcgacgatatagccgaagtaggagcccagttcgtagtaggagtccagttcgcagtcgttccccagttgatcgatcccgccccactcgtgtggagaggcgtgcatcttcttctcggagcaggagtccatccaaatcccggtctaggtctaggtccaggtcatccgtggaatctctaccaagagcaagtagagacagcaggtccaggtcatcgtccagaagcccagatggaaagaaaggcttggtctcatatggcgatggttctccatactaatgtgaaaggtgaaatatgtggtgctgagggctttggccttagctgtgaagttgttgcggtatttgttggaatcgagactcatgttgttgctccagttatgtcttcgttg

SEQ ID NO: 67594 - DNA, 204 bp, Glycine max
  Peptide Sequence Number=SeqID_184372
atgagctatagtggctcctcaatgagttctggtagtggatcttctagaaggacatttgagtttggaaggactcatgtggtcagacctaaagggaaacatcaggcaactatagtttggctacatggccttggtgataatggctcaaggattattccttttttattggctaacttagttgagtggataccttctcctcatgcttga

SEQ ID NO: 67595 - DNA, 255 bp, Glycine max
  Peptide Sequence Number=SeqID_184373
atgtcttatctctggttcaatcagaatccattgaagttcaggagaaagttcttcaaacgttggcttcgatcaccaaggcacaattcagttgctagtggaaactgcattttggccgtgcgagctggggcagtttcagtgctactcagggttgcaaagggcactgataatgaggacttggctggaacttctcttgctgttcttagtctccttgcgaggtttgaggaagggttgaatggtttgaagaggaaatgttga

SEQ ID NO: 67596 - DNA, 570 bp, Glycine max
  Peptide Sequence Number=SeqID_184374
atgagtctactctacatgtgcatggtggaatctgggaactatgaagggaaaatgaacagaccaggagattggaactgcaggacatgcaaccacctgaacttccagagaagagaatcatgtcagcgatgcggggagccgaggagtggcggcggcgactacggtggcggcttcggtgggggcagaggctcttcctcctttggcggattcaccactggcccggatgttcgccccggtgactggtactgcaccgtcggaaactgtggagcccacaactttgccagccgctccagctgcttcaagtgcggtgcccccaaggaggactcctccgccggcccattcgacgtcgacatgccccgaatgagacccttcggctttggcggcagcggcggcggcggctcctctgctcgccctggctggaaatccggtgactggatatgcaccaggtcaggatgcaacgagcataacttcgccaatagaatggagtgctaccgatgcaatgcaccgagggactccagtagtgccaggtttgctgtccaaggagagaatcgagaggctatccctatttcctag

SEQ ID NO: 67597 - DNA, 561 bp, Glycine max
  Peptide Sequence Number=SeqID_184375
atggggaattgcgttttcagctcgtaccacgaaacgacgtcgcaggtttcgacggcgaaggttgtcgttcacgacgggaggatgcaagaattctcttacccagtcaaggtgtcgtatctgctgcagctctacccggcgtgtttcatatgcgactccgacgagttgggattcgacgacgtcgtaacggcggttcacgaggacgaggagttgaggcccggtcaactctacttcgcgctcccgttgactcgcctcaagcgccacctcccgccgcaggagatggcggccctcgctgtcgtcgccacctccgcgctcgccaaatgcggccggagacagattgtgtttctctccgccgctgacgggaatgccaagcctgcccggcgagtcgcgcctgacggtggcgccgctgccgcgacggtttttaatcataacgtggcgagtaaagggaagggtaaaattggagaggaattgcagaacatgctaagtgtgaaattaattattgtgcacaagaatggtttcaaggtaggagtaagtgctttccggctaaggctaggagacgggtga

SEQ ID NO: 67598 - DNA, 306 bp, Glycine max
  misc_feature (25)..(25): n is a, c, g, or t
  Peptide Sequence Number=SeqID_184376
atggtagcctggcccgggacccaancttctcttcacagggaagataaaggtcccacaacccaagtagttgttgccactcctgacagatcccttgaggccacttcagagcctcctgcaccagtggtggacctaccctcacctcagcgtacaacagacccctccactcctattttagagataccagaggacctgaccacaccagtcctggctatggacacttctcctccagctactctagtacttcatctgacaaatgaggaggatgttcaaacaaaggacacccaggaccagtcacaggaattctaa

SEQ ID NO: 67599 - DNA, 219 bp, Glycine max
  Peptide Sequence Number=SeqID_184377
atggcaaatgcccaaacttacaccatggcacgattcccaacaaaactttggggcttcaaacttccctttacctcatcagaggagggtgatggtggttgtggtcatgaagccaacgttattgacgacctgatgatgagaatcattgcatgtagtggtgaggaactattggagggtggagactggagagtatgggaaaaaactcaaatctcacttgtatag

SEQ ID NO: 67600 - DNA, 576 bp, Glycine max
  Peptide Sequence Number=SeqID_184378
atgaagaaattggctagagctttaaaagctggccgccgcaaaacaagtataaaaaatcttgctgctgatctttgtcttgacagggctcttgttcttcaaatgcttcgtgaccctcctccaaatcttttaatgatgagtctaacaatacctgatgaacccgcaacgactgtagtatcacttgaaactaagcccagcgaaattgttcataaagaaacaagtattgatcatgcggaacctgaacccaaggctaaagtacctgttcataccttgcaacgtaattggcatgctcaaaagcgattgaaaaaggcccatgttgacactttggagagagtttataggagatcaaaacgacccactcaacttcctcttgagtcaatagtttcaagggggaaacttcaaataatgcatgactgtacggctggtactggtattgagaatgcaatgatcagtagtatcgtacatgtaacaaacattcctcgaaaaaaagttgttaagtggtttgaagacaaacgtgctgaggagggagttccagatcgtcgtgttccttaccagcgctctgttcctgaaactgcatga

SEQ ID NO: 67601 - DNA, 186 bp, Glycine max
  Peptide Sequence Number=SeqID_184379
atgatcattgtatctgagcccggaatggacgcggcgacagtaaccgttgagtacattcccgacggaattttgcatctcgtcaagatccgtaactgcaccgacgcaggactcgtttcagttgctgagggatgcagcaagagttcactaaaacttcgtattgtgtcatttgggaagtggcctaactaa

SEQ ID NO: 67602 - DNA, 294 bp, Glycine max
  Peptide Sequence Number=SeqID_184380
atgggaaccgagaaggatttaaggatagagaattcttcaaccgaatgctttagcttggctgttgaagaagaacctactaggtgggtggcaatagagatggaaatgatagtctcattgaaggaagcagctctgttattaggatttacgtacttgttgaaaacacaacttctcaaaacaacaaagtctgcttccataatcctcaccctttcttccatcacaaaatccttacctcgccctgcattccgcaccctcctcacccaattttctaagtccttctcgtgtaacctctcctaa

SEQ ID NO: 67603 - DNA, 447 bp, Glycine max
  Peptide Sequence Number=SeqID_184381
atgacctcagttttaaatgaaattatgatggctctgagtcaaccaaatattatcatactttggatgcatggatcaagtaatgcgagaaagggcaacgtggtggagaaaatcacgaggagagttcagagggaccagctgtttgatttggttgtgatgtcaagtgtgaggaaaaagcccgacttaagaagaattcaagagaaaactctggagggaagagctacctgtttgtgcaataggataaagatggaagagaagatccttatcatcctaaatgatctttggggtgcaatcaacttgggtaagataggaattccatttggaaacgatcagaaggggtgtaaaattttgctagtatcttctcataatcaaggtgttgttgtccaaccaaatgaaaacccaaatagaagtttgtgtgagtcttcagatggccgcaggttaaagaattaa

SEQ ID NO: 67604 - DNA, 612 bp, Glycine max
  Peptide Sequence Number=SeqID_184382
atgcagcctggttattcacttcgcaccttcacgggacattcaacatctgttatgtcactagattttcatccaaataaagatgacctcatctgctcttgtgatggtgatggtgagatacggtattggagcataaacaatggaagttgtgctagagtctccaagggtggcaccacacagatgagatttcagcctcgtctcgggaggtaccttgctgcagcggcagagaatattgtgtctatttttgatgtggagacacaagtgtgtcgatattcactaaagggacacacaaaaccggtggtttgtgtgtgttgggacccttctggggagttgctggcatctgtgagtgaggactctgtcagggtttggactcttggatcagggagtgatggggaatgtgttcatgaacttagctgtaacggaaataagtttcataaatctgttttccacccaacgtacccttcattgctgtcattggagttgtggaacatgagcgagaacaagacgatgactctgtctgctcatgatggtctcattacttccttggctgtttcaactgtaaatggtttggttgcttcagctagtcatgacaagttcctcaagctctggaagtga

SEQ ID NO: 67605 - DNA, 671 bp, Glycine max
  Peptide Sequence Number=SeqID_184383
atgggcgctgaatccggcggccaatggggcaccatcggcgccgggacgctgatggagttattcatgctgttagcgcacatttccgatacccatttccgcagccgcggcgaaaagctgtacggttttatcgacgtcaatgccgccaatgctgatgtggtttctcaacttaacgcgctgcgcgaacgcccggatgcggtggtggtgagcggcgatatcgtcaactgcggccgtccggaggagtatcaggtggcccgccagatcctcggcagcctgaactatccgctgtatctcatccccggcaatcacgatgataaagcgctgtttctggagtacctgcagccgctgtgcccacagctcggtagcgatgccaataatatgcgctatgcggttgacgacttcgctacccgcctgctgtttatcgactccagccacgccggcacttcaaaaggctggctgaccgacgagaccatcagttggctggaggcgcagctgttcgacggcggcgacaaaccggcaacgatctttatgcaccacccgccgctgccgctgggcaacgcgcagatggacccgattgcctgcgaaaacggccaccgtctgctggcgctggtggaacgtttcccgtcgctgacgcgcatcttctgcggtcataaccatagcctgaccatgaccca

SEQ ID NO: 67606 - DNA, 1926 bp, Glycine max
  Peptide Sequence Number=SeqID_184384
atggtgtactggaatctgcaattctacacaagagtttctaagttaagagaaaatacaacaggccctactttacatttatggtttgtgaaactctatctgcagacacaattaataaaggcaagggagcaacaacagcagcagaaccagcagcagccacagccccagcaatcacagcatcagcaacaacacatgcagatgcaacagctcctgttgcagagagcacagcaacaacagcagcagcagcagcaacaacaacagcagccacaatcgcagcaacagcagtcacaaccacaacaacaacagcaaagtagggataggcctcatcttttaaatggtagtgcaaatgggttagtcggaaaccctggaactgcaaatgcactagcaacaaagatgtatgaggaaagattaaaacttccccttcaaagggactctttggatgatgcagcaacgaagcaaagatttggtgagaacatgggccagctcttggacccaaatcatgcaccgatattaaagtcagctgcagctcctggccagccttcagggcaagttttgcatggtgctgctggtgggatgtctccacaagttcaagcacgtactcaacaattaccagggtctactctggatataaagggtgagattagtcctgttttaaatcccagagctgtgggtcctgaaggatcattgatgggaatgcctggatcaaatccaggtagcaataatttgactttgaaagggtggcctctcacaggtttggagcaactgcgctctggtctactccagcaacaaaaacctttcatgcaggctcctcagccttttcatcaactccaaatgttgacaccacagcatcagcaacagcttatgctggcacaacaaaatctggcatcaccatctgccagtgaagaaagtagaagactgcgaatgctattaaataataggaatattggtctaaataaggatggtctttcaaatcctgttggtgatgtggtatcaaatgttggatccccacttcaaggtggtggtcctccttttcctcgtggagatacagatatgctagtgaagttgaagctggctcagttacagcagcagcaacaacaacagtcaagtaccaatgcacagcagcagcagcttcaacagcacaccctttcaaaccagcaatctcagacttctaatcatagcatgcaccagcaagataaagtaggtggaggtggtggtggcagtgtcactgtggatggtagcatgtcaaactcatttagaggaaatgaccaggtttcaaaaaaccagattgggagaaagagaaaacagcctggctcctcgtcaggtcctgccaatagttcaggaacagcaaatactacaggtccatcaccaagttcagcaccctcaactccttcaactcatacgcctggagatgtgatatcaatgcctgccttgcctcatagtggtagttcttcgaagcctttaatgatgtttagcacagatggcactggaacccttacgtcaccatctaaccagttgtgggatgataaggatcttgaattgcaggctgatgtggatcgctttgtggaggatggatctctagatgaaaatgttgagtcttttttgtcccatgatgacacggaccctagagatactgttggccgttgtatggatgtaagcaaaggcttcacattttctgatgtaaattctgtacgggcaagcacaagcaaagtttcctgttgccatttctcatctgatgggaaattactagcaagtggtggccatgacaaaaaggttgttttatggtacacagattctctaaaacaaaaagctactcttgaagagcattcatctttgattactgatgtccgtttcagtcctagcatgcctcgtcttgcaacatcttcattcgacaaaactgtcagggtttgggatgttgacaatgttagttga

SEQ ID NO: 67607 - DNA, 339 bp, Glycine max
  Peptide Sequence Number=SeqID_184385
atggctgccttccatggcttccatgtcagcccaaaccacctcttcctatggcatcctttccacacagccacccaccaacaaccatttttgcaggatccttcccctttgttttcgcacacaccttatccttatgtacatctagctcaatcccttgggattgattttgagagcacccgaaattgtttgctaggcttgttcggtaccaggaaaactcttcatccatcatctcccaccttacccctaaaaatggaaagcaatttccacgtacatgttactggctctagcaatgacggcaacaatgcggggaagcttgtagtaccacactattacaaaaagtag

SEQ ID NO: 67608 - DNA, 360 bp, Glycine max
  Peptide Sequence Number=SeqID_184386
atgggttttgtgcttcacgctcaattctttgattttttggcttggtttgtggttttccgcaagttttgtggggtttattggaagttgctgattttggctgctgaacttggaatcttttgtgtgagggatttgaaggcttctgctcaggcttttcaagctgaaggaaaagtatcatcggaccctgttgctattgatgccccgggaggttttctgttcgagtggtggtcggttttctgggatatatttattgcaaggacaaatgaaaagcactcagaggttgctgcatcgtatattgaggttggttgggtacaaattttcactggtttcacactatgcaaccttctaccatgccaaatttaa

SEQ ID NO: 67609 - DNA, 717 bp, Glycine max
  Peptide Sequence Number=SeqID_184387
atgttaaaaccttattttctagtagtgccacttcaccctgccttgcctcttgagagcataaacaacttccattgtggtaatagtcttccttctcttgtgctcaaggtaaggaatcgtgccgacaaaaaagtcccttgtgacgccacggaggaacttgtcccttggtgtatgatagagctacttataggtaccccaaccaagcctcaagctctacctaacccaccaaacactctccttgataccaagtggttgattggtaggcgctttggtgatgctcaaacacaaaaggagatgaaagtggttccattcagcattgttaaggctccaaatggcgatgcgtgggtggaagctaataggcaacaatatttccctagccacattagtgcctttgttcttaccaagatgaaggaaattgcaaaagcatatatggggaaggctgatgaaccaggtgagcttaggtggaacaacccttgggatcctggagtacctggacagaaatgggattcaattggattttgcagtcctctggtacatgaacgaccacgatgtcgtcatcccacggcgtcgtcactcacagtcgctatcaagtcggaatcaatgtcgacacacacaaccactatgtgtcttcttccaccaccctggctatcaatgttgtttcctttcacaacacacttgaccatagcgttatcacgcgcgaccaccatgaagtcaaaataa

SEQ ID NO: 67610 - DNA, 1209 bp, Glycine max
  Peptide Sequence Number=SeqID_184388
atggagtccttaaaggcgcaagaaggaggagaggagcaagtgaagtgcgtgtgggttcatggccctatcatcgtaggagcaggaccctcagggctagccgtcgccgcgtgcctctcccaccacggagtaccctacgtcattctcgagagaacaaactgcataacctcactttggcaacacagaacctacgaccgcctcaaactccacctccctaaacacttctgcgaactccccttaataccctttcccctccatttcccaaaatacccctccaactcctacgcttcacgcttcaacatccgccccaggttcaaccagtccgttcagaccgcccagttcgacccttgttctcagctttgggtcgtcaaaaccaatggttttcagtacatttcgccgtggcttgtggttgctactggagagaatgctgaacccgttgttccctcgatttctggcatggacaagtttcgcggacccattgttcacaccagcgtctataaatctggttctgattacaagaaccagagggttttggtcattggttgcggcaactcgggtatggaagttagcttggatctttgcaggcacaacgccaacccttacatggttgcaagaaacacagtacatgttttgcctatggagatgtttgggttttcgacgtttggaatagctatggctctcttgaaatggcttccaataaagttagtagacaagttggttttggcggcggctaggttaatgttgggtgacaccgctcgctatggcgttagaaggcccaaaacagggcctatcgagctcaaactagttaccgggaaaacccctgtgcttgatgttggacaagtcgctcaaataagatccggtaacatcaaggtgatggaaggagtgaaggagataacaagaaacggtgccaagtttatggatggacaagaaaaggagttcagcgctataatattggcgacgggatacaaaagcaacgtgcccacttggcttaagagttgtgaatctttcacgaaagacggaatgcctaaaacgccgtttccaatgggttggaagggagagaacggattgtatacagtggggttcacgagaagaggtcttcttggaactgcatcggatgccgtaaaaattgctaaagacatcgctgatcaatggatgaccgttaaggacagatcatactgtaattcccacatcatctttctcaagagtacatag

SEQ ID NO: 67611 - DNA, 192 bp, Glycine max
  Peptide Sequence Number=SeqID_184389
atggtgaacacagagccattaatggctaatgaattttcctcaagtgatggtggggcaaagttgcgcgttgcttacaagggccttccaggagcatatactgaggatgcagttttgaaagcatatccaaaatgtgagacagtgccatgtgaagactttgagacttcattcaaggttgcattgcttgtttcttaa

SEQ ID NO: 67612 - DNA, 237 bp, Glycine max
  Peptide Sequence Number=SeqID_184390
atggtggtgaacttcttcttggctcatcttctccttgaagtggcgtctccaatattctttcttccatcttcatttcgctgccatgatctacaagaagcaaaggactccattgatggagaagatccaaggcctacaagctctacatggagctacatcatgtggtatcagagcatcttcatgaattatcattttttcagtcataatcttcttgtgctgaaatttttaccaaatttctag

SEQ ID NO: 67613 - DNA, 441 bp, Glycine max
  Peptide Sequence Number=SeqID_184391
atggatctaggggaaattttcttgttgctcggtgggagcaggtcgttgatattggaagcatttgtggccccctgtcgacttgagcgacattattttggttcacacccttatctttgttgcaagcgagattgtgtcgtggttttcaaatccaacacaagaataaggggtccccatcgtcatctccttcgcttcattgtccttgccgctttcatcttggatgcctatgcctctaatgaagttgacactgccttgctcatccccaaccctaatttaatagatttttcagagtgccaccatgacgagcttaagggtgttcaccatgaacatgaggaggaggatgggaatagggtgcaacagcacaaagagaatagggtggtgcagtttatgagtaacaaagggcatatcagtctattcatgttgccaatgaggtgcagaaagtag

SEQ ID NO: 67614 - DNA, 246 bp, Glycine max
  Peptide Sequence Number=SeqID_184392
atgacgcaaccacatagcacagatcacaacgaaagaacttggattcctcctccaaacggcttcctaaaacgcaacttagatgctgctattctcaaagagataaacacatttggaggtggtctttgtatcagaggagaacatggaagctatataaaatcaaactccaatattttccaaggaattccatcaccatcgtcagaagctgaatgtgctaatccaatggatccagcagctgggattcaataa

SEQ ID NO: 67615 - DNA, 761 bp, Glycine max
  Peptide Sequence Number=SeqID_184393
gctgtcgatcgtggttagtggataaagctgttctaccaatcgaaaattctgttggtggaagcatccaccgtaattatgatttacttcttggacacaagctacacattgttggggaggtgcagttgctaattaaccactgcctcttaggattggctggtgtgagaaaagaggatctcaaagctgtaatgagtcatcctcaggctcttgttcaatgtaagaagatgctaactgatttaggtattgccaagattagtgtagatgatactgctgcagctgctaaggcagtgctcttaaaggggagaaaagacattggagctattgcaggttcaagggcagcaaatatgtatggccttgacgttctagctgaaggaatccaggatgacgacgttaatattactcgttttctgatactcgcgagggatcctagaattccaggaaatgacaggccctataagactagcattgtattcagcctagacgaaggtccaggtgttctattcaaagccctaggagcatttgccttaagaaacattaatctgtcaaagatagagagccgccccttgaaacagtctcccttaaggattgttgaagatttaattgatgagagggctaagtattttgaatatcttttttatattgactttgaagcttcaatggcagatccgcaagcccagtacgctttagaaaatttgcaggagtatacaaaatttattcgtgttcttggttgttatccggtggataaaacagatacatcagattga

SEQ ID NO: 67616 - DNA, 456 bp, Glycine max
  Peptide Sequence Number=SeqID_184394
atgggaatccgaaaaacagcaacatgttctgtatcgaaagatggtaatgcctctgttgagactgatgtacctttccctgctgattactctgagcttctggaacaagccagagtagctgcagatttggctataaaggataacagacagctaatgcacagaaacagaatcatcttttcaaatgattctttcaatggaagcaagttgttggaagatgcagtgttcctagtatggtcatggcttagagcaagggagacagattttgtaatgcactacaaccaatggtctagtaatctaaatgagattgagtttcccacagctggactcgggtctgtgccaggtgatggggaaggtggaattgaaatgactgagagcatgcaattgattcgtgaattttgtgaccgcttcattagttcagagaaagccacacgaacaagaatagtaatcttcttgatttaa

SEQ ID NO: 67617 - DNA, 378 bp, Glycine max
  Peptide Sequence Number=SeqID_184395
atggcatccaagaaaaggaaagctccttctacacctacccaggccagatttgatagatccaggttcacatcccaagaggcttgggagagatatacagacatcatggtgcctagaaaaatactaacggagaggaatgtagtagtttattacactaagttcgacgagttccaggaggaactcgagagaagacattgggatgagaagctgactgattttgctgatagaagcacacacattgctattgtgaaggaattttatgcaaacctttatgaccccgaggataaatcacctaagcaggagagggtgagagacccctgtagtgcaagaagagggggagaatttgtgtacttattccacgtttgcactcctgaggcctga

SEQ ID NO: 67618 - DNA, 198 bp, Glycine max
  Peptide Sequence Number=SeqID_184396
atgcctaccacaacaagtggtactccctcaactgtggcaacctcaaggacacccactggtaagaggtcaccgactccatctccacctgctgccccgatgttaattaggcaagtttgtgaagtgctgatcttcatcctctcgctaagccaatcttttggcttaacgagccatccgctgagcgcaacactcctcagttga

SEQ ID NO: 67619 - DNA, 177 bp, Glycine max
  Peptide Sequence Number=SeqID_184397
atgtctcctccacctctagaacttcacaatcactcacagactcatctcaagctttcaggacaacttcctcttcaagcttcgttctctgcagcacgcttagcgccactatggaccgctcagcgtgcattagtggatttcggcttagcgcatgcttttctcgctcaacggatggactga

SEQ ID NO: 67620 - DNA, 249 bp, Glycine max
  Peptide Sequence Number=SeqID_184398
atggaaacaaggttcaaaagggctatcaaaggaattaagtcaaggaagcatcaacaagaatcaagccaaggctattgtgcaagcaatcaatggggcaaaacacaccaaatgattatgatgatgtatggctcaaattctcacaaagtgtctttaaagcgacaaagttggacaaccacgacacttccccacgccatcaaacttgatcgcccgcgcccaattgagaagaatctcatgcgtcgtcaggcttga

SEQ ID NO: 67621 - DNA, 648 bp, Glycine max
  Peptide Sequence Number=SeqID_184399
atgaattcaaggccttcaagttatagttctaaaacccggtccactcctgcaaaggcaagggaatctgcagttgtttcatatgccttgtcaaagtcaccctcctcatgggagaaagtttattggctctccatcgactaccttcttgttgccaagctggcagctttagttgagcatacagctgggacaagccagagttgtggatcatattttacttcagtgatgtatgtagaacattggtgtgaagagcaatttaagactctaacaattgggggtccagatttctcccataacgaaatgttgccggatcatattgaaatacttgtttcggcagtcactagaatcaacgaaccagatagcttatatggaattcttcagtctcacaagttgacttctcaaataatcacatttgagcatgagggaaactgggggaaggccctggagtattatgacttgcaagtgcaatcagatgcctcagtacagaaggatggctgttcaaaaagtatgtcattgaaacaaacaggagcagcaaacccttcatcttttgcctcagaggtagatgagatgaggcagagtagaccttacaaagggttgattagatcattgcagcagattggctgcacacatgtgctggacatatttttaatttga

SEQ ID NO: 67622 - DNA, 465 bp, Glycine max
  Peptide Sequence Number=SeqID_184400
atggcttgggatttacgctggagaacatgtcataataatagcaccgagttttgtcttctgaagccaactgtttctcctgagcctgtgattccttccattgaacagatgtcatggctggatatggagtggtgctcaattttgcaaaggacacaattgcatatgaatttgctagaaccatttatagcatttcgacgagttctacttcaagttttaagttctagagactgtatgctgcaacatcttctgcagtctgccaccacacttcgtaagggatgtaggttctctcaagcagctgctgctttgcatgagtttaaactcctttctgttgaaaccaaagggcaaagctcatccgtatattggcttggaaggagtgagagggagaggtgtgaatacttcggaaaaggagggatgaatgcaggggggggctgggtgggtaggttgaatgcacacttaaggaagagttga

SEQ ID NO: 67623 - DNA, 831 bp, Glycine max
  Peptide Sequence Number=SeqID_184401
atgggagcatccattcctaatagatacatgtttatacactatgtagccaatttatgtattgcctgtctttcttcacgaaaagatgttgtaaatagcatgcttagcacaatggaagaggttcaatctttcaaatttatacctttagtataccaaattgcctctagaatgggtaactcaaaggatggtcagggacatctcaatttccagtttgcattggtttctcttgtgaagaaaatggccattgatcatccatatcatacaatacttcaacttctggctctggcaaatggtgaccgtatcaaggacaaacagcgtagtagaagttcatttgtggttgatatggacaaaaagcttgcggcagaaaatcttttaaatgagttgtcatcttatcatggagctatcatacgacaaatgaaacaaatggtggagatttatatcagacttgctgagatggaaacaaagagagaggataccaataaaaaagtgacactaccaagggacttacgtaatctcccggtgctagaacttcatacacttgagctgcctatacaattattgaaaataacatcagcagttgataatttggacttagggcctaactcaaccctagaaaatcagtatgtacctgtagtgacagctacaatttcaattgatcatagttgccagtatcatgaaggctcttttccttacttcaaaggattagcagattcagttatgataatgaatggtataaatgctccaaaagtggttgaatgcttgggttctgatggccgcagatatcgacaacttgcaaaatctggaaatgatgacctaagacaggatgctgtatga

SEQ ID NO: 67624 - DNA, 978 bp, Glycine max
  Peptide Sequence Number=SeqID_184402
atggttgagatttttcacttttttatgaaacaggttgttccttttacaccaagtgctggtgttcttgagtgggttaatggaacacttcctctcggtgaataccttatagggagcatgagaaatggaggtgctcatggtcgctatggagtaggagattggtcattccttaaatgccgagagcacatggcaaatgagagggacaagcgcaaagcattccaggaagtttgcaataatttcaggcctgttatgcattattttttcttggagagatttttacagccagctgagtggtttgaaaagagacttgcttatacccgaagtgttgctgctagttctatggttggttacattgttggccttggagatcgacatgcaatgaatattttaattgatcaggccactgcagaggttgttcacatagatcttggcgttgcttttgaacaaggcttgatgcttaagaccccagaacgggttccatttaggcttacaagagacataattgatggaatgggggtaactggtgtagagggggttttccgaagatgttgcgaggaaacactctctgttatgcggacaaacaaagaagcattgctgacaattgtggaatatgaattgaacttccatttctataatctcttcataatagatgagtaccctctacaggtttttatccacgatcctctttataagtgggctttatctcctctgaaagctttgcagcgtcaaaagtgtgacctttcttccttttctccacaggaaatggatgatgatttggatacaagtttggaggaaccacaacatgattgccaaggaaataaggatgctgcacgtgcacttctccgtgtcaagcaaaagcttgatggttatgaagatggcgaaatgcgaagcatccatgggcaggtacaacaactcatccaagatgcaattgattctgagcgattgtgtcaaatgtttcctggttggggagcttggttataa

SEQ ID NO: 67625 - DNA, 333 bp, Glycine max
  Peptide Sequence Number=SeqID_184403
atggaggcaaaactacagggtaagggtcctccaaggtggttgacctcgttgtcggaagaaacaaaacctgtttggctggaaaatggagttacaaaagtggcaccttcaaaaacaaatgctggacgtgctgtcatgtgccggtttgaggcactggttgatggtttttggcatgacaaagatcatgtgcgtggggcacgtaaaacaccagttgaggaagtagtggtcgaaaaaggacagattggattttggcaagttgaatggtggggtcaccttccggaaaggtcaccggaggtgtggcaatggctggctgtggttgcccaaaaagtcgcttga

SEQ ID NO: 67626 - DNA, 363 bp, Glycine max
  Peptide Sequence Number=SeqID_184404
atggagttgcggcaaagcttattaacccatgcagatagttgccagtttgaactgctcttgatggggaagaacaagggtcgtcaatcgcactcagctgcaaagcaaattatggtgaagggtactacctcagattcaggtaaatcccaaacatctgttacttttggcctggctggtttcttggatgttgtccatgcaaatcagaatgcttatactacttcacaggataatcttgtaggcaaggtgctcgtaaaaaggcagggacaagttctgcaaaaactgatgatgtcgcacaccaagtgtttgataatttgtcagaatgcagtgctgaatctgaatcttccccagaggtttcttgcaccttag

SEQ ID NO: 67627 - DNA, 1044 bp, Glycine max
  Peptide Sequence Number=SeqID_184405
atgtctcgcaaagaaaacctcctatatgaactgcatacaaagaaaggtacttggaagatagtcgtgcgaataactgatatgtggcgtgttaacaaacataatggtcgacaatccattgagatggtgttgatggaccatacgggtacaaagattggggcaactctatcgcaagaaattttccctgaatttgagctcaagttgcgttgtggtggtgcatatgttattaagaacgtaaaggttgttgatactcattctgactacaaaacaacgtctgtcaaagaggtggacagacctgagattcatcctaatgttcataccattacttcatttgctgatataatttcaggcgttgcaaaacctgatactttagttgatattgtgggtgttattactgaagtgattgaacgcaaaacagttaatcctgcatacagagtaactgtcaagttgagagacaacagtcatgctgagatcatcatgactgtgtgggaggaatatgctcttcagctggatgatgctattgagaaaaaccatttgaaatccaacaattccatgataggtacaatgaatgatttggatttctttgctaggttattaagcagtttggtacaggactgttactgtttgacagtgggcactgtcgatgaggtgcagcttgtcgttcgtgccagaatcatgttactcacactattccaagttgtcaagatgaaacagaatggggagaaggcgaacttccatttttgggatgcagtatgtatcaaaatatttggtaaaactgcagatgaatgttgtcaagagttgatagcgagtggtgatgagatcaaggtgttccctgcgtgtgttgatcaattgttgggtaaaacttgggttgtcagattcaaacaccgtatacagatgcaccaatcatctgtgttggattttagtgaacaggaacatcatatacaatcagtgatatccacactaggtctacaggatgaacaatgtataagcaacaagtcactggctgttggtgctgcatcttcatcacaacaagattaccatcctaca

SEQ ID NO: 67628 - DNA, 2725 bp, Glycine max
  Peptide Sequence Number=SeqID_184406
atgtttgcattcacatctcctggtgtcaaagtagacacatcctataatactggaagaggtcctcctacattacgcatacatggtcaatcgcatcaccttattggaagcctcctacctatgccggataactcaccaaagtttgcacaactatatatttatgacacggagaacgaagtcaacaataggctttcacaataccctatcaaaaataatgttgatgaagacattataattggtatcaagaatatgctagatacccacaatccatatgcacaaaaattcagaatggcaagggataaactagactcttctgtagtgtgtgacctgaaactaaagctcattagtgacaggcaaactgatgaaagattgtataatttgccaaatgcttctgaagtggctgctttaattgttggtacaaataacagagatatcatcattgagaagcaaacagacatgctgcaaagaataaatgaacttcatcctgcatatttacctttgcaatatcctcttttgtacccacacgatgaagatggctacagaccaaacattcttcataaggatcatccgcatagccatgctgcaaagaggaacaaagttaccatgcgtgagtatttttgttacatgatgcaatcaagggataatgaagcacaaacaatactttattcaagaagattgtttcaccaatgggttgttgatgggtattgtatgattgagtctcaaaaactaaactatgttagacaacatcaacaagaactccgagttgacaagtacatcaatttaaatgactgtaataatcagcccttaacccaaggcaatgaaaaaggcaagagaattatactaccaagttcgttcgttggtagtcagagatatatggaaaaattgtattttgatgggatgacaatttgtgcccatgttggatttcctgatctattctcgacattaacgtgtaatccagcatggccagaaatacaacgacaagttgcaaagtcaaatcttacagctcatgattgccctgatgttgtgtcacgggtattcaaaatgaaactaaaccagttgatgcatgatcttaagagtggacatgtatttggtcccattcttgcatttgtttacaccattgagtggcaaaaaagaggattgtctcatgctcatatcttaatctttttgcatccttcaaataagtatccaaatctagaagacattgacaacataatttctgctgaaataccaaacaaggacacagatccagaattgtatcaaattgtctccaaccacatgatgcatggtccatgtggactagccaataaaagggaaccatgtatggccaatggcaagtgtttcaggtttttcccaaaaaagtttcagccagccacaattgttgaccaagatggttttcctgtttatagaagaagagacaccagacagactgtgcaaaagcagagtgtttatctcgataatcaatttgttgtcccatatagtccacatttgctactcaaatatagaacacacctaaatgtggaatggtgcaatcaaagtacctcaataaaatatttgtttaagtacatcaacaaaggatctgatcggattacagcagctattgtcaatgaccaaaaccaggatggcacacacaatcaggttcatgatgaaattaaacattatcttgactgtaggtatgtgtcggctcctgaagcatgttggaagattttcgcattcccaatgcatgggcgtgcaccagcagttgaacgcctttatttccacctagaaaatcaacaacctgtttactggaaagatagtcaagaaattggcacagtactggctaagagtacaatcaaagaatcaatgttcacagcttggatggattctaataaaatataccatcatggacgagatcttacttatgctgaatatgtgtccaaatttgtttatgatgtacgaaaaagatgctggaaaccaaggaaacaaggaaatactattggcaggctgatttgggtgcccccttccagtggagagttgttctacatgaggatgatgctttcctttgctaaaggatcacaatgttacgaagatattagaacagtagaaaatgttgtctatcatacattcagagaagcatgctttgcaaaaggttttataggaagtgatcaagaatttgttggtgccttacgagaagcaaacacttggggaactccacactatcttaggaagttatttgtgaagctgctatttatgaataccatggataggccagaatatgtgtggaaacaaacttggcaatggatggcagatgatattgtatttaatcatagaagacaaggcatccaactaacaaacaaagaaaaaatgcatctttgtttaacggaaattcaaaacctcttgcaagccaacaggaaaagcctacgagattttccttcaatgccatacccactaggatatgccgccaacccacaccaaaataatctcatctacaatgaactggcttacaacagggacatattggtcgccgaatttgacaaatgctaccagtcgctaacagatgagcaggcttctatttttaataagattatgcatgtggttgcaactcaatcaggtggagtttattttctgtatggatatggtggcacaggcaagacatttgtgtggaaaactttatcatctgctatacgctctactggcggcattgttttaacagtagcttcaagtgggattgcctcaatactatttcctggcg

SEQ ID NO: 67629 - DNA, 405 bp, Glycine max
  Peptide Sequence Number=SeqID_184407
atgttcgaggagggcgaaacggcgtcgtgctcgtcgtcaacggacgagagcgttgacctggagggggtcgcggaaggcgcgtactgcgtgtggacaccgaactccgttgggagtgagcggaaaaagagcaactcgacggggtccacatcgaaacggtggaagcttcgtgttcgggatttgcttcttaggagccacagtgacggaaagaataataataaacaagagcaacaaaagcaacgggatttgtttcggattgcgacgaagcctcaaaacgggagcgtgggaacggaacagcaacatcatgtggaacagaacaagaggaagtccttcttgccttacaagccggaattggttggactttttactaacgccaatggccttggtcggaatttgcgccctttttga

SEQ ID NO: 67630 - DNA, 354 bp, Glycine max
  Peptide Sequence Number=SeqID_184408
atgaagatgatgatgatgacgattaccttgcatctaactcatacgttggaagagtctttcaatgaagatgatagtgatgatggaatatctgatacagacgatgaagtcactgacatcgttgaaccagtttcaattgttcacccaaccgaaggtgtaccacaaattcaaaatccattttggaatgatgctatgcattataataatatcaattggagtcatctggacgaggaggacatttgtggtctggacatgccaacgacttttaatgttggacaagaattgtatgttggcatggattttgacagtaaagatgcggtaaaaaatgcactgaaacaatatgtgatgaaggcatga

SEQ ID NO: 67631 - DNA, 296 bp, Glycine max
  Peptide Sequence Number=SeqID_184409
acgctcagctcaagccaacttctatcagttcaggcggaaggtcagggggagtggtacaattaggccttcccttcgggacttcaccgctaacgagcatcgataagctgtcgcaagcaatcaaagcgattcccttccttattctaatagaaaagatatggagatttcagccctttccttccttgtttgcattccagatccgtcgtggttcggagtctcgtactagcctcgccctatctaaaactaaaaggcggatggaagatggccttcttaatgagctctctcgctttactttatcg

SEQ ID NO: 67632 - DNA, 654 bp, Glycine max
  Peptide Sequence Number=SeqID_184410
atgtatgataataatgatgtggtccacagtccggatgaatgcgttgatcctgaaacacgaaaaataaaagtccctaaatcagagtttgttaagacatataaaaatagcgtcttttctcttctggactgttatagatatgaaaataatgatgcacaaacattagaatcgcttcagagagaaattgaggatctgactttgaacttctctgaagatagtatttacaaaactagtcctaacattatggtaatgttaactaaaaacaacttgccaagtgctaaggaattccttcgtggaaagtatcttatggataaagaatatcccggcagaatgaccatttatgcagaaagtcgaagtggtgatagtctagaaaccagcggctcagagctatccgatgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtagggtactaaagcatctaaaactagagcttatccctttggtacagcattag

SEQ ID NO: 67633 - DNA, 1009 bp, Glycine max
  Peptide Sequence Number=SeqID_184411
aatggtgaaaccatttcagaacttgaaacaagattcatccatatagtaaatcacttgcttggtcttggaaaaacgtttgaagatgatgagctaaaaatcaagattctcaactgtcttacaagaacttgggaatcgaaaatcacaatgatcaaggaatccaaggacttggcatctatgtggatggaagctctcttcggaaaatttcttgaatatgaacatgggttgattcgacaatttcatgtggaagatacaaaaaagaaaaggaaagggattgcactcaaggttagttccacaaaggaagatcacaaagaaagctctagtgatgataaagatgtagagaatttgagcttgatgacaatgcgtcaacatcctctgattcttctagtgaagaagaacttgcaggatgaatccttaaccattgaagaaactgagcatgaaagtgaaaaacttgtttcaagttataaagccattggttgtgtttgtgtttctacttctcttaatatggatgattacaaatctttgccaaatgagtttgaaaagtttaaaaaggattactatgaagaacttataaagttacaaactgagttttcctatcttaaagatcttttcaggaaaatgaacaaagaaaagaatgatcttagtcacttgctcagtgtgcaaaagcatactaccagtaagactggtttgggcctaaaatcaagagactcactatggtacctggatagtggctgctctaggcacataactggtgacaagtccagacttgctgaccttgtgttaaaggaaggtggatatgtcacttttggagacaacaataaggcaagaattatgggagaaggaaatattggaaatcagaaaaagacacaaataaaaaatgttctatatgttgatggacttaagcacaatctcttgagcataagtcaactatgtgacaaaggcttcaaaattgaattcaacaagaattgttgtctcatttgtgaagcaaaaactggtgaggttgttcacatag

SEQ ID NO: 67634 - DNA, 537 bp, Glycine max
  Peptide Sequence Number=SeqID_184412
atgaccgaccctctcaatgagtcaatctcatgttttctcataagggtggacccttgggtactagaacctgtcacctttagaggactacacatcctcaccttcagagggctgcacgccctcgccttcagaaggctacacgccctcaccttcagagggtcatgtaccttcaccttcagaggactacacatcctctcctttagagaactacatgtcctcaccttcagaggactacacgtcctcgccttcaaagggtcatgtaccttcgcctttgtagggctacacgccctcaccttcagaggactacacgtcctcgccatcagaggactacacgtccccaccttcagagggctacacgccttcgccttcagaggactacatgtcccccttttcaaagagctgcacgccctcacccttagagggcgacacgccctcacctttagaggactacacgtcctcgccatcatagggactacattccctcaccttcaaaaggcgacacgtcctgaacttcagagggctgcatgccctcacctttag

SEQ ID NO: 67635 - DNA, 363 bp, Glycine max
  Peptide Sequence Number=SeqID_184413
atgggccccgacgggtgcagagaaacgcgagggattggaaccagagaaatggcacgcaaaccaagaaaaaattcagaagctcttctcatctcccacgttgcttttcttctccctttctcatccaccattgttgcccatcaaagctccaaactttgctcaccatttctactccaaattgcaaaaggaagccattttcggagtcgtgaaacgcaccactacgttgtagaaaagtatgagattttgagggctagagaagctaaatttggggttagtgtatattggagtctaaagacttgtgggaaaacttgggctgagcaaatgagaaaaatgagtgacaaaggtgaaagcaagagccatttctag

SEQ ID NO: 67636 - DNA, 519 bp, Glycine max
  Peptide Sequence Number=SeqID_184414
actcatcttctccttgaaggggcgtctcctctctctcttcctttctccattccgctgccattcatcttccaagaagcaaaggattccattgatgaagaagatcctaggcctacaagctccaatggagcttacaccacttatgatgaggggagcccatgggcctgcaagtggcttatgggtaaggctcatatgacggggatcaagggagccccgtatcagagacgtatggatgccctgactgtgactgacgtgtactggatgccctatgctgagcaccggggatttggctacattcagactgtccctccaccgccggtttgtgattctttgacgggtgatgatatagatgaccggtggctgcatttttcagaccatatggtgcctgcaggggacttctgtgtagtttctgggcaggagactgctaagccgagacatccgcctccccctcatgatgaggagttcgtcgagccacccatccccgaggtttcaatcgcgtccgatctccctacgcattcagtg

SEQ ID NO: 67637 - DNA, 243 bp, Glycine max
  Peptide Sequence Number=SeqID_184415
atgacacctcaatttcatgagacagttatgctaagactgaagcctatatgcaatgtgggagaccagtcagggtcacgatgttttgcgagaatgctccaatcatatggaatcagcataggcttaaaggagcactcaaacccagtgacccccaaggcctacactccgaagagtttgtcagggcctctccctcctgattcaggtccaacccctaaaatcattttagcatacagacactgcttgtga

SEQ ID NO: 67638 - DNA, 549 bp, Glycine max
  Peptide Sequence Number=SeqID_184416
atgacgacgaccgatgccccgtccgcgtccactccctcacctcgcagtttgtcacggtgcacacccgtatactcctttcaggcagtattccatgttgataggaactacattgaggtccccagatcttatcataagcaatgggctccacattaccctgcttatgtgaagatagaatacaatggagcgccgcacatcattaaggttaggaaaaatggtcagcaatactacttggccgatggactgaaacaattcagaagaaacttcaacatacatgaaggtgtattgttgttgcctaccgaggctgtccattttgttgatgcttcaacaccatttatgaccgtgcaacatagcagtggcgttcgtgacatatggaccatctccatgcataatggtgaacaacatgttgatgacccttggaacagattgttaacggacaatgacttgatgggtggagacgaggtcatcttctattaccggcctaacgaacatgtgtgggagataatcttcaggaaggagccgatatgggatgaagatgaagactccacttga

SEQ ID NO: 67639 - DNA, 330 bp, Glycine max
  Peptide Sequence Number=SeqID_184417
atgaaggtggaacgcagtagtcggaggcgttgcctgtggaagattaacgtggaaaacagcgtccgtactcttgccgacccatggtaccagtacttggcggacaatgatttcatgtctggagatgaggtggtgtttgggcttgatgcggcgactttgtgcctttttggtattcctgaacatgaggaaatcatgtggaattcccttaaaatggcaggggtgcagcaagtaatacatgagaaacccagcaaacacactaatagcaaggtgcaattacaaaacaaagcaaagagggcaattgctagacctgtgtacctgcgagactgtgtgtga

SEQ ID NO: 67640 - DNA, 783 bp, Glycine max
  Peptide Sequence Number=SeqID_184418
atggaaaggagttcgtcatcgtacacctccaaggcccgaagtcgcgtgttttgtctgtgtaacatagaggctccactagtgacatcgtggactgaggaaaatccagggaggcgtttttatggttgtggtctatacaaggatagaggtacgaaagggtgtaatttttttcagtggcatgatccagttgacaacaatcgtcaaaagaaaatcattgtagggttgatgaaggaggttgatgaattgaagttgagggaaaaggatttgcaaaccatgattagtgagatgaagatgaaggaaaaatgtttatggattgtattggttgatggtcatgtgttgaccgcaggcatttacatgtggcatggcacaatttggaagggtcgcggttcaccaagcattgactgtgaaatttctattgtccaaacatactctcttgagaacaagaatggcctcccgcagctctggtggtgtagatcggggtccatcggcaaagtagactttgttgtgaagctgtctaactctgatataaaatggtgttccaagatatgtcaagcggacaaagcgagggtatacttgccattgtttgtggaaaaaataaggtacatctatgatgcagatgatgagtctgaagtggtggttgtgtcggttgattggtaccctgagtctgaattcatggttgtatcggtctgggttgactgggagacgagtgttttcggatggaatgcgaaagaactcccaattgacgtcgtgtctcgtgtggtggtgcatgcaattaatgtggagtga

SEQ ID NO: 67641 - DNA, 573 bp, Glycine max
  Peptide Sequence Number=SeqID_184419
atggccagacggaagtcctcaatagggtcattgaacaatacttgcgctcattctttcatgatcatcctaatcaatggttcaagtttcttcccctggcagaatggtcctatgacacatccgtgcattctggcacaagattttctcccttcaaagtcatttatgcattcgactctccagcgcaggctgcttaaatctcagaatgcgatgaagactcaagctgatgctcaccattgggatgtccaattagacgtcggtgactggccttcttacttcaaactctcaaagaggtacaacgggccttaccttgtagaagcgtgtgtcgtcccaatcgcgtatcaactacatctacctcctggctccaagatacaccctatttttcatgtttcactcctgaaaccacatcaaaggcccattacttctgacacctcccctctccctcctctaggtacagtcaatcatccaattgtccgtcctttgcagttcttggattggaagatagacactgcttccactccaccaacccaacaagttttagttcaatgggatgacctcaccccagaagacacttcttag

SEQ ID NO: 67642 - DNA, 453 bp, Glycine max
  Peptide Sequence Number=SeqID_184420
atggtagctggcgctgttgtgttgactaccgggcactcaatgctatcaccattaaggactattttcccatgtcgacaattgatgagctactggattaattgggtcgcggttcttggcttaaccagtttttaccgaaaattcattcgccactatgcagccattacagcaccattaactatgctcctgtggaaagaccaattctcctggtcaccatccgctcagactgcgtttgaccaattgaagctgataatgatgcaagccttggtgttggcgatgtcggacttcaccattcccttcaccattgaatctgatgcttccagcacggcgatgggcacagtgttgttacaaaactctcacccaatcgctttcttcagcaagccattatgtccacggcttcaatgggcctccacatacgtccgagagcttcatgctattacgtcctccattcgttaa

SEQ ID NO: 67643 - DNA, 324 bp, Glycine max
  Peptide Sequence Number=SeqID_184421
atgatagcacaggcccttgtctcatcgagtggccaactcttccgtcgaaaggcgtttaatcgagggtttcgggtttggagggaaggtagtggcagggataggagaagaagggttgggccgataatggcagcgacgctacggcctacagaagggataggggttgaaacgcctgcacttcgcggtggagttcggggtagatcagagatgaaacaactcagcaaggagggtggagctaggctagctatgcggtttgcgaggcgtttgaactcggtgagatactcattcactgagttgtgctgttggagcttgaataaagcgcactaa

SEQ ID NO: 67644 - DNA, 264 bp, Glycine max
  Peptide Sequence Number=SeqID_184422
atggttgaagaatactctggtatgcatttgcaacctcacaagcctcttgttggtgctaatgcatttgtccatgcaagtggcattcatcaggatggaatgcttaaacataaaggtacatatgaaacaatatctcctgaggaaattggacataaaagaaccaccagaattggtattgtgctagggaagcttaggtatgtaaaatactttttactcaaatatgcttatgttagaaaaagcatgactatcaatataagaggaaggtga

SEQ ID NO: 67645 - DNA, 267 bp, Glycine max
  Peptide Sequence Number=SeqID_184423
atggctggttgtggcaaaaccctagggtccagcactgccaaaaaggccacctcaaggagtagcaaagccggcctccaattccccgtcgacctatcgcctaattcctcaaggccggaaaatatgtcgagcgtgttggcgtcgatgctcccgcttacctcgccactatcctcgaatatctcacagccgagagacaataagaagactcgaattatgccgcaccacattcgattggcgatgagggacgatgaagaattaaacaatgcttga

SEQ ID NO: 67646 - DNA, 186 bp, Glycine max
  Peptide Sequence Number=SeqID_184424
atggaaaaagtttcctttgtacttggagctcttctaaagcatgaaaatgaacaaaagaagaagataagtcatgcatgcaaagaaaaagatcttagcttgtcaaagttgagtgttgaagtggctaaagagaggattcaggaagggtgtggcaaggaattgtcagccccttcccccattggtgactag

SEQ ID NO: 67647 - DNA, 303 bp, Glycine max
  Peptide Sequence Number=SeqID_184425
atgccaccaactaaagcttttccggttgcacaggaacctgatgatccacttccaactcaaattagcttccatgccatcttagggcacatggcaccgaaaacgttacgcgtgatggggtctatctctgaccagaaagtcctcattttggtggacggaggtagtactcataacttcatccaggaacgcttggtcaccatgctagggccacatgcacagtctactccaccattacacattatgattggtaatggtatcgagattgaatgtctacaaatttgcaagcacatttcgcttcagctctag

SEQ ID NO: 67648 - DNA, 591 bp, Glycine max
  Peptide Sequence Number=SeqID_184426
atggcaaccaaaacctccactccaagttctcaatccccaaaactctctcatctccgccctcaatacattcccaaccacatccccgactcctcctacgtccgcatcttggacaccaccctccgcgacggcgaacaatccccgggagccaccatgacagcaaaggagaagctcgacatcgcacggcagctggtgaagctgggcgtggacatcatccagcccgacttcccttctgcgtcgaacagcgacttcatggccgtcaaaatgatagcacaagaggttggcaatgctgttgatgatgatggttatgtgcctgtcattgctggcttctgtcggtgcgttgagaaggacatttctactgcatgggaggctgtgaagtatgctaagaggccacggctttgtacttccatagctacgagccctattcacatggagcacaagctgagaaagagtaaagatcaggtgattcagattgccagggatatggtcaagtttgcacggagtttgggttgcaatgatattcagttcggtgctgaagatgctactaggtacgagcctttcatttgtcttactctttttggatcacgtttttag

SEQ ID NO: 67649 - DNA, 1149 bp, Glycine max
  Peptide Sequence Number=SeqID_184427
atgggtgtcacaaaagctttggccagactacaagacaacttcacctggaattctattcgacaggacgttcatgattttgttgcacagtgcctcaactgtcgacacaccaaatatgtgaccaggaaaccagcaggattgtatctccactaccttttcctactcagccataggagaacttatcactcgattttcattgtcgaattaccgatatataaaggaaacaccacaatactggtggttgtatatcgattctccaaaggtattcatttgggccttcttccatctcaatatattgcctatcaagttgccactcttttcctggacatagtttccaagcttcgcggcatgcctcagagcttagtctccgacagagaccccttgtttattagtaagttctggcaagaactgtttaagctatctggcacaaagttacacttaagcttgacttatcatcctcaatctaatggtcaaaccaaggttatgaaccgcataattgagcaatttatgcgtgcctttgttcatcatcgcccatcgccatgggaggcagtggacacattactcaccacatgggaggcagtttttgatagcttacgtcataaattgttaaaagcgcaagctcaaatgaaacattttgcaaacaataaccgtccaaaagtacactatgaaaaaggtgactgggctatggtcaaactccgtcctcaacgtcagtcgtccctaacgggccccaacaagaccaagctcactaaacgtttctatggccccttcaaggactcacgtatccaccttgtctttcattgctcactcctcaagccattccggcatgatgcaagaaatgaacccagcccacttccattacctggaaaggacttcgacaaccgtcctctcatcacccctctaactatcctcaatactcgttgggtagacacaaacaatggacctcgtttacatgtgctagtgcaaagggccagtttaccagttgacgacacatcttgggaatattgggcttcattaaaggagaaatatcaccttgaggacaaggtgatttttgaagggatcaggagtgatagaccagtcaacatgcatgaagcccagcatggaaggcctcagaggaaggtcacacctcatcaacgtttttgcgattacgtttaa

SEQ ID NO: 67650 - DNA, 156 bp, Glycine max
  Peptide Sequence Number=SeqID_184428
atgtgtgcgaggtcaaacgggcgaggtaaacccgtaaggcgcaaggaaagcctgattggtgggatcccccctgttggcggggcgaagccagaggaaactctggtggaggcccgcagcgatactgacgtgcaaatcgttcgtctgacttgggtatag

SEQ ID NO: 67651 - DNA, 747 bp, Glycine max
  Peptide Sequence Number=SeqID_184429
atgccggtgatggccggggtgttcggcccccgaagcagccaaggagtcgcactcgctgggcagcgtgctggccgacatcggctggaccttcgtgcagctgggcctgttcgtggcggtgatgctggtggtcggccgccgggtcattccgtggatcctggagcgtatcgccggcaccggctcgcgcgagctgttcaccctgtcggtgctggcgatcgcgctgggcgtcgcgttcggctcggccatgttgttcggcgtctcgttcgcgctgggcgcgttcttcgccggcatgctgctcaacgaatcggagctgagccacaaggccgcgaccgattcgctgccgctgcgcgatgcgttcgcggtgctgttcttcgtctcggtcggcatgctgttcgaccccaacatcctcgtccagcacccgtggcaggtgctggccacggtgctgatcatcatgttcggcaagtcggccgccgcattcttcatcgtgcgcgcgttcggtcacccgaccagcaccgcgctgaccatctcggccagcctggcgcagatcggcgagttcgccttcatcatcgccggcctgggcgtggcactgcagatcctgccgaaggaaggccagtcgctggtgctggccggtgcgttggtatcgatcatgctcaacccgctggtattcgggctgctggaccgttggcaggccaagcaggagcagtcactccaggccgccgagcccgaagaggccaccggtccctcacgtga

SEQ ID NO: 67652 - DNA, 705 bp, Glycine max
  Peptide Sequence Number=SeqID_184430
atgccttcgccttcagaggactacacgtcctcacctttagaggactgcaggtcctcgccttcagaggactataagtcctcaacttcagaggagtacacgccctcaccttcagaggactacacgtcctcacctttagaggactacaagtcctcggcttcagagggctgcacttcctcatctttagagggctacatgccctcaccttcagagggctacatgctctcaccttcagaggactacacgtcctcgccttcggagggcaacacgccgtcgccaacagaggactacgtgtcttcgcctttagagggctacatgccctcgcctttagaggactacacgtcctcaccctcaaagggcagcacaccctccccttccgtggactactcgctacacgccctcgccttcagaggactacttgtcctcgccttcagagggctacacgccctcgcctttagaggactacacgtccttgccttcagtgggctacatgccctcgccttaagaggactacacgtcctcccctttagatggctacacaccgtcgccttcagaggactacatgtcctcgccatcagagggctacacgccctcgccttaagaggactacttgtcctcgcctttagagggctacacgccctcgccttgcgaggactacacgtcctcgccttcagaggactacacgccctcgccttcagaggactacac

SEQ ID NO: 67653 - DNA, 492 bp, Glycine max
  Peptide Sequence Number=SeqID_184431
atggacagaccagaatatgtttggcaacagacatggcaatggatggcagatgatatcacattcgatcatagaaaacaagatgagcaaaaaactattgtcgataccattatccgtatagttaacactcaatcagctgtagtttacttcctctatggatatggtggaactggcaaaacatttgtttggacaaccttatcatctgctatacgctccaatggtagaattgtttgtacagttgcttcaagtggaattgcttcattactattgcctggtggtcggacagcgcattccaaatttgctataccagtccctgcaacacaaaattcgacatgcaatattcatcaaggcagtgagttagctgaattattaaaggttacaaaactaatagtctgggatgaagctccaatgtgtcacagatttgcatttgaggcactagataaaagccttaaagacatcatgccgaacaatctgccttttggaggaaaaatttag

SEQ ID NO: 67654 - DNA, 135 bp, Glycine max
  Peptide Sequence Number=SeqID_184432
atgcatcaccaaaagaggaaaattctagatgaggcttcattgtcattaagcgagtcggagacccatcatgaccacaaatcaacttccactccctatggctcaaacagacctgggtatatggcccaatatctcaaa

SEQ ID NO: 67655 - DNA, 465 bp, Glycine max
  Peptide Sequence Number=SeqID_184433
atggagatcattcgaacaaaagggaaagattcgcacaagcttggagcgctatccgcagactcaacagaagtcagttgggaaagaaatcagactatgaccaagagctttggcctaccctaccgcttacctagatacctatcgtccaccatcccaccatcatccttgcctatcccctttgatactaaggaagagtttcatgaacaattaaccaaagaaaggcaagaaaaagaaacttggaagaggagatgccaggagctcgagcaagagaatgagactttgaaggggaagatagcccaacagagccgtgagctttttatccagaaccagaggatgattgagaaggacgacttgcttcgtcggaaagacgctttgctccaccgagatgctagaaggaagaggaggtttatggatttgttctcccgtgcacattcagattccgaggatccatctactccgggagtttga

SEQ ID NO: 67656 - DNA, 382 bp, Glycine max
  Peptide Sequence Number=SeqID_184434
atggataggttgacgaccatgatgagtgcactcctgtcagcccagaactctcaagctgccgccgctgctgtagagcagcctttggtgagcacaaccccgctatctacagtgacttctccacccctctttttgcctccaggttgtacatggggaatgccacctccagtctgtggaagcccccagcccgctgtatctgaagttccacctccttttgctcagcagtcagcaccggttccgcaacccagtacctctttccctcaagctgcaatgacttattcagctccactgattcacactattcaacaagaggtcgaaccaattttccaagctgaaaatgttgtagctttcgacaagatggaagaactccaagaaagatttgatg

SEQ ID NO: 67657 - DNA, 270 bp, Glycine max
  Peptide Sequence Number=SeqID_184435
atggcctctggtatcgattaccaagggtggagggatgggtcactggtaatcgattaccagatcgcgatggtggcacagctaatccgtgaacgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggacagctctttggattcgttttgtatacttttga

SEQ ID NO: 67658 - DNA, 306 bp, Glycine max
  Peptide Sequence Number=SeqID_184436
aactttatggattgcgcaataatgcttcctttcggctcccgacatgttgcagaacttcacggattgcctaacgatgggtgtcaagtacctcgaagcggtcaagcgaaggcgcggatgaccataaggtatcttcgcctaccacctgactcgctgtccctggatgacaaaaggtgcagaagacaatgtcagtttcttcgcgtcaacgggctcgtttgcccctggttgacgaaaggtgcgcgtaaccataagggtgcagaagacgacgttagtctctgcgtgctgtcaagtgtggagtcttatagatag

SEQ ID NO: 67659 - DNA, 585 bp, Glycine max
  Peptide Sequence Number=SeqID_184437
atgaatttgctgaaatcgctggctgcggtcagttcgatgaccctgttttcccgcgtgctgggctttgcccgcgacgccatcgtggcgcgcgttttcggggctggcatggccaccgatgcctttttcgtggcgttcaaactgcccaatctgctgcgccgtattttcgccgaaggcgccttttcacaggccttcgtgccaattcttgccgaatataaaagcaagcagggcgaagacgccacgcgggtttcgctgctgcgcgtcacctttccttatattctgctgatctcgctggcgtcgctggccggggcgattctcaacacctggaaccgcttctccgtcccggcgttcgcgcccacgctgctgaatatcagcatgattggctttgcgctgtttgccgcaccgcacttccatccgccggtgatggcgctggcgtgggcagtggtggtgggcgggctgctgcagctgttttatcaactgccgcacctgaaaaagattggcatgctggtactgccgcgcgtcaacctgcgcgatgccggcgtgtggcgggtgatgcgccagaagggcccggcgattctcggcgtatcg

SEQ ID NO: 67660 - DNA, 225 bp, Glycine max
  Peptide Sequence Number=SeqID_184438
atgcagctatttctggtgctgagtgtttgttggtgctttacttgcgtcatttctttgctttgtttttcatgtatattcattctagtatgtgcagctttgtgttctgcatatgaggtggtccctgagggtaccttttgtcctttggtggggttatttgccaggcatcttgcgttccagttcacctttcctcctactgacacttgcacttttgtgttctgcatatga

SEQ ID NO: 67661 - DNA, 207 bp, Glycine max
  Peptide Sequence Number=SeqID_184439
atgacaccgagctttgcctcgatcgatttcgcatcgctcaaggcttggcactgtcgatctctagattttttccatcttaagtgtgggctatatgcccctgttgtggaagctggaggattttcttggcgactcctccgtcgtgatgtgttactccgaccatcaccaccaccaccacttaggtgtgagagaacaaagggacctatgtga

SEQ ID NO: 67662 - DNA, 2109 bp, Glycine max
  Peptide Sequence Number=SeqID_184440
atgcaagcagtcttgatacaccaaggattgggtgatgctttgaaagacaaagctttgagggaagtagcaagggaaccagcagctgcaacaatatggttgaagttggaatcactctacattacaaagtcagtggcaaatctacttttcttgaaacaacaactctattctttcaagatgacagaggaaagaatgttgtcaaatcaaattgctgactttaacaacattcttgatgatcttgagaatcttgaagtaaagatggaggatgaagacaaagctctaatactgctcaatggacttgcaagtaggtatgatcattttaaggatgctatgttgtttggaagggaccaaaccattacccttgaagaagtgcagtcatcaattcaaaccaaggaaatgcaaaggaaacatgaatccaagaaactccatttttgtgatctaatgttgaatccaactcagtttcaggccaaagaagagaaggcaaaagctgttgatgactcgcttagcgagacaaatctgctcagcaagatgcatccgcttagcgaggcatccagctcgcttagcggatgggaaaccctagaaaaggataagatagagatctgctcacctagtgtgctgccagcccgcccatcaaggacccttcagaaactgaagggtctaggagcctttaaaaacactaaagttggcagaaatgaagagacacaacggaagagacggtacaagaagggttgccctgaaaggagaggcaaagatttaaagaaatctcaagaaccagaaaacgtggacattgatcaagtaagttatgaaactgttgatgttctggttgtctcaaattctgagattgagaaggattgggttatggattctggtggagtaatgatgctaggaaacaacaagccatgcatagtccaagcatacactacacaaattgaacatggcatgatgaaaatctttaaagactctgtgatgattgctaaaggaattaaaatgaatggtttgtatatcctagatggttctactattatagcacaagttgttgttgctagtcaaaaccaacatgataacaccaatttatggcatatgaggttaggacgtgttagtgaaaaaggaaaagctaaaagggccaattttggaataggcttgcatgctacaggtagaccttttgaatatgttcattttgatctctgggatcctgcaaggaccatgactcatggtgagcaattcaatgagttttgcaagaaattaggaatccaaaggcataaaataatggctaacacccctcaacagaatagcttgacagaaaggatgaacagaaccatcctaaaaagggtcagatgcatgttactgagcgcggatttaccaaaaactttttggggagaagctattacaattgtttcttacctaatcaatagatgcccttcttctgcattaggttttaaaacccctatggaactttggggtggaaaaccatcatattactcaaatcttagagtgtttggggctttggcttttgcacacatcaagcaagacaagcttggggctagaactgacagatgtgcctttataggatatccacctggaatcaagggtacaagctatggaagatggaaccgggtgaaccaaactgtatcatcagcagagatcaacttagacattactgaagttgaggtggagctaccaacacaaagtgttcaagtcaaggaaacagataatgatcaacaacctgaacctgtagttaacaattacaacttggctagagacagagttagaagaaacattgtgcctcctagaagatatggacaagttgatctaatctactttgctttgacagttgctgaagagattcaagctattgaacctataaactttagggaagccttgaaccacaagaaaagtgaagaatggatcacaaccatggaagaagaaatgctttctcttgagaagaacaaaacctggattctagttgatctaccaagaaatcagagagtggctagattcaaagcaagacttgttgcaagaggtttctctgcttgcgttgtttctttgcctgacagtttttcaagtaatcaagagttggaacatagagaaagagtagtagggttcaaatcctag

SEQ ID NO: 67663 - DNA, 280 bp, Glycine max
  Peptide Sequence Number=SeqID_184441
cgcccctccctcctcccggaagcactcacctcctgcctgctgcttctttccttcttccgcgagaccagcgcccccttcttcttctccgcgagaccaacgttcttctcctcgaaccagttgttgtttgccttcgaggcttcttccggaacttccagaagaaggtgttccggaagatttccggaagaagggttcttccgaaaatactgaaaggtcttccggaaactttccggaagaagtagttcatccgaaaactttccgaaagaagggttcttccggatga

SEQ ID NO: 67664 - DNA, 417 bp, Glycine max
  Peptide Sequence Number=SeqID_184442
atgttaatgtataatgatcaattttcttgtgttggtccgattgagttattatgcactgttggaaaaacaccagatgtaataataaacttacttcaacgcactatgccccgtactcgtgacgcgatcctatattacaacgggaaatggaacatgccaccgcagaacaaatttgttggatgcgcgttcacaggaaaaaatcctaagaaatttcaaattccttcaacatgtcgctttgagtattcagatgcgcttataaaatatgaaataaatgagctgaggactaacgaagaactgctgaaggtgttagtacaatctaactactggaaaaaatatggaccaatagaaattttagctgtctttactaaatatgttgtgaaaatcgaagacgaggtgacagcgacatcgctaaacaactga

SEQ ID NO: 67665 - DNA, 816 bp, Glycine max
  Peptide Sequence Number=SeqID_184443
atggttcatatgtatgaccagttagatgaggcttctaggaccaccacacgacagattgcggggtacctgactctactacagtgctggatctatgagcacttccctagtgtgcaccagtgcgccacagatgatacataccaggaggcgtccccacgtgcttcctggtggctgacgtcgaaggcgcatatgaagggaatcacaggagcaccttacagggcacgttgtgatgctttgaccgtcatggatgtgtcctggttgccatacactgagcatcggggggttagggcctttgagctaatttcatcattccagggtcagctgagatggggtcctatggtggtcacagctcgaccggagagggtggtacgacagtttggttacattcagagcatccctccaccgcctgttagtgctcgattgtcatatgatgatatagatgacaggtggatgcattttgcggagcacgtactacctatgggtgagctttgtctagtgcctgggcaagtatctgcggattacatagagtggtttttccgcatatctcacccattcatgataccgacccaggcaggtgaccagcccagagatgcaccagccgcagaccctgaggagtacatacagctgcccagcccccaggatgattacgacggctatgaggcggttgcacagaggttggagcgtgtgctcaaccttaggatggtcactgcaggtacagagttatatgatattatgcaggattgcttgacgatcgccagagggggagcctgtgctgatgaaagtgtcagggctcgacagagacggcgcacagagcattga

SEQ ID NO: 67666 - DNA, 640 bp, Glycine max
  Peptide Sequence Number=SeqID_184444
gtcaaggaggcaaagagttgggaagtaccggcggccccattttgtgcaagttcaaaacaagcatgccttcccgccatatggcttgcctcccaactatacaccacccaatgttgcgcacactcccgatgagaatgtcaataactccactcccatactcattgagagccaacaacctcaatctgatcatgcacatgtctctcaacccatgggggagacacatgaaataccccaccataatctagtcaactttgagccttgccttggatacgccactaaggagcaagcagttggtggtgtacccttgccaaacactttggagggccctcagtttcgcccacaaccacaaccacaacccttgtattttgcgataggaagaatccctcctactatggcaaaaaggggaaaattggatcatatagaggaaaggctcagggaaattgaaggaggcggagatcatgctcttgctgacatggcaaagttatacctagtgcctgaggtcgtcatccctccaaagttcaaggtgccggatttcgataagtacaaggggactactttccccaagaatcatttgaaaatgtattgtcaaaagatgagggtgtacgtgaaagatgaaaaactgttgatgcatttctttcaataa

SEQ ID NO: 67667 - DNA, 661 bp, Glycine max
  Peptide Sequence Number=SeqID_184445
atgggcaccgttgacggcaagctgtacgcactggatgccgattccggcaagccgtgcgaaaactttgcagataagggcgtgctcaacgtcaaccagtggaatacggttaacgctaaattcccgctgtccctgctccagccgccgacggtggtgggtgatcacctgatcgttgggtgggcgggcaaagactgggcttacgcagaagcgccgccgggcacggtgttttcaattaacgcgcagaccggggcacgtgaatggacttttgacgccatcccggccagcattcgccagcgcaccggtacggctaacgtctggacccacatgtcggccgacgaagcgcatggcctggtttatctgccggtgtcatcaccttcgccaaactactggggcggcaaccgcgtcgatccaattccgctcggcacctctacgactgcgctggatgtgaataccggcaaagtggtgtggtcgcgacagtgggtgcatcatgatgtgtgggattacgacatcaactcagcaccgacgctgatggacattaccgtgaacggcaagcagataccggcgctgattcaggccaccaagcagggtttcctgtttgtggtcaatcgcctgaccggtgaagatgtctggccgattgaggagcgtccggtgccgcagggcgatg

SEQ ID NO: 67668 - DNA, 162 bp, Glycine max
  Peptide Sequence Number=SeqID_184446
atggtgaaggtattggtggcatgcgacggcgctacaaaggtgttggggttgcatgcttcaagagtggtagagcattgcggtgtggatatgggtgacgtaatgaataggcagatctgggtggtggcgttagtggttttggaggttagggaagaagatgactaa

SEQ ID NO: 67669 - DNA, 117 bp, Glycine max
  Peptide Sequence Number=SeqID_184447
atggcacttccttattggtgggacaggaaactgagacagatatatgggacaggtgatttccctcctgatggatcaacgggatctcaagtctcaaacaagcgtgaaacggaacgatgg

SEQ ID NO: 67670 - DNA, 357 bp, Glycine max
  Peptide Sequence Number=SeqID_184448
atggatgtgcttggaggtgtagagcaacaagcatccttgcaagtcgatggaacttggttgtacaaaaagtacaaagggactctgcttgtggctgtttcacatgatgggaacaacaaaatctttccaatagtcttcgtcgttgtcgaggacaagcacgggtcgataaaaaatgcctactcaagatgggttagtgggtggatgccagagaattgtgtgcatgccttggatcttcttcatcaatggagtcctttgcttcttgaagatcaatggaagcgaaatggagaaggagaaaaggtaggagaagatgaatcgagggagagggagagaaaaagcacgaaattttgtgcctcaaatgag

SEQ ID NO: 67671 - DNA, 384 bp, Glycine max
  Peptide Sequence Number=SeqID_184449
atggaatcccagtcaaaggtgatggtttttggtataccatggagatgccaaatctttattgaaaaacaggaagccaagtcaggggaagcaaacttggaaggaaggccgataagatgcactgacttgttgagcctatcacaaacaaaccacaccatcgtgtgtccaaaagaaggagggcgagtgacaaaatcctctgtcagttcttcccatactctatttggaatagaaaaaggttgtagtaatcccgatttcttttgtggtagcaaggaagggacaggggaggaagttacagaaaagagcaatgcatcatcagaaaactgccttgagagagcatccacaacaattgttgttttttccagtggaccttaccctcaaggtcgttaa

SEQ ID NO: 67672 - DNA, 630 bp, Glycine max
  Peptide Sequence Number=SeqID_184450
atggctagtagttccattagcaaagttggtactagtaacagtagtcttcgattggagttggtggagttgctatgtgggttttgggttgggtgtctcatattaaagtttggagacataattgcatgcaacggtggtgatagcgatttccatcgtttgtgtgatgatgagcttaggcaccacgagggttgcatggaagagatgatggaaaacgtagcttccatgaacaacatgaacttggtctcgtcagcactgtggacaaccttggtggtttctcttaagcacaagagaagggtattgagctataaggggtgcgcaaacacaaagtgtgtaaggaagagaagcatgatctctgtgaagacaagtggcattgatgggtttgtggtagatgatggtggcaatggaatgaaaaaggggaaatgtttagtgatggtggcatttgtggtggtggcagacattggcagtggcgttgctaggtgtgatgacatggcagttgtggaggcaatgatggttggggcggtgacgattgctgttgttgaaaatggaattctaggtggtggttgtccgttatgtgcaacaacgatgatggtgtttgcaccgctgtgtgggcatagggataaggaaaatgtttga

SEQ ID NO: 67673 - DNA, 1011 bp, Glycine max
  Peptide Sequence Number=SeqID_184451
atggatcaattgtcggcgatcagcgaggacctggccgagatcgacggacacatcgccgacaatttccgcgccctatcaaatggatttcagaagttggagaagattaaggattcgaatagacagagcaggcagttggaagacctcacggaaaaattgcgagaatgtaaacggcttattaaggagtttgataaagaagtcaaaacattggagagtagctttgatagagaaaccaacaaaatgttgaatgagaaaaagcagtcaatgatcaaagagctaaactcatatgttgctttgaaaaaacagtatgctacaaatattgagaataaacgaattgaactctttgaggggcccaatgaaggttatgcagaagaaaatggcttgctagcatcctcaatgacaaacgaacagctaatggatcatggaaatcggatgatgaatgagacagatcaagccattgaaaggggaaagaagtatattcttaacttagaccaagtagcaattagcgaagaagttatccatgtagttcaagacaccataaatgttggtacagatactgcagcagctcttaaggctcagacggaacaaatgagcagagttgtcaatgagctggattcaatccatttctctataaagaaagcctctaaattggtcaaggaaatcggtaggcaggttgctactgacaagtgtattatggcacttcttttccttattgtcattggagtaattgcaatcattattgtaaaggttttgatggccttctacagatctacagtctctagtttatgcatttttagtgtcacgtaccaagtatgtttggaaaggattgtttttgccactacagtaccaaaagataaaacttgtcccagtgcactttatttgaaaggagtttcgtacttcatcctccgaaatgctggtggtgttcttgtgcacccagaaaacaaggacattcgcgacattccaggactagctcctccagttcagaaccgaagactgctctggagtcacagttga

SEQ ID NO: 67674 - DNA, 663 bp, Glycine max
  Peptide Sequence Number=SeqID_184452
atggcaaataacatggttacgatggtattcctcatattgatgttgatttcatcaatcactccaacagaaattgatgcaaggaatcaagacctcgttgcagccactaaggagatgcaaaaggcaaattactttacatttgtaatgctcatcaacatgtctccacttgacacaattgagggaaatgtgacattcttgatgcccaatgatcgaatgctggctaacatggtcttacaagaagggtccatttcaagcttcttacttaggcattcaatcccatcaccaatgctctttgatgtcttggaacaattccccacagggacaaccattcccacatcactgccaaattgcatgctaagagtctccaacaatggtaggaagaattatgttctaaacaatgttaaaattataagtccaaacttatgtgtagcaggatcctcaattcgatgccatggcatagatggggttttgtcagaagtgtgtgcatcaatagcttctcctcctagtactagagacaacctcaatcctcctacattggcagctcctcagccaacaacactgaatattgggccacacaaatcagggtctccacattggttttcttacgatggatcattgaattttgtagcatgcttgatgttgtatctgactgggatatacttttaa

SEQ ID NO: 67675 - DNA, 822 bp, Glycine max
  Peptide Sequence Number=SeqID_184453
atgtgggagcagctatcagtaggtgaatccaaaaccctagccctcactctcaccaccattttttcaattcttgagctatgtttcagggataatagggcagggatgtacaaagaacgagagcgaggtggtgtttccgtttccgcctctaaatccgaggatcggaagcgaatcaacgacgttctcgataagcacttggaacgatcctctccttccacttcccgccccatcaacaccgcttccaagaattccaacctccaagtggaggaatctgagacggagagtgaagagtctgatgttagtggctctgatggggatgacacctcttggatctcgtggttctgtaatctaagagggaatgagttcttttgtgaggtggatgatgattacatacaggatgactttaacctctgtggattgagcagtcaagtgccctactttgattatgcccttgatttgattctcgacgttgagtcatcccatggtgacatgttcacggaggaacagaatgagttgattgaatcggcggcggaaatgctttatggtatgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaaacattgatggagcttactttggaacaacatttccacacctcttcttgatgacttatggacaactgaagccacagaaaccagcacaaggctatgttccgagagtttttgggttcaaagttcacaagccataa

SEQ ID NO: 67676 - DNA, 189 bp, Glycine max
  Peptide Sequence Number=SeqID_184454
atgacaccacttttaatgatgaaatcctacctcccaagggcattggatagaagactccaagaagatttggtcaaatattcaggagaaggccctagggttctcatgagccttaagggttccatagtgtatggagggtacactagtaatataggatttttctgcccttgtattttagggtacctagactag

SEQ ID NO: 67677 - DNA, 468 bp, Glycine max
  Peptide Sequence Number=SeqID_184455
atgtttatacttgatacttacttctctcattctaagcaggacgcacattctgctgctgagaaagcttacaatatggcaaaggtggatgacggggtgaataaagtagtggctgcagctaataaagcagcaaacacagccagagatgcagctgtaaaggctgtgcaaaataggatgcaccataataataatatgcgaaagcaaaggaagcagaatgaatgcaaggaaggagaatcacaaagatgtgcaaaaaaatgctacgaggtgcctgcttggaaccactttctgtcattgaactcaatggcagattgtggagcaaagttaaagatttgggaagctcaatttcgttatcatttgtacgatcagacttacacatcaaacaacgataatggaggtgacatcgcaacaatttctacaggaactcatgccaaaggtgtcaaacaggctggttcataccaatcaccaggctaa

SEQ ID NO: 67678 - DNA, 963 bp, Glycine max
  Peptide Sequence Number=SeqID_184456
acttgtgctggaaatgggattggtgacagtacctccttgattccagaatcctccagaagaccaagcctctcctctctgcaaataccagcaaggtcagtggaaaatgcattatcatcttttaacaagacagatggtcctacattgatatcaagtgcaggttccagtagagggctacccccaaggccaaattcagccagtgccatcaagtccaccatgagaactttactctctgagaggagctttagggctaagaattcttcacaggatagtgaaaggactgttctgattgttcctgatgcctcaccatctgatggtcctgtggataataagccttcgacttcgcggtccctttctcttaacaagtttttgttcgcttcttcaaccaaagcaggacattcgttgccggttaccccaactgcaaattcaggtgtagagaatgtacatggaagacatctagggtgtgattctgatttaagtaaagtgaaagtaaatcagcacatgactcgatctgtttcggttccagttaatatcaaaactgctaatttaaggcatacagattctagaaggctggttcgtgtaatttctgtaagatcacttccaggcactagtggtggcatttcagctgacaatgctttgggatcagagattgtcaatgaagatgcttctgaggatattccggaggaagatgcagtttgtaggatttgtttggtggagcttgtggaaggagggaatactcttaggatggaatgcagttgtaaaggtgagcttgcacttgctcaccaagactgtgcagtaaagtggtttagtatcaaaggaaacaagacctgtgatgtctgcaagcaggaagtccaaaaccttccagtaacactcttgaaaatttctaatccccaaactgttactcggcagccattgaatgcaccagaaccacaacagagagaagtaacttcttacaggcaagcttaa

SEQ ID NO: 67679 - DNA, 1062 bp, Glycine max
  Peptide Sequence Number=SeqID_184457
atgcatcaccaccacaagccagagcttcacatcggaaaagagaacccccacctctcttccgatgacgccgccacttcaactccacaaacccatttctcaattcaggtttcaccttcctcgccccatccacctccaccaaactcaccaaacacgccgttccaccatgaacgcttctccaacaagagaataatacccatcatgactttccctctgttccaaacaccctttggcgcaaagtttccaacttccaagcttctcccgcgtttccgcttcctcctcttcctcccccttccttccctctacctcctcttctcaaaccctagccccttagatttcttctcagttatcgctttctcagcagcactcttcgtttccctcaatttggcactgtctttcttcactcgattgttccccaccaaattctcatcatcatcatcatcctcttctcctcagcctgttgtatggtctattgggtcgaaccctaagcaagtaaagaacacaaattgggggtgttgggtccaagtttacagcaatggggatgtttatgagggtgaatttcaaaaagggaagtgttgggggagtggggtttatcactatcacatgcatgggaggtatgagggaggatgggttgatggaaagtatgatgggtatggtgttgagacatgggctagagggagcaggtatagagggcaatatagagaaggtttgaggcatggaatggggatatataagttttactgtggggatgtgtatggtggtgagtggtctaatggacagtgtcatgggtttggagtccacacttgcattgatggcagccgctatgttggggagttcaaatggggagtcaaacatggacttggacagtaccatttcagttgtgccttggtgacttgttggtcatgggttcgaatccggaaacagcctctttgcatatgcaagggtaaggctgcgtacaacatccctccctcataccttcgcatagcgaagagcctctgggcaatgagtagttattgtaaaggtcgattaaattaccatatatggaagtttgtgaatgaacgatag

SEQ ID NO: 67680 - DNA, 180 bp, Glycine max
  Peptide Sequence Number=SeqID_184458
atggttgattctagacatggcaacaggacagggacgggaattgcctcaccaatccccaatcccgacttctcaacatactcctgtatccattttcgatactcggatggatacatggatgaatatgggtacgggtatgagacggataataacatcccaaattctaacctggaccacgattaa

SEQ ID NO: 67681 - DNA, 180 bp, Glycine max
  Peptide Sequence Number=SeqID_184459
atgactgcaaatctatggcctgaaacgtataacatcgacaccagtgcagaaacaagaactctacctaaaaacagtaacagaacaacaaaggagatgttgaggggaaatctcacaagcagcaaggtcagaaacagcaacaagcatgcctccaagcaaacaaaagagaaatggatcaaatag

SEQ ID NO: 67682 - DNA, 798 bp, Glycine max
  Peptide Sequence Number=SeqID_184460
atgggccgatatgagtgggccaagagaaggaaacgtccctatataaaagatggagcagaagaaagagacggtgacgacgacgacgagggaggaagcgaaagagagactatcatatgtttagagaatctctactttttgcgcgctctggaatccaccgtcactctcccttctcaacgcaaggccatcttcagcgaccttctctcaagagacgttgctcttttcttagaacgatacgggtccaaactcgcgtgcagtgagcttaacgaattcgattcgatgaaagacggttatgaggttaattggcacgtgaagcggttaaggagcataattagtccgacgtcggaggagctgaggatgcggccagtgacggtgaagaatcggaggcgcgcctgcttggacaaactgctgtgccaagggcattacttctccgaggatgcaatgagggagagagagccgtatctgcatcatgagtacgtggggaggtttcaggaccagagttgcagacgcatggcgaggccgggggagcggtggtccgagacactgatgaggaggtgtgatgagacggagctggttgtgaagattagagggggagcagcagaggatgggcgtgccgtagagggactgggttggaggaggaggaagacaaagaagaggaaactcaagaggaggtggaagtggatgaagacaggagaagaaatagtagcaatggacaaccctgtagagcttcagtgttgtgtgatccatgtaattgatctcacttggtgggataataatactattgctcttgttcttgtttaa

SEQ ID NO: 67683 - DNA, 1811 bp, Glycine max
  Peptide Sequence Number=SeqID_184461
actatcatgggaacgttccaccgaagaaattctattggggaagcttaaatttgctttgaggaatcaccaggtgcaagaagcatgggaatcatttcatgattttagaagcctttatggttaccctgagattgttagagagaaatcaggtttacttcatgctgatacgttaaccaaacttgcactgtctctagctaggttgcaaatgacatgccctgcctcagtggttcttagattgatgcttgacaaagggtgtgtgccctctatgcatttgttgtctttggttgtttttcatattgcgaagacagaaattggaacatatcttgcatctaattatctgtttcaagtttgtgatttttacaattgcttgaatgataaaaagggtaaccatgcggtcaaggtcgagctggataccttggtctttaaccttgttcttgatgcttgtgtgaggtttaaattgtctttgaaaggcctgagcctaattgaattaatgtcaatgactgggaccgtggccgatgcacattcgattgtgataatttcacagattctagagatgaatggtttgagagatgaactgaaggaattgaaagatcatattggcagagtttcgtctgtttatgtttggcactatcgtcagttttatgatagtttgttgagcttgcactttaaatttaatgacattgatgctgctgctaagcttgttctggatatgactagctcgcataactatgatgttaaaaaagaatgtgagaaacatttgcaaaagccttgctttattgccattggatctcctttccttaggactgtcttaaagatacatattgaacctgagctactgcataaggattctgtccttaaagtggaaagcagacaagatcttattttctataagggtgggaaactagttcttagtaatagtgctctggctaaattcatcagtggttacaagaaatatgggaggattggtgaactttcaaaacttttacttagtattcaaggggaactaaattcagtggcagggtccagtttgtgttctgatgtaattggtgcttgtattcagttaggatggcttgagtgtgctcatgacattttggatgatgttgaggccactggttctccaatgggccgggatacatatatgttacttgtgtcagcatatcagaaggggggaatgcaaagagaaacaaaggcactactgaaacaaatgaaaaaggttggtttggacaaaggattatctgatgatgctattgatgaacacaacctctgtgaagaaacattaaattcacttggtaaagctgatttggcaatcgccttggttcaaatattgaaagatgaagatcagacagtttttcctttggtgtataacttaaattcttccattttctttttctgcaaggccggaatgatagaggatgcactaagggcatatagaagaatggtcgacatgaaaattcaacccacaagtcaaacttttgcttttttgatgtgtggatattcttctcttggtatgtatcgggagatcacaattttgtggggagacattaagagattcatgaggagtggcaatttagtgggaaatagagatctgtatgagttactgctgctaaattttcttcgaggtggttacttcgagagagtgctggaggtcattagccatatgagagaccataacatgtatcctgacaaatggatgtacaaaaatgagttccttagacttcataagaatctttataggagcttaaaggcatcaaatacaagaactgaagcacaaagcaaacggcttgagcatgttcaagaatttaggaaatgggtgg

SEQ ID NO: 67684 - DNA, 336 bp, Glycine max
  Peptide Sequence Number=SeqID_184462
atgaagactgatctcggtgaagccgaagccgagatgccgaagacccacgaagttgggtttgacatgagtctccaccagaaaagaggaagcctttttaaactaaaaagccacgttctctctcctcactcagccaaaagaattcagaagcttttctccctcattctcacgttgctttttctccctttctcctccaccattgaagcctccatcaaagctccaaactttgctcaccatttctgctccaaatcgcaaaaggaagccattttcggagtcgtgaagcgcacctctacgttgtgggacttcaaatttcagaaaactgataaagatgaagggtag

SEQ ID NO: 67685 - DNA, 438 bp, Glycine max
  Peptide Sequence Number=SeqID_184463
atggtcattctttataagtttcctaaaggccttcactgcaaagccttggtggatcttcccttttccaagactccggatgtaatgggaaaatttgactatcgatttatcaagaaagctcaagccgagaaggttcctcctcctcctccttctgttattactagaatttccatccaagaaagccatgggcctctgagtggagggccttcaaagaggcaaagggtggagttgataccggttgccactccttctgtcattgagagtctcaacgccttcttggaggttgttccttgcacgccaatggattacattgcttgtttcaccaaattctggggcgatgagtttgaaagggcaaatgtcgagtgtcagagggcacagtctgattgtgccaaggttgaaaaagccttggttaaagccacacgttctaatgagatgtgctga

SEQ ID NO: 67686 - DNA, 297 bp, Glycine max
  Peptide Sequence Number=SeqID_184464
atgtgggtttttgggagggtgataggtggagatggaaccttaagtggagaaggaggtgcctttcccccgttttgtttgaaactttcttccgcgaccaaaagccttcttcttcctccttcgatttcttcttcttcttccgtgacccaaagcttcttcaccttcgagttcttcttcttccgcgaccagagctccaagtgtccagcagtcttctccccgcgtccaggtcttcttctccgcgcgcgtcgtcctccattgccggcatttgaagctttgaagcattcgtgttacgccctatag

SEQ ID NO: 67687 - DNA, 438 bp, Glycine max
  Peptide Sequence Number=SeqID_184465
atctttgatttatttgatgtcaagaagcttggagtcgttgacttcgaagactttgtcagatctctcaatgttttccacccaaatgcttcattaaaagacaagatagctttttcatttaggctctatgatttgcacaatactggctttatagagcgccctgaggtcaaggaaatgttaattgcacttctttttgagtcggatatgaagttggcagatgatgtcatagaaacaattcttgacaagactttcgtggaagctgacctaaagcaagatgggaaaatcgacactgaagagtgggaaacttttgttaaaaggaatccgtcagtattaaaaatcatgaccctaccttatctgagggacataacaatatctttcccaagttttatttttaacagcactaacgtggaaagggttgatgaaacaagtacaaggctttag

SEQ ID NO: 67688 - DNA, 288 bp, Glycine max
  Peptide Sequence Number=SeqID_184466
atggagaatgtcatcgataggacaagacgtgaagcagagaattcgaaaaaatttgctataaagaggtatgagggaaagtttgcagagggaaaatttaatttgtttgttgaaacggtcaatataaaaagtgtaggagcagatgtcaagttcagtgcatcttttctcgggagtattgccgagtatgttgatccagggttgccattcatatctctcagtaaaggcctacagttgaatactctgaggatgatgactcaaattattcctcaagcactacggaatcctcgctag

SEQ ID NO: 67689 - DNA, 126 bp, Glycine max
  Peptide Sequence Number=SeqID_184467
atgtcatctgataatcaacggcagctgctggaaaatacagtggtttgtggtgacacttcttctatggtaggttttgaagagagatttcagaaggaatctagcttaagttcatctgcttctcgttga

SEQ ID NO: 67690 - DNA, 381 bp, Glycine max
  Peptide Sequence Number=SeqID_184468
atgccaaaaaatcaaattttgatcgcgttttcgaagtgcggttaccttgttgggagatgggtgaaggagggaatggaagttattggacagagtggtggagaaaggttgggaatttcgtcaaacagagaaaagggtgaagcttcgagaaaggatggcagaggaacggtgggtctacaagtgaaggggaagaaacctgacagaatcataagttcaaacttgaatttcattgggaaacttagcctcgatgctagtaatggaaacaccgaggtttacatgaatggtcgagagatcacaatacttgaattgagggtactcaaggatgagagcaattcaaggagctctaatagtagcttccttaaaatacatcttaaaacggtttaa

SEQ ID NO: 67691 - DNA, 207 bp, Glycine max
  Peptide Sequence Number=SeqID_184469
atggttcgaatagttgcatgtcttccatggtggcattgccgaatgaaactaccagaaaatgcacaacaactgccacttgcagacatggagaaatcaagtgaacaagaagaagcaaagggtagttacaagcaagacaagaagaagcaactgagcgtcagaggagaagaagaagaagcaactcagcgtgagaaaccagcaacttcataa

SEQ ID NO: 67692 - DNA, 348 bp, Glycine max
  Peptide Sequence Number=SeqID_184470
atgaaatggtgtttgaggaccaaacatgggactagtcagcatcatttaaggcgaggttgctgttgtgaagaagcgaaaactttgagcccttgccattcacaagttgatcacggttccccatccatacgacggttgtgtttcgtgtttggccatagggttcggaataccaaacgacgaaggaatatgcgttttcgccaacggcaaagaaaccagcagagagcatgccgtttggagagatacagggcaacagtgttttgtaaacctatttcctatgtcactgacaacaaaacacttgttgcgtattggatttcttggcatggccaaaccctgaagcctagaaatatgtga

SEQ ID NO: 67693 - DNA, 177 bp, Glycine max
  Peptide Sequence Number=SeqID_184471
atggctagatgtgttggcatagagccttgtacacttgtgatggatttggagggtactgatggaagagaacgtggaaaggtcatgaagagattgtttagtcgatgcaaaacaacaatattgtttgtcatacgtgataagacaaagatatgggactctattcctagaccagatgcttaa

SEQ ID NO: 67694 - DNA, 414 bp, Glycine max
  Peptide Sequence Number=SeqID_184472
atgactatgcagaacaggcagtttcaacaagagaccagagcctccattcagagcttaactaatcagatgggacaattggctacacaattaaatcaacaacagtcccagaattctgacaagctgccttctcaagctgtccaaaatcccaaaaataagcagcacatccctcctcttccattccctccaagagcagtttccaacaaaagaatggaagaggcagagaaagagatcttggaaacatttagaaaagtagaggagttgtgcactaataagcggaagcttaaaggaagtgaacaaattagcatgggcagaaatgtctctgcattgattggtaaatctgtcccccaaattcctgaaaaatgtaaagatccaggtcccttgcagtcaactgatgtggttaattcatttagctaa

SEQ ID NO: 67695 - DNA, 453 bp, Glycine max
  Peptide Sequence Number=SeqID_184473
atgacaaaaattcccttcagcgtttttgccaaacttcttccgttgacactcgcggaagaaatgttccgcgggcatcaacggaagaaccttcttccgtcaactgcggaagaaggttctttcgttgatgcctgcgaaacatttcttctgcgagtgtcaacggaagaagaactgcggaagaaccttcttccgtggaactacgcggaagaacttcttccgcgagagtcaacgaaagaaggttcttccttacacacactccagtcacacacttcttcctctctccatttctctaactctgaccatgcaattggcgttggtctcattgcattctctgtagaaatgacaaacatggctaaaggaaaaggcaaggaggtcgccggaaaaggttctgccgacaagcacaagggcgccttcgacgatgacaagaccggtggcggccgaaagagaaacaagtga

SEQ ID NO: 67696 - DNA, 147 bp, Glycine max
  Peptide Sequence Number=SeqID_184474
atggtatcgactatggacttgggtggtggcgtcgcgtgcatgcgaagggataggtcacccaccagctatggtgtttgggtcgtggatgttgttgtagctgcttctgttggtgacaagattggggttggtggtggtggaggatgttga

SEQ ID NO: 67697 - DNA, 664 bp, Glycine max
  Peptide Sequence Number=SeqID_184475
acaatggaattcttccggaagaagcttcttccggaaacattccggatgacgttcttccggaaattgtctgtgagtatttccggaagacacaaattattcttccggaagaagtttcgccacttcactgtttgctgggtgccccagcaataatgctgggtgcacgtagcaactcccccaatcttattgttctgccagtagctattgacggcataggaagcatggaccggcaaagtgttgggctggaagcacattccattaggctgaatggacttgcaatctgcgccagacccacaggcagggcattgctttgtgcacccagcacaattgctgatacacccagcacaacacaatgcccccataggcatagtccatggcctcttgaattattgggtcaggaactgtgggctttgccgcacaccaaagtgcgtattgtggtggtggaaggtgcactagtggtgatgggcttggagcatgctttggtgggcttgagggataaggttgagaagaaagggttaccacctatgcttggaggtgtcaaatttagaggagcaatggaacttgacaatgtaggttgtggtgctagtgaattgaaaggtggtaagggaagggaagagggagagccatatgaattatcaaggtttgagtacccatatgaatcatcaag

SEQ ID NO: 67698 - DNA, 291 bp, Glycine max
  Peptide Sequence Number=SeqID_184476
atgcaacagggacatgcatacatccccatagttaggttccttaaccccaactatgagacctctctcatttacgttcgtcagtccaaatgcaaggttctcagagaagttacaaaagaaaggattgagagatttttctccaccgaatccttgaggtggattctaaggattccgcttcgattaaaatgttcctcttggtgtggtggtttggcgacaagcaacggtggctcgtggtggccatcggtggttgtgggtggtggagaagaaggtgttagggtttgggtgggtgtttag

SEQ ID NO: 67699 - DNA, 375 bp, Glycine max
  Peptide Sequence Number=SeqID_184477
atggcgacacccaacaacaacaacaacaaccccaacatcatcaacaacaacaacatcgctacggcgaaaccaggaaccctaggcgttggcgtgggtgcggtccctactccgcccaagtcccagcgtggccacaacaagcccaagtgcaaacagtgcggcaatgtcgctcgttcaagatgcccctacgaatgctgcaagagttgctgctctagaaatcaaaacccctgtcatatccacgtcatggttgtggttttgttacgattcttgacattgccggaaattgggggcaaatgcgaatacaattgtggtcacaatgtggttgtggcaagccccaaaaccttgatattgcagctggagtcatctactcttatgtag

SEQ ID NO: 67700 - DNA, 249 bp, Glycine max
  Peptide Sequence Number=SeqID_184478
atggtgagcagcaaaacgaagaagaagaacgcgtcgcaaggtgaagacgaacggatgccgaggtcacgcaggaggagaaagaagcaagaggaagaagaagccgaaggtcacataggaggaagaagaagtcgaaggaatgcgcagaacaagtgttgggtgataaggaagaaggtcgcaaaacaagaagaaggaacgcagaagaagatgaaaagctgggtgcaaaactttttaaaaaataagcagggataa

SEQ ID NO: 67701 - DNA, 225 bp, Glycine max
  Peptide Sequence Number=SeqID_184479
atggcgttggccactaccactcctccgcaagaccatcctgctcgtgtttatgccgatggcatttatgatctctttcactttggccatgcacgctcccttgaacaagctaagaaatccgatgcagtgacccacaagtacaaaggcaaaactgttatgacagaggacgaacgttatgagtccctccgccattgcaagtatcatatcactgttacttttattttctaa

SEQ ID NO: 67702 - DNA, 681 bp, Glycine max
  Peptide Sequence Number=SeqID_184480
atgagcagatgggtggatgaagtcattccagatgcaccatgggttatcaatcaagagtttcttgacaagcacaaaatagactatgttgctcatgattctctgccatatgctgatactagtggtgttgcaaatgatgtttatgaatttgttaaggctgttggaaaatttaaggaaacacaacggactgaaggtatttctacatcagacgtgatcatgaggattgttaaagattataatcaatatgtgctacgaaacttggatcgtgggtactcaagaaaagatctcggtgtgagctatgtgaaggaaaaacgactaaaggtgaataggaggttgaaaactttccaagagaaagtaaaagagcatcaagagaagattcaaactgtagcaaagaatgttggtatgcatcaaaatgaatgggtagaaaatgttgatcgttttgttgttggatttctagaaatgtttgaagaaagttgtcataagatggggactgcaattagagatcaaattcaaaagaagttaataggtgaacaatcaagtgatgtatcatttcttcttcaaaatggcaaggacaatgaggatgaagagtattattattatgagggtgatgatagtgatgaagaatattttgatgatgatgagcttaatcccttgagtaatgtgaaagaccaaataaaaaagtag

SEQ ID NO: 67703 - DNA, 318 bp, Glycine max
  Peptide Sequence Number=SeqID_184481
atggagtatcaaaaccaaagggccaaggagggtagattctgtgagaaactcaagatcaagaataaaccaaagtttgtaggagtgagacaaagggcttcagggaaatgggcagcagacatcaaagacacatcaaagaagattaggctttggcttggaacttatcaaactgttgaggaagctgcgcgagcttatgatgaagatgcccagcccaatacgcgcgctgcgcgcgcgtcacgcgctaagcccatgatccaacagaagcgcgcgctaagcctgcaacacgcgctaagcccgcgatctaacagaagcacgcgctaa

SEQ ID NO: 67704 - DNA, 801 bp, Glycine max
  Peptide Sequence Number=SeqID_184482
atggttaagactagaggattaggccatgcgttaggtagggttgttgccagaggtctggggagaggggatggtgatgattttgacggtgctccccagcgccgaaggccgaccgcatcggcacaaaggcgacaggtacctatcattgttgacgatgttgtgcctacggtacctgtggactcacctgcagtaccagaggcagaggctgttgtagttggggatgagcccatggaacgtcctgagttgaagttatcctcccatgggaggaaggtgcataacttgggcatgcctgttcctgcaattgaggacatggttgctgggacaagattaagtcctttgatcgcgtgttcgataaacatcggtgatcggggacttatatcctcctttgttgagaggtggtaccgggagacttctagtttccatcttcttgtgggggaggtttcgatcatgctggacgacgtcgcgtctctttcccatctgtcgaccgttggcacattccatgacttccagcctctgtgcaccgacgaggcgatgctgctgttggttgagttgttgatggtctcagcagaggtgcccatggctaagacaggtcaatgtggtggaccatacgccctgcatgacctcactcttgctgggcagtatgcatggggagctgctggcctcgtccatatatacgatcagcttaatgattgttggatatacgaacacttttcgtcagttgcggagtgcaatgctgatccggactacgacgaggtgtcaccatgtgcgtgtcggtggattgcgacaaagaagactctgaagaag

SEQ ID NO: 67705 - DNA, 1227 bp, Glycine max
  Peptide Sequence Number=SeqID_184483
atgaccaccacgttgcaccaccctcataacgtttccgtggtggaaatttcacgttccggtgccaccaagaagcgcgacaagagggttgttggcattgttgtggattctgtttctttctttgtggctttcacaatattcttggggtatgtttttgttcggagatggaagattggtgggagaaaagagagagagaaagacaagttccagaagagtggtttcgtggcgtatcctagggagtttcattacaaagagttgaagtctgctacaagagagtttcaccctattaggattgttgggcatggatctttcggagcagtgtataaggctttctttatatcttctggaaccatcgctgctgtgaaaaggtcaagacattctcacgaagggaagactgagtttctggatgaactcaacaccattgctggtttgaggcacaagaatttggttcagcttcaaggttggtgcgttgagaagggggagttgctgcttgtgtatgacttcatgcccaacggaagcttggacaagatgctttacaaggaacctgaaagggggaagcttttgagttggtctcacaggcaaaacattgcactagggttggcttctgtgctggtttaccttcaccaagagtgtgagcagagagttattcacagggatattaaggctgggaacatattgctggatggaaatttcaaccctaggttaggggattttggattggcaaagcttatggatcatgataagggccctgtttccactttaactgctggaacaatggggtaccttgcacctgagtatcttcagtatggaaaagccactgataagactgatgttttcagctatggggtggttgtgcttggggtggcttgtgggaggaggccaattgaaagagaagggtctaagatgttgaatctgattgattgggtttggcgccttcactctgaaggaaaagtgattaaggcagctgataaaaggttgaatggggagtttgaggaggaggagatgaggaaattgttgattttggggttgagttgtgctaatcctgatagtgctgagagaccctccatgaggagagtgctgcaaattctaaacaatgaggctgcaccacttgctgtaccaaaagtgaagccaacactcaccttttcttctgacctacctctgcctctcactattgaggacattgtttcagaggctgatcaagagtctatgtgcgagatcaaaattgactga

SEQ ID NO: 67706 - DNA, 558 bp, Glycine max
  Peptide Sequence Number=SeqID_184484
atggtgaagctcgatgcttccttgagtggaagccgagaagccaacgtagacggggtctctgaggtgatgagaaagatcgaacttgacagagaggagagcgatggtgttgccgctcttgaggtcgatgccgtgcaagatggggtctccggttacgagggacttcatggagtccacgtcgaagcccacgtggttctcgttcgggtcgtcagagcgcgtgtcaaattcgatggcgacgaagccggtggcggtggggaggccgaggggttcggagagggagagggtggtgttgggggagaggaagaaggcgaggccgtcgccggaggaggtggggttgaggttgtggatggagaaggagaaggtggtggagaaggaggcgtggaagagggagacaggttggctgtagacaacggcgccggtgctggaggtgggggcggcgttggtgagtcttacgacgccgttgtttctgagagaggaatcgccgaggagggtgatgttgttgagagtgaaagaagggaagtcgaagctcacgttgtctgctactgccacctcccacaataa

SEQ ID NO: 67707 - DNA, 318 bp, Glycine max
  Peptide Sequence Number=SeqID_184485
atgaagcttaaaagaatgaggcataatatcttagtgagtcctctaaggactctaggtccagctcgcctaggcgagcacattgcattagcactaagtttcaggcgagctgcctttgcctcaagtgcccattttcctataaataggcgtgctagggagactgaggaagggttccaaggttcagaaggtgaaggaattgagagaagagagaaagaagaagaagaaagaagaggaaacgaggctgagatgctactgaatcgtgatcgtgatcaatctctacgttgttcctcattcggtgttcttcgtgcgaccattggttag

SEQ ID NO: 67708 - DNA, 882 bp, Glycine max
  Peptide Sequence Number=SeqID_184486
atgtcatccatgaactgtggaaaaagtttttatttatcaaggaagactgagtttctggatgaactcaacaccattgctggtttgaggcacaagaatttggttcagcttcaaggttggtgcgttgagaagggggagttgctgcttgtgtatgacttcatgcccaatggaagcttggacaagatgctttacaaggaacctgaaagggggaagcttttgagttggtctcacaggcaaaacattgcactagggttggcttctgtgctggtttaccttcaccaagagtgtgagcagagagtgattcacagggatattaaggctgggaacatattgctggatggaaatttcaaccctaggttaggggattttggactggcaaagcttatggatcatgataagggccctgtttccactttaactgctggaacaatggggtaccttgcacctgagtatcttcagtatggaaaagccactgataagactgatgttttcagctatggggtggttgtgcttgaggtggcttgtgggaggaggccaattgaaagagaagggtataagatgttgaatctgattgattgggtttggggccttcactctgaaggaaaagtgattgaggcagctgataaaaggttgaatggggagtttgaggaggagaagatgaggaaattgttgattttggggttgagttgtgctaatcctgatagtgctgagagaccctccatgaggagagtgctgcaaattctaaacaatgaggctgcaccacttgctgtgccaaaagtgaagccaacactcaccttttcttctgacctacctctgcctctcactattgaggacattgtttcagaggcggatcaagagtctatgtgcaagatcaaaattgactga

SEQ ID NO: 67709 - DNA, 609 bp, Glycine max
  Peptide Sequence Number=SeqID_184487
atggcggaacagccatcccgccattaccacttgcgggatccattgaaaaaacagacccccaatgttaaaatcgaccctgaatgtaaatttgccttggctaagtcgcaaattcttaggtctgagagaaaccccaatctttctcggggagttggcaccagccaagcaaaaactgggtggcgcatagtaagtattcttttcatttcattcatcgtcttattgcgcacgtcccccatcctcggcttctccttcgtggagcactcttactccgtcacccaacacatccaggtcatggatgttccactgccactggataaattggctttagatttgattgataatgagccctcccctgcaaacatgagcaacagcaggatatatgtaattctggtggcaactggaagctttaatccacctactttcatgcatttacgcatgtttgagcttgcaagagatgcattgaattcagatggctactgtgtaattggaggttacttgtctcctgtgaatgatgcatacaagaaaaagggcctaatatctgctgaacatcgaatacaattatgtcatttcgcctgcaaaagttcagattttataatggttgatccatgggag

SEQ ID NO: 67710 - DNA, 288 bp, Glycine max
  Peptide Sequence Number=SeqID_184488
atgttggatggttcattatctatccaataccaaatggttaaaactatatgcaaagattatggagtagtctgcattcccagggaaggacaagatgttgagaagactatatttaaagatgacattctgaatgagaataaggataatatcaaagttgtgaatgaacttgttccaaatcaaatcagctcaaccagagtaagggattgcattgcaagaggactatctataaaataccttaccgcggatgaagtgattgattatatcagagagcaacaattatacttgaactaa

SEQ ID NO: 67711 - DNA, 516 bp, Glycine max
  Peptide Sequence Number=SeqID_184489
atggacaaagcaaaactgtacaccttacgctggtctgccatgcaaattgccaggctttctgccgacccaaaagtagatgcactagccctcagccagattgaaatcctctcgcaactgctggaagaaccgatcccggaagaattcaggccaccggaaccacctcgccccagtttgcatgttgaagaggccgcaccggcaaaaaagcgctacccgctcggcgaaaaaaagttgtggtaccccgaagccctggtgcgcactgatatcaagcgtgcagcacagggagaatacccaaaaggctacccttatggtgccattgtccactttactgccggacaatattccaagggcgttgaaaatgcggtcaccgccatttcaagtagcccctatttcttttgctgtataggtaccgagggaaaattggtgcaggccaacccgctcaaccagtggggctatcatgccggggaaagtgcctggatcatagatggtgcaaaacgcaatggggtatccaactttctg

SEQ ID NO: 67712 - DNA, 513 bp, Glycine max
  Peptide Sequence Number=SeqID_184490
atggaagcggtactcccatttgaggtagaggtcccttcccagaagatactagcagaatcgggcctagaagaatcagagtgggctcaaacacgctacgaccaactcaaccttattgaaggtaagcgtttgacgaccatgagccatgagcgcctgtatcaacaaaggataaagaacgcgtttgacaagaaggtgtgcccctgcaagttcaatgagggggaccttgtgctgaaaaagatatcccacgttgttcaagataatcgagggaagtgggccccgaactacgaagggcctttcgttgtgaaaaagggatttttctggaggggctctggtgctcaccaacatggatggcgaggagctaccctcacccgtgaacttcgatgttgtcaagcgatactacgtttaggatctggggcaattgaggaaatcactgcatgttcttttatttttgtgtgttctccttggttttccctagggattcctatccgttgtaattttctcgtcacaattctttaa

SEQ ID NO: 67713 - DNA, 1368 bp, Glycine max
  Peptide Sequence Number=SeqID_184491
atgccccaccagcgcctctaccgttgtcgcgtccagccagcgtttctcctgcggaagcgcctgctggtcgagaataaagagctgattatccgtcacccgcaggctggtcgtctgtattgtctgcatgtcgttaattccctgttgcgttgttgtagcacattgtgtcaggatgaaatccagatgtatagacgtctacatgtctttattcgcaaaatcagtgaggagcaggcaatgtcgcaataccgtacctttaccgcccaggacgccgtggagtatgccaggcagtttggcggccttgataatccctcatcgctggtagaggcgcaggaagtgggcgacggtaaccttaatctggttttcaaaatttacgatacccagggcgtgagccgtatcatcgttaagcaggcactcccttacgtgcgctgcgtcggcgagtcctggccgctgacgctggaccgcgcgcgcctggaggcgcaaacgctggtcgagcactaccggcacagcccgcagcacaccgtgaaaatccaccattacgacccggagctggcggtgatggtgatggaagatctctccagccatcgcatctggcgcggcgagctgattaaaaatcatcactacccacaggccgcacgtcagctgggggaatacctggctcacacgctgttccacaccagcgatttctacctgcacccgcacgataaaaaagcgcaggtggcgaagttcattaaccctgagatgtgcgagatcacggaagatctgttcttcaacgatccgtaccagatccacgcgcgcaacagctacccggccgagctggaaagcgacgtcgccgccctgcgcgacgacgctcagctgaaaattgccgtggcctcactcaagcatcgcttcttctcgcatgccgaagcgctgctgcacggcgatattcacagcggatcgatattcgtggcggaagatagcctgaaggccatcgacgctgagttcggctacgtgggcccgattggctttgacgtgggtaccgccatcggcaacctgctgctcaatttctgcggcctgccggggcatctgggcattcgcgatgccgccgccgcgcgcgaacagcgcctgaccgatattcaggaactctggaacaccttcgcggaacgcttccaggcgctggcacatgagaaaacgcgcgatgccgcgctgagcgtaccgggctatgcctccgcgtttctgaaaaaagtctggcacgatgccattggcttcagtggcaccgagctgatccgccgcagcgtagggctttcacacgtggcggatatcgacaccatcgcggatgacgccatgcgccacgaatgcctgcgccacgcgattacgctcggcaaggcgctgatt

SEQ ID NO: 67714 - DNA, 747 bp, Glycine max
  Peptide Sequence Number=SeqID_184492
atggcattcttgggagagacaagcaatcagacagttgtgaactacacattaggttttatttttccaaatggatccattgttcacaacgacaatggtgtttcctttcaagcttccactccagttcccattcgagtacctaacgggtgtgattttgaaaccaataaacaatttttggatgaaatttactattggcagcctttcacatatgcagatgatgctgatgttaacacaatgttaatgtgtaatcatggattttcgtttgttggtccggttgagttattatgtagcattgctagaaccccggatggtattttaaacttacttcaagctactatgacccctactcatgatgccctgctatattacaatgggaggtggaacatgtcatgccaaaatgagtttgttggttactcgttcacaggaaaaaatcccaaaaagtttggcattcccaccggatgtaccatggatgaaatgaaggatttgatcaagcaagttgcgcctattgggattcccctttatggtattgatgaaacacaaatggtatggagattgttttttcggaaaccaagtcaccatgagtattcagaaaaagtaataaaattcgaaataattgaactcaaaaccaacgatgacgtgatgaaggtgctgattgagtctaactactggaaaaagattgggccaataaaaattttagctgttttcagtacacctgtaccggaaatggaagacgagttgtccttgtcgtaa

SEQ ID NO: 67715 - DNA, 875 bp, Glycine max
  Peptide Sequence Number=SeqID_184493
gtcgactcctagaggatcccaccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttaccttcgtagggctacacgccctcaccttcagaggactacacatcctcgttttcagagcgatacatgccctcgccttcagaggactacacgcctaacctttcaggggtctgcacgtccttcccttcagtgggctacacaggactacatgtcctccacatcagaggactacacgttctcccctttggaggactacatgtccttgccttacgagggctacacggcttcaccttttgaggactacacgccctcaccttcagaggattacacaggattacacaacctcgccttccgagggctagacgccctcgccttcagaggagtacacatcctccccttgagagggctacatgccctcgccttcgtagggttacacacccttaccttcaaagcactacacatactcaacttcagaggactatacatcgtcaccatcagagggctacacgtcctcgcctttagagggctgcacatcgaattcctgcagcccgggggatccactagttctagagcggccgccaccgcggtggagctccaattcgccctatag

SEQ ID NO: 67716 - DNA, 640 bp, Glycine max
  Peptide Sequence Number=SeqID_184494
atggctcttggcaatgtgctggagcatggcgacctgcgacgacggcgacgggcgcagcaggcgcgtatagcattccatgattgccaattcgcccaccagcttggcgccgacttcgggtatgtgtgcaatgttgttcgtcttctgacggaagtacccgttcaccaagtcgcgctgaaccttccaagccaggtcatcggtgaagctcttgaccagcatcaggtagccggattcggtcagaagggtgacgcctctgccctggatgggaaccaacttgttggcggggatttcggacgcggatcgtacgaaatgctcgcgcagttgcgccggtgtcatctggaggtagtcttccgtttcaacgaagcgcgcgcggttttcgttaaagctgcgccgggccgtaccttcggggcgctgatggacgcggtcaaccatggcgagggtgacgacgcgcacgccttgcacctcgacgacggggatgtcggtgccgtggatgtggatgagcttttgaaagcgttcgcggccgcagtcggcgccgttggcgatgtccgaggcgacatatgcgcccaggtcggccagcttgttgatccgcgccagcagcactgcgggattcggatggcggcggccatttgcgcagtccgcgatg

SEQ ID NO: 67717 - DNA, 135 bp, Glycine max
  Peptide Sequence Number=SeqID_184495
atgatatggaagtacagtactccttaccaagaaaggaacgcaaaacttcctcatcaatacttcataaacaatgcttgcattcttcacatcacctttgctgcaaggtttggattttctaaacctatgtgtttatga

SEQ ID NO: 67718 - DNA, 960 bp, Glycine max
  Peptide Sequence Number=SeqID_184496
atgcatggcctgatccgtggcgaccagctcgagctaggcgtagatgcggacacaggtggccaatgcacctatgtgctggaactgacaaaagctttggcaaaacaatcgcaagtcgccaaggtagacttgctcacccgcctgattgacgaccctcacgtctctgccgactacgcacaacctgaagaagtactctccagcaaagccaggattattcgcctgccgtgcggtccaaaacgctacatgcgtaaagaaagcttatggccgcacctggaccagatggtggataaatgcttgcactacttacgccagcagcgacgtttgcctgatgtgattcactcccattatgcggatgcaggctatgttggccgccagctctccatgttgttggggatcccattggtacataccggccactcgctggggttgccgaaacgcgaacgtttgctctctagcggacgtaaagcgaccaccatcgaaaaacaatttaactttgaacggcgtattgcaaaagaggaagcattgctgcgtgatgctgcgctgatcgtcaccagtacgcgccaggagatcgagttgcagtatggcatgtatgctcagatggatggcaaacgcttcaaagtcatcccgcctggtacagacactacacgtttttcaccggcaggccgtcggcctattgccggcggagtggagctcagcatcactcgctttttggaacaacctaaaaagccgatgatattgtgtatttgccgcccagagttgcgcaaaaacattaacggtttactcaaagcttatggatcacatccagcgttgcacgaacgggcgaacctggtgctggtcgcaagatctcgagaggatatccgtcaattggataaagcccagcaatcagtattaaatgagctgctactggatattgatgcttatgatttgtggggcaaagtagcgattcccaagcatctgccatag

SEQ ID NO: 67719 - DNA, 249 bp, Glycine max
  Peptide Sequence Number=SeqID_184497
atggtgctggtagcggctattgcagcctcattgacctccattatctcttttatgctcatcatggcctccatcattgtagccatttgccctttcaaggcctccatgtcggccttcatctgctcttacacctcctctacttcacctattactctagctctagcatgggttcgtaaacaaagtagtgatgtaactcaattcatcttttgccctaatttgcaagttggttacttccatactgtcataccctaa

SEQ ID NO: 67720 - DNA, 475 bp, Glycine max
  Peptide Sequence Number=SeqID_184498
gttgtcgtcccttgtgacggacgcgtggagtgctaatactttccccgtgcgtaaatacaactccagaggattacatgtcctcgccttcagaggattacacgtcctcgccatcagaggaccccacgtcctcgccttcagaagactgcacgtcctcaccttcagaggactgcacgccctcaacttcagaggactgcatgtcctcacctttagaggactacatgtcctcgccttcagaggattacacgtcctcgccatcagaggaccccacgtcctcgcctttagaggactgcacgtcctcaccttcagaggactacacgtcctcacctttagaggacttcacgtcctcaccttcagagggctacacaccctaatcttcagaggactatacgtcctccccttgagaggactacacgtcctcgccttcggagggctacacgccctcgccttcagaggactacacgtcctcaccacctga

SEQ ID NO: 67721 - DNA, 465 bp, Glycine max
  Peptide Sequence Number=SeqID_184499
atggctctcgccgtttccactacttcttcctcttcagcagctgctgcagcttctagctccttcttctctcgtctcggatcttcctccgacgcaaaagctcctcaaatcggttcgtttcggtttccggagaggtcgcttgtttcgtctgttgttgtcaatgtaactcaacgacgctccttggtgaggccactcaacgccgaaccgcaacggaacgattctattgttcctcttgcagcaactatcgttgctcctgctcccccccccccccccccccccccccaaatggaggcgaacaaagggttttttttaaggtttggggggggatttgccgagggtggaaaagaaaaagaaaattttgagcaaaaaaggcaagaccttgaaaaagcctctccccctgaaattatggaaaaggcccccccgaaaattgggaaaaaaatcgcttttgcgttttgggagattctttaa

SEQ ID NO: 67722 - DNA, 1963 bp, Glycine max
  Peptide Sequence Number=SeqID_184500
atgaagggtgtcacttcaattgttggagctgttgcgacggatatgggaatcttgacaactccacaattgcattggatggttcgtgctagaaataagggtatgaaagcttcagagcaggattactttgaacagctttcaagctcattcaggtgcttagtggatttgatcccagctgaaaaatgtaagtttgatggggtgaacgacaaagtggtcgtggatggatctaatggggttcgaaacagcagtgaagatggaggagtactgaatgatggagttggtgctgattatgtgcaaaaagagaaggttcttccaaacaactttggttctaaagacactgggataaggttaggggaagtaggaggaggtcttactgaaagctggataaatgctgatcggcttgtttattttattgtgccacctaaaagcagtggtaggattgaccttgttgatggggacaagatactatccctgtttgccttatttattagggagcaactaagctttcttaatgagaaagaagacatgaaaaattgccaccaagcccatgttggtgtcatacagactgcttatgcaaatggggcatctactaattaccttaaactgttgggacttgaagtcaattttactccaactggagtgaaatatctgcatgaaaaagccaccgaatttgatattggtatctactttgaggcaaatggccatggaactgtcttattttcagaatctttcatagagtcgttggaggctagaactaatgagatttctttaggatccaaagaaggggaaaaagctgctctgagattattggctcttagtaagttgatcaatcaagctgttggagatgctttgagtggatttctcttggtggaagtcatattacagcatatgggatggtcaataaataaatggaatgaactttatcatgatttacccagcaagcagctcaaggtcaaagttgctgacagaacggctgttgttactgttgaatatccttgtaatttagccatgtttgagcgggttgctgccgtccgccgccgcgtcgtccgccgtccgccgccgcgtcgtccgccgccgccggccgccgccatctccggcggttttctccggcgagaccagggttcagatcgcctcgagaagcgcgacccaaccctgcaactcgcgccgccttccgtcgtcgcacgcgcctccacgcgccgtttcttcttctcgcgacttccggcgcgtgcagctcacgcgccaccgtgccagcgtcggaagctgccacttccggtcttggcagcttcgtcgtcacttcctgggtctgtttcaggcttcacctcccgcttccggcaagccatttggtctgctcttgagtgtcttcctctcttgggtgttaggttgtggttccttggtcaaggacaccatgaccacttggagaaaacctcggattctgtttcagttgataaaagacctgaatgggagaagcttgactatcaactatgtgccgtgttatggcaatcagttgagccggatatcttggagatcctccgatcatttaaatcgtgtcgctccttttggaagaaagcccaggaaatctttgccaatgatatccaaagcttgtttgatgcaaccatgaaggttacagccctcaagcaaaccagtcatgacatgattgctcatgtgggtaaggctcgggctgccgtggaagaactgagaaagttccttgtagctgattcattggaagaagtgaataggaagcttgacaagttctacatggttcttattttgaggagcttacattcagactttgatcatgtgcgtgatcaagtacttgctggggaccagattccatcaatggattccctcatcactagacttctccgcgtgcctcatttattgaaggatgagaatcctactgatggagtggagacgtcagccatggttgcgtctcgagggagaggaagcggccgcaacagtagaggag

SEQ ID NO: 67723 - DNA, 537 bp, Glycine max
  Peptide Sequence Number=SeqID_184501
atgcttccaacagagaaaactccagagatgttgaataaatcagctagtttcaacggggtatctggtgcttatctctgcttgctattgataataggggcagagttttccaaaatgatggttttcatccatactggtaagatgatccctgaggcaagtatggtgaagtcccctgcaggaagagagaaaggaacaggaattctgatgccgccaaatcctccagcagctttgtgcattcccagagatggattgctatcaatacccaccgctccaaaaacaaccttgttctcaagtatgggtcctaagaatgataaagtcactgctcagggttacatcagcttgcaatgcctccatgaactccttggtcctggaacgcgcaatggtaaccaagttgttcaccagatctgctttggtcaatccaatgccgcggtcaataatggaaaaagtcttgctggccttgatgtcgatggtagcggagatgatggtggaggcggtggctacggaggtggtggtggtcgtggcagcgggcattggtgttga

SEQ ID NO: 67724 - DNA, 345 bp, Glycine max
  Peptide Sequence Number=SeqID_184502
atggattgcgtggggcaactgcaaagtttaaacccccaacaccacatttttggtggtatacatgagcatgtggagaatctatatgttctagaagccaatgattcaccatttgcatgcctatgtggcggcggcggctatgagggtggagtaggaggtgggtatggtcatggatccggaggagctggtggtggaaatggaggatttggaggtggtgttggcagcggaaatggaggatttggtggtgctgctggcgccggaaacggagtatttggtggtggtgggatgggcgacggcggatatggaggaggcatttgtggagaattcatggatcagttacgaccctga

SEQ ID NO: 67725 - DNA, 798 bp, Glycine max
  Peptide Sequence Number=SeqID_184503
atgacactcccgtctaaggcagggaaacacttacatttacgtcgtctcaaggagacgaatttagaaattgagctttggagtatctggtgtttctgtaatgggttttctttcttgattctcatgtacaactttttcttggataaggcttctttaaaatgcattttggtggatgagaatgaccgtgtggttggtcatgattccaaatacaattgtcacttgatggaaaagattgaagctgagaatttgctgcatagagctttcagtgtattcctgttcaactctaagtatgagttgcttcttcagcaacgatctgcaaccaaggtaacattccctcttgtgtggacaaacacctgttgcagccatccactgtaccgtgaatctgagcttattgatgagaatgcccttggagtaagaaatgcagctcagaggaagcttttggatgagcttggtattgttgctgaagatgtaccagttgatcagttcaccccattgggtcgcattctttacaaggcaccttctgatggcaaatggggagagcatgaactggactatctgcttttcattgtccgggatgttaacgtgaaccccaatcctgacgaagtggctgatatcaaatatgtgaactgcgatcagttgaaggagctgttgaggaaagctgatgcaggtgaggaaggtctgaagctatcgccatggttcagacttgttgtggacaatttcttgttcaaatggtgggaccatcttgagcgaggaactcttggggaggtcactgacatgaagaccattcacaagttgacataa

SEQ ID NO: 67726 - DNA, 595 bp, Glycine max
  Peptide Sequence Number=SeqID_184504
cttagggagtactgtgcatgataagacactcttcactgagactttcaggtatactggggaagatggatttgagatatcaattccctcagagagtgcagtggatcttgccaaggcaattcttgaaaaatctgaagggaagataagattgacaggattaggtgctcgagatagtctacgccttgaagctggattgtgtttatatggcaatgacttggaacagcacattacacctattgaggcaggactgacatgggccatagggaagagaaggagagcagaagggggttttctaggtgctgatgttatactaaaacagcttgaagaaggccctaagatcaggcgtgttggtttcttttcttctggccctcctcccagaagccacagtgagattcaagatgaaggagggaacaacattggggaagtcacaagtggcggattcagtccttgcctcaagaagaacatagccattggatatgtgaaatcaggattgcacaaagcaggcaccaaagtaaagattattattcgaggaaagtctaatgaaggagttgttacaaagatgccatttgtaccaacaaaatactataagccgtcctaa

SEQ ID NO: 67727 - DNA, 213 bp, Glycine max
  Peptide Sequence Number=SeqID_184505
atggtgttgataaatccaatcaacggcgtctctccatcacccactttcaacacaaccttcttttctgatccatgccttcctccacatacattctctactttcaccatcgcgcgtaacaagctcaactcgccaggaattgaacttgcgttttatagattagtgcaaaatgctactttgagaatgtatgcagatgtgggagaatggaattgttga

SEQ ID NO: 67728 - DNA, 1332 bp, Glycine max
  Peptide Sequence Number=SeqID_184506
atgcaacaatacagcaccttcttgtgtctatccttcccttccaagttcccaactagtcctcatctctctgaaactacactccactccatctccatggaggaacacaaaaaagaagggttttttttgcccacaccagttgcaaaactaatatcctttcaaacggatttgatctataatggcctggtttctctcttttcccctatccactctcttttctccgtggcttctgagtcctaccaccgtgcagaggagaccaaagacagtgttgaatcagcagtgcaacgtgctctttctcatcaaatcactcatggcagcgcactcttgctgaagaaactaggactttgctttctgagtgttgcgtatgtgtgcatggttatgattttggctctcattctggctgctgtggtgggtgttgctttggttcggttgtgggtggaggaacccgtgtctgtcaaggataatctgcattttgattacactgaagctcaccctacggctgtgttttcattcaatggagttagaagtttaaagggtcaccttaagaaaaagcacataagtgtcccagttggccactcgtttttcgcttctttggtccttgtgatgcctgaatctgacttcaatagggagcttggcgtgtttcaggatgtgtttcttcaagagttaattagagacattttgcagttgactgcagaactcctatctgtgaatggaaatgtgatagaaaaatctagccagccatgcatgttgaggtttagaagctcaccaattcgactagtccgaacctttatgatgggagtgcctctggtgctgggaatctcaggggagactcagaatattaatgtggatatactgaagcacaaagaagactacagaagaagcaattctattagggtaactctgcatccaagagcaggaacatcatctcttccacagctatacgaagccaaaattgcgataaactcccatttgccttggactaaagagttggttcgaaattggaagtggacattttatgtttgggtgtccttgccactcatctttctggtgacaccagagtatttcagtgatcatagggtgagtgaacttacaagagaagaacctggacaattacaagttgaggaattaggagatgaaagtgaggtttctgagttgttgaggaaatggagaagaagcagaagcaagagaaaaactgtactagcacatggtggtgtgccagaaaccattgttggttcatcaacatccagcattagcatgatgactactagagaagatgtaaccagtgtggctgtggaagatgaggttgaggactctgaatcagcgtgcataggttag

SEQ ID NO: 67729 - DNA, 273 bp, Glycine max
  Peptide Sequence Number=SeqID_184507
atggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaattccgtccaaggctaa

SEQ ID NO: 67730 - DNA, 624 bp, Glycine max
  Peptide Sequence Number=SeqID_184508
ccttggacggaattaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 67731 - DNA, 579 bp, Glycine max
  Peptide Sequence Number=SeqID_184509
atgggaacaaatcaaaccggcaagaggttctaccaagtcaaggttaaaagcttagataccaccagcattaaggaattagggcggttgatggaacctctccaaatgcaagctttccgcaagacttacggaaagatcttagaattgaccttagcagagacttccaattggtaccgaccatcgaagaattttaaggagattctaggatgtcctctcggaattgcaactgtggtcaaggattcagcaagaggtttgtaccgcgtaaaacaaactcgaaacggcatagcgggcctaccacggaagtacctagaagacaaggcgagggatatggcaaatcaagaagattgggtcccgtttatggatgtgttagcattgctaatctttggggtcgtcctctttccaaacgtagatggtttggtggacctagccgcaatcgacgcgttccttgcataccgccatagcaaggaaagtccggtggtagctgtcttggcagatttatttgacacatttgaccgaagcaagacacgaggcatccatgtccgctccaaagccatcgctcgtgtactgaaaagagaagaatag

SEQ ID NO: 67732 - DNA, 141 bp, Glycine max
  Peptide Sequence Number=SeqID_184510
atgcagttacgtgatcaaggtagtgtgcttagtgagttgacactcgctcagcgcatctgtacagcttatccttcttccagattcttctctgcgcttagccaatggtggtcgcgcttaacgggttgctcgctcagtggatga

SEQ ID NO: 67733 - DNA, 531 bp, Glycine max
  Peptide Sequence Number=SeqID_184511
atgccctcgccttcaaagggctacgcgtcctcaccttcagagggctacgcgtcctcgcctctagagggctgcacgtcctcacctctagaggactacacgtcctcgcctccaaaggactacaggtcctcgccttcagagggctgcacatcctcgactccagaggactacatgtcctcgcctccagaagactacacgtccccgccttcagagggatgcacgccctcgccttcagaggactacacgtccttgccttcagaggactacatgtcctcaacttcagagggctacgtgtcctatccttcagagggctatgcatcctcccctctagagggctgcacgtcctcgcctctaaaggattacatgtcctcgcctccaaaggactacaagtccttgccttcagagggctgcacgttctcgcctccagaggactacacgtcctcgcctccagaagactacacctccccgcctttagagagctacacgccgtcgcctttagagggctacatgtcctcgccttcagaggactactga

SEQ ID NO: 67734 - DNA, 258 bp, Glycine max
  Peptide Sequence Number=SeqID_184512
atgactccatttgtggctctatgctttctttctgcattagggtgcttcgacggacgcggtggttattgggtggaggtggggcttgctttggagagacaggagcagttgtgtccattcaggtcctttggagggtgtaggaagcaaaaaggggaagtgcaggaagtaaaagcctggtctcttcctctttctgggcccatgggctataagatggtgtttgacttggctatatcaatgtttatgcctttcaatgacaaatga

SEQ ID NO: 67735 - DNA, 2241 bp, Glycine max
  Peptide Sequence Number=SeqID_184513
atggaacaagacaaccttaacaacaattgtgatgaggaaaactttgtgtctgactcgagaggaagaaaaagaagcattgctgagagaaggggtttcaattccaatgctgcaagaatcaacacagcactgtttcgcactgcaacaacttcaacaacaaccccttcaccttcccctgctgttcgatcacctcgtctcaccattcccccgggcattagtcccactgccttgcttgactctcccatcatgcttccaaattctcaggccatatctcccaccgttggctctttcttcacgctgccacttctcagccatgaaggatcaatgctcacaactgaacaagggaatgtggatgtgtcaaccgcatttgatgtcgccgcctctttcaaattcaagcctcgtggacatttggatcctaatcctttgcctcctttccctgcttctctaaatcaggggcatgtttctagtcatttccactcagtaaagggagaaaatagagagagccacctacttgctcaagttcagccaccattagatttttcatgccaagcagatttttcaaaaggccattctgtgaaaaatagtgaagtgaattcgtacaatgatatgaaaatggtaaatgatgcgattgttaatgccaataatgttgagatgccaatgtctggctctgaggaagtaagtgatgaaagcgctatgctgaaaaatgctatcaatggtgaggatttcggagggcaacctgcttcagaaggagaacagaaagaggtatcccatgcaacgggagcagtaaggacttcagaggatggctataattggaggaaatatggacaaaaacaggttaaaggtagtgagtatcccagaagctattataaatgcacacagcctaattgtcaggtcaagaaaaaggtggaacgatcccatgacggtcaaataacggaaattatttacaagggtgctcataaccatgcacaaccacaccccggacatcgagcatcttcactttctactgatgaggtttcagacatggctgaagacagtaccttagctaaaattgaaggtgggtatgtctggagaaatattcaaacaggattaaaagatacaaaacaaagttttgattggaaggctgatggacaggaaaggacatcatcaacttctgctgtgactgagctttcagatcctatatcaactaacaaagctaaatctctacgtatatttgaattggaggacactccagagctttcttctacacttgccagtcatgatgatgatgaagatgggaccgctcacgcacttgtgtcggctgaagacgaagctgagaatgatgaattggaaccgaaaataaggaagaaagagagctatgcagttgaaccaaatttgccccctactagggctgttcgagagccaagagtggttgtccaaattgagagtgatgtggacatacttgatgatggttaccgctggcgtaagtatggacaaaaggttgtcaaaggaaatccaaatcctaggagctactacaaatgtacaagtactggatgtatggtaaggaaacatgtggaaagggcttcacacaatctgaaatatgtccttactacttatgagggaaagcataaccatgaagtgcccactgctagaaccaacaatcaggtaaactcaagtgatggtggtttacctcccaatggtgctaatggacaagtttctcttacattaccagggaatgctggcattccaaagcccgaaactcatcaaactcttggacatcattttgatagaaaaccggaattcagcgacgagtttctcaggcctagtttggttggaagtttcgggaatgatatgaagtttcggccttcttccctttgccaaatgaagtatccttccttgaataacgccatgccatatggctcctatggactgaaccctgaacgttgcactgcccctcaagctggatccattccctccatgttccctgattttccaatgccacttccattgaatcttccctcatctggaaatttttcaattgctggactgaattttaaccgtgtcaagccaatgaatccggaccagtctttcctttctgggcagcaggtgaaggacattgatacagggttcctgaggcctaaacaggaacagaaggatgatactatgtacggctcgtgcatgcccccgctagatcatgcaaatgcttcactcacttcttcaccatcaccatccatttatcaacgcgtcatgcacaatttcccttcataa

SEQ ID NO: 67736 - DNA, 1204 bp, Glycine max
  Peptide Sequence Number=SeqID_184514
agtcgatgtttcagccccaaagatacgtaccataaagcaagctgaggaattaaaatcaaaagacacaactccattatcagaaaagaagagtttcaacagcacaatatcatcacatgatattgatgaacaacaccattctacatacactaacgccctcattcaactctacgcgatcttggaagctgtagctgacagagttgaaatgcacgacaacattggcgagcaacgtaacaactggaacacgctgctcttgaactccatcaacatgataacactcactgccacaaccatggctggtgttgcagccacgtgcagtgaaggtgcaggtgcacctcttttggctctgaagctatcttcagcacttttgttttcagcagccactgggatgtcactcatcatgaacaagatccaaccctcacaactcacggaggaacaacgcaatgcttctaggttgttcaggaaccttcagagcgaaatcgaaaccgcaattgccctcgggattaataacaataaccctaccgaggaagatgtgaagggtgcaatggagaaggttttggctcttgacaaggctttcccacttcctttgttaggagccatgcttgagaaattccctaagaaatttgaacctgctgtgtggtggccttctaaaccctacaacggaaaaggaaagtcacagagaaagggaaacaaaatgaatggatggagtgaagaactagaaattgaactgaaagaggttgtagaagtggtgaagagaaaagacattgaggactatgagaggctcggaaacatgattttgaagattaacaagactttggccattgcaggtcctttactcacaggaattgcagcagcaggaactgcatttataggcaataataatggttattggggagcattggtgcctctcattgctgggtcattggcttcagctgttaatagctttgaacatggagggcaagtaggtatgatttttgaaatgtacagagcctctgggggattcttcaagatgttggaaagttctcttgaatcaactttggaagaggaggatttagagagaagggaaaatggggagctctttgaaatgaagatggctttgaagttgggaagaagtgtgtcacaactgagggaacttgcttctaaatcagcttcgtatcgcatggaaggagttcttgacatagacgaatttgccagcaaactgttctga

SEQ ID NO: 67737 - DNA, 286 bp, Glycine max
  Peptide Sequence Number=SeqID_184515
atgatccagcttctgttcacggtgatattttcggagacggcgatgatagcgttgcttctgttcaagacccctttgaggaagctggtgataatggggttggatcggttgaagcgtggccgtggacccttgatggttaagaccgttgcagggaccgttctcgtggtgtttttttcgagtgtgtatagcatggtcaacattcagaagcgtgggatcgaggagggtgctattgttaaccccaccgatcaggttcttatggccaagcacctcctcgaagcaacgctcatgg

SEQ ID NO: 67738 - DNA, 1212 bp, Glycine max
  Peptide Sequence Number=SeqID_184516
atggattcaagcaaattttcttctttctcatattgcagttcaagaagaatagctgcaacaatcaatgtgccgaagattaagccaccggcacaactcatgcaaaaagagaatccttactgctccaatctcagcgccaagagttccacagcacctagaacaagcacaccaaattccactgaggttactaagcttcatgtgattatggagattgtagcagaaagaatagagatgcataagaacatcggagcacagcgcgacaactggaactgccttctaacgacatctgttaatatgattactctctcagctgcaaccatggttggccttgcagctgttggttcaagtggagcaactgttgtggccttgaaggtgtcctccacaattctttacatggcagccacagggttacttgtggtcatgaacaaaatccagccatcacagcttgtagaggagcagagaaatgctgctaggttgttcaagcagcttcatagagaactccaaacaaggctttctcttgggaatcctagtgagaatgatgtcaatgaagcaatggaaaaagtgttggcattggacagggcttaccctcttcctctattgggctcaatgcttgaaaaattcccccaaactgtggagccagcagtgtggtggcctagacagaagcaaaagtgtctaaaaaaagaagagtttggtgggaagttcaaagggaagaatggatgggatgcaaggttggaagatgaaatgagaaaggttgtgctggttttgagaaagaaggacatggaagactacttgaggttgggtaaagaagtcttgaacttcaacaaggtattggcagtttctggtccactactcactggccttgcagctttaggatcagtttttttgggttctgtgaatgcaccttggcctgttatgcttggggttattggaggagctttggcaagtgttgttaacacattagagcatggggggcaagtggggatggtgtttgagatgtataggacaactactggtttctttaagctcatggaagagagcatagagctaaatataaatgaacaagatcctcataaaagagaaaatggggaattgtttgaaatcaaagttgctttacagctaggtaggagtctctcagaactcaggcaatttactgcttcaatttcatcctcacctgaagagaatgattgtcaagagtttgctagcaaacttttctag

SEQ ID NO: 67739 - DNA, 309 bp, Glycine max
  Peptide Sequence Number=SeqID_184517
atgatttttggtgaatttgagttgttccagtgtgtggatcacggcaaaacttcactggggaatagatcggtgtgtggtcactcggttaccactggggagacactagctgtgtattcagcacaagttggtggtgccaatgcttatcaagtgtcaggaaccccagcagattgtgtctctttggctttatctggggcattgttttcttggtcaaaacctgttttggctttagtcaatgccagagttcgtgctcgaaggttcaagaatattcccccgaaacaaaatacacacacattattgatctcagtttag

SEQ ID NO: 67740 - DNA, 528 bp, Glycine max
  Peptide Sequence Number=SeqID_184518
atgtccttttgggacaacaacaacaataattcacacgagttgcagtcccagaatcagttacctgttgttcagtcaaagggtgggagcaagatgggttctttggcaaagaagggactcaacaattatggtcaaacagctccagcaacaccctttgagaatcaaggggtgctatcagcaatcagcgatattgtgtctcagaaacttactgggatacagaaacttcaattaagacgtcttcttctcaaagtggtttttggagccgcttatcttggaccctttggacacttttttcatttaatactggataaaattttcaaaggaaagagagattcaaaaactgtggccaaaaaggaaaaactgcaaaaccttctgtttaatctatctatttatcatgagctgaattcaggcatcgcagttggcacctgtgtcatcaatctgcttttcattggcagcacgaaatatcagctaacttatgcagtacagcacttgtgtttgaagcacttcgactccagaactaaaaagaattaa

SEQ ID NO: 67741 - DNA, 435 bp, Glycine max
  Peptide Sequence Number=SeqID_184519
atgcaagtcggctgcatgcatcttactggtttcacagtgcttcaccctagtggtgctatccttttccttgcgcttatgatagacagactacatcattacataagagaacttcggattcgaagaaagggcatggaagctgtgaagaaacaaaccagagggaccgaagatggaaaagttgcaaattcggaagaaattaaggctgtggaggaagaaagagccagattgagagctgaacttagccgccttgaatctgaactacagtcaaaaacaaaagatgtagatgctgctgaagccaatgtagctgctctgagaaaacaatctgaggggttccttcttgagtatgatcgcttacttgaggaaaaccagaacctccgcaaccaactacaatccttggacaggaaattgtcacattcaggttccaagaagaatatgtaa

SEQ ID NO: 67742 - DNA, 330 bp, Glycine max
  Peptide Sequence Number=SeqID_184520
atggacaggcttgtcattcttcctttctctgctggttgcatctctgaggccagtgttgctgttggtgttccacatccaagaagatcaaaaccagacaccaatgcatcacctcctacaataaaacggtctaaaagcgtcgaggattcagagattttgtctggtgaaagcatgaagaactcgttgaggctgctagacgttgttccaaagtctaacctatcctacggcttcaatagactggtcaagggtttcaagaatttttctcaattgtttggtgagaaatttaacatgatggtttcattttataatcccttgatttatctgaggatttaa

SEQ ID NO: 67743 - DNA, 1269 bp, Glycine max
  Peptide Sequence Number=SeqID_184521
atggattggactagaggccacaccctcggccgcggctccaccgcggccgtctacatcggggagtcccaccggtccggtgaagtgtttgccgtgaagtctgcggagctccaccggtcggagttcctcaaaagggaggagaggattctttcaacactgaaatgtcctcaaattgtggcctaccgaggctgtgacaacacgttcgagaacggcgtgcagtggttcaacatgttcatggagtacgcgcctcacgggaccctggcggagcgcggtggcgggatggaagaagcggtggtggggtcctgcacgcgccaaattctgcagggcctgaactaccttcactccaatgggatagtgcattgcgacgtgaaggggcagaacgtgttggtgacggagcaaggggtgaaaattgcggactttggttgcgctcggagggtggaggagtcatcgtcggtgatcgccggcacgccgagattcatggcaccagaggtggcgcgtggggagcagcaggggttccctgctgacgtgtgggcacttgggtgcactgtgctggagatgatcaccgggacgccgccgtggcaaggcggcggagacccggcggcggtggtttataggattggattctccggcgagtcgccggagatacctggttatgtgtcggagcaggggagggactttttgggaaagtgtttgaagagggagcccggtgaaaggtggtcggtggaggagcttcttggacacggttttgttaaggagtgcacggaattgaagttgttggtgttggattcggacactcccactggtgtgttggaacgaggtttttgggattcactggagacagctcagcatgaagcacttgattgtccctctcctagggacagaattcgtaggttgttttcggatgagcctgtttgggcatcgaacgatgacgaatgggtcactgtgagaggcaatgagatccatgacatacatttggaggctgagggtttgttctttcaccaaaccaacactactttttgtaatgtcgttagtgatgaagacaatgttttggtaactttttgtgatcctgaaattgtagaatcaactgcagctgaattgagtattagtgataatgattgttatcttagaggcagaaactgtgattgtcgcaccagagaatcattgttgtcagcttgtgtatgtctagtgattgttttccatggaaaatttgattctaataagatgagattttttatcatgccttgcattttgctcccctttcactctctttaa

SEQ ID NO: 67744 - DNA, 282 bp, Glycine max
  Peptide Sequence Number=SeqID_184522
atgatgagatgcgtgaagggaacaacttgtttgtggtctctaacagaatcacaaaaggaaccagatctacaacctttacgtcgcaatggtggaggatggggtggggttgcacgaggtggtggtggatggggatggttttggatgacaggacgacacggttgggggactgagacgtctaaggggaaggggaggaggtgtagggatttgaccctaactagagtagcccgaggcccataccaaaaagcggcatatgctcacatagcatttgcactaccacaatag

SEQ ID NO: 67745 - DNA, 891 bp, Glycine max
  Peptide Sequence Number=SeqID_184523
atgtcaaatgtggtcgtgttctgtttctgtctatggaccctgttgttttctcttgtgttctgtgcacccaacgacgggttgggaaggattggactgaaaaaggtgaaattgaacacccatgacgttgaggggttgaaggaatttcggtcttcaattagaaagcatcatcttcaaaacatccttggaggcgctgaggaaaccgatgttgttgcgctgaagaattacttggatgctcagtactatggtgaaatagccattggtacccctcctcagaagttcactgtgatttttgacaccggtagctctaatttgtgggtgccgtcatccaaatgttacttctcgattgcatgtttcatgcacgcaaggtacaggtctagccaatccagtacctacagggaaaatggtacttctgctgcaattcaatatggtactggagcaatttctggtttctttagcaatgacgatgtcaaagttggtgacatagttgtaaaggaccaggaatttattgaagcaactagagaacctggagttacatttgtggctgctaagtttgatggtatactaggacttggatttcaagatatatcagttggatatgctgttccagtgtggtacagtatggttgaacaaggtcttgtaaaggatccagtattttcattttggctaaatcggaaaccagaagaagagaatgggggggagcttgtttttggaggtgctgatcctgctcactacaagggcaaacatacttatgtaccagttacacggaaaggatattggcagtttgacatgggagatgtgcttattgctggtaaacccactggatactgtgctgatgactgctcagcaattgcggactctggaacttctttattggctggtccaacggtatga

SEQ ID NO: 67746 - DNA, 369 bp, Glycine max
  Peptide Sequence Number=SeqID_184524
atggcaacgttggaaaagccttgggctcatagcaaaacggattttcaatgtggtttggacaaaaatatcaaactgaagaaaatgtccttgaaagttgaaatttcatacatattcataaatgcaatgtggcaaattaacttgaggtcaagtgaaacaatggaatcagaaccttatcctgagcatccaggagaaccagattgttcatactacattaggactggcctttgtagatttggagcaacatgtcgatttaatcatcctcctaacaggaagctggctattgccgctgcaaggatgaaaggtgaattcccagaaaggataggacagccagaatgccaggcatgtacttgtttatcaatgaatgcataa

SEQ ID NO: 67747 - DNA, 267 bp, Glycine max
  Peptide Sequence Number=SeqID_184525
atgacaatccagaacgagtacatgttcttcaactgcagccaagacagcctatgttctgcatgtgagcacttttctgaacactgtgattcctcgtgtgacagtgctagctatctctgcagccacttgccaggctcctcttactatcccaaagccactcagtctctgaggttgatgcttaagtattgtgctacttatgctagcgtttattggaagaatgttggtgctcctatgccttatgatcaggttccggaatacgggatccgttga

SEQ ID NO: 67748 - DNA, 384 bp, Glycine max
  Peptide Sequence Number=SeqID_184526
atggctttggtcattgctgattccgaaaagaaagaatcaccattcctcacttatgttaaaaaccacaattatactcaaaaccatgcaaccccatcttctgaaagtgaagtattagcctctctaagaggctccaaaggcctccgtggccataaaaatgtacgtggaggtggagccatgacttgtgataaataccctagagtttgtcgtgctaagggcagcgaagggcctgattgttgcaagagaaaatgtgtgaatgtgtcaaatgacagaaacaactgtggcatgtgtggtaagaggtgcaagtactcccaagtgtgttgcaaagctatgcgtgaaggaatcagagaggacaagaactccgaacgagtgccaataattaattaa

SEQ ID NO: 67749 - DNA, 1467 bp, Glycine max
  Peptide Sequence Number=SeqID_184527
atgacagatgcatcattaatctcattggagaaaggtaagaattctaaatcaatgaataaagagcatagatctttgaaggaagaaaacagaagtatttcagtagatagcttgaaaacattgcaaggtagcagtgtccgtacacaggaagagcttgcagcttttagggaccaaataaagtcaagggaccatcacattgagaagccagcagctagtgagctacataaatgttctggtgagttagaaattggtagaaggtgcttcctggacaaggtaaacaggaatgaagatgaggagacatatagtcattatgatgctgtaaataaatataactcagaatgtacatcggttatggatatttcccctgacaatgttgtaggagctataggtgaacaacaattttggaaagtcagaagaactatcatcaatcaacagaaaatctttgtcaagcaagtgtctgagttgcatagactgataaaggtgcaaagattaatagcaggctcaccccatatattgcttgaagataaccttttacataacaagccaccacaaaaaacatccacaacccagaaatttcaatccgactttgccggcaaaaaaccatcgtcagttgttaaacttgacaataaatctgtgaaggtcaatacagatgagaaggctacaaacagtgcagtcgggaagattccaattccttgtatcagcaacataaccaaaggccatgctaatcaactaccaaactatggccatcacttaggaaaccttgcattaggctctgcagattcaaattccaaacagcccccaagctatgtctaccctccaccaggaaaccagtggctagttcctgtcatgtccccatctgaaggcctagtatacaaaccaatcatagggccatgccctccaaatgcaggcttcatggcacccatatatggttcttgtggcacaatgagcttcaatcctctaagcaaggatgcttcttcagatgcaactcttgctccaagttctcaccaaaagcttggaatcatttctggttcatctttatcccagttaccatcattcatgaatcatccatcttctttatcagcttcagctattgagcaaatggggcagtctaatggtcctgaaaatcaccattcatgtggagaagtcaattctgccatattgcaccaaagctcatctaacatgtcaagcccaacaagtcaaatgatgtcaagaaacatttcaacttatcatcactcactgaaagataaggaacttcagagaagcacagctagtagtccttccaagagaatgagtggagaagcacttcctttgtttcctttagcaccaacattttggcaatcagaagatagaaacacacaggttgaacatcggccacgagtaatcaaagctatgcctcacaatccaaaaacagcaagtgaatcagctgcaaggatattcaggtcaatacaagaagaaaggaaacatttgtaa

SEQ ID NO: 67750 - DNA, 1194 bp, Glycine max
  Peptide Sequence Number=SeqID_184528
atggcaactctaaccactcttctagtaactttgtattttatagtacctgccttagcttcaacaccgaatagagattcaacaaaggagttcaacgctctctctcctatttcaagctatatcaacaaaactcctgaggatgttgtcatcatgaacacaatagactcatgttggcgagccaaaacaaattgggcttcaaaccgcaaagccttggcagattgtgcaattggctttggcaaagaagccattggaggaaagtttggtgatatatacgaagtcactgacccttctgatgaccctgtggacccaaaaccaggcacactccgttatggtgcaatccaaacagaacccctttggataaccttcgccaaggacatggttattaggctcaagaacgagcttatggtgaatagctacaagaccattgatgggagaggagccaaagtggagattgcaaatggggcttgcattacgatacaaggtgtttgccatgtcatagtgcatggaattagtattcatgattgtgaaccgggaaagggtggcatggtgaggagtagtcctgagcatgttgggtatcgtgaagggtctgatggagatgccattagcatatttgcttcctctaatgtatggattgaccattgctttttggctcgttgcaccgatggtctcattgatgttattcatgcctcaactgctgtcaccatctctaacaattacttcacccagcacgacaaagtgatgctgctaggacacagcgatgaatacaccgcggataaagtaatgagggtaacagtagctttcaaccgctttgccagtggcttaatagaaagaatgccaagggtgagatttggttatgcccatgtagtcaacaacctgtatgacgagtggctcatgtatgccattggtggcagtgccgaccctaccatttttagtgaagggaactattttacggcttcaaatgattctgctgcaaaacaggttaccaagagggaaagtagtgaaaagtggaacaattggaaatggaggagttttcgggatgaatttataaacggtgcttattttgtgccatctgggtatggaagttgcacgccaatatattcagctgctcaaagttttatcgcggcccaggcatctatggtgcccttattaactctcaatgctgggccactcaattgtgttgttgacaaagcttgttaa

SEQ ID NO: 67751 - DNA, 153 bp, Glycine max
  Peptide Sequence Number=SeqID_184529
atggaggttgaggaaccttggttggggttatggctatcattgaattgtcgagtggatatgggagcaagtcatcataggacaccggaattaggtgtatatgcctatatgttcttggtagaagtaggaatagtgggggcaagatatgcgggttag

SEQ ID NO: 67752 - DNA, 486 bp, Glycine max
  Peptide Sequence Number=SeqID_184530
atggcatcaagaaagagagcgagaaccgaggacatcccttcatcatccaacccatctccttcgacagcagccatggaaccagatgcccaacaagcacattctttaattcctatgttgcaaagcttattcaggggacaattgatgatcgtatgcaatcagcaagagttggctcaccacaggctaatcatatctatggagcagttcctagaaaaagtgccatggcctgaagctcatctccctctggaaagagcacataaggatgttcctcccagacttgtaccagctaggactgagctgacatcagctgaaccacaacctcctatagtagatccacctgcttctccggagcttgagacattgtctcctccggcaccacctctgataatcatccctgatgactcagctgatgaagttgttgctcctcctgattcaccatcttgcaacatagatgatggttctaacttttctgacaggatggattgctga

SEQ ID NO: 67753 - DNA, 249 bp, Glycine max
  Peptide Sequence Number=SeqID_184531
atggctgctgtagatattactggctcaaacagcaatgacctcaacaaaccttttaggtttaaagggtatcatttcaagcgttggcaacaaaagatgatgttttctttaactatgaggaaagctgcctatgttttgaacactgatattcgagtggtacctgaagatgttgagaaggaagtgaaggataaaatgattgtggaattagatgtgaaaaagggaggtacaacaagcaaaaaggagcagaaataa

SEQ ID NO: 67754 - DNA, 330 bp, Glycine max
  Peptide Sequence Number=SeqID_184532
atgagatctaatggaacttggtgcattccaaaagaagaagaaatcatggaagctttggagaatgtgggtgatatatatcaagaggaaatttcaaaagctcctgtaccacttgttgaacattttgccatggtattaggaagaaagtcaaaccattctttaggtgttggtagtgcaccaataacaaagaagttttcacacaaaaaaattattcaaaatcaacttgaaaatgcacaaaatcgagttaataatttggagttggaagtgcaaaagttgacaaatattacaaaaaagcaagaggatgtcattacccaacttcatattgaagtataa

SEQ ID NO: 67755 - DNA, 390 bp, Glycine max
  Peptide Sequence Number=SeqID_184533
atggtcattcccaagttcaaggtgctggactttgacaagtacaaggggactacttgccccaagaaccatctaaagatgtattgtcggaggatgggggcatatgcaaacgatgagaaactactgatatatttcttccaagaaagtcttattggggtagctattacctggtactctgacttggaaccttcccgatatcagtacaattctgctcaggataggatgcaactacagaacatgtgcaaaaaggggcacaaatctttcaaagaatacgcccaaaggtggagagacctagcagctcaagtggcacctccaatgactgagaaagagatgatcacaataatagtagacacattaccagtgttttactatgaaaaatggtggggtacgtga

SEQ ID NO: 67756 - DNA, 241 bp, Glycine max
  Peptide Sequence Number=SeqID_184534
atggtgacaaaaagggttaagaaatatgagaaaatgatgacacatcagtacataccttcaagctttgctgatttagtcttcgccggggaaaggatcgaagcgggtctgaaaagaggcaaatttgatcatcctgctttgatgaatgagaaaaccggggcaaatgaagaggatgagaatgaggaaggaacccatgttgtggctgtcattcctacatggccaaacttcccaccagcccaacaat

SEQ ID NO: 67757 - DNA, 525 bp, Glycine max
  misc_feature (470)..(470): n is a, c, g, or t
  Peptide Sequence Number=SeqID_184535
atgctgaacgaaggaagcgtaggaaaactattttacaagaacgaaaaagacaacgttcagctactaatgtgtatctcacaatgtagtccaaccattaaccataataataaccctactacaagcttccaatctacaccaccatcacacgggactttatctataaatgattctgaacgttactcaaaaagacatacagtcaatgtttcttgcatccagagaaatttgatgtcatcttttgagcatcaaaaaaatagaacaactgcttctacatccacatgccaaggtagtaatccttattccaatatgacacagtcagacattcatagagataaacatgagagagcaactaacactacacagcataatcaatttgtcgcccatgatagctcacattccaccgataatgatgcagttgttgcagaaatcaaactactcatggacaaatatgctgaaagaaggaagcgtaggcnaagtattttacaagaacggaaaaaacaacgttcagctactaatggtagtacttaa

SEQ ID NO: 67758 - DNA, 1233 bp, Glycine max
  Peptide Sequence Number=SeqID_184536
atgcagtctaggttggaggaagggaaggaccctgctggattaaggactactccctctaggcccttccctttgagacttctgcagttcttcttggcctttttggttattggcctaggtgcttcgtttcttagcatgtacatgattagacattttggcattcataatgtggctttgctacagtcttcgtttaagccttgctttgagcagccggcaaacatagaaagttggactatgcctcggtccaatttgctgcatgccatgaatgacaccgaactcttttggcgagcttcttttgttccaaggatcaagagttatccttttaaaagaactcccaagattgccttcatgttcttgactaagggacccttgccaatggcaccactctgggagaagttctttaaagggcacgcaaggctttattcaatctatgttcatttgctgccatcttataatgctgattttccaccatcatcagtcttttacaggagacagatcccaagccaggtcagataccattcctttgtgtcatttagggtcaaaatttctaaccagccttctccttcaccttcacaggtggcagagtggggaatgatgagtatgtgtgatgctgaaagaagacttctggctaatgcattgcttgatatctcaaatgaatggtttatcctcttatcggagtcctgcattcccctccaaaacttcagcattgtgtaccgttacatagcacactcaagatatagctttatgggtgcagttgatgaacctggtccttatgggagaggccggtatgatggaaacatggcacctgagatcaacgtgagtgactggcgaaagggctctcagtggtttgaaattaaacgagaactagctcttaggatagttgaagacagaacttactatcctaagctcaaagaattctgcagaccacacaaatgttatgttgatgagcactattttcagacaatgttaacaattaatactcctcatcttttggcaaatagaagcctcacttatgtggactggtcaaggggtggtgctcacccagctacctttgggaaggatgacatcaaagaggaattcttcaagaaaattttgcaggatcagaaatgtctttataataaccagccatcttctctttgcttcctatttgcaagaaagtttgcacctaatgctttgggccctcttttagacatagcacccaaagctctaggaattggaaaaaggcctggcttctaa

SEQ ID NO: 67759 - DNA, 579 bp, Glycine max
  Peptide Sequence Number=SeqID_184537
atgtttttcttcaaatggtttcatttgttcatcactttccatgtcttggctgcaacacccatcttctcgttaacagattcctcaaaccaagtctccactaactttctggacaatgccaagaagcctgaagttttttattggatggtcaaaatcagaaggaggattcatgagaatccagaattgcgttatgaggaatttgagaccagtaaactcattagagaggaattggataaactgggtatcccatataaatacccagttgcagtcactggtgttattggctacatagggacaggaaactcaccttctgttgcattaagagctgatatgggtgcacttcccatccaggaaaaggtggaatgggagcacaagtgcaagatacctgaaaagatgcacgcatgtggtcatgatgctcatgtcactatgcttcttggggcagcaaagattctcaaacagcacgaaaacgagatacagaattccagttatgtcaatctttggtttctttctaacatactggtaaattgctgcgcattgtccaattgccaaatgtcagtatcttccatcatgccaattttgtaa

SEQ ID NO: 67760 - DNA, 519 bp, Glycine max
  Peptide Sequence Number=SeqID_184538
atgagtagaaggcagcaaaaggtgttcaaattgttcatatggattttgggaatctttcttgtcgcttacattgcaggacgacctttgtattggcatctcaatgagaccctcaatgccacctcttatccttgtcctccttgtcactgtgattgctctcctcaaccccttcttactctccccgaaggattgaccaacaattccattgtagattgcatgaggcaagacccagaggagagtgaagaggttgggaagagttttacggatcttttagccgaagaagtaaagcaaaaggaagctgaagctgaggaaaaacaaagaagtgtagacacgaaacttttggaggctaagaaattagcatcacagtatcaaaaggaggctgacaagtgcaattcagggatggagacatgtgagcaggccagggaaagagctgaggcagcacttgaaaaccagatgaaagaaactgctttgtgggagcttagggctcgccaaagaggatggaacaaaaagatgcttcaatga

SEQ ID NO: 67761 - DNA, 1353 bp, Glycine max
  Peptide Sequence Number=SeqID_184539
atgtgttgcttcagaaaacggttcaatttgttcttcattttccttgccttggatgcaacacccatcttctcattaacagattcctcaaatcaactctccacaaactatctagaaaatgccaagaagcctgaagtatttgattggatggtgaaaatcagaaggaagattcatgagaatccagagttgggttatgaagaatttgagaccagtaaactgattagagaggaattagataaactgggtatctcatataaacacccagttgctgtcactggtgttattggctacattgggacaggaagctcgccttttgttgcaataagaactgatatggatgcactcccgattcaggaaatggtggagtgggagcacaagagtaaagtacctggaaagatgcatgcgtgtgcccatgatgctcatgtcgctatgcttcttggggcagcaaagattctcaaacaacatgaaaaacagttgcagggaactattgttcttgttttccaaccagcagaggaaggaggtgcaggggctaagaaaattttagatactggagccttagataatgttattgctatctttggattacatgtgaagcctgagattcctgtaggtgaagtggcctctaggtctggtccattattggcaggaagtggtgtatttgaagcaataataagaggaaagggaggtcatgcagctcttccccaactttctatagaccctgtaatggctgctaccaatgtcattattagcttacaaaaccttgtttctcgcgaggctgatcctcttgaccctcaggttttgacaattgcaaagctccaaggaggtgatgctttcaatgttattccagattatgtcacaattggtggcactttccgagctttttctagagaaacattggagcaccttaaacaacgcattgagcaggttatcattggtcaagctgctgtgctaaggtgcaatgcaagtgtcaacttctttgaagaagagaatcctttatatcctccaactataaataatggtgacctgcacaagctttttgttgatgtagctgggaatttgcttggtatcaataaagttgacactaatatggaacaagacatggctgctgaagactttgcgttttatcaagaggtcatacctggctactacttcacgcttggaatgaagaatgcttcttcatttgaaccggttgcgccattacactcaccctatcttgtaatcaatgaagatggacttccttatggggctgcacttcatgcatcattggccactggttatcttacaaaatatcagcggggcatagccaaggtagtagggaaatatcatgatcaattcttcaactgtcacatgctttag

SEQ ID NO: 67762 - DNA, 510 bp, Glycine max
  Peptide Sequence Number=SeqID_184540
atggaacttggaaatagttgtaacataataatgagtttcagacaagattttcggatttcacttgaagtctttaggataggatgcattgaaatgatagcaaatcttcttgatcgtgctgtagaaaatgttggcaggaaatcattgaaggttttttttcaagtgaatacaagcggagaaacatccaaatttggcgttgaaccagctcagtgggtggatcttgtaaaacatattacaaactgcccaaaccttgagttttgtggcctaatgacaattggcatgctggattattcatccaccccagaaaactttaagacgttatccaattgcagaagtgaagtttgtaaagcaattggaatatcagaaacacaatgtgagctgtctatgggcatgactggagactttgagcaggctctaactctaattttgaagattgagatgggaagtacaaatgttaggaatggaactgccatatttggatcccgagaatacccaccgaaagaagaggagtag

SEQ ID NO: 67763 - DNA, 667 bp, Glycine max
  Peptide Sequence Number=SeqID_184541
atgtctggtcttgctgccgcgtgtccaggttcaggtgcaccacccttgtctcttaaactatcatccacgctcttgttttgtgctgccacagggttactactagtgatgaacaagatccaaccatcacaactcgccgaggaacaacgaaacgcaacaagattgtttaagtgcctcaataccaaaatagaaactactattgctcttcggaatcctacagaggaagatgtgaatgatatgatagagaaggttttggctcttgatagagcttacccacttcctctcttgggaggagccatgcttgagaaattccctgaaaaatttgagcctgttgtttggtggcctaataataagacttcacaaccccatgaaggaaaagcaaagagtgagaaaatggaacaagagttaatgaatggatggagtgaagagctagaaatggaactgagggaggttgttgaggtgacaaaaagaaaagattttgaggactatgagaggttaggaaacatggcgttgaagattaacaagagtttagccattatagggcctttgcttatgggcattgcaacaattggttctgtgtttgtggacaatattgggtcatcttcatgggcatatttggtgacccttttggctggatcatcggcggctgtggttaactcctttgagcatg

SEQ ID NO: 67764 - DNA, 1260 bp, Glycine max
  Peptide Sequence Number=SeqID_184542
atggcttctatggccagaggcgccaagagacgccactcgataataagtagaaaaatgctgatcctcttctccgcttccctttcatgcgtcgtcgttttagttatttgttctctcttcagattccactctcccaaacccccaatttcaatttcaatttctcgcgtcgtcttcgatggccctcccaagatcgctttcttgttcctcgttcgccgcaacctccctctcgatttcctctgggacgctttcttccagaacgtcgacgtttcgagattctcgatatacgttcattcggcgcctgggtttgtgttggatgagtcaaccaccaggtcgcaattcctctacggtcgacaaatcagtaatagcattcaggttttatggggagaatcaagtatgattcaggcagaaagattgttactggcagcagctttagaggaccctgcaaatcaaagatttgttcttctctcggacaggaagggatgggtgggacttggcatttgtttgtgcaaacttacttgctcatgctgtgttcctctgtacaacttttcctacgtgtacaattatctcatggtttctccaaggagtttcgtggacagttttcttgatgcaaaggagggccgctacaacccaaaaatgtctcctaaaataccaagggaaaaatggcgtaaagggtcacagtggatcactgttgttcgtaagcatgcagaagtggttgtagatgatgatgttatcttttctgtctttaagaaatattgtaagagacgtccaccaattgatacaagcaagggaaagctgaatctgcatagttctgattctgaaaaccggacaagctggtctgaagggttgaaccggaaaggtggatcaatggccagacagaaacttcagaagcagcacaattgtattccagatgaacactatgtgcagacattgcttgcaatgcatgaccttgaaggtgaacttgaacgtagaacattgacctataccctatggaaccagtctacaacaaaaatggagaataaaggctggcatcctattactttcggctattcaaatgctagcccgcaaaggataaaggaaataaagggcatcaaccatgtttattacgagactgagtaccggatagaatggtgtcatacgaattccacatccgttccttgctttttgtttgctaggaaattctctcagggagctgctatgcgcttgctgagccaggaagttgttaaccactttgaagtttctgcactgttagccactcccacatga

SEQ ID NO: 67765 - DNA, 2268 bp, Glycine max
  Peptide Sequence Number=SeqID_184543
atgttttcatacaaaccaaagcagagtccaagtggcctaaaacgttgtgttgtctcactaccacacccagccaccaccaattcagtcaatgccactatcaaccaccattcaacccaaggtgcacaccaccaagttcttgccacctatgcatctatgctcaaaacccatgtcccttctgacgcctacactttccccagtcttctcaaagcatgctcttttctaaacctcttttccctcggtcttaccctccatcaacgcatcctcgttagtgggttgtccctcgatgcctacattgcctcttctttgatcaacttctacgctaaatttgggtttgctgatgttgctcgtaaagtgtttgactatatgcctgagaggaatgtcgtaccttggaccaccattattgggtgctactcgcgcaccggtcgtgtgcctgaggccttttctttgtttgatgaaatgcgtcgtcagggaattcaacccagtagtgttaccgtattgagcttgctgtttggagtttcggagcttgctcacgtgcagtgtttgcatggttgtgcaattttgtatgggtttatgtctgatataaacttgtcaaattccatgctgaatgtgtatgggaagtgtggtaacattgagtattctaggaaattgtttgattacatggatcacagggacctggtttcatggaattcgttgatctcagcctatgcccagattgggaatatatgtgaagttttgttgcttctcaagacaatgaggttacaaggttttgaggctggcccacagacttttgggtccgttttatctgtggctgcatcaaggggtgagttgaaattgggaaggtgcttgcatgggcagattttaagagctggtttttacttggatgcacatgttgaaacatcattgattgtagtgtacttaaaaggtgggaaaattgacattgcatttagaatgtttgaaaggagttcagacaaggatgtagttttgtggacagcaatgatctcaggccttgtgcagaatgggtctgcagacaaagcactagctgttttccgtcagatgttaaaatttggagtgaagccatctactgctactatggccagtgtaatcacagcttgtgcacaactagggtcttataatttggggacatcgatccttggttacatattaaggcaggaattacctttggatgttgctactcaaaactctcttgttaccatgtatgcaaagtgtggtcacttggatcagagttccattgtatttgatatgatgaacagaagggatttggtttcctggaatgctatggttactggatatgctcaaaatggctatgtttgtgaggccttgttcctttttaatgaaatgaggtctgataatcaaacacctgattcaataaccattgtctccctcctccaagggtgtgcatccactggacaactacacttaggaaaatggatccacagctttgtgataagaaatggccttaggccttgcatcttggttgacacttctttggtagacatgtactgcaaatgtggtgatttggatactgcccaaaggtgtttcaaccagatgccaagtcatgatttggtctcatggagtgccataattgtgggatatggttatcatggcaaaggggaggctgcattgaggttttactcaaagttcctggaaagtggtatgaaacccaaccatgtgattttcctctcagttctatcttcttgtagtcataatggactagtagagcagggcttgaacatatacgaatcaatgaccaaagattttgggattgcaccagatcttgaacaccatgcttgtgtagtagatctcctcagtcgtgctgggagggtagaggaggcatataacgtgtacaagaaaaagttcccagatcctgtacttgatgttttaggcataatccttgatgcttgtcgagcaaatggtaataatgaacttggtgatacaattgccaatgatattctcatgctgaggcctatggatgctgggaattttgtacaattagcacactgctatgcttcaataaacaagtgggaagaagtgggtgaggcatggacctatatgagatctcttggcttgaaaaaaattcctggctggagctttattgacatacatgggaccatcactacatttttcacagaccacaactcacacccccagttccaagaaatagtttgtacactcaaaattttgagaaaggaaatgatcaaaatggaggaagtggagatttaccttgaaagcagccacatatcacaataa

SEQ ID NO: 67766 - DNA, 321 bp, Glycine max
  Peptide Sequence Number=SeqID_184544
atggaattctgtgcaactctaccactttctcagcttccttatgtctacccttcaacacttagtagtaacaaagcttatccattttggtcttgcaagcgaaggatctcatcacgaccaacacgcttacactgcagcaagatgtttgtacctggatttggagaagcatcaccagaagcaaaggctgctgaaaacctccacaatttcttcacctttgttgcagtgaagattgttgctgctcaacttgaggttccttctccttttgctttttcatttgttccacaccttcctattgcctttcgtgctcgcttgtattcattctaa

SEQ ID NO: 67767 - DNA, 791 bp, Glycine max
  Peptide Sequence Number=SeqID_184545
gaagtggtgtatttgaagcaataataagaggaaagggaggtcatgcagctcttcctcaactttctatagaccctgtaatggcagctaccaatggcattattagcttacaaaaccttgtttctcgcaaggctggtcctcttgacccccaggttttgacagttgcaaagctccaaggaggtgctgcattcgatgttattccagattatgtcataattggtggcaccttccgagctctttctagagaagcattgaagcaccttaaacagcgcattgagcaggattatgattatgagtttaagggtgatcctatacataactgcaatgtggccttcaagtttatcactgtggtgggggctaaggctgattcatatatgcaggttatcattggtcaagcagctgtgctgaggtgcaatgcaagtgtcaatttccttgatgaagagaaacctttatatcctccaactataaagaatgatgacttgcacaaggtttttgttgatgtagctgggaatttgattggtatttataatgttaacattgatatgcaaacagacatggcagctgaagactttgcattctatcaagaggccatacctggctattacttcacgcttggaatgaagaatgcttcttcaattgaaacggttgcgccattacactcaccctatcttgtaatcaatgaagatggacttccctatggggctgcacttcatgcatcattggccactgattatcttacaaaatataaacaggacgtagccagggtagtcgggaaatatcatggtcaactatga

SEQ ID NO: 67768 - DNA, 672 bp, Glycine max
  Peptide Sequence Number=SeqID_184546
atgtcctgtgtaaagaacagtactgcactaggaatagaactttctgttgtgctaggagaacggtcaaaccaatgtactgataaccttacatacaaaatcccaagacgcccaagagattttggatcttcaaagaagagaaaggttcaagatattataaaatcgaagtcaatgggggaagatgttttggtttgctcaaagaggactgaacttccatttaggaaatggctagaagcaaagaagtgtcttacttcgttgaagaagaaaagaaaacttgaaaacaatatcttaattaacaatttggaagataataaagtttatgttccctcaaagacaaattccagaagcaaagctagaaaaatggatgatgtaaaggatactgagcaaacttccagaagatgtcatcaatgcatgaaaaaggaaagagcagcatatgtaccttgtactaaatgtcagaaaatatttccggatttgtcaatagaagatattgcacaagagtgtcccttttgccaaaagaattgcaactgcaatgtttgcttgagttcaagaggaatgatcaaggtgaatattttgactcacacagctgaggtaacgttaactgatgaacagaactctgttatttcaaaactgaaaaaagcacacattgcccaagatgagaaagagcaccgtgcttga

SEQ ID NO: 67769 - DNA, 639 bp, Glycine max
  Peptide Sequence Number=SeqID_184547
atggatatgcaagcatcaaatgaatttcttgcagaattgaaggttctgacacacgtccatcacttgaacttgggctccttatttttggtttatgagtacattgagaacggctatttaagtcaacatttgcgaggctcaggaagggatccgttaacatgggcagctagagttcaaattgctcttgatgcagcaagaggactggaatatatccatgagcacacagttcctgtctacatccatagagatattaaatcagcaaacattttgattgacaaaaacttccgtgcaaaggttgcagattttggtctcacaaaattgaccgaatatggtagttcttcattacatacgcgtcttgtgggtacatttggttatatgcctccagaatatgcacaatacggtgatgtgtcctccaaaatagatgtatatgcttttggagttgttctctatgaactcatatcaggcaaggaagctattgtcaagataaacgaacctgaaaatgaatcaaaaggactagtctccttgtttgaagaagttcttggtctgtcagacccgaatgaagatcctcgtcaacttgttgatcctagacttggtgacaaattccctcttgactcggtatttaaggtgtctcagcttgccaaa

SEQ ID NO: 67770 - DNA, 111 bp, Glycine max
  Peptide Sequence Number=SeqID_184548
gattgtcgtcttctagccgccgatgatggtattagagatatattgaaagagaatttgccataccagattcatcttcttgtaaaggatgatgtatctcattttcctccttga

SEQ ID NO: 67771 - DNA, 420 bp, Glycine max
  Peptide Sequence Number=SeqID_184549
atggtgaaaatcagaaggaagattcatgagaatccagagttgcgttatgaggaatttgagaccagtaaactcattagagaggaattagataaactgggtataccatataaacacccagttgctgtcactggtgttattggcttcatagggacaggagggtcaccttttgttgcagtaagagctgatatggatgcacttcccatccaggattttgacatttttctaataatagatggttggtttatttgggtaactgggttgaaggaaatggtggagtgggagcacaagagtaaagtacctggaaagatgcatgggtgtggtcatgatgctcatctcactatgcttcttggagctgcaaagattctcaaacaatatgaaaaagagatacaggtcaatttacattttatattgtcttcttaa

SEQ ID NO: 67772 - DNA, 596 bp, Glycine max
  Peptide Sequence Number=SeqID_184550
gaaaattccaaggaggtaatgcattcaatgtcattccagattctgtcacaattggaggcaccttccgagctttttcaaaagaaagcttccagcaattaagacagcgcattgagcaggagggcgaggcgagattcgagggtgcgttttccaagaaaggaaaacgcgtgggagtcgccactaaagtttatgttgtgattgcacaagctgcggttctgaggtgcaatgcaacagtcaatttctttgagggagagaagcctttctttcctgcaactataaacaacaatgacttgcatgaacattttgggactgttgcggtgaatttgcttggcatcaataaagttaatgacatgccaccattgatgggagctgaagacttttcattctatcaagaggttatgcctggctactttgcctttattggaatacagaatccctcacatgaaaaactggagcaagtacactcaccctatttcaagatcaatgaagatgtgcttccttatggggctgcacttcatgcctcattagctgttagttatcttctaaaacatccgcaggatgtaccgtctgcagaggggaaacatcatgatgaattgtaa

SEQ ID NO: 67773 - DNA, 942 bp, Glycine max
  Peptide Sequence Number=SeqID_184551
atggtggagtgggagcacaagagtaaagtacctggaaagatgcacgcctgcggtcatgatgctcatgtcactatgcttcttggtgcagcaaatattctcaaacagcatgaaaaagagatacaggggactgttgttcttgttttccaaccagccgaggaaggaggtggaggggctaagaaaattttagatgctggagccttagaaaatgttactgctatctttggattacacgtggtgcctctcattccagtaggtacagcggcctctaggtccggtccattaacggctggaagtggtttctttgaagccaaaataagtggaaagggaggtcatgcagctattccccaactttctatagaccccatattggcggcttctaatgtcattattagccttcagcaccttgtttctcgcgaggctgatcctctagatccccgggttgtcacagtttcaaagattcaaggaggtgatgcattcaatgttattcctgattatgccacaattggtggcacctaccgtggttttactaataaaagcatggaccaacttaaattgcgaatcaagcaggttatcatcggtcaagctgctgtgcagagatgcaatgcaactgttaacttctttgaaaatgtgggaccagcgaatcctccaactgtgaataatggtgacttgcacaagcattttcaaaatgttgctgagaatgtgcttggcgtcaataatgttaatcttaacatgccaccattcatggtagctgaagactttgcattctatcaagaggtcatacctggctacttcttcacgcttggaatgaagtatgcttcacctaatgaaccgtttcagtcattacactcaccatatctcagaatcaatgaagatggacttccttatggggctgcacttcacgcatcattagctactagttatcttataaaacttcagcagtaa

SEQ ID NO: 67774 - DNA, 1809 bp, Glycine max
  Peptide Sequence Number=SeqID_184552
atgggttcactcaattatttgaatttaagcaataatgcactctccatgacagttggtgatatatttgctagtcttcaagatcttggcaccctggatctatcattcaataacttctctggggatcttcctccttcagttggtgcattggccaatctttcttctcttttcttgcagaagaaccagttgactggttctcttagtgctctcgttggtttgcctttggatactttaaatgttgcaaacaataatttcagtggatggataccccatgagcttagttccatccataatttcatatacgatggaaattcttttgagaaccgtcctgctcctcttccgccgacagttacttcacctcctcccagtggatctcatagacgtcatcattctggatctggttcacataataaaacacaagcttctgataatgaaaaatctaatggccataagggtttgacagtgggggctgtcataggcattgttttaggttcagtactggtggctgctattgtgttccttgctcttgttttctgtatccgaaagcaaaaggggaagaaaaagggtgcaagaaattttagtgggagccttcctcgtggagttattaatgtaactcctcagatgcaagagcagagggtaaaaagtgctgctgttgttacagatctcaagcctcgtccagcagaaaatgtgacagttgagagggtagctgtaaaaagtggatctgtaaagcagatgaaatcccctataacttctacatcatacacagttgcttctctccaaagtgcaacaaatagctttagtcaagaatttattattggtgaaggttctcttggccgagtttacagggctgattttccaaatggaaaggtaatggctattaagaagatcgacaactcagctttgtcattacaggaggaagacaattttcttgaagctgtttcaaatatgtcacgcttgcggcacccaaacattgtgacattggctggatattgtgcagagcatggccaacgacttctagtttatgagtatatagcaaatggaaatctgcatgacatgctccattttgctgaagatagcagcaaggatttgtcttggaatgcccgtgtacgcatagcacttggcacagcccgggctttagagtacctgcatgaagtgtgcttgccttctgttgtacatagaaatttcaaatctgcaaatatattacttgatgaggagctcaatcctcacctgtctgactgtggtttagctgctttgacaccaaacactgagcggcaggtatcaactcagatggtcggttcatttggttatagtgctcctgagtttgcattatctggagtatacactgtaaaaagtgatgtttacagctttggggtggttatgctggaactattgactggtcggaagccacttgacagttcacgggttcgatcagagcagtcacttgtgaggtgggctacaccacaactccatgatatagatgccttggccaaaatggttgatcctactttgaacggcatgtatcctgcaaagtcactgtcacgctttgctgatatcattgccctctgtgttcaggtaaagggaaatgcagaaatttgggacaagagtaagaatgagtgcattagagggaaagttgaggtagcatggacagtcctgttagagccggaacccgaatttcgacctccgatgtctgaggtggtgcaagcattggttcggttagtgcaaagagcaagtgtggttaaaagacgaccaagtgaggaatctggttttggtcacaagaccccagaccatgatgccatggacatgtcattttaa

SEQ ID NO: 67775 - DNA, 384 bp, Glycine max
  Peptide Sequence Number=SeqID_184553
atggttttacctggagatgtttttgatttgcctattcggaaggacattattcatcgtgttgttaggtggcagcttgcaaaacgacaacaggggactcactcaacaaaaactatcagtgaggtcagtggcactgggagaaaaccttggaatcaaaagggaactggtagagcaaggcatggttcattgcgtgggcctcagttcaggggtggtgccaccatgcatggccctaagccccgaagccatgctttcaaagtcaataagaaggttcgacgtctagggctgaagattgctttatcagctcgtgcagcagaaggaaaggcaagtctcctccccaacccgtgtccccactcaccatcaaaaaataaaaagtgttaccttccctaa

SEQ ID NO: 67776 - DNA, 522 bp, Glycine max
  Peptide Sequence Number=SeqID_184554
atggaatggaataatgcttcacattggcgcccggctctttatcctatgcaccaattcaagtgcaaactttcatgggctagcaatgagggtggtgataggaatggatcgtctgaagaggatgttgatctacacaacatgatagatccccaggcagaggacagggatttaaagggtcagcttttgcgcaagtatagcggatacttgggcagtctgaagcaagaattcatgaagaagaggaagaaaggaaagctacctaaagaagcaaggcaacaattacttgaatggtggaacagacattacaaatggccttacccatccgaatcccagaagctggctcttgcagagtcgacaggtctggatcagaagcaaatcaacaactggtttattaatcaaaggaaacggcactggaagccttcagaggacatgcagtttgtggtgatggatccaagccatccacactattacatggataatgttctaggcaatccatttcccatggatctttcccatcccatgctctag

SEQ ID NO: 67777 - DNA, 237 bp, Glycine max
  Peptide Sequence Number=SeqID_184555
atggaagaaggatactccaccaacaagcctctgctactcaaaggtgtcaaatgtgactactggaaggaatgtctgatagctcactttgagtccattcatatagacctctgggatgttgctcaaaacgatctgatggcaacctcttggatgactgaagccaacctctatcggatggcaaacacaacatcagaagaatcaaatgaagaggtaaacctaaataaccttgaaactctttaa

SEQ ID NO: 67778 - DNA, 636 bp, Glycine max
  Peptide Sequence Number=SeqID_184556
gccatcccaagttattctgctaggagatccttgtttgagcattatgttaaaactcgtgcagaagaagaacgtaaagaaaaacgtgctgcactgaaggcagcaattgaaggatttaagcggttactggatgaagcctcagaagatattaattacaatactgattatcaaactttccggaagaaatggagaaatgatccacggtttgaggcattggaccgcaaggaacaagagcacctattgaatgaaagagtgcttcctttgaagaaagctgctgaagaaaaggctcaagcaatgcgtgcagctgctgctgccagttttaagtcaatgcttaaagagcgaggagatatatcttttaactcccgttggtccagggtcaaagaaaatttaagggatgacccaagatataaatgtgtgaggcatgaggatagggaagttttgttcaatgagtatatatctgaactgaaagctgctgaacatgcagcagaaagagagaccaaagctaaaagggaggagcaggtattagctgcaaaatacttgaagttgaaacttgtttataggacaagctcagggaaagagaacgggagctgcgcaaaagaaaggaaagagaagaacaggaaatggaaagggtgcgactaa

SEQ ID NO: 67779 - DNA, 276 bp, Glycine max
  Peptide Sequence Number=SeqID_184557
atgactgtgtcatacaaggattggcacgagatgctcccttttgcattgcatggttatcgaacctcagtatgcacattgattggggcaacccctttctctttggtctaccggatggaggttgtgcttttgtttgaagtagaggtcccttctttgagaattcttgtcgaatcagggttggaggaatcagagtgggcccaaactcactttgatcagttgaatcttatggaaggaaataggttggccgccatgagccatgtacggttttataaaatctga

SEQ ID NO: 67780 - DNA, 433 bp, Glycine max
  Peptide Sequence Number=SeqID_184558
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtgtttttttgacggcaacgttagagg

SEQ ID NO: 67781 - DNA, 270 bp, Glycine max
  Peptide Sequence Number=SeqID_184559
atgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaagaaaaatcgatgattttaccattgtgcatgtctaacaatggagacttcttcatgctgaaattcactagaaatgctgatgatgaataccaaacaattctgtataaccagggggatgatgtgagttcttga

SEQ ID NO: 67782 - DNA, 290 bp, Glycine max
  Peptide Sequence Number=SeqID_184560
ggatcgcgcccgcaggacacccagtggacccaaagaagtccaacagggtcttggggcttccagctctgattacgggcctttgtcagttctacggagtgtccgtcacccccagcaaggtcatcaggcctcctactaaccgagctttcataaagaagtattgcgcccccaggcaggcagagggcgagacaccacaacagcctggggatggccagcaacaggcaacaaatgcaccgtcgccacctgcagagcccctcagctcatccacaaaaaggttagagtattgcctatga

SEQ ID NO: 67783 - DNA, 168 bp, Glycine max
  Peptide Sequence Number=SeqID_184561
atggataagagcttgaacaaactcaattttagcgaggcagccagctcgctcagcgaatgcaaaaccctagaagatgataagtcagagaccatcccgcttagcgtgcattcagcccgcccagcgaggaagttgtctctactcacgcttagcgcgcccagactcgcttag

SEQ ID NO: 67784 - DNA, 795 bp, Glycine max
  Peptide Sequence Number=SeqID_184562
atgtacgaagtgagtcaccggaataatttgccaacaatcagaattcagcgcctcgagaggcccgctcacgtgtttgcagtcgaagaggttgttgacgataaaccctggttccatgatatcaagtgtttccttcaaagccaggaatatccacccggagcatccaacaaagacaggagaactttgagaagattgtctgataagcaagaagcagaatttttgatgcatgaggtacatgaaggctcctttggtactcactccaatggacatgcaatggcaaggaagttgttgagagcaggttactactggatgtcgatggagacagattgttgcaagcatgcaaggaagtgccacaaatgccagatttatgctgacagaattcatgtacccccaactacacttaatgttctttcttctccgtggcctttctctatgtggggcatcgatatgattggtagaatcgaaccgaaagcttcaaacgggcatcgtttcattctagtggctattgattacttcaccaagtgggttgaagcagcatcttatgcaaatgtgactaagcaagttgtggtccgctttatcaagaatcagatcatctgccgttatggtgtgcccaacagaatcattacagataatggaacgaacttgaataacaagatgatgaaagatttgtgtgaagagttcaagattgagcatcacaattcttctccttacagacctcaaatgaatggcgcagttgaagctgcaaacaagaatatcaagaagatagtgcagaagatggtggtcacatacaaagactga

SEQ ID NO: 67785 - DNA, 963 bp, Glycine max
  Peptide Sequence Number=SeqID_184563
atggagggtggtagtagtagctctaatggcacttcttatctgttggcttttggagaaaacaacagtggtgggctatgcccaatgacgatgatgcctttggtgacttcccatcacgctggtcatcatccaataaatcctagtaataataataatgtaaacacaaactgtctcttcattcccaactgcagtaacagtactggaactccttctatcatgctccacaataatcacaacaacaacaaaactgatgatgatgataacaacaacaacactgggttagggtactatttcatggagagtgaccaccaccaccatcaccacggcaacaacaacaacaatggaagctcctcctcctcctcctcttctgctgtcaaggccaagatcatggctcatcctcactatcaccgtctcttggcagcttacgtcaattgtcagaaggttggggccccgcctgaagtggtggcaaggttagaagaagcatgtgcttctgcagcgacaatggctggtggtgatgcagcagctggatcaagctgcataggtgaagatccagctttggatcagttcatggaggcttactgtgagatgctcacaaagtatgagcaagaactctccaaacccttaaaggaagccatgctcttccttcaaaggatcgagtgccagttcaaaaatcttacaatttcttcctccgactttggtgatgaccctctccctctctctatattctatcttctcaaatattctgcatatctaaaaagtttggctggttttgcttcctttatattgttaaaggttctccttgaaatgaatacagagatggatgaatgtgccgaatgcagcttgctggtgaatttaggtctgtggttgttcccaggagtggtaaggctagatactctcattggaaatgtaatatgcagacgaaaaagtggcagaaaagagttgaagttctttggggataagtggtga

SEQ ID NO: 67786 - DNA, 204 bp, Glycine max
  Peptide Sequence Number=SeqID_184564
atggacattatgtgcagaaataatataagtcagggttatggctcgtcatttgctaaaccaacgttgctggtgtacttattattccctaggtcgagtaagaagggccttgagcaacaagaagagttgcacgatcagaagtcaactcagctgctcaaagccagcagaatagctgctcttccaaagtctgagctatcataccgctaa

SEQ ID NO: 67787 - DNA, 327 bp, Glycine max
  Peptide Sequence Number=SeqID_184565
atgacgtctgaggcagcaaaggaaattgctaacaagattgatgcgtttgaggagcaagcctcacagggttcctttgtcgcccatggacgtcatgatgtactaactactgccattgggcgaccagaacaccctggtcgtgtgcgtgttgcaggagccagtgtaaccatcaagcaatactttggattggcttcaaggacctcctacacgtcttcctccatggctcccaaagacctgcaccagttgaagcaacaaatcagggaccagctggaggattcgttcacagaaaaagtcactcgacaactaatgttatccttcagcttgatatag

SEQ ID NO: 67788 - DNA, 250 bp, Glycine max
  Peptide Sequence Number=SeqID_184566
atgagggtgttccacatgaaggagttgggacgcggggtggagtggaagattctgaaagcgagggagaggtcgccgaagggggagagggcgcacgagaagaacaggcggctcgcggcgaaggggtcggtggcgacgacggcggagacgatcatctgggcatggacctgcttcagctggtctagggttgtgcatttgtcggatatgagtgccagagtggcgagggttctttgcagcggcggtggtttaaagg

SEQ ID NO: 67789 - DNA, 405 bp, Glycine max
  Peptide Sequence Number=SeqID_184567
atgcgccgaagcaacgtcctccccggcaagcacaccttccccttcctcctcaaggcatgcgctcgtgtgcgctcgttcacagcttcccaacaggtccatgtacatgtcatcaagttcgggttggactttgattcccacgtggttgatgcattggttcgatgttactctgtttcgggacactgcgtcagtgcccgtcaagtgtttgatgaaacgcctgagaaaatttcgagtctttggaccactatggtttgtgggtatgcccagaatttctgctccaacgaggctttgaggctgtttgaggatatggttggggagggctttgagcccggtggggccaccctggcgtcagtgttgtccgcatgtgcccggtcgggttgtcttgagcttgggggaaaggattcatga

SEQ ID NO: 67790 - DNA, 2421 bp, Glycine max
  Peptide Sequence Number=SeqID_184568
atgatgctaggttcattacctatattgcccctccctgctcctccttctgatggaaatctaggtcctctgcctgagtctcaagtgattgatgataatgaggaggagcagaacaaatcaaattctgcttctgttccggcgccggcaacagttgccacccacaccagaacgattggaattatacatccgcctccggacattaggaccattgttgataaaacctcccagttcgtggccaagaatggtccagaattcgaaaagaggattattgcaaataacacaggaaatgttaagttcaatttcttgaactcgtcagatccataccacgcatattatcaacacaggttgtctgaatttcgtgctcaaaatcagtcttcagggcagcagcaacctgcagactcggcggctgttcctgaatccgtcccgtctgatagcaacggcgtagtagcagcagcagcagcagctgcagaaaagccagatttttctgcccagtttaaacctgtaaggaaagtgcttgaaccccctgaagctgaacagtatacagttcgccttcctgaaggaattacaggtgaagagctggatattataaagctaacagcgcaattcgtggctcgaaatgggaaatcttttttgacagggttgaccagtagggaagttaataatccacagttccattttctgaaaccgacccacagcatgtttacgttttttacttccctcgcggatgcctattcgaaggttttgatgccaccaaagggtttgatggagaagctaaagaatagcgtgtctgatatgactactgtccttgaaaggtgtgtgaataggctggagtgggatcgttctcaagagcaagctaggcaaaaggctgaggatgagatagagcaggaaagaatacaaatggctatgattgattggcatgattttgtggtggttgaaacaatagattttgctgatgatgaggaccaagagttacctcctccaatgactattgaggaggttataaggagaagcaaggtgacagccatggaagaagaagatattgttgagcctggaaaggaggtcgaaatggaaatggatgaggaagaggcccaacttgttgaggagggcatgagagctgctagtttggaagaccgtgatgacaggaagcagaatgaagtcagggttactgaagaccctgaaccaccaatgagaattgttaagaactggaagagaccagaggagaggatttctgcagaaagagattccaccaagtttgttgtttctcctatcactggtgagttaattcctattagcgagatgtcagaacatatgcggatttctctcattgatcctaagtacaaagaacaaaaagaaagaatgtttgccaaaattcgagagacaactttggctgcggatgatgaaatttcaagaaacattgttggacttgctcggacccgtcctgatatatttggtactacggaagaagaggtctccaatgctgttaaggcagaaattgagaagataaatgatgagcaaccaaagcaggttatatgggatggtcacactggtagcattgggcgtacggcaaaccaagccatgtcccaaaatattggaaacgaggatcaaaatgatgcttctaataatgaagccaggaactttctgggtcctgctgcacctcctccaagacctggtatgccttcagttcgtcctcttccaccaccacctggactggcattgaatcttccccgtgttcctgtccaatattctgctccccatagtggtgcccttccaatgcctccaccaagacccatgatgccatctattcggcctgctcctcctcctccaatgccgatgaatactggacagcagtcagttatggctggccaaccacccccaatgcatccatcaattcctatgaataaccaaggaattcccatacccccacctccgggatctcacttcactcatgttccagttccacgaccttttgttcctctttctgttccgcaatcagtcatgcctatgatgcatccaccacctttgcctcaaggagtgccaccaccactgccaccagaggaggctcctcccccactcccagaagaaccagaaccaaagaggcagaaacttgatgattctgctctgatccctgaagatcaatttctggctcaacatcctgggcctgttcgcatcagtgtatctgttcctaatgttgatgaaggaaatctcaagggacaagttctggaaattacagtgcaatctttgtctgaaactgttggtagtctgaaggaaaaaattgctggggagatccagctccctgctaataagcagaaattgagtggaaagcctggctttctcaaggataatatgtcactcgcccattacaatgttggtggaggtgaaacacttaccctctctttaagagagcgtggtggtagaaagagatga

SEQ ID NO: 67791 - DNA, 561 bp, Glycine max
  Peptide Sequence Number=SeqID_184569
atgccagagaggaatgttgttacttggaatgctatgatctgtgggttgggtgcttatggatatgtggatgatgcgcttggtttgtttgagaagatgaagaaagagggggttgttgttcccaatggtgtcacctttgttggagttttatcggcttgttgtcatgctggcttgattgatgttggtcgtgagatttttcggtcaatgaagtcggtgtatggaattgagccgaagattgagcattatgggtgcttggttgatcttcttgggagagggggttggttgttagaggcggtggagctggtgaaaggaatgccgtggaaagctgatgtggttattttgggaactttgttggcagctagcaggattagtggaaatactgaggttgctgaaagagtggtgaaggatattcttgctctggaacctcagaatcatggtgttcatgttgctttgtctaatatgtatgcagaggctggacagtggcaggaagttttgagactgaggaagacaatgaaagaagagagactcaagaaggctccagggtggagccttgttgccacttag

SEQ ID NO: 67792 - DNA, 288 bp, Glycine max
  Peptide Sequence Number=SeqID_184570
atgtcggatcacgagctgctagcgtcgggagaaagcataaaagagagggaatcagatgatgtggtgtgtggggactcgtcgtcctcctcgagaagcggcgagatgggttcggtttggttggaggccacgtacaccgtcccaagttcccgtcagcggagtgactcctttggtacactcactggcaccagatcacagccctatgatcttcagaaccgctccggtcaactccgcttcgatcccgttccctcaaaggacaaaccctgcgcggaacttcttggctttcgctaa

SEQ ID NO: 67793 - DNA, 225 bp, Glycine max
  Peptide Sequence Number=SeqID_184571
atggaacaaaagctgaaggccaaggtggtggttcagacatgttattacgagcttgggacaggacttgaaagtctcttctcaacgcttgaagttgagcacgtttcactcagttacgtcatcacttggtgttaccacaccatctgcaacaacctgccagaacttcttggatcgcaagagattctccatcaacatgctccaatgatcataatgactatcaaaacgtga

SEQ ID NO: 67794 - DNA, 664 bp, Glycine max
  Peptide Sequence Number=SeqID_184572
tgataagaaaaacgcagagaacaacaacgaagaaaaagagaaagtgaagaagaaagagagaaaaagtggaagcggaagcggagcgagttccgccgaattgaacatcaacatatggcccttctcgcgaagcaggtccgcgggaaatgcggggacccgacccaaactgttcgccggagctccggtgacccggaaggtgaacagcgcgccgtgttcccggagcaactccgccggcgagtcaaagtccagaaagtggcccagcagtccgggccgcgccggagtccacgtgggccggagcagcccggtctggcaggttcgccggaagaactccaacgagcctcctcagaagcccaaaactcgccggagcaaagttgctgccggcggaggaaccgccagggttttgaatctgaacgttcccatgtgcattggctacagacaccacttgagctgcagaagcgacgagaacagcgccgtcggagttagcggcagcgccgccgccgtcatcaactgtaacagtaataacaataatactaataataataacagtggcggcaatgatggaggaagtgggggcaatatttttaacctgcgcaacctcttcaccaaaaaatgcgcaggtttagatttttgtatacggaaagctacagtttcactttttattttgtga

SEQ ID NO: 67795 - DNA, 363 bp, Glycine max
  Peptide Sequence Number=SeqID_184573
atggccctcactcaagaccctgacaccaatgtcttcgaccaccaccccaagaaaagcgtgccttgcatgacaccgctgccatgtgcaggcggcgatgcccctggctggggtcggctgcatgcacctatgactgcgtcacacgagccatatgcagcgccaaggacggcaccaacttcgtctacccctccccccctgttcgacgaccctgtcgccaaaccatcgtctttctactccgctgccaatgccaacgtcgacttcgatcccaactactacaaccgcttcctcctccacgacttctccgatatctgcctctccaagaccaatgctatcaagaagtcactagacttgctattattgcattga

SEQ ID NO: 67796 - DNA, 537 bp, Glycine max
  Peptide Sequence Number=SeqID_184574
atggttaaggaggagtgtaaggaggtaagtgtctcctccaagagtttagctaagaaggaaagtcatttggcaataaagacaaaccttaaagaaacttcccctcttagacaacctccacatcttctcctttgtaaaaagacacttgttagcattgccacacctcttggtaaaaagacatttataggtgatatgatgaatgtgttgagtggtgcagcccttttttgcaaaatcactcatgcccctaacatcttcatgattcatgtacatagggattcattaggtaggaataatcaacatgaaaatacagaaagagatcaaggggttcccacataccctaagagaataaaggttattactgcatgtaagcacatcaacatagattacttgcaatacgttagtccagtgtatatattggattacatgtcaagtgtctacaaagtcccattagtaggtatgtgtcatcatgattactggccaccatatgaaggaccacaattttgtgccaatctagccatgaggagaaacaaaaaaggttga

SEQ ID NO: 67797 - DNA, 349 bp, Glycine max
  Peptide Sequence Number=SeqID_184575
taccccgagaccacactctagccgactccgagtctggcctcggatatgctactgaggggctagcatttgatggcctatccctgccgaacactttgggggaccctcagtatcgcccacaaccacaaccctttcattttgtggtgggaagagtccctcctgctatggtggaaagggagaaattggatcatatagaggaaaggctaagggtcattgaaggaggcagaaattatgcctttgctgacatggcaaagttgtgcctagtgcccgatgtggtcattcctccgaagttcaaggtgtcgaacttcgataagtacaaggggactacttgccccaagaatcacttgaagat

SEQ ID NO: 67798 - DNA, 281 bp, Glycine max
  Peptide Sequence Number=SeqID_184576
agaagaattatacctttgggacgtcggatgatggagcgtggatgacggtactacaagagaagccgcgagaggaaggaatcaagaagcttcgagagaagctacgacgaagggagaacgagaagatgacgagtccatggactagcccgcggtctgcgcaggtccgtgggttgcccgtaagcccgcttaatccatggtttgagaatcccacgaactacaacaccttaagaatcccgcttaatccagatctttcattgttggcttgtgatattttgagcatctaa

SEQ ID NO: 67799 - DNA, 271 bp, Glycine max
  Peptide Sequence Number=SeqID_184577
tgaggaaaattgtttccgtggaaaaaatccaagccgaggtgcttccgtaacacttctgagacgtttccgtgagcgatttcatgaagattcttcatcattcttcaccgttcttcatcttcttcatcgttcttcgttcgttcttcgtcgttcttcagtcttcaactggaaaggaccagtcactagagccatgagcaagaggctccaagaggattgggctagagctgctgaagaaggccctagggttctcatgaacctcagggcagatttctga

SEQ ID NO: 67800 - DNA, 576 bp, Glycine max
  Peptide Sequence Number=SeqID_184578
atgctcgctgctgctacttcagcttctcggcaccttcttcaacgcgatgccagaatcggtgcttgcagtggcagtggcaatcgagttcgttctcttttgactgcttctgccatcaccacaacctacccaattcgcattagaaaatgttacagtgacggttatggaattagtttcaataaccctaaacacagaacccgcccaagtttgctttttgctgtaaaagggttcctctctgattcatcaaattctaattccccacatggcagagttaccagaccttacttaccacacctgttaatagattacctcaaaaagaataatttggtggatttgtcctacgtacatggaatcgggtgcaggcgtgcagggttgcagcacctagctccactctgtctaccagagtaccagaccctttccttttctctctctctctctctgatgcaagtgcagtcacacttcaataatcgtgcacttaagaatgatgtgtaccaatgttcagaattcagattacgagcttctttttaccttgattcaaaagtacgcttatgtcattcatctgagtttactagtaaataa

SEQ ID NO: 67801 - DNA, 1206 bp, Glycine max
  Peptide Sequence Number=SeqID_184579
atgggttctagagcacgttggcgccagagttgggctccacagcccttgacacccttaatggaaggccctggccctgaaatgcaagaggaaggaaccaagaaagagagttcatgggaagtaataagggaatggttcaggactcagaagatctccccaagtggaagtttttcacaatcatcatcatcattctatggaaccattcatgccaagacacaagatttgaggctcttgcttggtgtcttgggctgtcccttggctcctattccctcagcacatgatcccactcttagcattcacatcaaagacaccccatttgaaacttcaactgccaaatacattatccagcagtatttggcagccacggggtgcctaaaacagcaaaaggacactaaaaacatgtatgccactgggatggtgaagatgatttgctgtgagacagagatttcatctgggaagaatgtcaagtgcttgggtacaagaagcagtgaaaatggttgctttgtgctttggcagatgcaacctggtatgtggtctcttgaattggtggttggtgaccacaaggtggttgcaggcagcaatggcaaaaccgtgtggcggcacacaccatggcttggcacacatgcagccaaaggcccccaaagaccccttcgtcgcctcattcagctcatgagtcatgatcttgggattgccacttactgcaggttgctaaggggcttggatccaaagaccacagcgagtttattcaccaacgcgcaatgcttgggcgagaatcgaattgggaccgtggattgcttcgtgctaaaggtctcggccgatcgtgcggcagtggttgaaaggagtgagggccccgcagaggtgataaggcacattctatacggttacttttgccaaaagagtggactcctcatatacctagaagactctcacctcacaagggtcccaacacaagacaatgatacggtgtattgggagaccaccatagggagcagcatcggcgactaccgggacgttgatggcatcctcattgcacatcaagggcggtccgtcgcaacggtgttccggttcggggagctctcgatgcagcatagccggacccggatggaggagatttggaccattgatgatgttatgtttaatgtacctggactctccatggaccatttcattcctccagctgatatctttgacaatataaattctccatga

SEQ ID NO: 67802 - DNA, 1668 bp, Glycine max
  Peptide Sequence Number=SeqID_184580
atggcgtccaagtccaacaacaaaactccacccgacccaatgatctcctccggccacaccctcattccggcgattcgtcgtcgccggaaacatcgaaatccaggcattgccgtcgcctttcgcctcaagggggcacacaagaagcactctgcaagtaacaacaacagttcccctgtgaatttcggggaaggttttcagaaaagtgaggaggcttcggcgaggaagctcgcagcagggttgtggcagtggcggtttatgaacggtactgtttttcgatatgcaccatcgttgcctccgtccaagtctcagcttgaatcttcgacgccatgtctcaaatattgttcaaaggaagaggcaacaaaatggaaccctgcccttaataatgaagcattcaacaagtttactatgctttattccatgaagcatcttgaaaaaaaacaaattgtaggtgactgttactttggtgtcactaatttgctagaactcttacgagctcagaggtccatcaatgaactcaaggccacacagaaatcctctaggaaaagaggggaacaatttttgcagaatcttgaagacaaaaaggtcctccggaagtgtagagaatgccacaagattgaaacaacgtttgataacataaaggacaagttggcaagggaaaaaagaagtagagaaaggatggagttattcaataccaaattggtacacgaattggctaaaaccaagacttctgcaaagcagtacatgactaactacaagaaagaaaagagagaaagaaaagtgatagaggaagtgtgtaatgaattagccatgaaagtaagggaagacacggctaagcttgagatgttgctaagagattccgtgaaaatttgcaaggtggtggaagaagagagggagatgatggaaatgactgagctatggcgcgaagaacgcatgcaaatgaagctagccgatgcacagtttgtacttgaagataaatacaatcagatggtccagttgattgcttttctccaagtgttcttgagatcaaggggtgccgaactagacaccactgaactagaggacgtagagttgatcaaacaggcagttgaatcagtaaatattaaacgcattgtggagctttcatatgatttctcaaagtcatctgatgatgcagtttccacttctgaagagctaagaaaagaaaacacagaagaggagttgaataaaagccctatattgcatcacaacagtccctccagtgattattatattgaattagaactaaataataatggttatcttgaggatcagaagtttaattcaatgccacaaagaggagacacagacacctattctgttaatgttaaccaagacaaggatatgttattaggtagtgaagcagaatgtagtgaaaaggcatgtttggaacctttgaagagtagtaaagtttgtcttacctctaaacagctaataaggtcatgccccaatggtggaagaacgatttcttctacaaaatcttcacaggatagaaggctaggtgatgatggttggcacaaacaaaaggagtgtaaccaaagacttccaacaagctcagttcaatgtcaaagttctgttgaaggtagcttcaaacacacggaagagcaagacaagacccacctaaagataaaacaactaaaactcaagctttaa

SEQ ID NO: 67803 - DNA, 491 bp, Glycine max
  Peptide Sequence Number=SeqID_184581
atggaaatggactttggatcggaggagaatgcttccattgtgtatgctgccttagcagttgacaaagagttgcaacctgataaaggtttaatatgtataccggataggtatttggcatggtgcataagagtgttgttaggtgcacccagcatttttgctggtgctcctagtgcggtgaaggtgaaggtgcgttgcggtggtcagcggcggcaaacgaggtacacagaaggtggtggctgtgtcgcgaacatgaacgaagatgagtggatgtatgaaataatgtctgaacaagcagatatggattatgaaaatgaagaagcatgtggtgcgaatgaaccatatgttgattgttctaatgcgttcaatacttctcaggtgtttgagtgccgagaagatgttttgcggtgggctcgattcgttgctcatgaaaacagatttgtgacggtgattttaaggtcggatacaaacataggtagtagaggaaggactac

SEQ ID NO: 67804 - DNA, 567 bp, Glycine max
  Peptide Sequence Number=SeqID_184582
atgagtcaactcggcgccgtgttgcggactcagagggagcccaggaggagtaccattctgggtttgttgacggagcaaatggacggcgttgatagtgggacccgcaggaggcgcagcttcaaggaacgcttcggattcatcggcatggggtgctgtggggccacctggggcttccgttccgacgcgctaagtgtcacccaaggagaacagcaacagcaggaaacggatccagagtgcgtgggtccagcaggtttgggttcgggtatgaatctcgcggcggcgttagcggcggagaggcagctccgggggccgcaggaggaggcagtgagagcgccggggacgccgtggagggtgtcgctgatgaggctgctggaggagaccgaggcggagaaggagaaggagaaagagaaagaggagaatgttgtggggaatgattcggtgtgctgcgtgtgcatgggaaggaagaaaggcgcagcgttcatcccatgtggacacactttttgcaggtacaaatttgttcgaccatgcgctagtttaacttgtggaagatcttcagtcttcacttga

SEQ ID NO: 67805 - DNA, 342 bp, Glycine max
  Peptide Sequence Number=SeqID_184583
atgtggaagcatctgggactgatacgtgtttttgtgacacgttttctggaggctaaaaaccgccagaaatttcttttcataagaaacacatggatcaaatcgttcagagaatactcccagcaacaaagtttcatcattcattcacgaagtgctctgggtgagtcgaaagatgaacctatatattctaactacgatgcacatcttgctggtgatgattctgatgcctataagagagcactggctgctgcacatattgttaaccctgcagtttctgctcttaaccgcaaaatttcgttgcttagatatatcgcagtcctagccacaaataagtttactgattaa

SEQ ID NO: 67806 - DNA, 669 bp, Glycine max
  Peptide Sequence Number=SeqID_184584
atgaggcaaaatcttacttttattggggaacttgctgtttactactatgtttttctacagaatgatatcaacattgatctgaagcttagacatgatattccacgacacgaagtcaaacaggtgatttgttcactttgtgggactgaacaagagctaaagttttctagtcctgattttaacttcttccaggttcagcaaaactgtataaattgtggtgtttgtatgggaaaatacttctgtggaacatgcaagctttttgatgatgatatatctaagcagcagtaccattgctgtggctgtggaatttgcaggctttgtataaaattcagattgattgattttgatatcttttcacttgatacagaactggaggaagcgaaaatttcttccattgctacaagtgtgtatttgtttgaatcaagaaacgatgtcactgttatgccatgtggacatacgatccataagagctgcctgaatgaaatgagagaacatttccagtatgcatgccctctctgctcaaagtcagtctgtgacatgtcaaaggtttgggagaaatttgaccttgagattgctgctacacgaatgcctgagcaatatcaaaataaaatggtcagtgttctttttcaacatgattatggatactacatgcttgttattcctgctaactaa

SEQ ID NO: 67807 - DNA, 420 bp, Glycine max
  Peptide Sequence Number=SeqID_184585
atgagtctcttcttgatctcgcaggttggacaacttgcaacacaactctctgagcatggaagtggatctttctcagtgaacacacaagttaacccaaaggaacaatgtaattcaattacaacaaggtgggggattgtggttgatttgaaggataatggtgagaaaaagaataaaggagttgaaaaagaaaaagtgaaaaatgttggacaacttgcaacacaactctctgagcatggaagtggatctttctcagtgaacacacaagttaaaaatgatgaagtggtgactagtgaaaaaatggaagagaaagtgagctatcattgcatggcctggggacaagcatatttttcaggaggaggaatagcagatgaggatgaagacatggaagatcctattgactattttattgtaggaaactga

SEQ ID NO: 67808 - DNA, 114 bp, Glycine max
  Peptide Sequence Number=SeqID_184586
atggtgaagggaaatgctggactgccaattaaggtgattttcttgacattatcctcaaacttcatgtctgtgttctgtgaagaggagctagaaagactccttatgcttcattga

SEQ ID NO: 67809 - DNA, 402 bp, Glycine max
  Peptide Sequence Number=SeqID_184587
atggattccaacttttttttttatcatacttattgggatgttgtgggaattaaggtttgggagatgattgttcatagttttcactcaagcaccattaatcctgccttagtggaaactcttattgttcctattcctaaggttgacaacccaatgagccttaaagattttaggcctataggtttgtgcaatgtcatcctcaaagccatctctaaaattctggaattcatgagattaactttatctgaatttgggtttccttcttataagaagaatctgatgatgaactgtgttatttctacttctcttgctttgagatggaagaatgagatgattgtctgcttttacctcagccaagacttctctggtgaagatggttcaaaaggaattagacatgttttgtaa

SEQ ID NO: 67810 - DNA, 675 bp, Glycine max
  Peptide Sequence Number=SeqID_184588
atggtatggattcgttttcctgggcataacttttacttctacgatgaaagtattttgctagcattgtcttttgcagtgggttctccagttaaggttgatgtgaaagctctagatgctcgaagaggcttgcatcgtatctgctcatcctacgggtgctatggtcacctcacacgtgactataaaacccaaccagcttcaaacaatgatttgaaacaacaacaacctcagccaggtcaagaggcgacgattaagaaagagaagaaccaggcaaaggatactttagttgtggggtctaaagtggtgttcactattcctgcgaagcctacgatgagttcccctcatgtgactacaacaaccaattccaaccacaagatggtggctaagaataagtgccatcgaaaagagccagatttccctatgtggcagttattgattaataccaagaatgaggcctcaacatctaaagctggttcgagttccatcaactccaatcagatttttcctactcccaagattcaggaagtgagtgggatagtttctacagtgaatttgcaacaactggccgggaatttcattgttgtagtgcatgatgataatgtccaacaaacaaccatggaagttagtaatgttctagtacctgataatatttgtaatgatgttacagatgacactatg

SEQ ID NO: 67811 - DNA, 180 bp, Glycine max
  Peptide Sequence Number=SeqID_184589
atgccttttgctttttggtttttcctggagtcaatgtcatcatcaataacagtgacaatggtgacaaagatgacaacaattgacaacgatgatagttacaatagtgatcatgatggtgacaacaacaatcacaaaagttatgacattgacggtagagataatgacgatggactacgttga

SEQ ID NO: 67812 - DNA, 1296 bp, Glycine max
  Peptide Sequence Number=SeqID_184590
atgttgagaaagaggaccaggtcaatccagaaggatcaacatcacactggtcaaatggcaatctctgataccaattctgagtctcatgctttggggggtaatggaaaaagcaactcaattttcaatgcccctcttctgtttgtgggtatgggtcataagggtttgttggattgtgattcagttaagagccccacttcaccactagattttggtttcctctcaaacctaagtaacccctttagaaccccaagttcattgtccaatgaggggccacataggagttgggactgtgccaaagtaggtctaagtattatagattctttggaagaatgttctaagttttcttggaaaattctccaggcttcagagagcaagaagactagtctttgtccccaaatgattactaaagcaccaaaatgtaaatcctatatggattctactcaggcatctaaatctttacctaaagatttttgtaagattccttgtactcagaatggttctattgtccctaagggcgagtccactgttctttttgagattggagagacccctctagaacatgagttctttgggaaagctgtgtctttttcattggattcttacagtccaacaaaatatctgtctggtttaactggttccaactttgatactgactctgagaattttgctttgaaacaaatgtgctctcctcctcattttattggaggaagccaaaataacacaaaaattttgctaccttctgagttaaattcaaatcctgtggctgcagtctattctaatgaatttattgagtctctatcagcttgtgagattgaaaactctgaggattacacctgtgtgatttctcatggtcctaatgcaaaaacaacccatattttctgtggctgcattttggaaactcatgctaatgattctgaaagacattataaggctgaagaggagggaaagggattgtcccttttcagtgttaacattttgcatactccaaaccagtatccttctcacgacttcttaagtgtctgctaccattgcaacaagaagttggaagagggaaaagatatttatatatatagaggtgaaaaatcattttgcagtttgagttgccgcgaaatagagatcatgatggatgagcaagagaaatccaattcatcaccagaaaactctccaaagtgtggatttggaggggaaccatggatgattgttttgtacatcactgcgtttgctatttgtttttcagctttcatggtctcggtggaagatggctctccacagctactagatttggtttccatataa

SEQ ID NO: 67813 - DNA, 645 bp, Glycine max
  Peptide Sequence Number=SeqID_184591
atgcgccgaaaaaggaagagtcgattgggaccaacatttggctggataggaggcaacgcaatcaattggtttcctcattggaaggaaggcaaggaaggagttcttttctcgtgtggggactaccctaatgttccattgatagggactaggggttgtattaattataatcccgcactcgccataagacagctagggtaccccatgagcggagcgccaacagaagaaagtctctcgcctttccttgtgagggatctaggcgcgcaaagtctcaaggtgatacaaagagtccataaggcgtggagaagtcgattgaggaaagacaaggagcttagaggcatccaaaatggcgtcatcggtggttatcgtggatggctaagagttcacacgcgagggttagattggctctccaaattgaaagttatcaatgaggagaacttcgaagctccggaggaagatgaagaagtccaagctctaaaattagagctagggaaggcaagactcgcgaaggagaagttcaaatcagccgctacacacatccggaaagagtataccgagttacaagaggaaaacgcggccactgcaagagcccttgaacaagaaaccaaaagggcccgcaaggaggaacatggccgagagaaattctga

SEQ ID NO: 67814 - DNA, 177 bp, Glycine max
  Peptide Sequence Number=SeqID_184592
atgccacttgtaggtggaggcagcattattggtgcaaaggtagatggagatgaggaagaaattgatattgctgtttggatctttgtgaaaaagcataaattgaactctatgaacagaaacaaaaaagaatgtagcgcggcaagcagagaagcacttaagctgaatttcgtccaatag

SEQ ID NO: 67815 - DNA, 420 bp, Glycine max
  Peptide Sequence Number=SeqID_184593
atggtcattctcaagttcaaggttccggactttgacaagtacaaggggactacttgccccaagaaccatctaaagatgtattgtcggaagatgggggcatacacaaaagatgaggaactgctgatacatttcttccaagaaagttttactgggttagctgttacctggtacactaacttggaaccttcccgagtccattcttggaaggacctaatggttgccttcgttaggcagtgtcagtacaattctgatatggctccggataggatgcaactacagaacatgtgcataaaggggcatgaatctttcaaagaatacacccaaaggtggagagatctagtagcccaagtggcacccccaatgatggaaagggagatgataaatcgtgatggtagacacattgtcagtattctactatga

SEQ ID NO: 67816 - DNA, 195 bp, Glycine max
  Peptide Sequence Number=SeqID_184594
atggatggcgaggagctaccctcgcccgtgaactccgatgtcgggcagaatcgtcttaggccgtggtcggaggtcgagacaaagttaagggcagagaccaatcaagaggctagggtcatgaccgacagatcatcgtcccttccctactctggacaagcggaaaacgccgccgcaaggcagcctagtatcctttaa

SEQ ID NO: 67817 - DNA, 684 bp, Glycine max
  Peptide Sequence Number=SeqID_184595
atggatcatgaggatgaggaggaagatgatgataataacaataccaccaccaacaacaatgatgatgataatgatgaccatgatggaattatcatggctgaagacatgaacattgatactgtcactccgacaatggaacatgttgacacactacttgacatgcatggggtagcctttgcctttaccatgaagaatccaaactttgtagggcctgctaaagagcttgaacaatggaatcatgtgaataaggataccaacagaatggaatatgttgctgtaagggccaaagctttatctgccaaggcaaatatggtgcaagacaaacccattcagaaaagaaatgataatcctcctaagcctagggctaacctagttgaaggagatgacataattgttatgctcatttctcaggccaatgttgtgaccgataagaatgtctatcttggtgattctaggactactccagttttagggaaagtaaaggttcttctcaagctcaaatatgggaaaatgttggctttgagtgatgtgctacatattcatatcatcagagtcaacttggtctctgtagcattgttgagaaaggttggggtgaaagtctcttttgaatcggacaaaatggttatgactaagaacaatgtgtttgtgggaaagggatattgtgattatggactctttgtatag

SEQ ID NO: 67818 - DNA, 267 bp, Glycine max
  Peptide Sequence Number=SeqID_184596
atggtgatgaatcaccaagtgaatgtgtttctgaagctcatgatggtgaggattggtaaggtaaaaaaggatgctccaaaggaaaaaatctggtgcaacagaaggtatggaatggaagatggagttttgtttggagacttgaggaaattggctagtgaggagggagcttctgaggctgatatttcaatggttctaaagaataattgtgccaatggagatgcaagggaaggatcaagaggacacaattcaattacactggtgaaatag

SEQ ID NO: 67819 - DNA, 693 bp, Glycine max
  Peptide Sequence Number=SeqID_184597
atggcggcaattttctcttcttcgctcttcgtttcttcgcctcttcccaaaccactttcttcctcctattcccgaatccataaagctccacaacttttcagggctcgctcctcgctccttcaggataaagaggaaaaagtgatcgtgcaggattcattcccctccaaaacctctcctcttcactccgctgataaatcaactagtggaaactcgattaacacctctgcgttcgagaaacggattatcaaggtcgaacaatcggtgaatatctttctcacggattccgtcataaagatacttgatactctgtaccatgatagacactatgcaaggttttttgtgcttgaaactattgccagggttccttactttgcctttatgtcagttctccatatgtatgagagttttggctggtggagacgggcagactatctgaaagtgcattttgctgagagctggaatgaaatgcatcatttgctcatcatggaagaactaggggggaatgcttggtggtttgaccgctttctcgctcaacatattgcaatattttattatattatgacagttttaatgtatagcagtaagcccaagaatggcatactgatcagcagttcagcgcaaacaaagaagaatgaagaaactgacatagttccttttgctaaattatcaacagttaatcatcatgttgactga

SEQ ID NO: 67820 - DNA, 948 bp, Glycine max
  Peptide Sequence Number=SeqID_184598
atggaagatgaaagagggagtctcctactaccaaagaacatggaggagcaccacccagcacatgatcgtggaacaacagaattaaggaacttcagatcatacctgagatgggtttacgtggatcactccaacgtgtgcaaagctggtctttcttggaccgtgttcttcactttagcctttgttgtgccaacactctcgcactttctacttgattgtcccacctgcgaccgtgatcatagtcgaccataccacatacccgtgcagatttctctctccgtcttcgctgccctctctttcatcagtatttcttcgtgggatcgtaggtatggcttcagaaagtttctcttccttgataaattaggtgatgaaagcctcaagattcaacgagggtactcagaacagatgcagggaaccatgaagcttatcatgcgttgggggcttccctgtttcatagcagaatgtgcctacaagatatggtggtacgtctcgggagcatcacaaataccacattatggtagtatatacgtgagcagcatcattctgtgcacattggacctatgttcttggctgtatagaacatccattttcttcctggtgtgtgttctctttcggcttatctgctacttgcaaatacttagactagatgagtttgctcgagtttttcagcgagaaactgaggtggggtcaatcttgttggagcacctaagaatgagaaggaatcttcggatcataagccatcgtttccgaggtttcattctagcttctctgcttttggtgacagcaagccaactcatttttctgcttatggttacaaaacctcatgctgatgttgatatcctcaaggctggagagcttgcggtaaagcttctttcctccatagataacacctctgctaacagattagtcatgtacttatttaacaacattatgtcactagcacataattaa

SEQ ID NO: 67821 - DNA, 216 bp, Glycine max
  Peptide Sequence Number=SeqID_184599
atggctattcccacaacgagcaggggaagtaatggtgaactcacagtcacagcagagtttggcgccagtgaacagagtcattttgatcactctgtgaaccacaagaggaacatgtccaaaggaggcagtagcattaagggcttctcttcgtcaagccataatacacaaaggactgcaaactcttcctttagtgaccactcggtaattttcatttag

SEQ ID NO: 67822 - DNA, 874 bp, Glycine max
  Peptide Sequence Number=SeqID_184600
atggatagaaggttgatgaatgcaagttgtataagccctgtatatgagaatgaggttgaacagttcttggaatttgccttggaaaaaactcaaccgaatgaggaagagaaatatttgtgtccttacatgcaaatgggtcccaaactgagcagtgattcgaagaagcctttgtatttggagtgcaagaagtcattgacattcttgttagtagtgttaagtttggtcaatgtgaaggccatatatgagtggagtgataaaagcttcacatcattgcttaaagtagtgcatgatgagtttgaagaaatgcataaatgccccaagtgtggggtatcacggtacaaagttaaggttgacgagtgtagtaatgatgaaagcacaaagaaagacccccaaaaaaggtgttatgataggagaaactatgatggaatgctcttccattcgattgattcttccttatggaagaaaattaatcatttgtatccagattttgggaaagaggcaagaaatattaggcttggagttgccattgatggaatgaatctctttggcaatttaagcactaaccacagttcatgtcctattttgctagtttttgagtgggttgaggacatcaataccatatttggaaagactcaaaagaagttgacaagtgagaaaaacatatggaagaagaggtcgatattctttgatcttccatactggtctgatctagatgttatacattgtatcgatgctatgcatgtggagaaaagtgtgcgtgatagtgtaatcaacatgcttcttaacattaaaggcaaaacaaagtatggcttgaatacccatcaagacttagttgaaatgggtatatgtgaccagttacatccaaggtttgatg

SEQ ID NO: 67823 - DNA, 369 bp, Glycine max
  Peptide Sequence Number=SeqID_184601
atgcataagctatgtgagctatatgttgatgttgatcctccccttttagtggaaattggaaaagtgtacaatttggggtcaaccatacaccgcaagaaaatagaggatgataatgtcagggtggtgatcgaagaggttatagattcaaatgctcaagttcttttccttattgatgaagtgcaaatagtgggacatgcccttaatcatttcattcaatggccgaaaagactcgttagggctattacaactaaggttgtggagcgatgtagcaaagatgttccacacaaaaagttggaacctgaacttgatccacttgagcgtttattgatggtagcaagtcaaaataaggatcctatacaactaccttga

SEQ ID NO: 67824 - DNA, 480 bp, Glycine max
  Peptide Sequence Number=SeqID_184602
atgtcttcaattagattcctatggatcctgatggtgtctttgaaggtatcatgcgtgttaagccaaccgcagaagctatcagcctacgatgttctgatggagtacgggttcctggtgggtcttcttcccaagggagccatagggtattcgcttaacagagacaacgacaagttcgtagtgtatttccaaggagcatgcagcttcgacatagagtcctacacactcaagtacaaatccaccatcacgggtgtcatctcaaagggcaggctctataatctcaaaggtgtcatcgccaaaatcttgctcctttggctcaacatcactaaggtctcttgtcaagggaacaatatttacttctctatcgaaatcacttccgttgattttggtgtcaagaatttcctcgaaagcccccagtgtggttgtggtttcgattgcaaaccactacccttaaacggtgacgtttccgtttcctcaatttaa

SEQ ID NO: 67825 - DNA, 162 bp, Glycine max
  Peptide Sequence Number=SeqID_184603
atggatttttccagttgtcaaacacaacctaggagttatgagtatggatattatgttatagaacatattctcaaaattgtcaccgacaatattaatactgcatggaaacataactttgataattcgggtccaatgcctgatgaggatattgctagcatttga

SEQ ID NO: 67826 - DNA, 201 bp, Glycine max
  Peptide Sequence Number=SeqID_184604
atgaagtttccgaaatctggaaagtgtgagtgtaactggtattacactcacttaagcagttttcaatactttcacttagcggaccactgcgctaagcgagccagagagaccgcgaggataagaccgcttagcgagaggagcatgcacttagctgataagggctcgcttagcgctcacattgccgcaaggaattcagcttag

SEQ ID NO: 67827 - DNA, 465 bp, Glycine max
  Peptide Sequence Number=SeqID_184605
atggatgaagttcaaagtcaaagtgaatcatctctatcaaaccatcaatctcatcaagagcctattatcgaagaaaacttcatggagatcgattcaagcataaatgatcctttaagtcctattaacaaaaaagaaacacaagctgagctaatcgtcttggggaagatgagttaccaaacctcacccaagctagcctctggctcgcctgggccaccaaatagcttcatggtgaagaaactagctcgcatggacgagctcactattgcagggttaagtttcagctcgcttgggtgtcctaagggtgttttaaagggttccaaggttcagaagtggagggaattgagagaactaagaaagaagaagaagaagaagaaagaagaggaaacaaagctgaggcattgccaaatcgcgactatgatcaatctctacatcgttccttgtttggtgtttttcgtgcgaccgtcg

SEQ ID NO: 67828 - DNA, 399 bp, Glycine max
  Peptide Sequence Number=SeqID_184606
atgtaccctcccttgttctctttgaacctagttgatgtaccctccactagaactgatccacaagagatgtaccctctcttgttctcagtcaaacccaaggaatgggaagaatcaaaagaattctcagactgtgtcgttttgaatcctttgacaagggagaaggcagacacaaaagaattcaggcggttagtcctttgttcttttggaaaagggagaagagagacacaaaaagaattcaggcgattagtccttggcgaattctttttggcaaagggagaagagaatgaaaagatgaataacacaagttttcaaggtttggaaaaccagaaaacttcagagaacttttggtacaaagaagaagaagaagttcaaagagattcaaggcttgtaaaggattga

SEQ ID NO: 67829 - DNA, 339 bp, Glycine max
  Peptide Sequence Number=SeqID_184607
atgtcagcgtcatccgaccaacactacgaaaaagtctcatttgctatccaaaagacacaaagcacgatagcaagcagtggctatggtcgtcccctgcacctttctcggagatgtccgcttcttcaagccgagactatgaaaaagttttatttgctatccataagactcaaaggacgatgtgagcgtctttcgaccgacactacgaaaaagtcgcatctgctatctgtaagacacaaagcacgattgcaagcagtgacaaacgtcgtcacctgcaccctatccagagatgtcagcgtcttccgaccgacacagcgaaaaagtctcattcggtatgcataa

SEQ ID NO: 67830 - DNA, 369 bp, Glycine max
  Peptide Sequence Number=SeqID_184608
atgcaggcggccaatcgcgccaaagaggcgaagaacggcgtgaacgtggcctacgcgatcccgaaagaaggggcgctgacctactttgacatgttcgccatgccggcggacgccaagaacaaagacgccgcctaccagttcctgaacttcctgatgaaacctgacgtgatggcgggcatcagcaactatgtctattacgccaatgcggtgaaggactccacgccgctggtgaacgctgaggtgcgcaataacccgaacgtctatccgccggccgatctgcgcgccaagctgttcacgcttaacgtacagtcgccgaagctggaccgtgtcattacccgcgcatggactaaagttaaaagcgggaagtga

SEQ ID NO: 67831 - DNA, 210 bp, Glycine max
  Peptide Sequence Number=SeqID_184609
atgagggagatgcgggcagccattacagccaacaattgtgccattggcatggtagagtatgcagcctatgttgcttggcaagccaactttggggaccagctagttgctgctcaaggaggtgggaataaggctgcacatgaggaagctgcacatgaagacaacaatagcaaaatggatgcagactcttccttagatgaggcgaggtcctag

SEQ ID NO: 67832 - DNA, 564 bp, Glycine max
  Peptide Sequence Number=SeqID_184610
atgtctatgttgggtgttgttgcttctcttgaatccccagttctcgtccaacaaccaccacctattgaaccaacgccactaccaccaccatcttcaccaccacaacctcaagttcaagaggaaattggtgatagctcctatcgttatagctctaaagttgaaccaagatttgagttgatgtgtgacaccaatgattatgcagtaggggtcatgttaggacaacaaaggaataagatttttcatgttatttactatgcaagcaagatgctcaatgaagcatatctcaactacataactacaaagaaggagatttttgcggtcgtttatgcactagaaaagttcaggtcctatcttgtagggttgaagattgtagtttacacggaccattcaactattcaattccttctcaccaaggtggttcgtgaggaatttccaaatgagaagttaatggtcatgaagaaagcaaaagcaaaagttcccttggtttgttgccatggtaacttcaaagccacatgggagccaccagaagacctcaagctagctgaaaagaaaaagttcttctaa

SEQ ID NO: 67833 - DNA, 342 bp, Glycine max
  Peptide Sequence Number=SeqID_184611
atggcagtagattatgtctcgaagttgatggaagcaatggcaactcctaccaatgatgcaaagacaatgataaaattcctccagaagaatatcttagctaggtttggagtgcctcaagtcctaattagtgatgggggaacacatttttttaatgcacaattggcaaaggtcttgcaacactatgagtccagcaagcttgatgatagcttgtgggcctaccatactacattcaagacaccaataggcatctcctcattttcagatggtgtatggaaaggcatgccaccttccggtgtagttggaacacaaagccttttgggctctcaagtttctaatttttga

SEQ ID NO: 67834 - DNA, 312 bp, Glycine max
  Peptide Sequence Number=SeqID_184612
atgaagtcaagtgacatgcggggttaccgtatggttacccgcacctttcgtcaaccaggggcaaacgagcctgttgacgcgcagagactaacatcgtcttttgcactttttgtcgtcctgacccgtaaagtcaggttttactctcgttgtccggaaacattcaagcccggtgacgtgcaagattcttctctgttgggcagggacgatcgagtgcaatggcgaagggaagtgtcgtggttgtccaactttttcgctttcaagacactgaagtttgttgacgcttctgatgccttttcttttctttctgaatga

SEQ ID NO: 67835 - DNA, 1530 bp, Glycine max
  Peptide Sequence Number=SeqID_184613
atggtgaatgcactcagtcataatcagagtcactttctggtggtgctgttgaactccaattccaattgcagagggagcaagagtggtaacaacaccgtcttccgaaaaccctttgtgaaattccgaaccctcaccactcaaatttgccactcctcttaccaccgattcgctgacacaaagcacacaacccttctggttgagacttaccatctccatgacagcctcagagctttacttgcaaagcttcagaaggaagattgcaaccctctccacgtactcgcagaagatggtgattggtccaaagaccatttttgggccgttgtcaggttccttaaaagtgcctcaaggttcacccaaatccttcaggtgtttgatatgtggaagaacattgagaaatcacgaattagtgagttcaactataacaagatcataggcttgttatgtgaaggaggaaagatggaagatgcattatctgcattgcgagatatgaaagttcaaggtatcaagccttctttggacacttacaatccaataattcatggattatccagagaaggtaagttcagtgatgctttacgttttattgatgagatgaaagaatctggcttagagctggattctgaaacctatgatggtttgcttggagcctatgggaaatttcaaatgtatgatgagatgggtgagtgtgtgaagaagatggagttggaaggatgttctcctgatcatatcacttataatatacttatccaagagtatgctcgtgctgggctactccagagaatggaaaagctttatcaaagaatggtttcaaaaagaatgcatgtacagtcttctactcttgtcgcaatgctggaggcttataccacatttgggatggttgaaaagatggaaaatttttatagaaaaatcttgagctcaaaaacatgtctagaggatgatttgattagaaaagtggctgaagtttatatcaagaactacatgttttctagattagaggacctggcactagatttatgtccagcatttggtgagagcaaccttgtatggtgtctccgtcttctttcttatgcatgtcctttgagtaaaaaaggtatggatatagttgttcgagaaatgcgagatgcaaaggttaattggaatgtcactgttgcaaatattatcatgttggcttatgtgaagatgaaagatttcaggcatttgaaaattttgctatctcagttgccaatctaccgggtgcagcctgatataatcactattggaattctatttgatgccactagaattggttttgatggtagtggagctttagaaacatggagaagaatgggctatctatacagagtagtagaaataaaaacagattctctggtccttacggcatttgggaaaggtcattttcttaaaagctgtgaagaagtgtactcttcccttcaccctgaggacagaaaaaggaaaacatggacttaccatgatctcattgctttattgtcaaaacatactggtaccatcgactgtataaaacctagatag

SEQ ID NO: 67836 - DNA, 2757 bp, Glycine max
  Peptide Sequence Number=SeqID_184614
atgtcgaagctcgcgaaggcgctgatcccgtcgccgtcggggtggacggggagcagcttctgccaatggacaggcgtgaagtgcagcgccaaccgcgtcaccataatcaaaatcgcttctcagtcactcggcggaactcttcctccggatctgaactcgctctcccaactcacctcgctctctctccagaacaacaagctctccggcgcattgccttcactcgccaacctctccatgctcgaaagcgttttccttgacggcaataacttcacctccatccccgatggttgcttccaggggctcaccagtttgcaaaccctcagcatggccgatagcgtcaaccttgccccatggacgattcccaccgagttgacggatagcaacaacctcgtgaaactcgacctcggaaacgcaaacctcatcggtaccttgcctgatgtattcgacaagtttgtgagtttgcaggagcttcgtctctcttacaacaacctcactgggggtttacccaagtcctttgggggatctgagattcagaatctgtggctcaacaatcagaacggcttcggattttcgggttccattgaggtgcttgcttccatgacccacttgtctcaggtgtggcttcagaagaaccagttcacgggtcccattccggatttgtcaaattgcaccactttgtttgacctgcagctgagagacaaccagttaaccggtgtggttccaccttctctcatgtccctttctagcttgcagaacgtttctctggacaacaatgcccttcagggtcctgttccttcgtttgagaaaggtgtgaagttcactctcgatgggatcaatagtttttgtctgaaagatgttggaccctgcgattctcgtatctccactttgcttgatattgctgcgggtttcgggtatccccttcagttggcgcgttcctggactgggaacgatccttgtgatgattggagttttgttgtgtgtgcaggggggaagattattacggtgaatttggcaaagcagaatttgacgggaaccatttcacctgcgtttgctaatttaactgatttgaggaacttgtttctcaatgataacaatttgggtggttcaataccagggagcttgactaatctggctcagcttgaggttcttaatgtgtctaataacaacttatctggtgatgttcccaagttccctaccaaggtgaagttcactactgcaggtaatgatttacttgggcgttctgatggtggtggtggtggcagtggaactactccgtcgaagggttccggtgatgcaccgagtggaagcccgagcacagggccaggtggatcttcactttcgcctgcttggatcgcaggtattgttctaattgctgtgttttttgttgccgtcgtggtgtttgtgttttgcaagtgtcatgctaaaaaccggcatgggaagtttggaagggttaataatccggaaaatgggaaaggagaggttaagattgatatgatgagcgttaccaattccaatggatatggtggtgttcccagtgagttgcaaagccagggcagtgagcgtagtgacgttcatgtttttgagggtgggaatgctactatttcaatccaggttcttcggcaagtaacggataatttcagtgagaagaacattttgggtaggggagggtttggggttgtttataaaggggaattgcatgatggaactcaaattgctgtaaagagaatggaatctgttgcaacagggagtaagggattgaatgagttccaagcagagattgcagttcttagtaaagttcggcacaggcatttggtggcccttttagggtattgcattaacggcaacgaaaggctcttggtgtacgagtatatgcctcaagggacattaacgcaacacctgtttgattggggtgaaaatggctgtgctcctttgacttggaaacaaagagtagcaatagctttggatgtagctcggggagtggaatacttgcacagcttggctcagcaaagcttcattcacagggacttaaagccctcaaacatattgttgggtgatgacatgagagccaaggttgcagattttggtttggttaaaaatgcgccagatgggaagtattctgttgagacacgcttggctggaacatttggatatcttgcacctgaatatgcagcaccgtccgtagctgctctcttctctgttggtactgttcagtttactgtagggttccctgatgcccagacatgtcctacgggaagagtgacgaccaaagtagatgtgtacgcatttggagtagttttgatggaactgattacgggtagaagggcattggacgatactgtgcctgatgaaaggtctcacttggtttcctggttccgtagggtactgattaacaaagagaacatcccaaaggcaattgatcaaactctcgatcccgatgaggaaaccatggagagtatatataaagtggctgagctagcaggccattgcactgctcgtgaaccataccaaaggcctgatatggggcatgctgtgaatgtcttgggtcctctggtagagcaatggaagcccaccacccatgaagaagaagaaggttatggcattgaccttcacatgagccttcctcaagctctgcgaagatggcaagccaatgaaggcacttccacaatgtttgacatgtccatctcacaaactcaatcaagtattcccgctaaaccttcaggatttgcagactcctttgattcaatggattgccgctga

SEQ ID NO: 67837 - DNA, 507 bp, Glycine max
  Peptide Sequence Number=SeqID_184615
atggaccgttgcatcgtcgcacccctcggctcctccccagtcgaggtccttaaattcttccgcttcgtcacatgctgcctccgctggctgttcgacaccgacgcggttgctgcgttgtgctccaacatgacagcgatcaacgcgtcgctaagtggacattgggtcaattggaacactcttactcgccccaagagtcggggtggtctgggaattcgcacagctagagaaatgaatgtgactcttctaggtaagaatgcttggtcgcttatgcatgatcaacacaaactatgggtgcaattgctttctcataaatattctaaggatatgtttgtccttaatggcgcctcttatacgtgggcctccattgtcaaagctgtcagcatccttcaacctggattccactttcgattgggtcgtggttccctctcagtttggtttgataaatgttcagtgcaaatatcgcgcgacgctctgattggtcaacaaggaggcatagtccctatataa

SEQ ID NO: 67838 - DNA, 2310 bp, Glycine max
  Peptide Sequence Number=SeqID_184616
atgtggatgttgacggcgaagaaattaactgtttggataaatttctctccgtgggaagaaattaagatgctaaaaccaatttattcagttagtttttacataagcttcaaatgcgttttagcttatgggaaatgctcaattcattttacaaagtgtttgtgcttggtctattctgaacattacctaaaaatcacactagatattattacctttaaaattcactaccttggggctcttctgaattgtgagaaggatgatgatctccatgaacacatcaaagacatgcatagtttaatttctgttattgttacgggccttcaattgccgagtgaggagattcgtggggaggttctctttgtcctttacaaactatctgttcttcagagtacatcagcagagggagatggaagtgatatgttgattcccttctgtccacagatcttgtacctgttggtcgatgttctcatgaagattcaaaatgatgatgttcgcttgaattgtgttgatactgacattaggacgctgtctctgaaagagatttgttatttgtctcacaggaaggtcgatttcctgctagtatctttttctccgagagtttgcatctatagcttatatcctaaccaccaaagtttcaggctcaatgaacgagtaattgatgtcaatcattccaaggctgagtataaggacccagcagtcaagatgtgccttcaggtactaggtattttatcaactgctgaggaaacctttaaactaagactcgttgttggaatttctactctgatcccaacattacggtatgtggctgaagttccttttcaccctgtccaatgtgagacactgaagctcatttatgaatgcatttctgagtgccctggatctgtatcaacttttcaactagaggaactggttcttgttttgataagaatgctttctgatggggagatgggtattattccagagacgtttataatggtctgttcagtctttgttgctcttataagatctccatcttgtaatggagctttagatctgttaaaatcaattgaggaagcaacgaaccatgccattttagcttgtctctctgtctctgaaaggaatataaaccaaattttgcaatgcttgtacctacttaaagaggcatttgcatatagtcatgatggaaactccattaactctagtaagctggagcttagaagcagcattctagatatatgcagaacccatttactgccaaggcttgtagtgggcatcaatgaaatggaagaggacattgcccttggattacttgaaacttttcatttgatactgcttctgcactctagtattaatgccgtggaatttgcagagagtctgatttcaatcggagataggatgaaaaatagaatatatttgttgctcagttcactcatggattctctcctgggaaatgattctggacaaccaattagagagactgctttgcacctgccttgcgatcctattgatttactctttttgcttgggcaaaggagtactaagagtttggatttgccttcttgtcaatctgctgttttgctgattatgtacactagttcgctatatgatgaaagaagctataacttagaagaggctgacataattataggaaacaataatcaaactataaatgtacagacacttgcggagttggtatcaactgaagataactatggagctagacttgtcgtgtgcctattagcacagctcttggaggaagaaggccaggaacatgacataatatgtgttctgaatgtcatggcaactatggttctcatctgtccagctgtttgtgaacaattatctttgcatggaattgcgacaaaaatcaggacttggtgttatttgaataacagcttgtcgacaagaacttacatgtccatcttgattttggtttttaacactttgagttcagtgcatcctgaaacactatctactgatcaaagttgggtagcggtaaccatgaagatgatggagtattcaattctatccaaagaggttgatatcttaagtgacgaaagtctcttcgttattggcattctttccttaattttgtatctttccaccaataaagcacttgaagagacttccaaggccattctttttaatacttgtataatctctatgggacctgctttggttgaccatgacgagggaacatgcacaggagaaactttaatatttgttcttttgattcattacttcgccgttaaaagggttcgtggattggcaaaacttctttgcttcaacgaatccatcggagccgctagccttcattggcatccgttgccatga

SEQ ID NO: 67839 - DNA, 1254 bp, Glycine max
  Peptide Sequence Number=SeqID_184617
atggcaagtactcctggagttagtgcctcccttttcgatgcattggctaaggcgagaggattctataaaggttgttctgagtacaacattaccgtagttgttaagcgagaggattctataaaggctttacgggctgttcattccagattttttctctcaagaaccacaatagcaatggccattattgggcctggcttaattggaagcacactgcttgaccagctatgcgatcaggctgcaaatctgaaagaagaatttaacattgatttgcgtgtaatgggcatcatgggttcaaagttaatgctccttgaagatgatacagaacttcgacaagaaaaaggagaagtggctaatttagaaaaaattgttcaacatgtgcatggaaatcatttcataccaaacactgtgttagtggactgcacagccgactccgtcattgcaagcaattacgaggactggctgcgcaaaggaatacatgtgatcacccccaataagaaggcaaattcaggaccactttatgagtatttgagattaagagctcttcagaggcaatcatacacacattacttctatgaagctactgttggggctggtcttccaattatcagcactttacgtggccttcttgagactggtgacagaatattgcaaattgaaggtatcttcagtgggactttgagttacatctttaataacttcaaagatggccgggtttttagtgaggtggtagctgaagcaagggatgcagggtataccgagcccgatccaagggatgacttgtctggaattgatgttgctagaaaggtgataattcttgcaagggaatcaggtttgaagctagagctttctgatattcccgttgaaaatcttgtgccagaaccattaagagaggaatatcttgatgatttcttgcagggtagttcatcagctgaagagtttatgcaacaactgccaaaatttgatgaggaattaacagagatattaaaagatgcagagagttctggagaagtcttgagatacgtgggagtggtggacgtgagtaatgaaaaaggagtggtagaactgagaagatacaagaaggatcatccctttgcacaattatctggatcagataatattattgcgttcacaacaagaaggtatagaaaccagcctctgatagttcgtggacctggagctggtgcccaagtcacagctggtggaatattcaacgacattttacgacttgccacttatcttggtgctccatcatag
